United States Patent 7,630,836 (POLYNUCLEOTIDES) - sequence listing, part 9

SEQ ID NO: 9992 - protein, 519 aa, Streptomyces avermitilis
VTTSQLIHDQKKPGAARREGHPGIALAVIAACQLMVVLDSTIVNIALPHIQDALKFSTTDLTWVVSAYTLTFGGLLLLGGRAGDILGRRRVFMTGILLFTLASFLGGLAQEPWQLLAARALQGVGGAIASPTSLALITTTFPEGPERNRAFGVFAAVSAGGGAIGLLAGGMLTEWLDWRWVLFVNVPIGVLIAVLAPMYISESERHPGRFDIAGALTSTAGMASLVYGFIRASEEGWRDSLTIGSFGAAVVLLLAFGFVEMRAKEPITPLKMFADRNRSGTYVIMLSLAAAMFGMFFFIVLFVQNVLDYSPIQAGLAFLPVTAAIVTGAGLSQRFLPVLGPKPFMVTGSSIVVLGLGWQTFINPDSSYLGGVLGPMLLFGFGMGLNFVTLTLTAVSGVAVHEAGAASGLLNATQQVGGSLGLSILTTVFGSASRDEAEKQLPKFLADGSAEQKAEFAKTHQLPAPWGNEVLAHGISTAFIPAVAMAVLALVTAGLVIRVRKSDLEALAGTAGAAGPAGG

SEQ ID NO: 9993 - protein, 606 aa, Streptomyces avermitilis
VSDRPSTPEPRDAQPEGSEASRGAGRASRSEQSEHSDRSERSEGREKRDRAEATSGAGASRDAAAGADKSSGSVSGGVATVERTGDEGGSSADDDSAEPDQDDDWAPPSPSPSPAPWLADVQAGPPAPVRTATLWAAFATGVLSMLFLGDGLAVNLLFVAIPAALAAHFAAQAAGRRTRAWTLVWGVGGLALLAVPALRDADWPSFLAVVTAVALGSLALHGGRTWPAVLLGPIGVFNSVFTGAVWGWRGLRERAGGGHGRVGPVLRALVVAAVLLVVFGALFAGADAAFADLLGDLVPDASVSGGPWHVLLFVLGVVWALAAAHTAAAPARWDRAEIPEGRERGRVEWALPLIVLAVLFAVFNAVQLAVLFGGYDAVLKKTGQTYAEYARQGFWQLLLVTLLTLLVIVVALRWAPRDGSRDRTLVRGVLGTLCALALVVVASAVRRMDMYVEAYGLTRLRISVLSAELWLGLVIVLIMAAGVWGARWLPRAVAASAAAGVLVFGFVSPDGLIAERNVQRYEETGKFDLDYARDLSADAVPALDELKEPLRSCALRAIARGLGEDGPWYATSWGQARARQILDDRPVSPDADWSVCDRFDTDLMYR

SEQ ID NO: 9994 - protein, 301 aa, Streptomyces avermitilis
MTADSSYDGRLERALSGLRGLAVGDALGSQFFVPAHYPLLKRRELPPGPWRWTDDTEMTCSVVAVLAAHHRIDQDALARSFAEHLDPDRGYGPAVARLLRQVGEGGDWRELASALFKGLGSWGSGAAARIAPLGAWYADDPEQATHQAEISAYPTHQHREAVVGTMAVAAAAALAADPTGPPSAEALLDGVIALVPKSAVGAGLRRARDMLDYGDAATVAAVLGCGRRTTAHDTVPFALWSAARALSDYEQAFWTTARVGGDVDTTCAIVGGVVAAGKAGAPPGEWVERTEKLPDWVPGVA

SEQ ID NO: 9995 - protein, 219 aa, Streptomyces avermitilis
MARPRRIVLVRHGESAGNADDTVYEREPDHALPLTEVGWRQAEERGKQLRELFGQEGVSVYVSPYRRTLETLRAFHLDPDLVRVREEPRLREQDWGNWQDRDDVRLQKAYRDAYGHFFYRFAQGESGADVYDRVGGFLESLFRSFEAPDHPPNVLIVTHGLAMRLFCMRWFHWSVAEFESLSNPGNAEMRMLVLGNDGKYSLDRPFERWRDPERYGATG

SEQ ID NO: 9996 - protein, 201 aa, Streptomyces avermitilis
VLVKWIRCTVVDRRGFERGQRRWAGLLGEPGFRGQGGGWSRGRPGVAHIFAFWESRAFYDSFMARSHDRLAATQSGTFKDSQVKLFDHRFDVKTGFEPRFTDADLVRVAHCRVHEERAEHFALMQEKVWNPAMAGSPGMTRGLFGEAPGHEFLILSMWQSAAEHGKYRAERVERLALRAQTEADVAALAGDIVDLEPAWIV

SEQ ID NO: 9997 - protein, 177 aa, Streptomyces avermitilis
VNGLNKGIRKVELAVKWDPSPPGDPATDLDIVAATFLAGDAYGKPAYVVHFDSRSPDGTIYLNRDSKDGKGFGWDEVMTLELNRLDSRYARVVVGVVIQQRDAHRTFVGVLNPGLRMREGYTVLAEDDFGGVLGSTAATVGEFVRDDSGEWTFHPGIHGYDSDPATFARVMGGRQDS

SEQ ID NO: 9998 - protein, 964 aa, Streptomyces avermitilis
MTETASGPARGSRAKGTKAKGLRIERIHTTPGVHPYDEVEWARRDVVMTNWRDGSVNFEQRGVEFPDFWSVNAVNIVTSKYFRGAVGTPQREVSLRQLIDRIVKTYRKAGEDYKYFASPADAEIFEHELAYALLHQIFSFNSPVWFNVGTPQPQQVSACFILAVDDSMESILDWYKEEGMIFKGGSGAGLNLSRIRSSKELLSSGGNASGPVSFMRGADASAGTIKSGGATRRAAKMVILDVDHPDIEDFIETKVKEEEKIRALRDAGFDMDLGGDDITSVQYQNANNSVRVNDTFMKAVEEGGKFGLTSRMTGEVIEEVDAKSLFRKMAEAAWACADPGIQYDDTINHWHTCPESGRINGSNPCSEYMHLDNTSCNLASLNLMKFLKDDGKGRQSFEVERFAKVVELVITAMDISICFADFPTQKIGENTRAFRQLGIGYANLGALLMATGHAYDSDGGRALAGAITSLMTGTSYKRSAELAAVVGPYDGYARNAQPHQRVMKQHSDANGVAVRVDDLDTPIWAAATEAWQDVLHLGEKNGFRNAQASVIAPTGTIGLAMSCDTTGLEPDLALVKFKKLVGGGSMQIVNGTVPQALRRLGYQEEQIEAIVAHIAENGNVIDAPGLKHEHYEVFDCAMGERSISAMGHVRMMAAIQPWISGALSKTVNLPETATVEDVEEVYFEAWKMGVKALAIYRDNCKVGQPLSAKKKETEKAEVTAKTEATIREAVEKVVEYRPVRKRLPKGRPGITTSFTVGGAEGYMTANSYPDDGLGEVFLKMSKQGSTLAGMMDAFSIAVSVGLQYGVPLETYVSKFTNMRFEPAGMTDDPDVRMAQSIVDYIFRRLALDFLPFETRSALGIHSAEERQRHLETGSYEPSDDVDMDVEGLAQSAPRAQELKAVATPKAEVAAAVPAPKQAHTSAELVEMQLGIQADAPLCFSCGTKMQRAGSCYICEGCGSTSGCS

SEQ ID NO: 9999 - protein, 187 aa, Streptomyces avermitilis
MHCPFCRHPDSRVVDSRTTDDGTSIRRRRQCPDCSRRFTTVETCSLMVVKRSGVTEPFSRTKVINGVRKACQGRPVTEDALAQLGQRVEEAVRATGSAELTTHDVGLAILGPLRELDLVAYLRFASVYRAFDSLEDFEAAIAELREEQRERPAVDDEDHEDAGAERQGTDRGSGGTVEVPVPATVAD

SEQ ID NO: 10000 - protein, 259 aa, Streptomyces avermitilis
VTTTADSATITAQDRSQGRLEPVHAMNEATSHEGPKRSLPGRPPGIRADSSGLTDRQRRVIEVIRDSVQRRGYPPSMREIGQAVGLSSTSSVAHQLMALERKGFLRRDPHRPRAYEVRGSDQSSSVQPTDTAGKPAASYVPLVGRIAAGGPILAEESVEDVFPLPRQLVGDGELFVLKVVGDSMIEAAICDGDWVTVRRQPVAENGDIVAAMLDGEATVKRFKREDGHVWLLPHNSAYQPIPGDEATILGKVVAVLRRV

SEQ ID NO: 10001 - protein, 677 aa, Streptomyces avermitilis
MTKPSLPELLHAAVTAVGGTERPGQVTMAEAVAEAIDDSSHLLVQAGTGTGKSLGYLVPALAHGERVIVATATLALQRQLVERDLPRTVDALHPLLRRRPEFAMLKGRSNYLCLHRLHEGVPQDEEEGLFDQFEAAAPTSKLGQDLLRLRDWSDETETGDRDDLTPGVSDRAWAQVSVSSRECLGATKCAYGAECFAEMSRERAKLAEVVVTNHALLAIDAIEGAPVLPQHEVLIVDEAHELVSRVTGVATGELTPGQVNRAVRRAAKLVNEKAADQLQTAAEGFERLMELALPGRLEEIPEDLGYALMALRDAARTVISAIGATRDKSVQDEDAVRKQALASVESVHDVAERITNGSEWDVVWYERHDRFGASLRVAPMSVSGLLREKLFADRSVVLTSATLKLGGDFNGVGASLGLAPEGTQGDDLPQWKGVDVGSPFDYPKQGILYVAKHLSRPARDGDRADMLDELTELIQAAGGRTLGLFSSMRAAQLAAEELRSRIPEFPILLQGEETLGELIKNFAADPETCLFGTLSLWQGVDVPGPSCQLVVMDKIPFPRPDDPLMSARQKAVEDAGGNGFMAVAATHAALLMAQGAGRLVRASGDRGVVAVLDQRLATARYGSYLKASLPDFWYTTDRNQVRRSLTAIDEAAKKTEVTEVTEVAEVTEEAAKESEGA

SEQ ID NO: 10002 - protein, 377 aa, Streptomyces avermitilis
VPPTDASTDAEPATSADPARIAVSARSAADSEDTLELRLPDELVALFAAEEAAGGEEAAGGGDGAVRGEEGTAGGEEDAVGGAEEPAGRKDAGPEAQGTATAAPSVPARAGATAASADSDGCSDAVDPAAPFAAASTVPSASRVPSAPSVTSAPSVTFATAPAPAPPSLGDTKALAGRQAVSVTRAADDLLGRVEDWGPTVTPAGTFQLAPVRPERDLPLLGRWMNDPAVAAFWKLAGDESVTEQHLRAQLGGDGRSVPCLGVLEGTPMSYWEIYRADLDSLARHYPARPHDTGIHLLIGGVADRGRGLGSTLLRAVADLVLDRRPSCARVVAEPDLRNTSSVSAFLGAGFRFSAEVDLPDKRAALMVRDRPLRDLL

SEQ ID NO: 10003 - protein, 686 aa, Streptomyces avermitilis
LNATPTSDGGSRTHERAGHDTQLPTVQGPQAVFASEAQAAPAPETQAPLAPATQVVFVPEVRTPVVQASESVPPPVGRARESERLRGTTADPLDHPEAQTAAQAAAVENLLRCWVRENGLVAPDDGTLRIPLLATGTALLVPVHHWSPTGWHRFGLPYLADAPQTAPPADAVTVVALLAREAAGSRRAPRPAHSAVDHCAVDHSADLVGRVADSVRRTAVFIDDRRARPADEPDLFLAAEQALLLGHPLHPTPKSREGLSEAEARLYSPELRGSFALHWLAVAPPVLATNSAWTERGRPVPAEQLTARLAGDGLPMPDGFAALPLHPWQIREIRHRPEAAALLDAGLIRDLGPHGPAWHPTSSVRTVHRTGAPAMLKLSLGLRITNSRRENLRKELHRGVEVHRLLRSGLGEQWQAAHPGFDIVRDPAWLAVDDQHGNAVPGLDVMIRHNPFAPTDDVSCVAGLVSPRPWPQPTEQPRPVMRSRLAEIIIRLAGRTGRPRGAVATEWFLRYLEQVVRPVLWLDSEAGIALEAHQQNTLLLLDPEGWPTGGRYRDNQGYYFRTSRRAELEARLPGIGEHSDTFVSDEVTDERFAYYLGINNVLGLIGAFGSQHLAEEQLLLAAFRRFLADVATGPARLRTPLPTRLLDSPVLRCKANLLTRLHGLDELVGPVDTQSVYVTIANPLHS

SEQ ID NO: 10004 - protein, 484 aa, Streptomyces avermitilis
VAVTKSAVASLKREAEGAHAAHEGILRRQSARESAARTYARALPIVPVRARGLTIEGADGRRYLDCLSGAGTLALGHNHPVVLEAIRKVLDSGAPLHVLDLATPVKDAFTTELFRTLPAGLADRARVQFCGPAGTDAVEAAFKLVRTATGRSGLLAFTGAYHGMTAGALEASGGATDGRVARLPYPQDYRCPFGIGGERGAELGARWTESLLDDVKSGVPLPAGMILEPVQGEGGVIPAPDAWLRRMRAITADRSIPLIADEVQTGVGRTGRFWAVEHSGVVPDVMVLSKAIGGSLPLAVVVYRDDLDVWQPGAHAGTFRGNQLAMAAGTATLAYVREHRLAERAQTLGARMLDQLRSLATEFPCVGEVRGRGLMIGVELVRAEEDREAVSPGSGDFASLDTAGAGPRPAAPELAAAVQRECLRRGLIVELGGRHASVVRLLPPLTISDEQATAVLDRLADAVEAVARGRAERSRGFQRSERAG

SEQ ID NO: 10005 - protein, 410 aa, Streptomyces avermitilis
MRPIRPLFAARRGRSARRRTSPVLGAVGLATALALTATACDSGDDTKASSESSPSASSAGDDKIKIPDDIRDKLKERGIDIDKWKNGAWKNWNRDDWLREANEYINPIIKGLWDPDRMRDADDPDKNKGVDDNDLTGDQGVTDPTPAPVNAKAVQAAYHDNAPTAGKVFFDAPEGTMVCSATVVEDPAHPGKSNLVWTAGHCVHAGKKGGWYRNIAFAPAYNNAGQTTAELQNATKQEIAPYGVWWGDWAQTSQQWIEKGGETGGDGASYDYAVIHVTPEKGGDGKSLEETVGSALPVDFNAPAVPKVSSITATGYPAAAPYDGQTLYQCQDKPGRLSIAKSDPTMYRIGCTMTGGSSGGGWVATGSDGKPALVSNTSIGPVTSGWLAGPRLGPVAKGVYDSVSKKFAGQ

SEQ ID NO: 10006 - protein, 397 aa, Streptomyces avermitilis
MRSVRPPFARRRGRNTVLAATVAALALTATACNGSDDKASDKPETTTSQAAGQDKARMPGDIAARLKEHGVDVDKWKNGGWKNWDKDKWLSEAKDFVNPVIKGLWKPERMKSAKDPDKTISAKDASADQGVSDPDPAPVDATAEKTPYHEHAAPVGKVFFDSPEGSMVCSGTVIKDVNHPGKSNLIWTAGHCVHAGGSGGWYRNIAFVPAYNDLGKSAAALSDATSSEVAPYGQWWADWASTSHQWISGGDETGGAGAPYDYAVLHVKPESGSKSLEETVGAALDVDFSAPSAQDVSAMGAWGYPAAPPYDGQQMFKCLDEPGRLSLSPSLPTMYRIGCTMTGGSSGGGWFRVVDGETKLVSNTSIGPSDNTWLAGPQLGKGAKALYDTMSEQYGGR

SEQ ID NO: 10007 - protein, 497 aa, Streptomyces avermitilis
MTSSSSPSQDAQSFAHTYPEGLRADALMEEDVAWSQEIDGDRDGDQFDRSERAALRRVAGLSTELEDVTEVEYRQLRLERVVLVGVWTSGTIQDSENSLAELAALAETAGALVLDGVVQRRDKPDAATYIGSGKANELRDIVLETGADTVICDGELSPGQLIHLEDVVKVKVIDRTALILDIFAQHAKSREGKAQVALAQMQYMLPRLRGWGQSLSRQMGGGKGGGLATRGPGETKIETDRRRIREKMAKMRREIADMKTGREIKRQERRRNKVPSVAIAGYTNAGKSSLLNRLTGAGVLVENALFATLDPTVRRAETPSGRLYTLADTVGFVRHLPHHLVEAFRSTMEEVGDSDLILHVVDGSHPVPEEQLAAVREVIRDVGATGVPEIVVINKADAADPLVLQRLMRNEKRSIAVSARTGQGIAELLALIDNELPRPSVEIEALVPYTHGKLVARAHTEGEVISEEHTPEGTLLKARVHEELAADLAPYVPAPLA

SEQ ID NO: 10008 - protein, 489 aa, Streptomyces avermitilis
MPHTPRPRTRRVTSAMLASAVSVCLIAASAPAPAVPLGIGDRLFPHLGNPGYDVASYDLAFTYPGANNKPLTAVTTINAQAKGRLDRINLDFAHGIVRSVDVNGEPASFTGAGEDLVVTPEAPVSRGTPMRITVRHTSDPVSAKGQDSGWVRTEDGLVMANQADAAHLVFPCNDHPSDKAIFTIHVTAPDGYTAVANGRPAGADREGRATTWTYRTEHPMATELAQVSIGRSSVLHRTGPRGLPVRDVVPTKDRKRLEPWLAKTPGQIAWMERRVGPYPFETYGLLVAQAQTGFELETQTLSLFERELFTRSTNPKWYVESIMVHELSHQWFGDSVSPRTWSDLWLNEGHATWYEALYAEETAHRPMEPRMKEAYEASDSWRATGGPPAAPKGPEPGQKISIFRPNVYDGAALALYALRQEIGRPVFERLERAWVALHQDGTASTADFEQLASALSGRDLSRFFKAWLYGEKTPPMPGHPDWKSGQATK

SEQ ID NO: 10009 - protein, 720 aa, Streptomyces avermitilis
MSAEATNPATPGPVTPGAYRRKGRPRIDLRRLGRAALLGPAARDRLPDAIGHVAEAHRAHHPDADLEPLRRAYVLAESSHRGQMRKSGEPYITHPLAVTLILAELGAETTTLTASLLHDTVEDTEVTLDQVRAEFGEEVCYLVDGVTKLEKVDYGAAAEPETFRKMLVATGNDVRVMSIKLADRLHNMRTLGVMRKEKQERIAKVTRDVLIPLAERLGVQALKTELEDLVFAILHPEEYERTRELIVGNAANGGDPLTEIVENVRTVLREAGLQAEVLIRPRHFVSVHRVSRKRGRMRGSDFGRLLVLVNEDADCYGVLGELHTCLTPVVSEFKDFIAVPKFNLYQSLHTAVAREDGEVAEVLIRTHQMHKVAEAGVIALGNPYTPGADDPAEGERADPTRPGWLSRLLDWQEAAPDTDTFWSTLREDLAQDKEITVFRPDGGALGLPEGASCVDAAYAQYGEDAHACIGARVNGRLATLSTVLKDGDTVQLLMGQDPASEPSREWLEHAHTPAARIAIQRWLAAHPSPSPSEEPADGPATDGFAERFAADPAAEGAARFAPEGPAARPAANAVVDQPGASVRLAGCCTPVPPDEITGFAVRGGVVTVHRVECAGVARMKSVGRAEVGVRWGDTSECRVTLVAESFGRPHLLADLTEAIAVEGVAIVSATVEPPSRQRVRHTYTLQLPDAAHLPALMRAMRNVPGVFDVSRAQHQAAAAQ

SEQ ID NO: 10010 - protein, 289 aa, Streptomyces avermitilis
MSTRIAFLKGHGTENDFVIVPDPENAIDLPPAAVAALCDRRAGIGGDGVLHVVRSAAHPEAREMAAEAEWFMDYRNGDGSVAEMCGNGVRVFARYLQRAGHVTEGDLAVATRGGVKTVHIAKDGDVTVGMGKAFLPEGDVTVSVGERSWPARNVNMGNPHAVAFVDDLAHAGDLLAPPPFSPPTAYPDGVNVEFVIDRAPGHVAMRVHERGSGETRSCGTGACAVAVAAARRDGADPAVTGTPATYTVDLPGGTLVITERPDGEIEMTGPAVIVAEGEIDAEWLENAAL

SEQ ID NO: 10011 - protein, 177 aa, Streptomyces avermitilis
VAMEAGPRDTAQGAEQDTPERGDELGADGYRLEPDGVLLSPDGPDEQPPGGVTADGPEPEEMSPGPEVEVELRPQRRLRIWQLAPIVALAAVGSLMFAFPLAFEFGDGGAVVAMLGLLICSCAAGWGMMAARRVGYTWPGLPQRGSGRRVDWRVVIAYAVVVAAVVVLAVWRVARLR

SEQ ID NO: 10012 - protein, 312 aa, Streptomyces avermitilis
VSSAPPAPRVIAVVGPTAAGKSDLGVFLAQRLDGEVVNADSMQLYRGMDIGTAKLTPEERGGIPHHLLDIWDVTVAASVAEYQRLARARIDALLAEGRWPILVGGSGLYVRGAVDNLEFPGTDPEVRARLEEELALRGPGALHARLAAADPEAGHAILSSNGRRIVRALEVIEITGRPFTANLPGHDSVYDTVQIGVDVARPELDERIARRVDRMWEAGLVDEVRALEAQGLREGRTASRALGYQQVLAALAGECTEDEARAETVRATKRFARRQDSWFRRDPRVHWLSGAAADLTELPQLALMLVERPVTA

SEQ ID NO: 10013 - protein, 121 aa, Streptomyces avermitilis
MGVFARLLRRSKATKEASTAEAEAVKVTAVKVTAEPVAKVTEEAKGSEADAKADNKAGAKVAEKVEVVAESEVEGEATKAEPEPEASTEDTAQSVGESVEIPKQQSAEEAADSDTGEDART

SEQ ID NO: 10014 - protein, 91 aa, Streptomyces avermitilis
MSLLENLKAKLAPAKDKVSDLAQQHGDKVERGLDKAAKMVDEKTKGKYSDKIHTGTGKAKGAMDRLAHKDGGSPGGGATPPHDAPGPPTAF

SEQ ID NO: 10015 - protein, 239 aa, Streptomyces avermitilis
MLVAAAVCPCPPLLVPEVATGAAPELDAARAACTDALGVLAAARPDRLVVLGPAEQSGRGPHPEGTRGSFRGFGVDLDVRLGGDRAAPAASHGELPPSLAVAAWLLERTGWSDAAVEGLGVGETLAAERCIEAGEGLVARVERTALLVMGDASACRTLKAPGYLDERAAGFDAEVARALGAADVTALKGLDAELAYELKASGRAPWQVLAGAAEGAGLGGSLLYDDAPYGVGYLVAAWS

SEQ ID NO: 10016 - protein, 508 aa, Streptomyces avermitilis
MSSIDRSQPVGVKTYEVRTYGCQMNVHDSERLSGLLEDAGYVRAPDGSDGDADVVVFNTCAVRENADNRLYGNLGRLAPMKTKRPGMQIAVGGCLAQKDRDTIVTKAPWVDVVFGTHNIGKLPVLLERARVQEEAQVEIAESLEAFPSTLPTRRESAYAAWVSISVGCNNTCTFCIVPALRGKEKDRRTGDILAEIEALVGEGVSEITLLGQNVNAYGSDIGDREAFSKLLRACGQIDGLERVRFTSPHPRDFTDDVIAAMAETPNVMPQLHMPMQSGSDTVLKAMRRSYRQDRYLGIIEKVRAAIPHAAITTDIIVGFPGETEEDFEQTMHAVREARFTQAFTFQYSKRPGTPAATMENQIPKEVVQARYERLVALQEEISWDENKKQVGRTLELMVAEGEGRKDGATHRLSGRAPDNRLVHFTKPDEEVRPGDVVTVEVTYAAPHHLLAEGPVLNVRRTRAGDAWEKRHIEKTAEAAKPAGVMLGLPKIGAPEPLPVATGSGCGCD

SEQ ID NO: 10017 - protein, 158 aa, Streptomyces avermitilis
MDSAPLSHASPAAPAAPAAPAAPAAPASPASLVRAFHLAFGLDARTVPTEVSPELAAHRGELLAEEAAEVAEVSVTGPLDRLAHELADVVYVAYGTALVHGIDLDEVIAEVHRANMTKLGPDGRAVRRADGKVLKGDHYRAPDVGAILRRQGWGPAAV

SEQ ID NO: 10018 - protein, 332 aa, Streptomyces avermitilis
MFQALPRLRRRHALLGSTAAFVVFGLLLWWLLPLGEESPGGTVTFSTGTPTGVYQKYGKLLKQAIAKDMPKLDVTLLDSDGSQENVRKVATGNADFTIAAADAVATYELARKPGADRLRGCARLYDDYVHLVVPRSSSVQSVADLKGRKVAVGPSGSGVRLIAEHVLKAAGLDAEKDITPSSEGIAAMPGLLEQHKIDAFFWSGGLTTSAITELSKGFDIRLVPIGSTLVKRLHEQGDSSSYYRAAVMPADAYPLAQQGSSVQTIAVANLLMTREDMDATLTEQLTRTVIDSRDRIGSQVHAAQLVDLRTAIYTDPLALHEGASRYYRSVKP

SEQ ID NO: 10019 - protein, 468 aa, Streptomyces avermitilis
VRTRLLPLLIVLMAAVLLALGFPLAVSIAAAQQQRVVVDRIDDTARFAALAQFVTDRPTGSRVAVTDERGETLSKELAMYHDVYGIQAGVFYLDDAPMAHAPQNWYLPERGEGRDAFDEARLGRRSHDPEQVWPWEHKRLVVASPVIRDGDVIAVVVTDSPTGQMRSKTQHGWLLIGAGEIAAMLLAVGAALRLTGWVLRPVRVLDATTHDIATGRLKSRVAAAGGPPELRRLARSFNEMADNVEDVLEQQRAFVADASHQLRNPLSALLLRIELLALELPEGNEEIASVQTEGKRLAQVLDDLLDLALAEHAEADLRLTDIGELTAERVAAWGPVAAANGVRLAGTCPATTAWADPITLSSALDAVIDNALKFTPEGESVEVEVTSNGAVSSVVVTDGGPGLGDEELARVGDRFWRSAGHQNIKGSGLGLSISRALLAAGGGTISYAHHEPHGLKVTVTVPRTVPTA

SEQ ID NO: 10020 - protein, 228 aa, Streptomyces avermitilis
MRLLLVEDDNHVAAALSAVLARHGFAVTHARNGEEALQALVPESSGFGVVLLDLGLPDQDGYEVCGKIRKRTSTPVIMVTARSDVRSRIHGLNLGADDYVVKPYDTGELLARIHAVSRRNAHEEGGAAAETALRLGSVHIELPTRQVSVDGSVVQLTRKEFDLLALLAQRPGVVFRREQIISEVWRTSWEGTGRTLEVHVASLRSKLRMPALIETVRGVGYRLVAPAA

SEQ ID NO: 10021 - protein, 258 aa, Streptomyces avermitilis
MTEVSVAKDAVAATDELVVLKSVNKHFGALHVLQDIDLTITRGEVVVVIGPSGSGKSTLCRTINRLETIDSGDIRIDGKALPQEGKELARLRADVGMVFQSFNLFAHKTVLENVMLGQVKVRKADRKKAEEKARGLLDRVGVGTQSDKYPAQLSGGQQQRVAIARALAMDPKVMLFDEPTSALDPEMINEVLEVMQQLARDGMTMVVVTHEMGFARSAANRVVFMADGRIVEEAVPDQFFSNPRSDRAKDFLSKILHH

SEQ ID NO: 10022 - protein, 277 aa, Streptomyces avermitilis
MKLRKVTAASAAVLALAVTATACGSDDKDSSSSGGDKKITIGIKFDQPGIGQKTPQGYSGFDVDVATYIAKQLGYKADQIEWKESKSADRETMLQRGDVKFIAASYSITPERQEKVDFAGPYLLAHQDVLVRADDNSIKSPSDLNSKKLCSVTGSTSAQNVKDKLAPKANLLKYPTYSACLTGLQNKAIDGLTTDDSILAGYAAQASFKGKFKLAGFKMTNENYGIGVKKGSDLKAKINTALEKMVSDGAWEKAVTANFGPANYKNEPAPKIGDIKK

SEQ ID NO: 10023 - protein, 221 aa, Streptomyces avermitilis
VFDFLEGYDLLGAFWVTVKLTVFAGVGSLIWGTLLAAMRVGPVPLMRGFGTAYVNIVRNIPLTVIILFTSLGLSQTLGVNLGADTFETINFRLSVLGLIAYTSAFVCEALRSGINTVPVGQAEAARAIGLNFTQVLTLIVLPQAFRSVVGPLTNVLIALTKNTTVAAAIGVAEAAALMKEMIENEAQLILISAVFAFGFVCLTLPTGLILGWVSKKVAVKR

SEQ ID NO: 10024 - protein, 301 aa, Streptomyces avermitilis
MSSVLYDAQGPRAKRRNVLFTVVFLVAAAAVLWWVITSLNDKDQLAWEKWKPFFSSTEAWTTYLWPGLQNTLKAAALSMVIAMPLGAVLGIARLSDHRWVRVPVSIVVEFFRAIPVLILMIFGVALYSEYTNVSSDDRPLYAVVTGLVLYNASVLAEIVRAGILSLPKGQSEAAMAIGLRKNQVMRFILLPQAVTVMLPAIVSQLVVIVKDTALGGAVLTFSELLASVGPMSGYYGANTIASFTIVALIYIAINFSLTTFASWLEGRLRRGKKSTGAVLPPAAVGGAESTGAGGAGGGIGL

SEQ ID NO: 10025 - protein, 621 aa, Streptomyces avermitilis
VDPVIIVGAGPVGLALALALARQEVPSVVLDEGPGNDEQRPARTVVLREDTAALMERLTGLPLDEAGFRWAGWRSMRRKQVMSEITFDADGSGGSVYGSAGVAYGSGGAGYGSAGAAGVSDRSMGGSRRPVDDSRGAVGGSKGSAGDNRGPVGGPRGPVVGSGRTAEGAEGPAPLHIAQHVLTGALRAAIATERLVKVAVRSRLDAIEQEASGLTAHTRDPKGTWWRGSYLVGCDGPRSTVRKLLDIRFPGRTAVERHAVAALHAELPWPGEALLHRMPPWRTSGPSAGEVTARPLPDGVWRLDWLLPPGKDLVTPELLVTRVRETLAGWSGGPTPPYELLDTGVHTVHHRLARRWRAGRVFLAGDAAHLLGALGTQGLDEGLRDADNLAWKLALAWHHGPHEPLLDSYQAERRAVVAARLRAADQALPVVRGGGGLRAYVPGSARGHDALLTDGHLGRGALGTPGSYTDSPLAPERADSTAPVDTAPGAPVVDVRVTAEDGSFVRLRDRLGRGALLVVLIAPGTGVWERKHWVSAGIMPRLAAAVTALPHPAELLVAEGYPGAAAHTVLLVRPDGHLVTALSGVRPADLYAAAEATLGGPAGSGSKAGTETRAERAATGG

SEQ ID NO: 10026 - protein, 181 aa, Streptomyces avermitilis
VSVSPSTPAPASVSVSAQVPTQAELLDFVRRSAADAELIASLPLDPEGRTWVRLEGPGGSEAWLIGWPPGTGTGWHDHADSVGAFTTAAGELKENSLAVRLPSDGWRTLELTEGVDRERRLPAGKGRSFGNHHVHEVLNDSTEEHAVSVHAYYPPLPQIRRYSRTGQVLRLEHVERPEDWQ

SEQ ID NO: 10027 - protein, 133 aa, Streptomyces avermitilis
VSSSHERPIGIDELLEQVRKGLDRVEAADAYEAALAGDALLVDIRYAALRDRDGLIPGALVVERNELEWRLDPQGSHRAAEATGHDLRVVVVCNEGYASSLAAASLRQLGLHRATDLVGGFQAWKSAGFPVTA

SEQ ID NO: 10028 - protein, 315 aa, Streptomyces avermitilis
MTRRTDWAEYAYPVAPQGRGSGADGRSVGGGDGAYDEGEPYDDEASGAHGVYGAHGVSGTTREAYGAGGTYGGDADGDGSQSRGSRSRRGGRHGDGGFRGDRGEGASRDGGGAQGGRGRGRRRGFGEPAGDPQDGGAPASSRAEKGEPPGDPAERARAICLRLLTGTPRTRKQLADALRKREIPEDVADEVLSRFEEVGLINDSAFADAWVESRHHGRGLARRALARELRTKGVDSTLIDEAVGQLDSEQEEATARELVARKLRSTRGLDRDKRLRRLAGMLARKGYSEGMALRVVRQALEEEGEDTEGLGDEGF

SEQ ID NO: 10029 - protein, 377 aa, Streptomyces avermitilis
MAGTDREKALDAALAQIERQFGKGAVMRLGERPNEPIEVIPTGSTALDVALGVGGLPRGRVVEVYGPESSGKTTLTLHAVANAQKAGGQVAFVDAEHALDPEYAKKLGVDIDNLILSQPDNGEQALEIVDMLVRSGALDLIVIDSVAALVPRAEIEGEMGDSHVGLQARLMSQALRKITSALNQSKTTAIFINQLREKIGVMFGSPETTTGGRALKFYASVRLDIRRIETLKDGTDAVGNRTRVKVVKNKVAPPFKQAEFDILYGQGISREGGLIDMGVENGFVRKAGAWYTYEGDQLGQGKENARNFLKDNPDLANEIEKKIKEKLGVGVRPEEPTAEPGADAAVTSAAAATDDTAKTVSAPAAKTTKSKAAAAKS

SEQ ID NO: 10030 - protein, 343 aa, Streptomyces avermitilis
LTRTAVHRDRPDAGRWPRGVRRARRRRRTPPRSGYGGGARSLLLRESPGLLLRAYVHCLRPYDDDVGPAHEAWAMENLVSPAVPGAASAARKGPRRRFTTRPAERFCYATGALLVLSGLAHLVVFAVDGGPWDGPVSWRKPVTFGLSFGLTLVAVTWVTSYLRVGARLRTALLVVFAADCVVEVGGITLQAWRRAPSHLNMETGFDTLVSMTLAVGGGVLVVVLSVFAAAAFRHRPEGPVGMPLALRSGFAILVVALLSGAAMIARGVVLTRTGHQEAAYHSTAPLKPLHGVSLHAVLVLPALASLLSRTPWSDPRKQRLMYVAVGAYAVAVLAAGVWAVLTY

SEQ ID NO: 10031 - protein, 383 aa, Streptomyces avermitilis
MPRWLPRAMVLALALIAGFQFGSWAFHQLTGLLINILIAFFLALAIEPAVSWMAGYGMRRGLATFLVFLGAMIVTAGFVTLLGSMLAGQIIKMVEGFPDYLDSVISWVNTTFHTDLRRVDIQDSLVHSDWLRRYVQNSATGVLDVSAQVLGGLFQLLTIALFSFYFAADGPRLRRALCSVLPPARQAEVLRAWEIAVDKTGGYLYSRGLMALISGIAHYILLQSLGIPYAPVLAVWVGLVSQFIPTIGTYLAGALPMLIAFTVNPWYALWVLIFVVVYQQFENYMLQPKLTSKTVDIHPAVAFGSVIAGTALLGAVGALIAIPAVATLQAFLGAYVKRYDVTDDPRVHGHRRRGPGTGSGGALGRVRRLWGRSRAAESEDGSR

SEQ ID NO: 10032 - protein, 64 aa, Streptomyces avermitilis
MRLTVFWQRMADHFGAGYAETFARDHVMSELGGRTVDKALEAGWEAKDVWRAVCTAMNVPQENR

SEQ ID NO: 10033 - protein, 314 aa, Streptomyces avermitilis
MAETGASPLPPTPSARSPLSRAEHFVWLTARVLEQRRFAYHFLGGTADAVETALAAYRNEDDGYGHALEPDLRGPVSQPLHAGHALRVLDSIGRCGGQRVERVCRYLTSVSTLDGALPAIRPSQRGYPTAPFVPVVDDPPSDLLATGPVVGLLHRNEVWHAWLFRATDFCWQAVESLRKSHPYEVEAAVAFLDSAPDRPRAEAAADRLGRMVREQRLAVLDPERLDASPVSPGYGPGEHHFPYDFARTPGSLARAWFTDEEMARSLDFLAAEQRKDGGWPIRWRQWAPGTALECRPMVTIEALRTLKAYGRAIA

SEQ ID NO: 10034 - protein, 102 aa, Streptomyces avermitilis
LNIWIAIAATAVGCYAVKLIGLLVPAGVLERPLVRRLAALLPVALLAALTAQQTFADGRTLVLDAKAAGLAAAAVALVLRAPFLLVVAAAVVVTAGVRAMAG

SEQ ID NO: 10035 - protein, 302 aa, Streptomyces avermitilis
VARTAARARARTWTRVCEGTAAGAYGHGRGSVQERTRPTGAPAATVRGVAEQTALADIRSEDGGKPDAAVVRDALGVGVAVGLSGFAFGVTSAGSGLSLLQTCALSLLVFTGASQFALVGALAAGGNPLAAAAGAFFLGVRNAFYGLRLSQLLALPRAVRPFAAQWVIDETTAVALAQPTRRSVRIGFTVTGLSLYVLWNLTTLIGAVGAQAIGDTDAWGLDAAGPAVFLALLAPMLKTAAERAVAGIAVLLGLGLLPVLPAGVPVLVAALAAPTVLYVEGRRMRTSACDATSAHDTRREAR

SEQ ID NO: 10036 - protein, 298 aa, Streptomyces avermitilis
MAGTGKERARHWRYAELPGVDLLRASYIEKIFVRHTHENFVIAAIAEGVEVFHHGGADQYAGPGALALVNPDTPHTGRAGVPEGWRYGAVYPSPELVAEIAAETTSIRGTPGFTSPVLDDAYAAGLVHQVLRAADEGNALAADTLLRVAVTRLLRLNGGPMPQREVRSAGAGIAVRARTVLEERMAEPPTLERLAGDLGASPFALLRAFREAYGMPPHTWLTDARVRRARRLLDAGTAPAEVAVAVGFTDQPHLNRHFTRIVGVPPGAYQRERGSDARPVLGGEDGRTGARKNMDTGV

SEQ ID NO: 10037 - protein, 1658 aa, Streptomyces avermitilis
MVSSTHRALDGFSPATRGWFTGAFPAPTAAQAGAWRAIGEGSDVLVVAPTGSGKTLAAFLAALDQLASAPPPADPRKRCRVLYVSPLKALAVDVERNLRSPLTGIRQEAVRLGMPEPEVKVGIRSGDTPPAERRALSTRPPDILITTPESLFLMLTSATRDALTGVETVILDEVHAVAGTKRGAHLALSLERLDELLPKPARRIGLSATVRPVDEVARYLSPRRKVEIVQPKSGKEFDLSVVVPVEDLGELGGSPVADGSEGAERPSIWPHVEERIADLVQAHRSTIVFANSRRLAERLCNRLNEIAYERATGEPLDEHHAPAELMGGSGAAQGAPAVIARAHHGSVSKEQRALVEEDLKAGRLPAVVATSSLELGIDMGAVDLVVQVESPPSVASGLQRVGRAGHQVGAVSTGVVFPKYRGDLVQAAVVTERMRTGSIESLKVPANPLDVLAQQLVAMVALDTWQVDDLLTTVRRAAPFASLPESAFTAVLDMLAGRYPSDAFAELRPRVVWDRVAGTVTGRPGAQRLAVTSGGTIPDRGLFGVFLAGADPKKGGGRVGELDEEMVYESRVGDVFTLGTSSWRIEDITRDRVLVSPAPGVPGRLPFWKGDQLGRPLELGRALGAFLREVGALPKDDARLRLLAAGLDAWAADNVLSYLAEQREACGHVPDDRTIVVERFRDELGDWRVVVHSPFGAQVHAPWALALGARLAERYGMDAQVMHADDGIVLRLPDADLMGLDLLDQEPLKAGAPLDTAGAEQAPIGAADVAFDKGEVNQIVTDQVGGSALFASRFRECAARALLLPRRSPGKRTPLWQQRQRAAQLLQVASEFGSFPIVLEAVRECLQDVFDVPGLTELMGDIESRKVRLVEVTTPEPSPFARSLLFGYVAQFLYEGDSPLAERRAAALSLDSRLLAELLGQAELRELLDADVLTELERELQWLTEDRRVKDTEGVADRLRLLGPLTDAELAERGAEPQWAQELAGARRAIKVRIAGTDHWAAIEDAGRLRDALGTALPVGVPEAFTEPVKDPLGDLLARYARTHGPFTSTAAAARFGLGVAVTEGALQRLAAAGRVVQGEFHPAGIGQEWCDATVLRRLRRRSLAALRHELEPVPPAALAQFLPQWQHVGGGHGLRGVDGLVRAIEQLQGASVPASALEKLVLPSRVSNYTPAMLDELTAAGEVVWAGAGSLPGKDGWVSLYMADAAPLLLPAPHPLEPTALHQSVLDALSGGYGLFFRQITDQVRATTHPDATDPQLADVIWDLAWTGRLTNDTLAPMRSLLGSGRTAGSTAHRAKRAVPRGRYGSLTATARPQSRTGPPTVAGRWSLLPALEPDTTVRAHALARTLLDRHGVVTRGAVAAEGVEGGFSATYRVLSVFEESGQARRGYVVEGLGAAQFAMDGAVDRLRAAANARERDETLPGPDRSDGFAGGAPHRLDAARPFAPAAAPGSGDGFLDRFDPQFDSNLGAFADLSDTADAQPVSSHPGTQAAPGLPEVQPGPGLPRAQAGPRSPYGQGLPPNRTRSAGASRAVVLAAADPANAYGAALSWPEPPTGAGHKPGRKAGSLVVLVDGELALYMERGGKTLLAWPSDPDAKTTDDPRLLAAAEALAASARAGSLGTVTVERVNGASALTSPFGTLLEGAGFIATPRGLRLRA

SEQ ID NO: 10038 - protein, 280 aa, Streptomyces avermitilis
MPEGDTVYQAARRLHSALAGKVLTRSDLRVPKFATADLTGRTVLDVTPRGKHLLTRIEGGLTLHSHLRMDGSWKVYAPGQRWSGGPAHQIRAIFGTADRTSVGYRLPVLELLRTADEHRAVGHLGPDLLGPDWDPDRARENLLRDPARPLGEALLDQRNLAGIGNVYKSELCFLLRATPWLPVGDLPAEHLAQLPALAKKLLETNRDRPARSTTGRREQRLFVYGRAPRPCLRCGTPVRVADQGDGSRERPTYWCPACQPGPTPAPGAHARRPSRPRITN

SEQ ID NO: 10039 - protein, 254 aa, Streptomyces avermitilis
MPVKAYDLTGRTAFVTGAASGIGRASAVLLAQAGATVHCADRDEQGLHETETLIKGGGGTARTHHLDVTDRARLHQAVAGCDRLDIMAAVAGIMHSSPVLETRDEDLDRVLNVNFKGVLYACQEAARRMIADGTRGSIVTMASGAVDTGGPGLLCYGAAKAAVVQLTKTLATEVGRHGIRVNAVAPGWVRTAMTDRHDGAAQAHTEAFMARLSPLGRVGEPDDIAHAVLHLASDASPFTTGQILRPNGGVAMPW

SEQ ID NO: 10040 - protein, 92 aa, Streptomyces avermitilis
MAGRIARWGVALALGALWWWGVLRLVLVPDSGVLEGAVVAGGWGLSLLPVHCVPKARVAGAAGSDQWAVSWQQWRSREGRAEVRRGGDAPRA

SEQ ID NO: 10041 - protein, 156 aa, Streptomyces avermitilis
MYVVKSPLPDADLKTVAEALQGALVDLVDLSLVAKQVHWNVIGPRFRSIHLQLDDVVDTARLHSDTVAERAATLGVSPDGRAVTVANTSGIGETAAGWIQDKDAVGMLVTALGAVISRMRERVGSTADADPVSQDIFIGITADLEKHHWMFQAENG

SEQ ID NO: 10042 - protein, 125 aa, Streptomyces avermitilis
MILLRRLLGDVLRRQRQRQGRTLREVSSSARVSLGYLSEVERGQKEASSELLSAICDALDVRMSELMREVSDELALAELAQSAAATEPVPTPVRRPMLNSVSVAGVPPERVTIKAPTEAVDVVAA

SEQ ID NO: 10043 - protein, 181 aa, Streptomyces avermitilis
VNSLATEVLRLLGVRGETLAVAESLTGGLVAAEITAAPGASKSFRGSVTAYATDVKRDILGVDSTLLAERGAVDPQVAAQMAVGVRKVMGADWGISTTGVAGPEAQDGQPVGTVFVAVDGPFAGSGSSSGGGKVASLRLNGDRAEIRMESVRSVLALLLKELAGEQTGNERAQDTEENGGT

SEQ ID NO: 10044 - protein, 282 aa, Streptomyces avermitilis
MTGVPASAAGGSAGARGAASAAGASGAKGAAGVPGAMTARNAAGGSSGAQSVDDGAAGTQGAQGGASAGHESTRQVRGGKLGAAAVNQASVWNVANLLTMLRLVLVPGFVALMLADGGYDPAWRAWAWAAFAVAMITDIFDGHLARTYNLVTDFGKIADPIADKAIMGAALICLSWLGDLPWWVTGVILGRELGITLLRFVVIRYGVIPASRGGKLKTLTQGVAVGMYVLALTGPLATLRFWVMGVAIVLTVVTGLDYVRQAIVLRRQGIAERKAAAEEAER

SEQ ID NO: 10045 - protein, 495 aa, Streptomyces avermitilis
MPERRTVALVTLGCARNEVDSEELAGRLEADGWQLVEDAEDADVAVVNTCGFVEAAKKDSVDALLEANDLKGHGRTQAVVAVGCMAERYGKELAEALPEADGVLGFDDYTNISDRLQTILNGGIHAAHTPRDRRKLLPISPAERQSAGADVALPGHGAPEGLPEDLPEGLAPESGPRAPLRRRLDGSPVASVKLASGCDRRCSFCAIPSFRGSFISRRPSDVLGETRWLAEQGVKEVMLVSENNTSYGKDLGDIRLLETLLPELAEVDGIERVRVSYLQPAEMRPGLIDVLTSTPKIAPYFDLSFQHSAPDVLRAMRRFGDTDRFLELLDTIRSKAPQAGVRSNFIVGFPGETEADLAELERFLTGARLDAIGVFGYSDEEGTEAATYGHKLDEDVVAARLARVSRLAEELVAQRAEERVGETVHVLVESIDDEEGAVGRAEHQAPETDGQVLFTSGEGLTVGRMVEAKVVGTEGVDLVAEPLPGSLVCTEEAGR

SEQ ID NO: 10046 - protein, 298 aa, Streptomyces avermitilis
VATRSKGAPVSIGNSPDGNSPEDERPFESDREDARAADRPSIGRALQQARIAAGLTVDDVSNATRVRIAIVHAIEQDNFAPCGGDVYARGHLRTLARAVRIDPAPLLAQYDADHGGRPAPTPAAPLFEAERIRPERRGPNWTAAMVAAIVAVIGFVGFTAVKGSGGGDGTKTQVAEGSTPSTSKPASPTPKKAKPVDPKPDVSDSAIAAAPRDKVTVQVSAADGRSWISAKDHNGRLLFDGTLEKGDSKTFQDKEKIELVLGDAGAVQLFVNGKQIQDEFQAGQVERLTYTKGDPQAG

SEQ ID NO: 10047 - protein, 917 aa, Streptomyces avermitilis
VSPAVSTGNLTLMASRQPAAKKPPAKKAAVPTKAPAKKAPAKKAAVRKAPARKVAAKKPAPKPAPNPTGGVYKLARALWLGVAHAVGAMFRGIGQGAKGLDPAHRKDGLALLLLGLALIVAAGTWSNLRGPVGDLVEMLVTGAFGRLDLLVPILLAVIAVRFIRHPEKPEANGRIVIGLSALVIGVLGQVHIACGAPARSDGMQAIRDAGGLIGWSAATPLTYTMGDVLAVPLLVLLTVFGLLVVTATPVNAIPQRLRLLGVRLGVVHDAQEGLAEDDERYDEQWREALPPNARRRGPAPAGYDPDGDEQEALSKRRSRPRRSAGQQPDLNRPMDAVDVAAAAAAALDGAVLHGMPPSPLVADLTQGVTVERDGYEETTPVPAARAKAVKPPRKEASKAGVPDLTKAPPAETRDLPARAEQLQLSGDITYSLPSLDLLERGGPGKTRSAANDAVVASLSNVFMEFKVDAAVTGFTRGPTVTRYEVELGPAVKVERITALTKNIAYAVASPDVRIISPIPGKSAVGIEIPNTDREMVNLGDVLRLADAAEDDHPMLVALGKDVEGGYVMANLAKMPHLLVAGATGSGKSSCINCLITSVMVRATPEDVRMVLVDPKRVELTAYEGIPHLITPIITNPKRAAEALQWVVREMDLRYDDLAAFGYRHIDDFNEAIRNGKVKLPEGSERELSPYPYLLVIVDELADLMMVAPRDVEDAIVRITQLARAAGIHLVLATQRPSVDVVTGLIKANVPSRLAFATSSLADSRVILDQPGAEKLIGKGDGLFLPMGANKPTRMQGAFVTEDEVEAVVQHCKDQMAPVFRDDVTVGTKQKKEIDEDIGDDLDLLCQAAELVVSTQFGSTSMLQRKLRVGFAKAGRLMDLMESRNIVGPSEGSKARDVLVKADELDGVLAVIRGEAAP

SEQ ID NO: 10048 - protein, 228 aa, Streptomyces avermitilis
MVQKAKILLVDDRPENLLALEAILSALDQTLVRASSGEEALKALLTDDFAVILLDVQMPGMDGFETAAHIKRRERTRDIPIIFLTAINHGPHHTFRGYAAGAVDYISKPFDPWVLRAKVSVFVELYMKNCQLREQAALLRLQLEGGGGKVAVGETKEPAGLLAELSARLAAVEEQAEALSKQLDDDSADAAAVATAAHLERKLTGLRRALDALEPGTGSGAPSLPSPN

SEQ ID NO: 10049 - protein, 1829 aa, Streptomyces avermitilis
VESGAATRGTKTRAKGGQSLSNQRKPRTGTTAVDTAALNRLLAALVSMRDGNFRKRLTVSGDGVMSEIAAVFNEVAERNLHLTGELARVRRMVGREGKLTERLESGACEGSWAAAIDNSNALVDDLARPVSEVSRVLSAVAEGDLSPRMELRAQAADGNGHPLRGEFLKVGRTVNNLVDQLSSFTDEVTRVASEVGTEGKLGGQARVRGMSGSWKDLTDSVNTMAYRLTAQVRDIALVTTAVAKGDLSRKVTVHVAGEMLELKNTVNTMVDQLSSFSSEVTRVAREVGTEGELGGQAQVPGVAGVWKDLTDSVNLMAGNLTAQVRGIAQVTTAVANGDLSQKVTVSARGEVAQLAETINQMTETLRTFADEVTRVANEVGGEGRLGGQANVPGAAGTWKDLTDSVNTVFRNLTTQVRDIAAVTTAVANGDLSQKVTVDVAGEMLELKNTVNTMVDQLSSFGAEVTRVAREVGVEGELGGQAQVPGAAGTWKDLTDSVNTAFRNLTGQVRNIAQVTTAVANGDLSQKVTVDVSGEMLQLKNTVNTMVDQLSSFADQVTRMARDVGTEGRLGGQARVDGVSGTWKELTDSVNFMAGNLTSQVRQIAQVTTAVARGDLSQKIDVDARGEILELKNTINTMVDQLSAFADQVTRVAREVGTEGRLGGQAQVPGVAGVWRDLTDSVNGMAGNLTAQVRNIAQVATAVARGDLSQKIDVDARGEILELKNTLNTMVDQLSNFAEQVTRVAREVGTEGMLGGQAEVQGVSGTWKDLTQSVNFMANNLTIQVRNIAEVTTAVAKGDLSKKITVDAKGEILELVTTVNTMVDQLSSFAEQVTRVAREVGTEGILGGQAHVPGVTGIWKDLSNNVNLMANNLTMQVRNISQVAAAVANGDLTRTVTIEARGEVAQLADTFNTMVKTLSSFADQVTKVAREVGTDGILGGQAHVPGVAGTWKDLTESVNGMASNLTGQVRNIAMVTTAIAKGDLTKKIDIDARGEILELKTTINTMVDQLSSFAEEVTRVAREVGTEGQLGGQARVRDVDGTWRDLTESVNEMAGNLTRQVRAIARVATAVTRGDLNLKIDVDASGEIQELQDYINKMIANLRDTTIANKEQDWLKGNLARISALMQGRRDLDDVASLIMSELTPVVSAQHGAFFLAMPLVDAREGGAEQEDAYELRMCGSYGYSMGSMPTSFRPGEALIGTAAQEKRTILVENAPSGYLKISSGLGEAPPAQVIVLPVLFEGNVLGVIELASFTPFTQIQKDFLNQIAEMIATSVNTISVNTKTEVLLKQSQELTEQLRERSAELENRQKALQASNAELEEKAELLAQQNRDIEVKNTEIEEARQVLEERAEQLAVSMRYKSEFLANMSHELRTPLNSLLILAKLLADNADSNLTPKQVEFAETIHGAGSDLLQLINDILDLSKVEAGKMDVSPTRIALVQLVDYVEATFRPLTAEKGLDFSVRVSPELPATLHTDEQRLLQVLRNLLSNAVKFTDSGAVELVIRPAGADVPVAIREQLLEAGSLRDADAGLIAFSVTDTGIGIAASKMRVIFEAFKQADGTTSRKYGGTGLGLSISREIARLLGGEIHAASEPGRGSTFTLYLPLHPSELPPQGYAQMAPTMEVGELLASEPELSAPDIETPAEVKSYRDTQNGPAALFRRRRRAVTAAEERTALPGRPAQGQEQWVGAGQQEPAPQPRRGIRFDGEKVLIVDDDIRNVFALTSVLEQHGLSVLYAENGREGIEVLEQHDDVTVVLMDIMMPEMDGYATTTAIRRMPQFAGLPIIALTAKAMKGDREKAIESGASDYVTKPVDPDHLLTVMEQWMRAE

SEQ ID NO: 10050 - protein, 915 aa, Streptomyces avermitilis
MTTGLHPGGPPQDPRPTGNQPLPRQERVGEAALHADNRTRSSVITARAAASFDPVGRSVATARSFVRDTLQGWGFADIVDDAVVLTSELVTNAVVHAGTSADVLCLRSDDGVRIEVGDRYPEREIPLQAAAVNMGNPDREGGRGLQLCAALAGRWGVDYTPTHKQVWFQLDLPERPVGTRTAGPSLPAELLPLADGRVRVAVVQIDRAGAINAWNEDAEELFGYAAELVIGKPLTDLAAWPHTPGTSTGIVEALQLSRWEGSYGVRGASGRVIPVYASHLRVRDTGGEPSTVCLLVREHERAVLQTPLRGQSPDATNSAEGQALDPFEVFIGSPAPDDLDGLLQRTVERARDMLDADSAFLLLATDDETELEVRASTGLPSARQRFARVPVDAGPGRYGSARMPAVHDDLTAVPGAVPLLSGTGMRSVVTVPLKVEGRLTGSLGVAAESPSRYSNEEALRLQFAADRIALAVESARLGELERLRRGSLSFLVEASDLLAGTLDRDQTLALMAQMTIPTLATWCAVYTIADQASEPYLSYVLHEDEDRIDGVKALLSKIPPPEPIPTPGARVWSAPAQAAHEAALRTSMRSLGLGEPATVSSGIGTTLATASAVGGETVVLPLVARNRVIGMLTLGKPSDEHFRQEILELAEDLSRRAALALDNARLYSERTAISQSLQRSLLPPDLPHIEGVEVEVIYRAAGEGNEVGGDFYDLFPIRDGAYGFAIGDVCGTGPNAAAVTGLARHALRLLAREGLSGPAVLERLNSAILDEGARSRFLTLLYGELWPQEDGSALLKVVCAGHPLPLRLRQDGTVEPAAEPQPLLGVMEDLELYEQTVTLDPGDVLLCVTDGVTERREGTRMLGDDGLTDVLTTCTGLTAGAVAARIMRAVERFASDAPSDDMAILAMRVAGLQKD

SEQ ID NO: 10051 - protein, 225 aa, Streptomyces avermitilis
MGTVGMLKAAGAGAGDEVIVPAFGNVEVAEAVTLAGATPVFADIDPATYCLDPAAVEAAVTSGTVAVIAVHRFGRPADIARLHGVGQRHGLLVLEQGESEAPYDEIAQRRERAAYLDARLNGVWTPDGGDGHTYQHYVVRVPGNGRPDRDAFARAVRSKGVDCRVPVKTPVHRMPAFRRDVCLPETERAADETLALPVDVSLTKREMQRIVSACNALGGLLQPAF

SEQ ID NO: 10052 - protein, 561 aa, Streptomyces avermitilis
LSHPHPELGPPPKLPKGGLRVTPLGGLGEIGRNMTVFEYGGRLLIVDCGVLFPEEEQPGIDLILPDFTSIRDRLDDIEGIVLTHGHEDHIGGVPFLLREKPDIPLIGSKLTLALIEAKLQEHRIRPYTLEVAEGNRERIGPFDCEFVAVNHSIPDALAVAIRTPAGMVVHTGDFKMDQLPLDNRLTDLHAFARLSEEGIDLLLSDSTNAEVPGFVPPERDISNVLRNVFAGARKRIIVASFASHVHRIQQILDAAHEYGRRVAFVGRSMVRNMGIARDLGYLKVPPGLVVDVKTLDDLPEHEIVLVCTGSQGEPMAALSRMANRDHQIRIVQGDTVILASSLIPGNENAVYRVINGLTRWGAHVVHKGNAKVHVSGHASAGELLYFYNICKPRNLMPVHGEWRHLRANAELGALTGVPHDRIVIAEDGVVVDLVEGKAKITGKVQAGYVYVDGLSVGDVGEPALKDRKILGDEGIISVFLVVDASTGKITGGPHIQARGSGIDDSAFGDVIPKIAEVLERSAQDGVMEPHQLQQLIRRTLGKWVSDTYRRRPMILPVVVEV

SEQ ID NO: 10053 - protein, 299 aa, Streptomyces avermitilis
MAPTSTPQTPFGRVLTAMVTPFAADGALDLDGAQRLAAHLVDAGNDGLIINGTTGESPTTSNAEKSDLVRAVLEAVGDRAHIVAGVGTNDTHHSIELARAAEKAGAHGLLTVTPYYNKPPQEGLYRHFTAIADATELPVMLYDIPGRSGVPISTETMVRLAEHPRIVANKDAKGDLGRASWAIARSGLAWYSGDDMLNLPLLSVGAVGFVSVVGHVVTPELRAMAEAYIGGDVQKALEIHQKLLPVFTGMFRTQGVMTTKAALALQGLPAGPLRAPMVELSPEETAQLKIDLAAGGVQL

SEQ ID NO: 10054 - protein, 246 aa, Streptomyces avermitilis
VTDTPADDLKPSFRSDVTVELVKHSAADSDVLWAARVSTAGEQSLDELKKDPERSKGLINYLMRDRHGSPFEHNSMTFFISAPIFVFREFMRHRVGWSYNEESGRYRELEPVFYVPGESRKLVQEGRPGKYVFVEGTQAQQELTGRVMEDSYRQAYEAYQEMLAAGVAREVARAVLPVGLFSSMYATCNARSLMHFLGLRTQHELAKVPSFPQREIEMVGEKMEAEWAKLMPLTYAAFNTNGRVAP

SEQ ID NO: 10055 - protein, 79 aa, Streptomyces avermitilis
MFRRREPVPFAFIAEADKFRSNVTPPPRQRASAGQTAGRWLLGLTVIAGLVGALVVGMPSLSLDQSPATTQHSEASRGH

SEQ ID NO: 10056 - protein, 185 aa, Streptomyces avermitilis
VPLPFLTADRTFDEAADDLPLPYDDRDRWRRPYRPGPWRVGMAALLLLLASYVLAAAVVIALTGTASGAGAVLGIAAVVIACALRMLRMGVWVSARGVRRVGFLRTGTTPWEQVVAVRTVQQPVRWLGLPRTVQGQALILVRGDRAPEDQPSLLTTHGADFLARAAAFDRAADAVEAWASEYGRS

SEQ ID NO: 10057 - protein, 150 aa, Streptomyces avermitilis
MRAKITYAVTAAVLVVYFVLVGSRGVLLIQNGTLVTVTFGVAVLILPVIGVWFLWKNTQFVRKANALAAELDAEGGLPVDELRRTPGGRIDRDSADEVFARRKAETEDAPGDWRSWFRLAVAYHDARDTPRARKAMQRAIALHEGRPVEA

SEQ ID NO: 10058 - protein, 250 aa, Streptomyces avermitilis
MSKLRVAVLGVKGRIGSEAVRAVEAAEDMELVAALGRGDKLETLADTGAQVAVELTTPASVMGNLDFCVRHGIHAVVGTTGWTDDRLAQLKGWLAQSPETGVLIAPNFSIGAVLTMKFAQLAAPYFESVEVVELHHPNKVDAPSGTATRTAQLIAEARRKAGSAPQPDATVTALDGARGANVDGVPVHAVRLRGLLAHQEVLLGAEGETLTVRHDSLHHSSFMPGILLGARRVVTTPGLTFGLEHFLDLN

SEQ ID NO: 10059 - protein, 459 aa, Streptomyces avermitilis
VTSRSSTATARTSSEARAVARTQTLVKGVNGIGTVRKTTLPGGLRIVTETLPSVRSATFGIWAHVGSRDETPTLNGATHYLEHLLFKGTHKRSALDISSALDAVGGEMNAFTAKEYTCYYARVLDTDLPLAIDVVCDMLTGSLILEEDVNVERGAILEEIAMTEDDPGDCVHDLFAHTMLGDTPLGRPVLGTVDTVNALTADRIRRFYKKHYDPTHLVVACAGNVDHNKVVRQVRAAFEKAGALKQPDATPIAPRDGRRAIRTAGRVELLGRKTEQAHVVLGMPGLARTDERRWALGVLNTALGGGMSSRLFQEVREKRGLAYSVYSYTSGFADCGLFGVYAGCRPSQVHDVLKICRDELDHVAEHGLSDDEIARAIGQLKGSTVLGLEDTGALMNRIGKSELCWGEQMSVDDMLARITEVTPDDVRSVARDILGQRPSLSVIGPLKDKQASRLHEAVA

SEQ ID NO: 10060 - protein, 738 aa, Streptomyces avermitilis
VENETHYAEAVIDNGSFGTRTIRFETGRLAKQAAGSAVAYLDDDTMVLSATTASKKPKENLDFFPLTVDVEERMYAAGKIPGSFFRREGRPSEDAILTCRLIDRPLRPSFKKGLRNEIQVVATIMALNPDHLYDVVAINAASASTQLAGLPFSGPIGGVRVALINGQWVAFPTHTELEDAVFDMVVAGRALEDGDVAIMMVEAEATEKTIQLVAGGAEAPTEEVVAAGLDAAKPFIKVLCKAQADLAAKAAKPTGEFPVFLDYQDDVLEALTAAVKSELSQALTIAGKQDREAELDRVKEIAAEKLLPQFEGREKEISAAYRSLTKSLVRERVIKDKVRIDGRGVTDIRTLAAEVEAIPRVHGSALFERGETQILGVTTLNMLRMEQQLDTLSPVTRKRYMHNYNFPPYSVGETGRVGSPKRREIGHGALAERAIVPVLPTREEFPYAIRQVSEALGSNGSTSMGSVCASTMSLLNAGVPLKAPVAGIAMGLISQEINGETHYVALTDILGAEDAFGDMDFKVAGTKEFVTALQLDTKLDGIPASVLAAALKQARDARLHILDVMMEAIDTPDEMSPNAPRIITVKIPVDKIGEVIGPKGKMINQIQEDTGAEITIEDDGTIYIGAQVGSQAEAARATINGIANPTMPEVGERYLGTVVKTTTFGAFVSLLPGKDGLLHISQIRKLAGGKRVENVEDVLGVGAKVQVEIAEIDSRGKLSLIPVVEGEGDDEKKDDTDK

SEQ ID NO: 10061 - protein, 95 aa, Streptomyces avermitilis
VSLDAATKKQIITEFGTKEGDTGSPEVQVAMLSRRISDLTEHLKTHKHDHHSRRGLLILVGQRRRLLQYLAKKDIQRFRALVDRLGIRRGAAGAK

SEQ ID NO: 10062 - protein, 486 aa, Streptomyces avermitilis
VSFGPPPSPYTASTLESENRRKRRRLRILGAAAAAVAVLCAGIWGLSHTPSDQRPTASRQDPDAIRETVERRPATPEGATAVTRRAKGVKAGQTIEATGTWATGKVFAKTLGNRITGFKIATNKEAWKIGFPGAVCAATPHVTVDGRTAVAFSGEATRTDPSGGVMSGPCDEIAMFDIDTGKRLWHVKLPEKELVPATVTMTRGKVIASWKDGSAAYAMADGKLLWSHVPGAVCGDSGYAGGKALVRLVKCGNADNRRFRVEGTNPRTGKSLWTYQVDPGVQDVRLVSSSPVVIAVAAGAPEITDLISLSDRGTVRASLSVPGQRYVTKCATDITGPVETCEAVVVGDRQLYVATQGRDYVAGSAHGQVANEIVAFDLATGKSVRKFDAKVGRPMYPVRMSGDRLIAYRSSVSRYAPSAAVSIDTASGKETLLLLFGTDGMSFFDYLDVRYEHGRIFFAATTIDGPVNKDGEGESEWLADGFETSG

SEQ ID NO: 10063 - protein, 500 aa, Streptomyces avermitilis
VSFGPPPSVYTQSALAADQARSRGRMKVVGAVAALVVAVLCVGGWLLLSAGDDAPADGKAAAASQRPDEIRETVEKIPSTPEGRLVIEHSEDGLAKNTTDPRYAPGTWATGKIFAKGIARKVVGYKIQSQSEKAAWTLELGGHICATSRHVTADGRTAVVVQPSKPEGSKTAGVCNEVVFFDLDTGKKLWQAKMPSANQAYVTNTNLTLTRGVVAVAWRHGSVAYDMKNGKQLWDSTAVSNCEDEGFAGGRALLALVSCGEAPDTKYEVQKLDPRTGRADWTYKVAGGIQAVYMPSSDPPVLAVAAGDITVTDLITLDDKGKHLATVSLAGNRYDPGCGQRYFAAPYFGVMENCDKMVVGRKQMYVATKEGFDAAQPANWIVAFDVRTGKTAGKFDGRSFQSVLPLRMSGDELLIYRRTFGSVGPAAVVRWNPRTDKESPFLLFHLPEDEESELSDPEQSDIIVEKDRVFFAKRELTADDKHPKDPVLAAIGVGSAGVSH

SEQ ID NO: 10064 - protein, 502 aa, Streptomyces avermitilis
MTASVPTGATGGAGTTAPAGAGAGLGFCRVTIVAPDSRIDVALPDDVPVADLYPEILRLSQQSPAEGAPVGYSLVRRDGSVLDSARSFAAQRILDGELLTLRPFSESLPPAVFDDVSEAVASAVTRDRSLWSGELTRTAGLVAGGILPALLAFVVWSSQIRHDMHSLQGVLAAVAGILLVTLACVRARVYDDRGSAVALGLGALPNVAVAGSGLLPLSDGQGIGRLQFLLACTAVLVASVVLTLVSPRGDGPFVAFVFAATIGLLTTFIAILTDLKPMETAAVCAPLSVCALAFLPGLSMRFARLPIGFEPPNPSRGGYDPGEPAPQEPVDAERVAAQARRGHELLVGLVGGCALVSVGASVVLGFSSNAWAQLLALATGVAMLMRAHLFRYTAQVGATLAAGLAALVLLGLGLALNPPQGYWRGALQGDTTALDIRSVWLAAAVAAATVLVTAIGLVTPKRGVTPFWGRFLEIAESFVLLTLIPLALAVFDVYAQARAMTS

SEQ ID NO: 10065 - protein, 1323 aa, Streptomyces avermitilis
VSHIVVKRPPRALPSEVPTEEVVLQPPPELPRGQQEGALMQLLPMLGMGGSVVFFFNPQAQPFMKIMGMVMVASTIAMGISMLIRYRRGSQGQMADMRRDYLRYLSRTRRAAADAAKAQRDAQYYLHPSPEQLWALVAEGSRVWERRTSDEDFAQVRVGLGPQALATPLVPPETAPVDELEPLTASAMQRFLATYSVLEELPMAVSLRAFYHVTVSGEPTTVRGTARALAASLASLHSPEDLVIAVAAARESLPEWEWAKWLPHTQAPGLADGAGSRRLIAGDPMQLEELLAARLEGRPRFHPAGAPVPEQPHLVVVLDGLSLPPTSILASPEGLQGVTVLEVVPGNLTAGRGDLSVVVHPQLLRLESAQGSVYDGTPDVLSYEAAEALARQLAPLRVATGGDDDEPLLANLEFTDLLNLGDAASVDTKRTWRPRSQSERLRVPIGLGEDGRPVMLDLKEAAQEGMGPHGLCVGATGSGKSELLRTLVLGLAVTHSSETLNFVLADFKGGATFAGMAQMPHVAAVITNLADDLTLVDRMGDSIRGELNRRQEMLRDAGNYANIHDYEKARAAGAPLQPIPSLVLVIDEFSELLTAKPDFIEMFVQIGRIGRSLGVHLLLASQRLEEGRLRGLETYLSYRIGLRTFSAAESRAALGVPDAYELPNVPGSGFLKFGTDEMVRFKAAYVSGVYRSGSSQAAALGGPLPVDRRPVLFTAAEVPVQYLPVPQQRRQAPDEKDDALADTVLDVIVRRLEAQGPAAHQVWLPPLDSPPALDSLLPGLAAVQGRGLTQPGYEGAGRLVVPVGIVDKPYEQRRDPLWTDFSGAAGHMQILGGPQSGKSTLVRSLITSFALTHTPHEVQFYGLDFGGGGMAALADLPHVGGVASRLDPEKVRRTAAEVYGVMTRREEYFRTTGIASIADFRARRARGDISTADQPWGDVFLVIDGWGNFRTDYEALEPVVLDIAARGLGYGIHLVLTASRSMEVRSNLKDHLMNRLELRLGDPMDSEFDRKVAANVPTGVPGRGQTPQKQHFMAAVPRIDGLSSDTDLAEATTALATEVTRHWTQPGAPKVRLLPTEFPASQLPPGDRFPKLGVSFALDENNLEPVFVDFEQDPFFLIFGESESGKSNLLRLLIKRITERNDGNSTKLFVVDNRRSLLDATPATHLAEYIPMSNQMQHHMDALADLMQRRTPTAEVTAQQLRDRSWWRGPTVYVVIDDYDLVSTSSGNPLAGLTEMLPFARDVGVRFIIARSTAGAGRAGYETFMQRIKELGAQGVVLSGDPGEGDLLGGVRPRPMTAGRGVFVSRRRGKPLIQVGLAETAEY

SEQ ID NO: 10066 - protein, 106 aa, Streptomyces avermitilis
MADTQENTAAETVDEDVKARKEREKNELYALDISGVEWHSAPGTEEHEERVEIAYLPDGAVAMRSSLDPETVLRYTEAEWTAFVLGARDGEFDLEPTEHNGGLAAE

SEQ ID NO: 10067 - protein, 429 aa, Streptomyces avermitilis
MRNGDDDHIGHDDAGSAAGGAGNGADQGDAALSAPPSPVGRRAWLRSHRLLVSAMATAVVALAVAIPLTVSDSADAAPCWSVPAKARALAGDPAAARKALDPLDDASNLQRARRLLTHDRVCGDGAKVLGRIVTAATSATTSGSPHTMAQARSAFAVASALSHREIPPGLAPAVARMLAEYVVDVTRDVSDGHDRDATGPAESAEGAALDDTGFTPYGRFLAPHEAHTNFGLYEGLDSAHHVSLGVVITELAKDPEAFAILYDAERTYFAHYLERLTDRAGDPAARLTAKSKAEDKKFGEDWHAYDTDWPDNDLEDITDVIAALMQARTRYAKNGTITDLAAFDKSVRAHTDGAYRPAADRVTTRPPMGDIAERPPSARVRGDLFDGRQQLFTVYDAWVRDRDIPAERAGTLRQLLDDHYVRGLWLGRF

SEQ ID NO: 10068 - protein, 362 aa, Streptomyces avermitilis
MNPRTRRLLTWSVAAAVVLSGGAWTAEPYVQDWAVARDVCDGAVSRDTVDQLIPEDTHLKESRGRQIEQLGTYTCVLTAKQGDHARDWDLLAMSAYTRRDDQDLAFFDSFPEYGSATHTVLPGGLPGFVDRFRDVVLQVPCPDLGKDAEGRARRLVSRVSFAEDALVGAGGTAYRAAVSFTNTASKRLGCGADPLTLTRTAAAAALADPGRSDDPRGVVLADAEKTPCAWVAGAGLPDGVDWRVSGEGSAAAPLASCHLDVPEEAGVTEAGGESIGLYAWYGDWSNRFVTRDSTHGGRSSMTATVRCDGEAANFSLDSSDGVRDLGLSEGVSEADERRLLRLFVADQMERHDGCVGEPKFSF

SEQ ID NO: 10069 - protein, 99 aa, Streptomyces avermitilis
MATNADGTQVTYDALDFAATSIGNEAKTLEQDLQELKKLVAQCKQYWDGAAQDAFDSKLARWDKEANDIHTALTGIGHAVGTAGGTYMGGDKKAASYFL

SEQ ID NO: 10070 - protein, 116 aa, Streptomyces avermitilis
MATNGMKVNNDPVIKLEQDMYTKFEAIRARVHKLQGVIDGLEGQWQGIGRAAFDKKQYEINQSLGALGGILTEVIEGVNKTRKITDGSEDEVRAAVQKIDLQDGAPTVTASAFNNY

SEQ ID NO: 10071 - protein, 405 aa, Streptomyces avermitilis
VGAVVGALTVVSMGFAPSAAAYDAQSKQWYLESMQAEQMWKASTGKGVKIALIDTGVNADTSALTGQVLAGEVPKSVAYHATDDYVGHGTSMAELIAGTGSGGGLQGLAPGAKIVPYRVQLEGLKSGAEKDKTPKAWEALRAAADTDAKIISMSFGGMTTDEDEAAVKYAASKGKLLIAAVGNNASDGGSGLIDYPAAYPYVVGIASANKSLTVSKFSSSGNYVDLVAPGEGFPGWCNANFRSYCDDRNGTSPAAAIASASAALIWSAHPDWTVNQVTRSLIDTAGRTWAKGNPSKYAGYGLVRPRKVLANPHYNAGPAYSDPLAKENKTDGEELVTEVSPAPSPSASASSQAPKDTSGGATSAAGSSAESSNDSNSLWIALGAAAAVIVIGGAGAAVMRARRAR

SEQ ID NO: 10072 - protein, 595 aa, Streptomyces avermitilis
MTMTDKQHKADLDRVASQNSITDFARGVEERPRGGLFNNLVRSAVDATPFGQAMHGRTNFELHDLNQMLDLVEQTNPEDLESSGFALWDARDAIKAAAKELDGHIENVHWVGESGDAFRTWSRSLVASTQKLSDFAGGAGDQITAVAVGLANVRSAMPPRDQRPHATRPEQLPKAKQVESNEEYATAVRVEKDRQEAINQMNRLSSYYSVSHEALVALNSEAPTFKAMPDVGVPAPTSYAQVHGSGGAASDGSTAGVNHHATAGAAGHAGSRAAIDTPTPSIDTPTPSYDATGRTPPPDDPARTNIDSVGTLPPPVTAPGTGHTPPVTAAPGTGGGPTSAFDGGYGTPVPNGTSGRGGGAGGVRPPASAQGRAGASGLSNQGTGRSGGRGPMNQMGRPTATGQSAAKSTASGAKSSSMGRGVTGGTPRVGGEAMPRGAGGPTTGAGRSNGVVGGRPTTAGGASGKGGPRIPRGTVIGAEETANSRTAANGRPGQRGVFGAPEPTARPGSSATASRGGAGTSEAVTGRPSARNSVAGAERSGMTRGGVGLVRGPGGQAKSSDGQSTGGPKRPEYLVEDEETHLPTRPRRDVPPTIS

SEQ ID NO: 10073 - protein, 175 aa, Streptomyces avermitilis
VARLALRSYRGPNGSAHDGHTGKTGRSVVLPADMVGGVSATRAANLEVSGEALSTFMKRVDTVLSELEASAGNPKRVGAQTIRPASLNSGKQGAFPEADDLYAQYNAVHEKLTSLSRTLHLQIEAIGIAVQGAHRGFDNLEEEQRRRFWAIQTEIKEIRGAKGSEHSGDGTSLKG

SEQ ID NO: 10074 - protein, 150 aa, Streptomyces avermitilis
VAWDEWEQLKSEAQQRQQGTTHMQLNQLPVDPGGGSTQGDLKVSQKDLAAIGDAAYELNQAFEHFSDLARMSSIAAGDGLKGEGYAIGSALDHVAERWVDQVRSLLDATAHISNHLDYTKGAHAGDEVYIAGTLSSIATLDQGFDERKGS

SEQ ID NO: 10075 - protein, 766 aa, Streptomyces avermitilis
VDLDSLRQGNFHQLGEAITDWQNMTKHLKTLAEDADKNLKGKAHKANWAGMNATVTREFIDKTAGEFSDAHTQADTVTKILSDTRGELIDYRTQVNDAIDRGLKKNLTVMDMGDGSFVVTRSTRPDWASDPSGQNDTTSQKDADDLRDEIQRILDKATESDSTAAKALRLIADQAKYGFSDASYADRDSAAKALADADKMAKILAKNPHDVTNTELASLNSTLAKYKGDPLFAEEFATSVGPKKLLTFYAGIADPYQAQYDPERGKQAKQLQKNLGITIGQATLSDSDAMQGWEKKMIKLGPGQLDIDDASNPTGYAAMSNLMRFGDYDDQFLNNYGNKLFAYDKQVNGEAISLWVNNANQGDLNYWGYKNDRGRDPVTGFLEALGHNPDASTQFFAQPDGAGATVNKGSEVNDHLKYLTQERVWASDVTLEGKHGYVAGRDSLGHALESATTGYAYDAKPMTEKDPMIPGSGDRRTAATAGVMEEVAYLYGSEDGPKMLRGQPELADSLGKMAGAYIDDIDYSLSGVGESAKDADTFPAKYQGRADFTNAGAINFLSVLGQDENSHRAVTAAQHLYTLSQLDAHPSTSDANIEHAHDALVTGSQVRGILDNSRVEQAQTDYGEGSEESNKSLGRSADWIKLGAGAVVAGGVAAIPLPGTSAAALVVAPLAADTVGEAVNTFIGQQIDKGVDDAEADPAEKSQLTSSQFYGKGANQLGAAYQSYIEDSSKAADVAGKEDWKDDINNAYYGTGSHENEYRGRASYKD

SEQ ID NO: 10076 - protein, 195 aa, Streptomyces avermitilis
MTAMTTICFALAVVMAAAGCVKADRVRAWRHGFNPSADELPSSAFVAGRAVFFVLAGIMAFQGFQLLAVSDDVSWSDSELTKAVQGATTALDARSYFEIDSVGNDIKSMIEDEVVQHGGGDAPQSGVDAFPADTNTAKDADYTIKADGAKAAFCMHVKRTESKDGGYTPPGVAGGEGTVTIPEYELAATVDEGEC

SEQ ID NO: 10077 - protein, 432 aa, Streptomyces avermitilis
MMSTPMPYVTEATLRGTFARRAALAATTTAVLAATTVLLPAAAPAAVADSTTGQCTFPSKKYEGRPWALQRVNLDQLWDLSTGKGVQVAVIDTGVDVKNPQLSNAVDASKGENSLPAKNSKGEKIDRGNASGTTDTVGHGTRVAGIIAARSVKGTGFVGLAPDATIIPIKQNNAEGDGTALTLATAIRYAVGAGADVINISQDTANAVEPDPKLHEAVDYALTQKVVVVASAGNDGLGGNDKATYPASYKGVLAVAASDRNNERASFSQSGDFVGVAAPGVDMISTVPGGGHCSDNGTSFSAPYVAGVAALLKSKYPNWTAQEVVAQIEQTAERSIPGHDRLVGWGVVDPVKALSDIDAAHPVESPKPVNGVTRAKAPSVPTLHFGETAEERNTRLATYAVVGAAVLVLGLTGSAVAVRDARRRRGRVGGGV

SEQ ID NO: 10078 - protein, 507 aa, Streptomyces avermitilis
MASRRDELNAYTFAKRRVLASFVQPSPSGSEEGAPKPLRAVLPGVIIGVVILAVFGAIGMFSPTAPKGWKTPNANVIVASDSTTRYVVLETDGKAQLHPVLNMASAKLLLAPDKDTVITVDEKVLDSDTLPHGPTIGIPYAPDRLPSAKEAGAAKRWAVCERPGQGGTAIQKATFVFAQRDYGKTDGADRLAGGELLYVVGPDNKTPYIVDAQGNAYRVDSTDDNLLNALDTQGRKPQRVSQQWLNTLHQRDPISIPTVKGIPGAAANAPGDLRSADKVGMIIKARKGTTMQSYVVLPGRVAPISDFTATLLLNSPQLVTVGQTGEAQQVSPGAIVEGAPFAASEKWPQAAPETVNNATSATSGRNTVCNVLRSVHGKGGATTLSTWAGTEFPTSLPSGSSSAYVTPGSGQLYRQFQGTETSAGPVFLVTDTGLRYALQSNSDSATDDKGIGTTAKQREEELKEAKIAQTRLGYADTDAAPIPTAWSTFLPTGPRLSESAARQPQGS

SEQ ID NO: 10079 - protein, 445 aa, Streptomyces avermitilis
VMASGTRTRSRDRAQARGSSAPRPGAAQQPSAPGPRPQASGALHLRTRQGQSGAFRLQRIVLLEIAAAVLLAGWVIDPLALVPAAVVAVVLVLLAFVRRRGRSLPEWLGTARALKARQRRAASTPIPPGTEPGLAPAVECDPSLRTYAYGGRDRRPVGIIGDGTFVTAVLQVEADATALRAERSRQPLPLGLVRDALEVDGIRLESAQIVLHTQPAPALHLPQQSVAVTNYAPLQAQTGAPAVRITWIALKLDPELCPEAVSARGGGLVGAQKCVVRAADHLTSRLTGAGFRTTVLNEEELTAAIATSACANPLVTAGAGRTEARERRTEESGRSWRCDNRRHTTYWVRRWPLVGGDGRSLPQLVALLTAVPALATTFSLTLAHGERGEVSLCGHLRVTGRSDDELVAARRALEEAARRGGAGLARLDRQQLPGVLATLPLGGAR

SEQ ID NO: 10080 - protein, 267 aa, Streptomyces avermitilis
MAMTTASTPGARAYGAPGNADGPGEPSVAERLRGRARSGFGLIGPRHGRHSLSVEQVDSLALPIGDDGVVVGVDAEGQPAVLGLNRPTPYDVVLIGGLWTAQVLALRAAATGARVAVETGRAPAWMQLVHAMGGGQNGMSVYDVGRVPPQGASAGNPVLVVRDCGMRPPRGRVVSGPWQAVLTLLPYLSPVAPRLMRQARLVGVQRVSPDEAAEIGRTVALPRGDMDSLPTLPDGVTLWCADRDRQYVMTQPTDAETGLLGMPRRMD

SEQ ID NO: 10081 - protein, 810 aa, Streptomyces avermitilis
VARQTPPPLPRPPPTTYRPRSPGPRRRLRRARFRRCRPPISRPRPHRRPSGPRLRSRASRRAPRPQPPLPSKASRSRSRSPSRRPRRASRPRRPGSRSRSPRSSRRHRSRHPRPGTSLRRPHPRIPCPRRRPTPRARVTGAPAAPQAGYGFPQPGVPTPPAPDSRVKQDGYGFPQAGAQGVPQAGPPAGPISPAAQAAPAPPAAPSAPTPQPGYGFPQPGGPVPPQSGYGFPQQGAPAPGPAAPQDQPPAPQAGYGFPQPPAPAAGPDAHNPPTPQPGYGFPQQGQPPAPQAGYGFPQPPAQHAQAQPGQPQGPAVPPAAPAPHPGPQPSGYGFPQATPTPPAPPAQQAPQAQPSQPQPQPQPQPPVDPRTGAAWPQPVQHDQRQPTNPGVAPLGYTAAVELSSDRLLNNKKQKAKSGRPGAGGGLFKLGAKKEEAERQRKLELIRTPVLSCYRIAVISLKGGVGKTTTTTALGATLATERQDKILAIDANPDAGTLGRRVRRETGATIRDLVQAIPYLNSYMDIRRFTSQAPSGLEIIANDVDPAVSTTFNDEDYRRAIDVLGKQYPIILTDSGTGLLYSAMRGVLDLADQLIIISTPSVDGASSASTTLDWLSAHGYADLVSRSITVISGVRETGKTIKVEDIVGHFETRCRGVVVVPFDEHLAAGAEVDLDMMRPKVREAYFNLSVMVAEDMARHQQSHGLWTSDGNPPPVAAPPMPGQPLPGQPMPGQPAPGQPVPGPPYPQQGQQPYPQYPGYPQQPGQAQPQPQPQGQPQPQPHPGQPYPPAQQQPYPPNPNQGQAPGQAPPQQ

SEQ ID NO: 10082 - protein, 264 aa, Streptomyces avermitilis
MDTSASRTYVGDIGTLSGAARTEALDTLVEDLRSPDPVVRDEQAYVRAARWIPVLDAADRLRLGDRMAASFTDPAVQARAFAPLVLARIVEAGAWRPRWWSAFADWYPAETDLRGHDPALGWLHAVAHGADLLAAVSHHPGQDPVPLLELAVARLLTPTGHLFDAQEDDRLAHALAQILSHPGLTAAQSARWLDPVSEAFRTGEPGPVPAWASNTMRTLRMLYVLTDRGFRTKDTGAGIRTVTHRTSALDALAGTLAIVAPYSA

SEQ ID NO: 10083 - protein, 317 aa, Streptomyces avermitilis
VQRWRGLEDIPQDWGRSVVTIGSYDGVHRGHQLIIRHAVERARELGVPSVVVTFDPHPSEVVRPGSHPPLLAPHHRRAELMAELGVDALLILPFTTEFSRLSPAEFVVKVLVDKLHARAVVEGPNFRFGHKAAGNVEFLAEQGKTYDFEVELVDLYVTGEAGGGTPFSSTLTRRLIAEGDVEGAREILGRPHRVEGVVVRGAQRGRELGFPTANVETLPHTAIPADGVYAGWLHVGDEAMPAAISVGTNPQFDGTERTVEAYAIDRVGLDLYGLHVAVDFLAFVRGQAKFDSIDALLETMAVDVKRCRELIAAYDGE

SEQ ID NO: 10084 - protein, 1199 aa, Streptomyces avermitilis
MAERGRRTRDDGRGGRDAAEGAPAGREGQDATAAALVRFCDPAGRPRGTGFAADHHGTVLTSHEAVDGLSRLVLHAPGDRSCVVTAGAVTPLPDLGLAIVRTEGLALAPLPVIVRDRVGVGSYVRLVAGGWREARVLGTTAVTYTATDRCHLLDGAMELAIGTAGVDALRLGGGAAGGPVLDAETGAVVAVLGTALHTEHRAAGFAVPLRGTGCAAGPLDELLARNAATVPAYRADLNPAGVLELAATTVGSDGPSRAHEALAPVERARIVGEFAAFADGPAAVLGLVGAPGSGRTTELASLAARRTRAPEPAPTLWLRGADLLATDTSVADAAARALERAARIVAAADGVGGVDGGARHADGVLGDVRPERLARVAREAGRPLLLLLDGPEEMPSALAHRLPEWTAGTAPGGSGDSEGCGGSRGARDARGSGDSRASGGSGDSRGSGGSGDLGGTDGSGAWFGRLGRDEVFSSYLDLMCLRIAVRLAAADGLRGTAVRRLAARVSGQVHAAARRCLGAGQGELDRESFEAVFPWGPVPGRPFDGITGWATAVLTEGLLVPAGNGYRFAHEELADWIQGMHLDLEAALHALVHRDRDTPPSTPPVPRHRTGPIVQALLLLARQQGPAELALRLEDLADAAGALLPQRPDPGAGNAQSLAAPTAATRPPATRPPATRTLAARTPVPTNPGPLGPTLLHPTSSHPTPSHPTPSDHPAWWPVRLLADVLLHVPDATPYLPVLRHLAARIIEWRAQGRCVPEEFGPSFWESVPVGDTERFDLLRQLVVADEAPGGPAEGPRYLDAVSGLLAADPAAVHPHLTRWFDDDRPLPATPDATVATAAQALLHTHRRRALDDLTEALADSAHRRGDELLAVLAEEEPSAVCRAVDRWAHDERPARRVAAVAYGLRAAPHVRTEDGRELLRYAALALLARPADCTLHGGALALLVRDPRTRSRHLPQALARFGEGDPQVPASALATALASHPEPVLEAFQARLRRPGPDVGEVLRTLADVTTPALARRVATLVREVVELRPETADHVAAYVERRLEQGLASRAVLLPLVGGLLDGGPPEVRVALTTVLAAPGGAESGPLRHELLGLLLGRERDPAVLVALLCAAADGARHSGEQHTRELVRRAGLLLVRTPDGATRFDQALVELGRRVPGFAPLVARWLTREPEAWAAVVGPSTRRMIENLAGVVRVPA

SEQ ID NO: 10085 - protein, 301 aa, Streptomyces avermitilis
MTEKHRTPDGLVIVDKPSGFTSHDVVAKMRGIARTRRVGHAGTLDPMATGVLVLGVEKATKLLGHLALTEKEYLGTIRLGQNTLTDDAEGEIISSTDASRVTRDAIDAGVAKLSGAIMQVPSKVSAIKIDGVRSYKRAREGEDFEIPARPVTVSSFAVYDVRDAVAEDGTPVLDLVVSVVCSSGTYIRALARDLGADLGVGGHLTALRRTRVGPYKLDAARTLDQLQEELTVMPIAEAAAAAFPRWDVDTKRARLLLNGVRLEMPEEYAGRGAVAVVDPAGRFLALVEEQKGKAKSLAVFG

SEQ ID NO: 10086 - protein, 157 aa, Streptomyces avermitilis
VADNARAKRLADLIREVVAQKLQRGIKDPRLGSQVTITDTRVTGDLREATVFYTVYGDDEERAAAAAGLESAKGVLRSAVGAAAGVKFTPTLTFVADALPDTAKTIEDLLDKARASDAKVREVSAGAQFAGDADPYRKPESDDESDTAAKTDGDAAE

SEQ ID NO: 10087 - protein, 97 aa, Streptomyces avermitilis
MYVGTLSFDLLLGDVRSLKEKRSLVRPIVAELQRKYAVSVAETGHQDLHRRAEIGLAVVSGDTGHLTDVLDRCERLVAGRPEVELLSVRRRLHNDED

SEQ ID NO: 10088 - protein, 1046 aa, Streptomyces avermitilis
VAKVRVYELAKEFGVESKVVMAKLQELGEFVRSASSTIEAPVVRKLTDALQQGNGGKAAPRKAAPAKPGAPSPAQAARPAAPRPPAPKPAAAERPAAAERPAAAPAAPGPRPGPKPAPRPAPAAPAPAAPEFTAPPSAPAAPAAAASGPRPGARPGAPKPGGARPATPGQGQGGQVRGERTDRGDRGDRGDRQGAARPGGQAPRPGARPAGPRPGNNPFTSGGSTGMARPQAPRPGGAPRPGGAGAPGGPRPQGAGGQDRAPRPQGGPGGAPRPQGGPGGARPTPGGMPRPQAPRPGGAPGGNRPNPGMMPQRPAAGPRPGGGGPGGRGPGGGGRPGGPGGGGGRPGGGGFAGRPGGGGGGFAGRPGGPGGGGGGFAGRPGGPGGGGGGRPGFGGRPGGPGGRGGTQGAFGRPGGPARRGRKSKRQRRQEYEAMQAPSVGGVMLPRGNGQSVRLSRGASLTDFAEKIGANPASLVGVMMNLGEMVTATQSVSDETLKLLADEMNFVLEIVSPEEEDRELLESFDIEFGEDEGGEEFLVARPPVVTVMGHVDHGKTRLLDTIRKTNVVAGEAGGITQHIGAYQVTTEVNDEERKITFIDTPGHEAFTAMRARGAKSTDIAILVVAANDGVMPQTIEALNHAKAADVPIVVAVNKIDVEGADPTKVRGQLTEFGLVAEEYGGDTMFVDISAKQGLNIESLLEAVVLTADASLDLRANPEQDAQGIAIESHLDRGRGAVATVLVQRGTLRVGDTMVVGDAYGRVRAMLDDKGENVEEAGPSTPVLVLGLTNVPGAGDNFLVVDEDRTARQIAEKRAARERNANFARRGVRFSLENLDEALKAGLVQELNLIIKGDASGSVEALESSLLQLDVGEEVDIRILHRGVGAVTESDINLATGSDAIVIGFNVRAAGRAAQMAEREGVDVRYYSVIYQAIEEIEAALKGMLKPEYEEVELGTAEIREVFKSSKLGNIAGVLVRSGEVKRNTKARLIRDGKVIAESLNISGLRRFKDDVTEIREGFEGGINLGNFNDIKVDDVIATYEMREKPRS

SEQ ID NO: 10089 - protein, 97 aa, Streptomyces avermitilis
VSGRTHARACPERTCVGCRERAAKKDLLRIVAVEGDCVPDHRGTLPGRGAYVHPALVCLDLAVRRRAFTRALRAPGALDTAALRHYVEQTVAEQATP

SEQ ID NO: 10090 - protein, 328 aa, Streptomyces avermitilis
VDIDMSALRGLVREKEISFDLLVEAIESALLIAYHRTEGSRRHARVELNRETGHVTVWAKEDPEDLEEGQEAREFDDTPSGFGRIAATTAKQVILQRLRDAEDDATLGEYAGREGDIVTGVVQQGRDPKNVLVDIGKLEAILPVQEQVPGETYQHGLRLRSYVVRVAKGVRGPSVTLSRTHPNLVKKLFALEVPEIADGSVEISAIAREAGHRTKIAVRSTRSGLNAKGACIGPMGGRVRNVMAELNGEKIDIVDWSDDPAEMVANALSPARVSKVEVVDLAARSARVTVPDYQLSLAIGKEGQNARLAARLTGWRIDIRPDTEQSGD

SEQ ID NO: 10091 - protein, 169 aa, Streptomyces avermitilis
MSTTQSERLRELLEPLVGSQGLDLEGIEVESVGRKRVLRVVVDSDEGADLDAIADVSRALSAKLDETDAMGEGEYTLEVGTPGAERALTEHRHYVRAVDRLVRFQLTEGDELVARILTVDDAGLDLEVPGVKGRKATTRRLAFEDIAKARVQVEFNRKDKKDMTEEEEA

SEQ ID NO: 10092 - protein, 232 aa, Streptomyces avermitilis
VAGPRRPTTTPQRCVPAPAAPAGSAGQALGRPSVRTSPSRTSAVPFTLPPRIPPGPRRRSLLASAAGAALLVGCSESPDSANTAGSPSAADRARARAARDSAALATRYAAVIAAHPALADLLRPLRTAVVRHTEAFGGSAQASASASASASVSASADGDGRAPASAHPSASASPAVAADRKTALSDLAAAERALADRRTKALLELPGELARLMASVAAAGAAHAFLLTEGAK

SEQ ID NO: 10093 - protein, 167 aa, Streptomyces avermitilis
VSASTGTTGTPKAESTESAELRALQAALGAEHAAVYGYGVVGGKIGQARRADARAAYDAHRARRDELARSVRDLGGTPQAAAAGYALPFAVPDATAAVRLAAELEERVAGVYSDLVRAGTGARRRSAAEALREAAVRAVRWSGESVAFPGLAERAAATPTASATPQT

SEQ ID NO: 10094 - protein, 300 aa, Streptomyces avermitilis
MAFEPPQRLVRALGETERNGAADWLVKLPELVQQVVDLRELTVERVQAPGGRSSLVVLVRQADGTPAVLKLAPPWARPESERAALAHWGGFGAVQLLDGDGGEGVLLLERLHPEMSVRSLPEAKALLEAAGTLRRLWVEPPAGQVFESVAERTGRQAEAMRTSAAADAEVAPLVDAALAAREELLASAPQARLLHGTFRQSKVLAGERMPWLAVGPDPVVGECAFDLARLVRDRVEDLIASPSGASITRRRVKRLAESLELDQERLRGWTLFRAVESGVRARRVGRPQDAELLLEFAGWL

SEQ ID NO: 10095 - protein, 564 aa, Streptomyces avermitilis
MAQVQRMSRLMVKTLRDDPADAETLNHKLLVRADYVRRTAAGIWSWLPLGKKVLENVARVVREEMDAMGGQEVLLPALLPKEPYEATGRWEEYGPELFRLKDRKGAEYLLGPTHEEIFTQLVKDQCSSYKDLPVILYQIQAKYRDEARPRAGILRGREFLMKDSYSFDTADEGLAQSYALHREAYIKIFNRLGLDHRIVSAVSGAMGGSASEEFLAPAPAGEDTFVDCPACDYAANTEAVTFVAPAVESVEHPAVEELDTPDTPTIESLAEYLGVPASATLKNLLVKADGEIVAVGVPGDREVDLGKLGEHLAPAVVELVTAEDFEGRDDLVRGYVGPQGLEKVRYIADPRVAPGTAWITGANKINTHAKNVVAGRDFEVDDYLDVVVVEEGDPCPSCGTGLRLDRAIEIGHIFQLGRKYADAFQLDVLGKEGKPVRVTMGSYGIGVSRAVAALAEQTADEQGLCWPKEIAPADVHVVAAGKALQTELALDVAEKLGAAGVRVLVDDRAGVSPGVKFTDAELIGVPQILVAGRRSAEGVLELKDRKTGEREELTVEEAIARLSA

SEQ ID NO: 10096 - protein, 189 aa, Streptomyces avermitilis
MLRFPGQGHHNPDDVVIGLLDLAARVDEALAVQAVAFGLGADEVAVRHQIVLRHLTSPGARAFGATTGDGRLVGFVYGMPNDRTHWWSTVVEPYLRGQGHEDWLDNSFVITELHVHPHFQNHGIGRSLITTITDGAAEPRSILSAIDTESPARGLYHSLGYEDLARQVLFPSAPRPYAVMGAPLPLRRR

SEQ ID NO: 10097 - protein, 295 aa, Streptomyces avermitilis
VRRSADPRVRPPHVLTQTTTRVLEPSDLDAALAVLDREPVANAFVTSRVQVAGLDPWRLGGEMWGWYEDGMLTSLCYAGANLVPICATPRAVRAFADRARRAGRRCSSIVGPVEPTTQLWQLLEPGWGPAREVRAHQPLMVTDRLPDDVAPDPYVRRIRKDEMETIMPACVAMFTEEVGVSPLAGDGGLLYQARVAELVGSGRSFARLDRNGKVAFKAEIGAATHHACQIQGVWVAPEYRGQGLAAPGMAAVLRYALADVAPVVSLYVNDFNTPARAAYRRVGFQEVGAFMSVLF

SEQ ID NO: 10098 - protein, 385 aa, Streptomyces avermitilis
MTAISLGMPSVPTKLAERRKSRQIQVGTVAVGGDAPVSVQSMTTTRTSDIGATLQQIAELTASGCQIVRVACPTQDDADALAVIARKSQIPVIADIHFQPKYVFAAIEAGCAAVRVNPGNIKQFDDKVKEIAKAAKEHGTPIRIGVNAGSLDRRLLEKYGKATPEALVESALWEASLFEEHDFRDIKISVKHNDPVVMVNAYRQLAAQCDYPLHLGVTEAGPAFQGTIKSAVAFGALLSEGIGDTIRVSLSAPPVEEIKVGIQILESLNLRQRGLEIVSCPSCGRAQVDVYKLAEEVTAGLEGMEVPLRVAVMGCVVNGPGEAREADLGVASGNGKGQIFVKGEIIKTVPESKIVETLIEEAMKIAEQMEADGIASGEPSVSVAG

SEQ ID NO: 10099 - protein, 434 aa, Streptomyces avermitilis
MTTLMFILGIVVFAIGLLISIAWHELGHLSTAKLFGIRVPQYMVGFGPTVWSRKKGETEYGVKAVPLGGYIRMIGMFPPGSDGKIEARSTSPFRGMIEDARSAAFEELRPGDEDRLFYTRKPWKRVIVMFAGPFMNLILAVVIFFGVMMTFGVNTQTTTVGKVSDCVIQQSENRTKCARSDQAAPAKAAGLKGGDKIVAFDGKAVADWSALQSDIRANPGKDVTITVERKGQQLDLKAHLIKNQVSKTDGNGGYVEGKYVYAGFLGFTPASGIVEQSFGQSVTRMGDMMQNGVESLISLPGKIPALWDAAFGDGPREADSPMGVVGAARVGGDVFTLDIPPSQQIAMMLMLVAGFNLSLFLFNMLPLLPLDGGHIAGALWESLRRNAAKVLRRPDPGPFDVAKLMPVAYVVAGIFVCFTILVLIADVVNPVKIS

SEQ ID NO: 10100 - protein, 394 aa, Streptomyces avermitilis
VILGSTGSIGTQAIDLVLRNPDRFRVTGLSAAGGRVGLLAEQAHRLRVSTVAVAREDVVPVLREALTAQYGPGEPLPEILAGADAATQLAASDCHTVLNGITGSIGLAPTLAALEAGRTLALANKESLIVGGPLVKALAKPGQIIPVDSEHAALFQALAAGTRADVRKLVVTASGGPFRGRTKAELANVSPEHALAHPTWAMGPVITINSATLVNKGLEVIEAHLLYDIPFERIEVVVHPQSYVHSMVEFTDGSTLAQATPPDMRGPIAIGLGWPERVPDAAPAFDWTKASSWEFFPLDNDAFPSVGLARHVGQLAGTAPAVFNAANEECVDAFLNGTLPFNGIMETVTRVVEEHGTPRTGTSLTVADVLEAETWARARARELTVQTATAEARA

SEQ ID NO: 10101 - protein, 149 aa, Streptomyces avermitilis
MRIRAALPALAGAVALTGTILSTPAEAAGGVTIHHVWFDSPGSDTRSNASLNAEWVQIKNTGSATVSLKGWVLKDVSNHKYVFPDVAIGAGKTVKVRTGKGTDTTSTKYQSRGAYVWNNTSDTATLTKASGTKVDSCAWTTRDPSDTYC

SEQ ID NO: 10102 - protein, 920 aa, Streptomyces avermitilis
MPVLGLDNITGRIMRAGEGRILRRLQRIAAQVNSLEEEFKALTDEELQALTPEFTRRHADGESLDDLLPEAFATMREAARRTLGMRHFDVQLMGGAALHFGNIAEMQTGEGKTLVGTLPVYLNALTGKGVHLVTVNDYLAERDAEWMGRAYRFLGLTVGVIKSQSTPAERRAQYACDITYGTNTEFGFDYLRDNMAWSQDELVQRGHHFAIVDEADSILIDEARTPLIISGPADQPTQWYGAFAKLVTRMRGVRVQEEQFVTPADKDRLAHLRTTHDYEYDPKKRTVAILDRGVEYLQDQLGIESLYESEHTSLIGHLNNALKAKEHFRKDKDYVVVDGEVLIVDEHTGRILAGRRYNEGLHQAIEAKEAEEGTEAGVTVRNENQTLATITLQNFFRLYEKLAGMTGTAMTEAAEFHQIYQLNVVPIPSNRPMIRRDDPDQIYRTEEAKYAAILADIAERHETGQPILVGTTSVEKSELLSGLLRKQGIRHEVLNAKNHQREAQIVAQAGRRGAVTVATNMAGRGTDIMLGGNPEAMALAALPEDATPEDREAVLDRVGRAAAAEHEEVKELGGLYVLGTERHESRRIDNQLRGRSGRQGDPGASRFYLSLGDDLMRLFRAQVVERVMSMANVPDDVPIENKMVTRAIASAQSQLEQQHFESRKDVLKFDEVLNRQRTLIYAERRRVLAGEDLREQVRHFMDDTIEAYIRQETGEGFPEEWDLERLWGAFRQLYPVGITIEDLEDSVGGRPDLTVDDLVAAVTEDVHDRYARREAELGADALRDLERLVVLSVLDRKWREHLYEMDYLRDGIGLRWTLGREPIVEYEREGFDMFGAMTEAIKEESVGYVFNLDATGREGEGSALDRRPTDGLHFSAPTLDTAEGVVEGRFTTAPAGEPAEHDKAPPHRPGKSRNRRRRKR

SEQ ID NO: 10103 - protein, 161 aa, Streptomyces avermitilis
MRQGVGEEHSHGISVQLTRARGDARHQLDATDLVKALRTVRNEVVPLAEKLRQTAPETFEAHRDALAVLLNDCALALVDEEPRPPVATFDPMPVRRIDLRDVDALLDAGRPGERPVIQQLFRGSVAYAKDPVLREVIKANQQGVHILQRANHWIRMLADSI

SEQ ID NO: 10104 - protein, 646 aa, Streptomyces avermitilis
VSLMSATPHQPTVTEREARQVAEAAREQDWRKPSFAKELFLGRFRLDLIHPHPMPADEDAQRGEEFLAKLRDFCETEIDSARIEREARIPDETVNGLKELGALGMKIDTKYGGLGLTQVYYNKALALVGSANPALGALLSAHQSIGVPQPLKLFGTQEQKDTYLPRCARTDISAFLLTEPDVGSDPARLATTAVPDGDDYVLDGVKLWTTNGVVADLLVVMARVPKSEGHKGGITAFVVEAGSEGITVENRNAFMGLRGLENGVTRFHQVRVPAANRIGPEGAGLKIALTTLNTGRLSLPAMCVGAGKWCLKIAREWSAAREQWGKPVAFHEAVGAKISFIAATTFALEAVVDLSSQMADENRNDIRIEAALAKLYGSEMGCLMADELVQIRGGRGFETAESLAARGERAVPAEQILRDLRINRIFEGSTEIMHLLIAREAVDAHLSVAGDLIDPDKSLSDKAKAGANAGVFYAKWLPKLVAGQGQIPGAYGEFRREVDLSPHLRYVERGARKLARSTFYAMSRWQGRMETKQGFLGRIVDIGAELFAMSAACVRAELLRKEGDHGREAYQLADAFCRQSRIRVEELFGRLWSNTDDLDRKVVEGVLSGTYAWLEEGVIDPSGEGPWIADATPGAAKRENVHRPIR

SEQ ID NO: 10105 - protein, 269 aa, Streptomyces avermitilis
MQHRRPRLSKKARALVATTVVLAAAAGVTVAQAGETGKKCAAFDTITLGKYYVNNNLWGQDKATGTQCVWDDSRSGSTISWGTDYSWANNSAGHDYDVKSYASSVLGWHWGWKADKAATGLPVRVGDRKSVRTTWDFSVGAGPGTMNVAYDLWLHAKNNADWQDQPTDEIMVWLNRQGGAGPLGTKYGSVSLGGAMWDIYQGDIGWKVYSFVRRTNTTKATLDLDDFTQALVRRKLLSDDKYVSGIEAGTEVFKGAGRLDTKAYSVDIG

SEQ ID NO: 10106 - protein, 337 aa, Streptomyces avermitilis
MVTLAEVAQHAGVSASTVSYVLSGKRSISVGTRRRVEQSIQELGYHPNAGARALASSRSNIIALMIPLRTDMYVPVMMEIAIAVATSARTHGYDVLLLTGEEGPDAVRRVTGSGLADAMILMDVELDDERLPLLRSTDQPSVLIGLPADTSGLTCVDLDFGATGALCAGHLATLGHRDIAVIGEAPAVYERHTGFAERTLDGLRSRSRELGLRVLHRPCEGGYDAMALTLARIFDERPSTTGFVVQNESAVEPLLALLRRQGRAVPEDVSVIAICPDQVATQASVRLTSVAIPAQEMGRHAVEHLVAKLNGHGEDEVVLIAPELTVRASTGPAPTAA

SEQ ID NO: 10107 - protein, 642 aa, Streptomyces avermitilis
VRVEPWGPDAVRVRTRLGGPVLEGLPGALLDERPSTPYTLKIEDGRGTLTVGALTVEVDAEGLLRFVRTDDGGELLAEERAHFWWPGSRLYTPAGGGRHRLEQRFAAYEGERLYGLGQHQHGLFDQKGAVLDLVQRNAEVTIPVLTSSRGYTFLWNSPAIGRVELAGNGTRWVADSARQIDYWITAGDPADAQRRYSAVTGRTPMLPEWAAGFWQCKLRYRTQDELLAVAREYKRRGLPLDVIVCDFFHWTHLGEWKFDLDQWPDPAAMVAELAELGVELVVSVWPSVSPLSENHQLMEQRGYFIGTEYGPMAHADWPDKGVASTVQVAFYDATNPEAREFVWSKVRDNYLKPYGIRSFWLDACEPELKPGFQENLRYYAGPGPETGNLYPRENSRTFYEGMLAAGETEVVTLNRSAWAGSQRYGAALWSGDIGTDFATLRRQIAAGLNTALSGIPWWNTDIGGFHGGDPDDPAYREVMVRWFQFGALSPLMRLHGFRDPGTPLGPGMTGGPNEVWSYGEEAGAILEKYLRLRERLKPYVLDVMRAAHEEGLPVMRPLFLEFPEDRAAWSVDDAYLFGPDLLVAPVLTAGATSRTAYLPAGAWWTDAWTGQEYEGGTAVTVDAPLDRIPLFLRDGARLPVAE

SEQ ID NO: 10108 - protein, 237 aa, Streptomyces avermitilis
MAPRTLSKVTKALIAPALALGATIGLASAPAQAAVWSSCDQWGNTTLNGYTLYNNIWGSGAGSQCIWANSGTNWGVNANHPNTGGIKSYPNAKKVINKSITSLGSLSSSYNVTVPSSGAYNTSYDIWDTAYKYEVMLWVNYNGAVGALGTSQGNLTLGGHTWTVYKGNNGSNDVFSFLRTSDSSSGTVNVLPILKWIKDTKGWFGNVTIGDVQFGFEITSSSGGLDFTTNSLSVSSS

SEQ ID NO: 10109 - protein, 732 aa, Streptomyces avermitilis
MSEPVHGTWEAAPATRWEDAFLSGNGRHGVMVFGDPNDDRVIVNHHTLIRPNGSADAGPPALADRLPGLQDRLLAGDTTAGEDFTDGRPLLWVRPFHPAFRIRLRRPAPERRSYRRHVDFTTGVVGADGGGRSEVFVSRADDVVVQRVTGPGLTLDVTLDHRLPGAPRDLAVGHGAVLTSEGALLTLRARYPGGDLAYTGVTLAVVSGGRTRTALPGLRVEGAASLLLLTRVRRHTGELDVLAEARELRALLPGDEEDAYPHLLARHTALHRTAYLRAGLDLGADPTERALPGSELVRRPKSPALLERLFAAGRYHLLSSAGMLPPRLTGLWTGDWDTAWAGAFTTDANVNLQTASAAAAALPEVSEAHAALVHGQLPHWRDNARAIFGTRGVVAPAHTDGESGHIYHLSREYPLHVWTAGADWLLKPLVDHDETSGARDPRLAVALAEVAYFYEDFLTRTDKNGHLVVVPSYSPENRPANASWITLNAAMDLSAARHALLTAAHYHPGPDAERLRALADRLPPHRVNADGALAEWAWPGLDDTYDHRHLSHLYGVWPLDEINPYDTPELAAAAHRALELRGAENDSAHGHLHHALIAARLRDADRVAGALGNVLAGDFFHVSLMSGHYPNRHVYNADAAHTLPAVIIEALIQSTPGRLVLFPALPTAYPTGRLRGVRTRFGAEVDLTWGPGERTAVIRPTRTLRVDLRTSSGARPLDLVAGEDCVLTLGPQ

SEQ ID NO: 10110 - protein, 659 aa, Streptomyces avermitilis
MPGLTDATRGRILFGGDYNPEQWPEEVWQEDVRLMKEAGVNSVTVGVFSWAELEPTPGAREFGWLDRLMDLMHENGIGVVLATPTASPPPWMGRLHPETLPRDEDGRIEWWGGRQHFAHSSAVYRRYAAAITEDLAARYGGHPALTMWHINNEYCTYDWGDEAATAFRRWLQGRYGTLDALNTAWGTAFWSQGYDDWEGILPPRHAHYMNNPTQVLDFKRFTSDALMECFVAERDIVARHTPNIPVTSNFMPFWQGQDAWAWAGREDVVSVDSYPDPRDPLGGQYGALIHDMTRSQARGGPWMVMEQAAGPVNWRGVNHPKPPGLNRLWSLQAVARGADAVCYFQWRQSRQGAEKFHSGMVSHAGERGRTFQEVKRIGAELALLSEKVADTRVTGADVAVLLDWNAWWASGQDGRLSGEVDYPAVVRAWHRALWEANVTASFAHPEHDLSAYKLVVLPQLYLLTDTAIDNLVAYVRGGGTVVSGFLTGVADQDDRVRQGGMDERLRKLFGIRTLHEWWPLDADEKVGVEGFRGTLWSEEIEAADEAYAVIPYKGGELDGLPAVLRKGRAWYLSTLPEPAALWPLLAGIAEDAGVRPALDHLPAGVEAVRRGELLFLLHHGRDTVTVPVPGRHRDLLTGEDVVDAVELGRYGAAVLEAAP

SEQ ID NO: 10111 - protein, 739 aa, Streptomyces avermitilis
MRTPRPSRRTVLAGTAAAAALTAVPAVGSQAHAAETTAGPSYRWRNAVIGGTGFVTGVLFHPSVRGLAYARTDIGGAYRWDDRGARWTPLIDHLGWDDWNLLGVEAMAVDPTHPDRLYLAVGTYAQSWAGNGAVLRSEDRGATWTRTDLTVKLGGNEDGRGAGERLLVDPRDSDTLWLGTRHDGLLKSTDRGATWAAATAFPAKANSSGQGVVFLVAAGRTVYAGWGDGDGTSGTANLYRTADGTTWGAVPGRPSGTSAKVPLRAAYDTHTRELYVTYGDAPGPGGQSDGSVHKLRTATGTWTEVTPVKPGGTTSDGSADTFAYGGVAVDARRPGTLVVSTNNRWADGDTVFRSTDGGRTWTSLKDAAVFDVSETPFLDWGDDKPKFGWWIQALAVDPYDSQHVVYGTGATLYGTRDLKRWAPRIRGLEESAVRQLISPPVGEAHLISGLGDIGVMYHERLTASPSRGMATNPVFGSATGLAQAAARPAYVVRTGWGDHGNGAYSHDGGRTWAPFEAQPDIAKDAPGPIATSADGGTLLWSFVHWDGTTYAAHRSTDNGASWSEVSSFPKGATPVADPADPTRFYAYDFDNGTLYASTDSGRSFTARAGGLPSGDSQFKLVAAPGRSGDLWLSAKWNGLYRSTDGGDTFARIDSCWASYTLGFGKAADGADYPAIYQVGSTETITAVYRSDDAARTWVRINDDAHQWGWIGEAVVGDPRIHGRVYLATNGRGIQYGEPV

SEQ ID NO: 10112 - protein, 311 aa, Streptomyces avermitilis
VSTVTEQRPKAPGRWAAPPRPVWEEEPGKAGLAGKGIALAGACLGVLFPLWIVIVTSLSSKKVISDAGGLVVIPKGISFIAYQELLSGGQVTCATLVSLGVTLVGTLFSMTVSVLAAYGLSRIGSVGHRWFLMTLLATMFFGAGLIPTYLLVQSLGLTDTYLALILPSAISVFNILVLRGFFMGISQELVDSARIDGAGDWRILWQIVMPLSRAVIAVITLFYAVGYWSAWFNASIYLSDQDMMPLQNVMIQLVQKQEPPVGMGQAIKTGQVSALAVQMAVMVLALLPVAVLSPFVQRHFKKGMLTGAVKG

SEQ ID NO: 10113 - protein, 361 aa, Streptomyces avermitilis
VAHSTTPGAAARTDPSSATDTAEPSDGGSGSAKAARPAAVSKASKKALKKASEGGTLRTRLKRDRTLILMTLPAVLLVLVFNYIPILGNVVAFQEYDPYISDNGFVAIFESPWVGFEQFTRILDDSAFWNAVQNTFVLFSLQLLLFFPIPILLALLINSVIRPRVRAVSQAILYLPHFFSWVLVITVFQQIFGGAGIIAQTLRQHGYEGFDLMTDPGIFKFLVTSEGVWKDAGWGIIVFLAALASVSPDLYEAAAMDGAGRWRRMWHVTLPALRPVIALLLVLRVGDALTVGFEQILLQRDAVGPGASDVLDTFVWWNGVRNQDFSYAAAAGLIKGVVSLGLVLAANKVAHLMGEQGVYKK

SEQ ID NO: 10114 - protein, 560 aa, Streptomyces avermitilis
MTPNSATSAPSRRSFLASTAVAAAAVAGGMPLLAACGGSDSGSKEGTTSGKGAQKILPAFVAQNVVTPDIASKNGSALGFTSELSLADLKTSVPRKLGKGSTIKIMSPFWGSPPKSSNPYYSAMNAKIGANIVWQNQDGNTYDEKLGAVLASSDMPDVVVIPSWNMGGKIPSAIISKMADLGPYLSGDKIKDYPNLAAIPSDAWQYSIFGGKLRGLPQPAPTVPGIVPFYRKDVFDDKGYELPTTADAFLALAKEITDAKAKVWACDDMKWTAFGIFGVLSGSEKPLGWNLVDGKLIYRVETDEYLEALEWTRKLYAAGVVHPDAKAKNQGNAGQRFTDGQVLMYNQNISDWWGKMAEQATQNKDFRIAGMDIFGHDGGDPQLWCGSPAGIFAFINKKASKAVIHDVLAAANVTAAPYGTKEYMLTNYGVEGTHYTVKDGMPVKTDQGNLEVLNAYVMLASPAPTIAHPDFPDIAKEQVEWQQRMGAFTKKSSFFGLQVTEPARYTNLSNDFEDLEDDVVRGRKKISDMQQAVSDWKSQGGDKLRDWYKKLLDDSGSAQG

SEQ ID NO: 10115 - protein, 954 aa, Streptomyces avermitilis
VTAQTPPTPSFRDPRLPFAKRVDDLLARLTLDERIAFLHQFTPAVERLGIAAFRTGQEALHGVAWMGPATVFPQAVGLGATWNDDLVRRIGEAVSAETRAMRARDDRVGLNVWSPTVNLLRHPLWGRGEEGYSEDPRLTSAIATAYTRGLRGDHPTYWRTAPVLKHWLAHNNETNRDTTSSSVRPRVLHEYDLRAFRETVEAGAVAGVMPAYNLVNGRPNHVSPYLREHLRTWTDQELLVCSDAGAPSNLVDSEHYFDTHEEATAAAVLAGVDSFTDHGTDSSKIVERVRGALVQGLLSEADIDEAVRRQLAIRFRLGEFDPRLDPYAGTLDFDTAAHRALARESAEQAVVLLKNEGLLPLGPEVRIAAVGLLADECKLDWYSGTLLHRSTPLEGLYERFGADRVNFAEGVDRVRLRTSSGAFLRVPVAENAAEVTADEARGAEGALDPALLAGRTDLPPLTTDAVGSELALIDWGEGVLTLRAPDGRYLSVADDGYVRASADQPGGWVVQETFRLEPSESHDNGHLLKHTGTGRYVCVAADGVKVAAQEPRDAEIFELESTERGEDAVTRVAAAADVVLVFAGNDPHINGRETEDRTTLRLPAHQERLLRAARAANPATALVLVSAYPYAVDHADLPAALWTAHGGQAAGTALARVLSGDVSPAGRLPQTWYADDADLPGLLDYDVIGSRQTYLYFEGTPLFPFGHGLSYASFAYEGLEHRTDEDTVRVSFTVTNTGSRAADEVAQLYIRAVDPSVPRPRRELAAHRRLRLAPGASAELAFALPSAAFAFWDVAHGRRRVEPGSYELLVGASSEDIRLRTTIELTGEAAAPRAVRALGLKAADFDDQRNTEIVDRTKVSGDAVTPLDGGTGELVFRACDFGAGVSGVSADLAGEGVVEISLAGGPPPAVLTLPPTKGPYDYTTVTAAFAADGVHDVHLRLRGPLRLAQVGFSG

SEQ ID NO: 10116 - protein, 481 aa, Streptomyces avermitilis
VAATHAFWLAGRQATGETTFDVTSPWDGRLVGKVSVPTEAQTEEAVAAAYAVRDEFAATPAHVRAAALDHVSKRLVERTEEIAQLISAENGKPIKWARGEVGRAVSVFRFAAEEARRFNGGEAQRLDTDAGGQGRLALTRRFPKGVVLGIAPFNFPLNLCAHKVAPAIAAGAPIILKPAPATPLSGLVIGDLLAETDLPAGSWSILPVSNDRMPALVQDERLPVISFTGSEKVGYAIMDSVPRKHCTLELGGNGAAVVLADYASDADLDWAAGRIATFSNYQGGQSCISVQRVIADASVYERLLPRVVAAVEAQVTGDPSDDATEVGPLVSEDAAKRVESWVDEAAQAGARVLTGGKREGASYAPTVLVDVPADVTLSCEEVFGPVLTVQKVEGEAAAFAAVNESKYGLQAGVFTHDLQAAFRAHRALEVGGVVIGDVPSYRADQMPYGGVKQSGVGREGVKFAMDDYTYERVLVLTGLAL

SEQ ID NO: 10117 - protein, 360 aa, Streptomyces avermitilis
VERLRERPAPASAVVGAPDNEDRVELHSLGTGRRPRAALAVGTAAALGTAERYAVHSAIALLTLTTERSRSLHAAEQRIGAAVLRMLLAGESDHARAVAGDLYGALLDAPFRLILAESASASAARAHADRHARVAPTKRSPAAVAVPETNGDPLGGLAEIVESAAARSGESVLLVPDGERLVVLAVDGGAAVAACGEYAAALEAARAATREQPVTDEDELVVGLSAPAGPIAAGAAYKQAEQALSVARRRGRFLVEHEELAAGSVLPLLADDAVRAFADGLLRALREHDATGRGDLVASLRAWLSRHGQWDAAAADLGVHRHTLRYRMRRVEEILGRSLDDPDVRMELWLALKTTAAAGE

SEQ ID NO: 10118 - protein, 259 aa, Streptomyces avermitilis
MPPTLASLVHHSALKLTVRAGEDRLDVPVRWAHVSELADPVPYMEGGELLLITALKLDAEDPEVMRRYVKRLAGAGVVGLGFAVGVNYEEIPEALVDAADKEGLPLLEVPRRTPFLAISKAVSAAIAADQYRAVTAGFAAQRELTKQALGGGAEGLLTALAGQVDGWDGCCTTPRAPSSPPHPSGRADGPPGSPRTWSGCGSGRRPRARWSARPTTRTASSCTRSAPAAGRAPRSPSARPPPSAPPSGTPCTPRSPCSR

SEQ ID NO: 10119 - protein, 813 aa, Streptomyces avermitilis
VHGAAGQGARAMDSDGTQDARGTHATPVPRPAAPPPPVPPMPRGAPPVPEQAPARPATVADWLDEPRPAAAPGIWRYGYRVPRPAKGAQRLSPVTIVGLAVPLVVALIVWSLWRHGSVPYQWIVLKLFTPDDWWWGGTTAPKTWQGQEAIEVYTGVFFAVLVYAMGRLGSWSDVVRHYVTRRPQPARALLAALGALLTLTFVFPRAFPGVGWDALPVVAPLFSVTALLTGGYEVFQSQLVTDGLYALITLLVLWPFARIGDWWPFARERLAARGRGRAPETPAAPRPPAQWPELHDAGQHQAADLLSGEVLSGRMNDVDCARVRHAWNAAKRDGARLAAFSDTVLRRGAAAWVHPSGARDLPARTARHDVLEGQVRIGRWSAGDRTPLVYRGAGAALDAETLGTSLLAVGPSGSGKTRQLVRPLVESLTLRALTGRCAVVVVAAAGTPLGPDSAFDVVVKIGDPSSVHDLDPYADSDDPDEVASFLAEGLVGDLDTVDGRRAATALAQLLGPYRAVHGRFPALPVLRELLEGEPAALSSLREALAGDEHAVMRRELDARIRQAGSAADAGPALADRLALLDRPVFAAFFGGGGTDSGIRPFSLRSVVHHPLRVRVDLPERGHEEASRLIARLVLAQFTAVVRGGERAGERAHFVCLVLDDATGTPTTESVRGMQRLRSQNAGVVLALRTIGDVPEALHGPLYGAVGCRMAFSGVTTWDGSRFAHAWGTEWVETRDVAQHTVFADQPMTRAIHALRKLVTGKAVTTDAVTVRQVERERWSASELAHEVPPGHAVLSLTSVAGEHAPPLLVDLRG

SEQ ID NO: 10120 - protein, 444 aa, Streptomyces avermitilis
MSALPQERRVVTAIPGPKSQELQARRTAVVAAGVGSVLPVFTTRAGGGIIEDVDGNRLIDFGSGIAVTSVGASAEAVVRRASAQLQDFTHTCFMVTPYEGYVAVAEALAELTPGDHAKKSALFNSGAEAVENAVKIARAYTKRQAVVVFDHGYHGRTNLTMALTAKNMPYKNGFGPFAPEVYRVPVAYGYRWLTGPENAGAEASAQAIDMINKQIGADNVAAIIIEPVLGEGGFIEPAKGFLPAISKFAKDNGIVFVADEIQSGFCRTGQWFACEDEGIVPDLITTAKGIAGGLPLAAVTGRAEIMDAAHAGGLGGTYGGNPVACAGALGAIETMKELDLNAKAKNIEAVMKARLGAMAEKFDIIGDVRGRGGMIAIELVKDRDTKEPNPEAAGALAKACHQEGLLVLTCGTYGNVLRFLPPLVIGEDLLNEGLDIIEQAFSRI

SEQ ID NO: 10121 - protein, 274 aa, Streptomyces avermitilis
VDGFGPRPPQLRPGRALAHTPGASGSGSPHRSDGRTPQTPRGGRHTDLDGRPGTTPPVPGRPTFLLGLSALLLALITWQVAAHGPLARADERLSGTLVRPGRFSELLADLGNATVAVPVLAVVLVYVAVRDRRAGADRWWLPSTAAALLVAALPALIVPLKELIARPGPPVMGPGTGFYPSGHTATATIAYGTAALLLLPRLHATWARRTVLAASVTLNLAVAVGLIRRGYHWPLDVVASWCLGALLLTALAMFLSRSTGRSSAGTPSSRTGPS

SEQ ID NO: 10122 - protein, 609 aa, Streptomyces avermitilis
VDRTRRTVPRPRRHRLLAVGAAAVLAVPAMTALSSAARAADADLARNGGFESGLNAWTCAADSGKTVNSPVRSGGSALQATPAGSDHAQCAQTVTVKPDAQYTLSGYVRGSYVYLGASGTGTTDVSTWTQSAPDWQQLTTTFRTGPSTTEVTVYTHGWYGTGAYYADDISLVGPGVDAGQPPAAPTGLKAGTVTSTSVALSWSAVPGATGYAIYRDGVKARSVTGTSATVTGLSPATAYGFQVAAVNDAGESAKSATVPATTSAGSGGGSTDLPAHALVGYLHASFANGSGYTRMADVPDSWDVIDLAFGEPTSTTSGDIRFTRCPVTECPNVENDADFKAAIKAKRAAGKKVLISIGGQNGQVQLATTAARDTFVSSVSKIIDEYGLDGLDIDFEGHSLALDASDTNFKSPTTPVIVNLISALRTLKARYGSTFVLTMAPETFFVQLGHQYYGTGKWGGQDPRAGAYLPVIHALRDDLTLLHVQDYNSGPVMGLDDQYHSMGGADFHIAMTDMLLTGFPVAGDANNVFPPLRPDQITIGMPASTNAGNGHVSPTEVNKTLNCLTRKTDCGSYATHGTWPALRGLMTWSINWDRFGSWEFQRNFDQYFG

SEQ ID NO: 10123 - protein, 69 aa, Streptomyces avermitilis
VMLDLLAGERTERTELEMVRRKPLPFPPEPFAWTGIALTKWSLARADAHGGRRNLWLKAMDRLGLGFDS

SEQ ID NO: 10124 - protein, 511 aa, Streptomyces avermitilis
MAPSAMSRWTTSLSEAQPVPYWLDDPGRPRPEPALTGAETCDLLVVGGGYSGLWTALLAKERDPGRDVVLLEGREVGWAASGRNGGFCAASLTHGLANGLARWPDEIGKLEELGARNLDEIEAAVARYSLDCDFERTGEIDVATEPHQAEELRAWYEKLRRKGLADGIDLLDAGAVREQVDSPTFLAGLHDRGGVAMLHPAKLAWGLKRACLGLGVRVYEHTPALNLEAYGAGMAVRTPYGSIRARRVALGTNIFPNLIKRVRAYTVPVYDYALMTEPLTDDQLAAVGWKNRQGTRGQRQPVPLLPALRRQPDPVGRLRRDLPLRRPGTGRVRRPPRDVRQARRALLHLLPAAGGRPLHARVGRRDRHLLALLGVLRHRAPGKGRVRGGLHGPRRRGDPVRRGRDAGPAGGGAHGAHRAGDGPQEAAALPAGAVRLDGHRAHQVVAGTRGRARRPAEPLAEGHGQAGSGLRQLTLAVARGRVAFRSNGVRPAPPLCPGSHRSLTAGNRRRS

SEQ ID NO: 10125 - protein, 266 aa, Streptomyces avermitilis
MPFVRWLKHHLVVIAGLFTLGYLLLPNVVVTVFSFNKPKGRFNYEWQQFSTEAWRDPCGVADMCGSLSLSLQIAFWATVGATALGTMIAFALVRYRFRARGAVNSLIFLPMAMPEVVMAASLLTLFLNMGAQLGFWTILIAHIMFCLSFVVTAVKARVMSMDPRLEQAAQDLYAGPVQTFLRVTLPIAAPGIAAGALLAFALSFDDFIITNFNAGSTVTFPMFVWGSAQRGTPVQINVIGTAMFLVAVLFVLAGMVVGNRRNRQKA

SEQ ID NO: 10126 - protein, 314 aa, Streptomyces avermitilis
VMTSLADAPPPLAPPAAEKPPRSPKARKRGRLVPYWLLLPGLLWLVVFFALPMIYQASTSVQTGSLEEGFKVTWHFQTYWNALSDYWPQFLRSVLYAGAATLLCLLLGYPLAYLIAFRAGRWRNVVLILVIAPFFTSFLIRTLAWKTILADGGPVVGTLNSLHVLDVTNWLGMTAGDRVLATPLAVVCGLTYNFLPFMILPLYTSLERIDGRLHEAAGDLYAKPFTTFRKVTFPLSMPGVVSGTLLTFIPASGDYVNADLLGSTDTRMVGNVIQTQFLRILDYPTAAALSFILMAAILIMVTLYIRKSGTEDLV

SEQ ID NO: 10127 - protein, 387 aa, Streptomyces avermitilis
VTTMNNTDNSGDVRLSGISKTYGSFTAVQPLDLTVPQGSFFALLGASGCGKTTTLRMIAGLEEPSSGTVFLGDQEVTHLPPYKRPVNTVFQSYALFPHLDIFENVAFGLRRRGIKSVKKQVEDMLDLVQLGEQARKKPHQLSGGQQQRVAVARALINHPKVLLLDEPLGALDLKLRRQMQLELKRIQTEVGITFVHVTHDQEEAMTMADTVAVMNAGRVEQLGSPADLYENPNTTFVANFLGTSNLIEAEVDSKGGDEIVLRAGGGKLTLPTARCSAATTTGGKVLVGVRPEKISLTHADDAGEIPAGRNRITGKIADSSFIGVSTQYVIDSAVCPEFEVYAQNIDRDSRLTPGADVVLHWNPAHTFGLDAAQDIDAGVETVEEEAA

SEQ ID NO: 10128 - protein, 415 aa, Streptomyces avermitilis
MEQYEPDRLSPAQLAAVRRSFRNGRASLTRRSLLRASAGGALAVGGLGALSACGIPAAGRTEGGVSAEDHSAEEKTINFSNWPEYIDVDDSGKRHPTLDAFAKRTGIQVKYTEDINDNDEFFGKIQPQLAAGQSTGRDLIVLTDWLAARMIRLGYVQKLDPSHLPHAFANLSDQFRAPDWDPGRAYSYPWQGISTVIAYNKKALDGVEVKSVSDLLDNPKLKGRVGFLTEMRDSVGMTMLDMGKDPAKFTDDDYDAVIARLQKAVDKGQIRRFTGNDYTSDLSKGDFAACIAWAGDIVQLQADNPDVGYVIPDSGYMTSTDNMLIPNKARHKTNAERLIDYYYELEPAAELAAYINYVSPVAGVQPYLAKIDKSAADNPLIVPDKAMQAKSHAFRSLSSKEETAYQQKFAKLTGA

SEQ ID NO: 10129 - protein, 507 aa, Streptomyces avermitilis
MHNPGHRFQAQDRFADGAQYIAGRFAKGTSGRRHAVVDPATGEEVYRYELAGTADVDAAVAAARAAFPGWAATTPGDRSDALHRFAAVLADRAEEFARAESLQCGKPLKLTREFDVPGTIDNTSFFAGAARHLQGQSAGEYSGDHTSYIRREPIGVVGSIAPWNYPLQMAAWKVLPAIAAGNTIVLKPAEITPLTSLLFAEAATRAGIPDGVVNIVTGAGRDAGEHLVAHPDVAMTSFTGSTAVGRRVAEIATSTVKRLHLELGGKAPFVVFDDADLDAAVHGAVAGSLINTGQDCTAATRAYVQRPLYEEFVARTAALMETVRLGDPFAHGTDLGPLVSHAQRDRVAGFVDRARAYARVVTGGEIPEELKDGAYYRPTLIADAAQDSEIVQSEIFGPVLVVLPFDSDDEGIRLANDTPYGLAASAWSRDVYRANRATREIKAGCVWVNDHIPIISEMPHGGYKASGFGKDMSAYSFEEYTQIKHVMFDNTAIVRKDWHRTIFGDRP

SEQ ID NO: 10130 - protein, 195 aa, Streptomyces avermitilis
VVRARLACMGKIDSWEALVREVHAGARIKYLHFWGHRPRPDGRVGASCLSQWWPSPFTVDGVEYTTAEHWMMAAKARLFGDEEAQRRAIEAPTPAHAKKAGRLVRGFDEAIWARERYGIVVEGSIHKFAAHMDLQAFLLGTSGRVLVEASPLDRVWGIGLAADDERAGDPDRWRGPNLLGFALMEARERLAAGDR

SEQ ID NO: 10131 - protein, 108 aa, Streptomyces avermitilis
MPLPPSNGMGTAALVLGIISTVVFCLWPLAIVMGVLSVVFGVIGRRRARRGEATNAGQALAGIICGAVGIVLGVAFMVIIFAAAESSSDPWSTTDDSYSTSLVVHADR

SEQ ID NO: 10132 - protein, 358 aa, Streptomyces avermitilis
LTEHFDARGTRDAQTGRDLHSFIAGLPKAELHVHHVGSASPRIVSELAARHPDSSVPTDPEALADYFTFTDFAHFIKVYLSVVDLIRTPEDVRLLTYEVARELARQQVRYAELTITPFSSTRRGIDERAFMDAIEDARKSAEAEFGTVLRWCFDIPGEAGLESAEETVRLATDDRLRPEGLVSFGLGGPEIGVPRPQFKPYFDRAIAAGLRSVPHAGETTGPETVWDALTDLRAERIGHGTSSAQDPKLLAHLAEHRIPLEVCPTSNIATRAVRTLDEHPVKEFVRAGVVVTINSDDPPMFGTDLNNEYAIAARLLDLDERGLAGLAKNSVEASFLDAAGKARIAAEIDTYTAAWLAP

SEQ ID NO: 10133 - protein, 226 aa, Streptomyces avermitilis
MRTVTAVAHRGDPYRVRENTIDSLRSALRQGADAVEIDVRLTRDGVPVLLHDETLKRLWEQDRPLRSLSWDEVRGLTDGGVPTLVDALAATGESRVMLDLPGAGPRAVRRIVDVIREYGAEERVYYCAGAPAMLAVRAADPAAEIALTWTTLAPPRPALLDAVRPRWLNYRFSLVDRELTARVHREGYLLSAWTPDTRRSMRRLLDMGVDAITTNRIDALCALRKD

SEQ ID NO: 10134 - protein, 634 aa, Streptomyces avermitilis
VPTCCRSPRGGWSESSSAGGKTVIAEGGTPSPVVSEDSTRGVRGLHEPTVTCGIAHGQVQPGSGHPALISAPSKGTYVDGRQWHSTIAAAQAGDREALDELVAGWLPLVYNVVGRALGGHADVDDVVQETMLRAVDHLGSLRDPDSFRSWLVAIAMRQIRDRARRRTAEPLTDGAGDQAVDFAELTVLRLQLEGQRREVAEAVRWLDAEDRQLLSLWWLEVAGELTRRELAAAVGISRQHAAVRVQRTKARLETARGIVRALDSSCPELRDMTARWSGRPDSVWRKRLARHIRGCGYCAGPGEAVVPAERLLAGIALVPVPAGFTLSLALGGKPAAAATAASAGWSAKVLGVLGKPAVAVTAGATFAAGGVYVVTQTPDHPPRRAVAAPTAASTARPPSVTRSASPSPSRTTSPSPSPSKTRVPLYGTVVDAVDSAPSADTPPKVLPRRAEKGVTATGAPATGLTHRGETVTLSGEGYFRVRWQIQPKERPGSVAMPAWTGLDGRLFHVASGGGHRMDDPQPGTTDGTTWMGGPATGLAVLPSGTQQMWQNEYFWIDGTVTLHQNERGADYNLFVETSSWGKAAQDVRTGPEQGAVRYGLVRDNGKDTAPVPQYLTRSAPADPATVRQRSRVTP

SEQ ID NO: 10135 - protein, 194 aa, Streptomyces avermitilis
VKWPGMLFERVQVGGYAPVMSDRVALLKGIRGWLVVFVVCLVLSGATAFPLVHELRWTEDLLRSLSVPDRLPGLMDWIERVRRGLDATDAKYPFVLYGTDWLAFAHLVIAVAFYGPYRDPVRNIWVVEFGMIGCAGIVPLALICGPIRGIPFWWSVVDMSFGVFGVIPLYVLRKKIKRLEALTAAPPAAAVVTA

SEQ ID NO: 10136 - protein, 166 aa, Streptomyces avermitilis
LTSRWLDGTVEDVATPDELERQYTLLSAAARFDALRTRDALAPPPDDVDDVDDLGDGGGGDGAEPDEATGSAAPLTREEALELLALGEVLARKAAYGRQLSVRSARRAGASWSQIGAALGTSKQAAWEAHNRWIDEQAKQDREAGHWGLNDKEIDAARTLAGELDN

SEQ ID NO: 10137 - protein, 842 aa, Streptomyces avermitilis
MFERFTDRARRVVVLAQEEARMLNHNYIGTEHILLGLIHEGEGVAAKALESLGISLEAVRQQVEEIIGQGQQAPSGHIPFTPRAKKVLELSLREALQLGHNYIGTEHILLGLIREGEGVAAQVLVKLGADLNRVRQQVIQLLSGYHQGKESTVEGGPAEGTPSTSLVLDQFGRNLTQAARESKLDPVIGREKEIERVMQVLSRRTKNNPVLIGEPGVGKTAVVEGLAQAIVKGEVPETLKDKHLYTLDLGALVAGSRYRGDFEERLKKVLKEIRTRGDIILFIDELHTLVGAGAAEGAIDAASILKPMLARGELQTIGATTLDEYKKYLEKDAALERRFQPIQVAEPSLPHTIEILKGLRDRYEAHHRVSITDEALVQAATLADRYVSDRFLPDKAIDLIDEAGSRMRIRRMTAPPDLREFDEKIAGVRHDKESAIDSQDFEKAASLRDKEKQLLAAKAKREKEWKTGDMDVVAEVDGELIAEVLAASTGIPVFKLTEEESSRLLRMEDELHKRVIGQKDAVKALSKAIRRTRAGLKDPKRPGGSFIFAGPSGVGKTELSRALAEFLFGDEDALISLDMSEFSEKHTVSRLFGSPPGYVGYEEGGQLTEKVRRKPFSVVLFDEVEKAHADIFNSLLQILEDGRLTDSQGRVVDFKNTVIIMTTNLGTRDISKGFNLGFAAQGDSKSTYERMKNKVADELKRHFRPEFLNRVDDVVVFPQLTRDDILAIVDLMITKVDERLKDRDMGIELAQSAKELLAQKGYDPMLGARPLRRTIQREIEDTLSEKILFGELRPGHIVVVDTEGEGETKTFTFRGEEKSALPDVPPIEQATGGDRPGSGTES

SEQ ID NO: 10138 - protein, 197 aa, Streptomyces avermitilis
MAAMLELAILGFLAGGPLHGYELRRRIAQLSGHTTPVSDGSLYPAINRLVKRGLLDRRVEPGAAAAQRYVLSLTEAGHAELLQRLRHPADQAITDGSQFFTVLAFLSRLPDIADQHAVLRRRLAFLEEPASFFYDGDRPVRAEEVADPYRRGMMRVARATSRAERAWLHEVLDTPDQAGPGDARTANGAATPDEHVD

SEQ ID NO: 10139 - protein, 145 aa, Streptomyces avermitilis
MTEHTLRSVSVERTSTGHFTATNVRGGTIGFGTGSDPGDTDFTPVELLLAAIGGCTAVDVDVATSRHAEPTGFAVTVTGNKISDELGNRMTDLVVTFSVAFPDGEPGDRARAILPRAVKSSHDRLCTVSRTVEIGTPVTARAADT

SEQ ID NO: 10140 - protein, 411 aa, Streptomyces avermitilis
MAGRPGVVRGTTVGGMDGDRRGWRQCLLSGAVFAVCMVGTTLPTPLYGLYQEKFGFSELTVTVVYAVYAFGVIGMLLLAGNASDAVGRRPVLLAGLGFAAVSAVCFLCATGLGWLYAGRLLSGLSAGLFTGAATVYVIDLAPYGGASRATFVATAANMGGLGCGPLLAGVLAQYAAWPLYLPFVVHLALVAGSAAVLLWLPETVREPRPLSTVRPQRPALPSQVRAVFVPAATASFVGFALFGVFTSVSPAFLEQSLGVDNRAVVGLIVALAFFASTAGQLMVGRVGVGRSLPLGCAGLFAGLALLAGALRWDLLSLVVLSALVGGGGQGLAFRGALSAVAEASPADRRAAVISTLFVVAYVGISVPVIGVGVLTGPIGLEGAGLVFIACMAVLVSTAAVYLLRRPVRART

SEQ ID NO: 10141 - protein, 931 aa, Streptomyces avermitilis
MRRGPLNRTRRIGVTALAVLAALAGSPGLAQAQQPPQAKPLTAEADSPLPPGWRVTGEGVARELVWRSDRAVPVGDARVEFHADGRLLGVPKAAKDGHTFRLALGRATPLKDLQVLAAGRRLDAPAGTTGTKKPRNSAAAAQPPARLPANSVDPGRPGSYRTVTGEYDLDPVKLPGFAQPVEMQAVVVAPEGATGKRPLALFLHGRHTTCFKPGGSEDDVTIDWPCAAGTQPIPSHKGYLKDQKLLASQGYVTVSISANGINGQDGDAEDGGAQARSSLVRQHLAKWAGWAAHPGSAPAGVPDAAEADLSRVLLVGHSRGGEGVNRAAMDSLYPPPAAQDGYRGPVRWKIRGTVLIGPTIFGQNPVADVPSTTILPGCDGDVSDLQGEVYVDGTRGVSRGTALHSAVYVVGANHNFFNTEWTPGKSEAPSSDDFWDDPEGQPDPVCSTGTRTRLTADRQHQAGATYIAAAARLFVAGDDRVRPLLDGSGRRAPSADPARVLTHAVGARRTGGFLPDAPVKVTGGRLCSAVDPDPARACLNPDTNGSSPHFAGWQTEKETGRGAVALKWSTPGTAAKVRPAAPVSLSGAKSLALRVFVPPNATGTKLDVAVTDSSGRRAKLGRVQADGLPGSERTASYWARELRVPLTAATRAGLDLRHVKSLELTPRSRSGRAWLMDAWGWAPGTPAARAATLPRVDIGRLSVKEGDSGTRTYHIPVQVSGHGSGKVRFSVLDPGTGRAKDKLITVRPGSNPIDVPVKVKGDTRFGYDEQNDLIAKAVRGAVIGSYRGGVTAVNDDPAPAVTMTPVTDRVTEGGTLTWRISLSEPADVDVWQPVRALPVTEGAELSTKDVDPQWLTDHTGDLPDPERALSKANVWVWTSIPAGATTADFVVPTVKDQLAEPAESVRLALTDDNAEPLPDHPVRTGTVVDAP

SEQ ID NO: 10142 - protein, 308 aa, Streptomyces avermitilis
VQHPIALAPMGGSAGGALAAAVSRGGGLGMLGAGGGDREWLARELPLVAQAGGRPWGIGFQTWAIDRSTVERALEHTPRAVMLSFGDPSPFAECVRAAGAVLIVQVTDLDEARQAVDLGADVIVAQGTESGGHGARQGRSTLPFVPVVVDLAAPVPVLAAGGIADGRGVAAALALGAAGALVGTRFQATTEALVDPSTAKAIVEGHGGDTERNRVLDIARGSRWPSKYTARTLGHPYLDRWRGREAELAGDPRARQDYQRDVAQGNIPSLPVWAGEAIDLIKDLPSAADLVATLAAQAEDALTRAGRR

SEQ ID NO: 10143 - protein, 347 aa, Streptomyces avermitilis
MERAGPAEPRNVPSPGPRDECVSIRNLVARLRADYPSADAVTVEVTVRTAYDVFGVANLAAGLFQGFPVSTSGSRTAVAERAGARSQLTGVVGAALIVLMLVLAPGLFRNLPQPALAAVVITASLSLADIPGAVRLWRQRRTEFLLCIAAFAGVALLGVLEGIAIAVALSVLNVFRRAWWPYNTVLGRVQGLEGYHDVRSYPQAGQLPGLVIYRFDAPLIFANAKAFRDEIRRLADADPRPSWIVIAAEPMTDVDTTAADVLEELDETLNANHVHLVFAELKDPVRRKIERYGLTRTIDPRHFFPTVEAAVAAFRLRTGAEWTPLTTAEQPARPKPDTAAPPPADER

SEQ ID NO: 10144 - protein, 105 aa, Streptomyces avermitilis
MPDLTTWPKGMRLIVRKERPHPGAQLRFTDLDGLRLTCFATNTQAASSPTSNCATADRPAARTASETPATPACATCPCTTPHRTGSGWRSSPSHSTSSPGCRCSH

SEQ ID NO: 10145 - protein, 158 aa, Streptomyces avermitilis
LAEGDAADRQKGTPAPRRPVALHRPRRTAADLLRHQHPGGQLADLELRHRRPSRCEDRIRNARDTGLRNLPLHDTAQNRIWLEIIPLALDLLAWMPMLALTGQTRRWEPKKLRLRLFSAAAQLVNTGRRHRLRFAVRWPWTDVITHAIGRLHSLPIPG

SEQ ID NO: 10146 - protein, 396 aa, Streptomyces avermitilis
VPQTPRTPSLSRRSLLRALGGTTALGALAGCGVPAAYVQPGDRAAADLSVSDKRLTWANWPLYIDTDDKDTTRRPTLEAFEKRTGISVDYVEEINDNDEFFGKISPSLMNHQQTGRDLIVISDWMCARFVRLGWVQEMDRARQPNVARYLDPLLRSPAFDPGRTFSVPWQSGITGIAYNRRKLGREIKHVSDLWASDLKGRVTLLSGLDEAFALLMQGNGVDITRWTADDFHRVCDQVEKHVRSGQIRRFTGNDYIKDLSSGDVLACQAYSGDVIQLQADDPDIHFVVPQEGAELWAESLMIPNLARHKANAERLIDHYYEPAVAAELAAWVNYVCPVPAAQDILASSKDEDTAALAEDPLIFPDASMRGRLAIARDITSTERVEFAKRWNAIVGL

SEQ ID NO: 10147 - protein, 479 aa, Streptomyces avermitilis
VSTELRRLRNHIDGEFRDAADGRTTEVVNPATGEAYATAPLSGQADVDAAMAAAAAAFPAWRDQTPAERQKALLKIADAFEERAEELIAAEVENTGKPIGLTRSEEIPPMVDQIRFFAGAARMLEGRSAGEYMEGMTSIIRREPIGVCAQVAPWNYPMMMAVWKFAPALAAGNTVVLKPSDTTPASTVLIADIIGSILPKGVFNVICGDRDTGRAMVEHPTPAMASITGSVRAGMSVAESAAKDVKRVHLELGGKAPVVVFEDTDIPKAVEDISVAGFFNAGQDCTAATRVLVQESIHDEFVAALAKAAADTKTGQPDDEDVLYGPLNNPNQLKQVAGFVERLPAHAKVEAGGHQVGEKGYFYAPTVVSGLKQDDEIIQNEVFGPVITVQSFTDEAQAIEWANGVDYALASSVWTKDHGRAMRLSKSLDFGCVWINTHIPLVAEMPHGGFKKSGYGKDLSAYGFDDYTRIKHVMTSLDS

SEQ ID NO: 10148 - protein, 166 aa, Streptomyces avermitilis
VASRSADQRDSRESRNGTPQLDAVSLAIIGQLQEDGRRPYAAIGKAVGLSEAAVRQRVQKLLDQGVMQIVAVTDPLTVGFRRQAMVGVHVEGDLDPVADALTAMSEVEYVVMTAGSFDILAEIVCEDDDHLLDVINKRIRALPGVRSTESFVYLKLKKQTYMWGTR

SEQ ID NO: 10149 - protein, 459 aa, Streptomyces avermitilis
VGNPIAVSKDLSRTAYDHLWMHFTRMSSYENAPVPTIVRGEGTYIYDDKGKRYLDGLSGLFVVQAGHGRTELAETAFKQAQELAFFPVWSYAHPKAVELAERLANYAPGDLNKVFFTTGGGEAVETAWKLAKQYFKLQGKPTKYKVISRAVAYHGTPQGALSITGLPALKAPFEPLVPGAHKVPNTNIYRAPLFGDDPEAFGRWAADQIEQQILFEGPETVAAVFLEPVQNAGGCFPPPPGYFQRVREICDQYDVLLVSDEVICAFGRLGTMFACDKFGYVPDMITCAKGMTSGYSPIGACIVSDRIAEPFYKGDNTFLHGYTFGGHPVSAAVGVANLDLFEREGLNQHVLDNESAFLTTLQKLHDLPIVGDVRGNGFFYGIELVKDKATKETFTDEESERVLYGFVSKKLFEYGLYCRADDRGDPVIQLSPPLISNQSTFDEIESIIRQVLTEAWTKL

SEQ ID NO: 10150 - protein, 245 aa, Streptomyces avermitilis
MVAPPDNDVLWARTLHFTHNGSPALNGVSLGVRVGEILAVTGPRGSGKTTLLQCLAGLLPTQRGEVWFNSTPVHTMGPLTRERLRRDRFGWIDPAPLLVPELNVWENAALPLMLRGTGRRRAKATALEWLERLDIGDCARKRPYALVQAERQRVAIARALAPAPTVLFADEPTAPLHSADRAHVLRTLTTAARSHGITVVLATDDADTAALADRTVALRDGRRVHTVHLPPVAETEGRAACSLSV

SEQ ID NO: 10151 - protein, 464 aa, Streptomyces avermitilis
VLALRLARGAHPLVQLRRLLVTAAAAGTGFLLLGTLGYAMAHPDASARSVLRLAWCVAPMAATVYFAVAVARTDPGTRPRPGLSAIGLGPVRLMAVSAVTTALSTTLGSMLALLFFLHLRGDLTGMPFDGAAAEFLAADQPLPLPGALTLLALVPLAASVTSALVLRPRGEKQARMSGTSTTAGTSPTIGTPLTAGASATAGTPTTAGTTPTADTPPAADTDSTSTAPGTAADSPTPSAAPSSATPHDVPAEPLDPQRPAVPQPAPGGLPWSVAVLAAGLAVEMYASQSGPAPGLALPGRFADGPAGVLAGWTLTAMGLVLAGPAITYLCGWLLQALRPGALRLLAGRVLQEEARRIGQPLGVVCAVASGAYATATLYAGARPSFGPLSTLGALLVTGCTVATLVTAAVEAKHARAETTAALLRLGAPATMLRSAALLRAGALVAVFVPLTWAVAELAAMPLTG

SEQ ID NO: 10152 - protein, 135 aa, Streptomyces avermitilis
MYQQMIFVNLAVDDVDASKKFFTELGYTINPQFTTDDCACVVISDTIIAMLLSKQRYADFTKKRIADPTTTSEVLLCLSAESREKVDELVDKALAAGGTSSGETQDHGFMYGRSFDDPDGHTWEIVWMDPAAVQG

SEQ ID NO: 10153 - protein, 372 aa, Streptomyces avermitilis
VQPIPSPTASHDREIESLEEFDEVVSERGSLARYRVQAVDLTARTRALLTMDCAGAVFLGCPMDPEAAARVRATGALVFPPVPGLPFDPYRGRLYTPDELFDSLDTDYEATPDARAYAWFQRTKADGDIFASMVRAIHDDAVSDALDELLVGARVVGVMGGHAMARGTREYEGAARLGRELARAGFTVATGGGPGAMEAANLGAYAAPFGPEMLTEALQLLAKATSFTPSVTEWARAAFDVRERWPAGGPSVGIPTWFYGHEPPNAFAAHVAKYFANATREDGLLARSNAGVVFLPGAAGTVQEIFDNATPNYYESRGEPTPMVLVDRTHWTERLPAWPLLQSLARERSMESRIALVDRIEDAPGALKRLGG

SEQ ID NO: 10154 - protein, 224 aa, Streptomyces avermitilis
VSISRRTARSVRILGVASATAALALGVAGNAMACNISEFSAEAKCDGTKSVITVKDVDPSGVPAVVSVFLENNGADVKKIGEQEVKGSREGVTITFDEAWKPNAEYRIHVKAGNQVDEDIKPNLTTPATACKTETTPPATKTPKPSKKPSSSATPSATPSTSDSSTPPAASDNAPSPAVGESNLAETGANSNTGMIAGIAGGLVVIGGGAVFFGMRRRGASKAG

SEQ ID NO: 10155 - protein, 345 aa, Streptomyces avermitilis
MLLSLKAATVRFGGRAVLDAVDLDVAEHETVCVLGPSGSGKSTLLRAVAGLQPLDEGQVVLGGRAMDSVPPHKRGVGLMFQDHQLFPQRDVGGNVAFGLRMHGASRSEQEGRVRELLDLVGLPGAARRAVASLSGGEQQRVALARALAPRPRLLMLDEPLGQLDRSLRERLVVELRELFTELGTTVLAVTHDQGEAFALADRVVVMRAGRIAQSGTPLEVWRQPADEFVARFLGFDNVVGATVAGEAADTPWGKVPVPEGSPQGPGTLLVRPAGVRLADATEGLRCTVAARTFRGTHVAVHLQPEDDAPRLEAACALRDAPEPGETVGVAFDVADIVVLGGASGA

SEQ ID NO: 10156 - protein, 566 aa, Streptomyces avermitilis
VGQVVDLARTEVEPPARKGLSRGSAARLGLMALPVAFFGVFFAYPVAAIVARGLKADGAWQWGRIGDVLAQSGIQHVLWFTTWQAFASTALTLLIALPGAYVFARFDFRGKQVLRAVVTVPFVLPTVVVGTAFLALVGRGGLLDELWGVRLDTTVWAILLAHVFFNYAVVVRTVGGLWAQLDPRQEEAARMLGASRFAAWRKVTLPALAPAVAAAALMVFLFTFTSFGVVQILGGPTFSTLEVEIYRQTSEIFDLATAAVLTIIQFMAVGAILAVHAGTVRRREAALRLVDASMTARRPRGAGQWALLGAVLATVAVLLVLPLAVLVQRSFDAPGGHGFAYYRALTHDDGGTFLVAPITAIGTSLQYALAATAVAVLIGGLAAAALTRRDAGRLVRGFDALLMLPLGVSAVTVGFGFLIALDKPPLNLRGSWILVPLAQALVGVPFVVRTMLPVLRAVDERLREAASVLGASPWRVWREVDLPMVRRALLVAAGFAFAVSLGEFGATVFIARPDNPTLPVAVARLLGRAGDLNYGQAMALSTILMVVCAVALLLLERVRTDRTGEF

SEQ ID NO: 10157 - protein, 361 aa, Streptomyces avermitilis
VSTTKKFTAAALAAGLGLVTLSACGSSGSGGGDADSKTVTLVSHDSWAASKSVLEDFEKQSGYTVKVLKDGDAGQAVNKAILTKDNPQGDVFFGVDNTLLSRALDNGLFQPYEAKGSGLIRPEYQVDRAKHRVTPIDSGDICVNYDKKYFADHKLDPPASFGDLVEPRYKNLLVTENAATSSPGLGFLLGTAAEYGDKGWPDYWKKLKANGVKVVDGWEQAYNQEFSGSAGGKKAKGDRPLVVSYASSPPAEVIYASPKPKTAPTGVASGTCFRQVEYAGLLSNAKNTKGGKALLDFLVTKEFQEDMPLNMFVYPVVKGAQVPAEFSEFGPAAKSPETLAPAEIADNRDQWVKSWTSLVLK

SEQ ID NO: 10158 - protein, 368 aa, Streptomyces avermitilis
MPKPGELTFVAPRGAKKPPRHLADLSPAERKEAVAAIGEKPFRAKQLSQHYFARYAHDPEQWTDIPAGSRAKLQEALLPDLMTVVRHLSTDQDTTRKTLWRLFDGTLVESVLMRYPDRVTMCISSQAGCGMNCPFCATGQAGLDRNLSTGEIVHQIVDGMRALRDGEIPGGPARLSNIVFMGMGEPLANYKRVVGAIRALTDPEPDGLGLSQRGITVSTVGLVPAIHRFADEGFKCRLAISLHAPDDELRDTLVPVNTRWKVREVLDAGWEYAARSGRRLSIEYALIRDINDQAWRGDRLGRMLKGRPVHVNLIPLNPTPGSKWTASRPEDEKAFVEAIAAHGVPVTVRDTRGQEIDGACGQLAATER

SEQ ID NO: 10159 - protein, 136 aa, Streptomyces avermitilis
LRLKAIPAVTAIAAATFLGAAASPAQAGTGLLIAVQINSFQDWGNFNQDPVESTNTPGDAIRACDWTADGWAVTSYLDVGRNGTWDRTVSTSGVPSDFCTHWETGNLAEGTKVTIKACNTKAGYAPKNCKEEDTVA

SEQ ID NO: 10160 - protein, 392 aa, Streptomyces avermitilis
MNESSWGAPPQAGYWGPSDQGPAQGAAPAGPTYDAHDAQQTRPMPIVPDVPAHGGDQDDDRGAARLSGPLFRDDTPQTTSYGSQTPYVTQSPYGSQTPHGAQPQKPEPMPDAPQPAPAPQKKSAGRDLGAAIGVGVGLGVVIVASLFVVKAVFVGVIAVAVVVGLWELTSRLEERKGIKAPLVPLAVGGAAMVVAGYVRGAEGAWVAMALTALAVLVWRMTEPPEGYLRDVTAGVFAAFYVPFLATFVAMMLTADDGPRRVLTFLLLTVVSDTGAYAIGWRFGKHRLAPRISPGKTREGLVGAVSFAMVAGALCMEFLIDDGSWWQGLVLGFAVAASATLGDLGESMIKRDLGIKDMGTLLPGHGGIMDRLDSLLPTAPVVWLLLVIFVGSG

SEQ ID NO: 10161 - protein, 185 aa, Streptomyces avermitilis
VIEETLLEAEEKMEKAVVVAKEDFAAIRTGRAHPAMFNKIVADYYGALTPINQLASFSVPEPRMAVVTPFDKSALRNIEQAIRDSDLGVNPSNDGNIIRVVFPELTEERRKDYIKVAKTKGEDAKVSIRSVRRKAKDAIDKLIKDGEVGEDEGRRAEKELDDTTAKYVAQVDELLKHKEAELLEV

SEQ ID NO: 10162 - protein, 252 aa, Streptomyces avermitilis
MTTKADKSDDGKVRGRYLLKLSGEAFSGGGGLGVDPDVVHAIAREIAAVVRDGSEIAVVIGGGNFFRGAELQQRGMDRARSDYMGMLGTVMNCLALQDFLEKEGIDSRVQTAITMGQVAEPYIPLRAVRHLEKGRVVIFGAGMGMPYFSTDTTAAQRALEIDAEALLMGKNGVDGVYDSDPKTNPEAVKFDSLSYGEVITRDLKVADMTAITLCRDNKLPILVFELLAEGNIARAVKGEKIGTLVGDQGSRD

SEQ ID NO: 10163 - protein, 278 aa, Streptomyces avermitilis
MANYTAADVKKLRELTGAGMMDCKKALDEAEGNVEKAVEALRIKGQKGVAKREGRSAENGAVVSVIADDNASGVLVELKCETDFVAKGEKFQAAANAIAEHVAKTAPADLEALLASEIEPGKTVQAFVDEANANLGEKIVLDRFAAYADGYVSAYMHRTMPDLPPQIGVLVELDKPNAEIAKGVAQHIAAFAPKYLSKEDVPAEVVESERRVAEETTRAEGKPEAALPKIVEGRLNGFFKDATLLGQPYALDNKKSVQKVLDEAGVTLKRFTRIKVGI

SEQ ID NO: 10164 - protein, 308 aa, Streptomyces avermitilis
MAVVTMRELLESGVHFGHQTRRWNPKMKRFIFTERNGIYIIDLLQSLSYIDRAYEFVKETVAHGGTVMFVGTKKQAQEAIAEQATRVGMPYVNQRWLGGMLTNFSTVYKRLQRLKELEQIDFEDVAASGLTKKELLVLSREKAKLEKTLGGIREMQKVPSAVWIVDTKKEHIAVGEARKLNIPVVAILDTNCDPDEVDYKIPGNDDAIRSVTLLTRVIADAVAEGLIARSGAGKAEGDKAAGEPLAAWERDLLEGEKKADEAEAPAAAEAEKPAEAAAEAPAAEAPAAEAPAAEAPAAEAPAADAEQA

SEQ ID NO: 10165 - protein, 232 aa, Streptomyces avermitilis
MRDRSRMRAKRSVRTWPGLLLVLTVTVLGSTAWASGDMTARRTGASPGPEVSRAAGAPPGTGAPPGGGAPAPPEADGAVPAIGRAWPVGVRPLVVRGWEPPATAYGRGHRGVDLAAAPGTPVRSVAAGRVSFAGRVAGRGVVSVELTGTGEPPLRTTYEPVRPSVEKGDEVAAGGSLGTLEPTTAHCSTACLHWGLLRGRTYLNPLSLLPAWLLHRGPSRLLPVLGVPLPRA

SEQ ID NO: 10166 - protein, 179 aa, Streptomyces avermitilis
MQRAALLDAARSLLSEGGTEALTFPALAERTGLARSSVYEYFRSRAAVVEELCAVDFPVWAAEVSAAMDRADTPEAKVEAYVRQQLALVGDRRHRAVVAISAGELDAGAREKIRAAHGGLVAMIVQALGEMGHAEPRLAAMLLQGVVDAAVRRIELGAAEDPAAITDAAVAMALRGVRG

SEQ ID NO: 10167 - protein, 280 aa, Streptomyces avermitilis
MPQHTSGSDRAAIPPAARDGGSVRPPAPSTLDELWRSYKATGDERLREQLILHYSPLVKYVAGRVSVGLPPNVEQADFVSSGVFGLIDAIEKFDIGREIKFETYAITRIRGAMIDELRALDWIPRSVRQKARNVERAYATLEARLRRTPTEGEVATEMGIAVDELHSVFSQLSLANVVALEELLHVGGEGGDRLSLMDTLEDTAADNPVEVAEDRELRRFLARAINTLPDREKTVVTLYYYEGLTLAEIGNVLGVTESRVSQIHTKSVLQLRAKLASFGR

SEQ ID NO: 10168 - protein, 381 aa, Streptomyces avermitilis
MTDDERLARVALTRIIEPGDEIGGRWLREYGAVAVARRLVEGGEPFPRVSAKRWAGLRGRAAQARPERDLAEARQAGARFVCPGDAEWPAQLDDLADARPTGLWVRGRPSLRMWALRSVAVVGARACTEYGAHMAAALGAGLAERGWVVVSGGAYGVDGAAHRGALGAGGATVAVLACGVDQPYPRGHTELITRIAEQGLVVGELPPGDHPTPSRFILRNRVIAALTRGTVVVEAAYRSGALVTARAAQRLGRFTMGVPGPVTSGLSAGVHELLRGDAVLVSDAAEVAELVGDMGELAPDRRGPVLPRDLLEPGAARVLAALPGHGTATPDEIARGAGTTGDDAVGRLYELRSLGFVERHGDRWKLTRQALISVSQDRGRC

SEQ ID NO: 10169 - protein, 541 aa, Streptomyces avermitilis
MGFARTCSVALVGVEGVVVEVQAGLEPGVAAFTLVGLPDKSLTESKDRVRSAVVNSGGEWPQKKLTVGLSPASVPKGGSGFDLAVACAVLGAAERIDPRVLADIVMIGELGLDGRVRPVRGVLPAVLAAADAGYEQVVVPECAAAEASLVPGVSVLGVRSLRQLVAVLTDEPFPEEDPDEQGRPDPLLAGLRMPGTGAATGIHSVGAAPLDLGHDLADVVGQLSARTAVEVAAAGGHHLFLEGPPGAGKTMLAERLPTVLPRLGRDESLEVTAVHSVAGLLPGGKPLVDAAPYCAPHHSATMQALVGGGQGVARPGAVSLAHRGVLFLDEAPEFSGQALDALRQPLESGHVVIARSAGVVRFPARFLMVLAANPCPCGRLSQRDTLCECPPATIRRYQARLSGPLLDRVDLRVEVEPVTRAELTVRGARGESTRAVADRVRAARERSATRLTGTPWRTNSEVPGRELRSHWQAVPGAMEEAERGLERGVLSARGLDRVLRVAWTVADLSGHDRPDAGDVALALQLRTGVPRGVPMMIGASA

SEQ ID NO: 10170 - protein, 180 aa, Streptomyces avermitilis
VGGGVVHNHRVVHQDPQRARYGLSVGAGGGADMSTRKAQHGARQDTEYGARQGTEQGARRSAQRGALGRYGESLAARRLTESGMTVLERNWRGGRTGEIDIVARDGDALVVCEVKTRRAGLFEHPMAAITPAKAERLRGLAERWVQEHGGAPPGGVRIDLVGILLPDRGAPVVEHVRGVA

SEQ ID NO: 10171 - protein, 102 aa, Streptomyces avermitilis
MSAEDLEKYETEMELKLYREYRDVVGLFKYVIETERRFYLTNDYEMQVHSVQGEVFFEVSMADAWVWDMYRPARFVKQVRVLTFKDVNIEELNKSDLELPGG

SEQ ID NO: 10172 - protein, 175 aa, Streptomyces avermitilis
VPAEASSHDAYESYAPYASYESGAGAAGEGVEDSYKGGLRKVARVVLLDPQERILLLHGHEPDDPADNWWFTPGGGLEGDESREEAALRELAEETGITDVELGPVLWRRRCSFPFAGRRWDQDEWYYLARTTQTATAAAGLTELERRSVAGARWWTCQELTEAHETVYPTRSPSC

SEQ ID NO: 10173 - protein, 247 aa, Streptomyces avermitilis
MSRTGRTDEGHGRLGSTLSGLAVALGCVLFLGGFAWGAVVYRPYTVPTPSMSPTIVAGDRVLAQRVDGGDIKRGDVVVFKQKSWGDMLMVKRVVAVGGDTVGCCTGGKLTVNGKQIQEPYLPKGQAAEVRTIPTVTVPKDRLFLLGDERSGSLDSTAHLTEAFDGTVARSGVKARVDAVVWPMNGMLERPTGFEALGSLSSPGPLRLVVAAIVGGAVLVLGGAAYGPIANRARRRRSGARMEPAGAR

SEQ ID NO: 10174 - protein, 291 aa, Streptomyces avermitilis
VEDAATSASDSGDGDGGGTRESGEQGGQPKKQRSFWKELPLLIGIALILALLIKTFLVQAFSIPSDSMQNTLQQGDRVLVDKLTPWFGSEPERGEVVVFHDPANWLAGEPTATPNPLQRVLGWIGLMPSSNEKDLIKRVIGVAGDTVECKGTGPLKVNGHALNDTFVYAGNTPCSVDDQGGQFKVKVPKGKIWVMGDHRQNSLDSRYHQQDKNHGFVPVDNVIGRAIVIAWPPTRWNTLPIPDAFDQNLSAAAPGALGLAGAVPLVLWRRHRLAGGPTGGNPRVSSDGTAG

SEQ ID NO: 10175 - protein, 360 aa, Streptomyces avermitilis
MGNRGKPRGVSSSAAENLLPTGARRASGGAVRPGRAERRKLQRKVKRRRRRSAVKEIPLLVGVAVLIALVLKTFLLQAFVIPSGSMENTIQIGDRVLVDKFTPWFGSKPQRGDVVVFKDPGNWLAGEKTTKKNDPVVVKQVKEGLVAIGLLPSDNDKDLIKRVVAVGGDTVKCCDAQGRVTVNGMPLSEPYIHPGNKPSAFDFSVTVPQGRLWVMGDHRANSADSRYHRTEQYGGTVSEDSVVGRAMVIAWPLGHWTRLKEPDTYASVPGGVTTALGPSHRVASADRYGLIPLPSPAELPLVMGVVGLRRLRRGRRHGVRSGCGGFGGRRTIRTRWPRRSAGAARRDGTPGSGRRRDLRE

SEQ ID NO: 10176 - protein, 238 aa, Streptomyces avermitilis
MDTEAQHTERDRSSSPFESEEISDTQGPEGRSRFALVSRVADWLPGGRITLTLLSCLLFLLALSNFVMQPFQIPSSSMEGALRIGDRVLVNKLAYRFGSKPQRGDVVVFDGTGYFGDADYVKRVVGVGGDHVVCCDREGRLKVNGRPVDESSFLYPGDSPSDVDFDVVVPDGTLFVLGDHRSDSRDSRDHLGSPGGGMIPVGEVVGRADWIVWPAGHGTHLRRPGAYARVPAVDGAHG

SEQ ID NO: 10177 - protein, 116 aa, Streptomyces avermitilis
MSHLLDSVDSASLRSDLPAFRPGDTVNVHVRVIEGNRSRVQQFKGVVIRRQGAGVRETFTVRKVSFSVGVERTFPVHTPIVEKIELVTRGDVRRAKLYYLRELRGKAAKIKEKRES

SEQ ID NO: 10178 - protein, 282 aa, Streptomyces avermitilis
MRHGTLRVDVVTIFPEYLEPLNVSLVGKARARGQLNVHVHDLREWTYDRHNTVDDTPYGGGPGMVMKTEPWGDALDSVLADGYETDAHGPALIVPTPSGRPFTQELAVELSERPWLVFTPARYEGIDRRVIDEYATRMPVYEVSIGDYVLAGGEAAVLVITEAVARLLPGVLGNAESHRDDSFAPGAMANLLEGPVYTKPPAWRDREIPEVLLSGHHGRIARWRRDEALKRTTANRPDLIERCDPSAFDKKDREMLSILGWFPDPDGVPHGRFWRRPEAMEE

SEQ ID NO: 10179 - protein, 186 aa, Streptomyces avermitilis
VQLVVARIGRAHGIKGEVTVEVRTDEPELRLGPGAVLATDPASVGPLTIETGRVHSGRLLLRFEGVRDRNGAEALRNTLLIAEVDPDEVPEDPDEYYDHQLMDLDVVTKDGTEVGRITEISHLPSQDLFVVERSDGSEVYIPFVEEIVVEIDLEEQRAVIDPPPGLIDDRAEVDSSDTEAATEADA

SEQ ID NO: 10180 - protein, 79 aa, Streptomyces avermitilis
MLEEALEHLVKGIVDNPDDVQVASRDLRRGRVLEVRVHPDDLGKVIGRNGRTARALRTVVGAIGGRGVRVDLVDVDHVR

SEQ ID NO: 10181 - protein, 142 aa, Streptomyces avermitilis
VAVKIKLKRLGKIRSPHYRIVVADSRTRRDGRAIEEIGLYHPVQNPSRMEVDAERVAYWLGVGAQPTEPVLAILKKTGDWQKFKGEPAPAPLLVAAPKATRPSFDALGGDDAGKGEAITQKKKAEKKDEAAAESSSSESTEA

SEQ ID NO: 10182 - protein, 198 aa, Streptomyces avermitilis
VSTTPPVLAAELAQAWADIQRYHPELPDLAAPESLIGESSSACGHELSFERLLHEAVHGIAAARGVRDTSRAGRYHNRRFLAIAEELGLDHPEEPHPSSGFSLVTLNPEAKRRYRPTIERLQRALKAHTAATAADTARSFRGPAARHGSSGGGVRVKAVCDCGRNVRVVPSVLAQAPIVCGGCGKPFRIPEVVGAAAS

SEQ ID NO: 10183 - protein, 471 aa, Streptomyces avermitilis
MAKAPVLTPRADDFPRWYQDLINKAELADNGPVRGTMVIRPYGYGLWERMQQEMDARIKETGTQNAYFPLLIPQSYLTKEADHVEGFAPELAVVTHGGGKELEEPAVVRPTSEMIINDYFSKWVQSYRDLPLLINQWANVVRWELRPRLFLRTTEFLWQEGHTAHATYEEARDFAAHIHRHVYADFMENVLAMDVVLGRKTAKERFAGAVNTLTLEGMMGDGKALQMGTSHELGQNFARAFHTQYLSKEGKQELVWQTSWGSTTRMIGALVMMHGDDNGLRVPPRLAQTQVVVLAIKGDEAVLAKVRETGDRLKAAGLRVQVDDRTDVPFGRRAVDWELKGVPVRVEVGPRDLENGTAMVARRIPGGKEPVALDALAALLPTALEEDQALLLRQARERRASRTSDVSTIEEAVEAAAGGGWARIPWATLGERGEAELAEHAASVRCLVAEDGSVPGADDAPGNVAVVARAY

SEQ ID NO: 10184 - protein, 287 aa, Streptomyces avermitilis
MTPTLVRQHLPHAGPAPRVDPCARARDWAEIQERMLVPLYEAVHERLEVGPGTRLLGLGCGSGLALLTAASRGAAVTGVDTRVPERLALARERLLPESRGTRARTDPRIVDGTPEDAAAAPGEPGYNLVTAFEPIGCATGDAERLGELLAAATPLAGRGTPVVLAGWGPPERCATSSVLRVATRLADPLRGARSWRPALRDDLEEIAQRAGLRPDGSGRVACPFGYADVNNAVRGLLSTGLFDPAITATGQEQVDKEVTEALHPHVRQDGTVWMPNVFRYLIARTPQ

SEQ ID NO: 10185 - protein, 516 aa, Streptomyces avermitilis
VFDTLSDRLSATFKNLRGKGRLSEADIDATAREIRIALLEADVALPVVRTFIKNVKERALGSEVSKALNPAQQVLKIVNEELVTILGGETRRLRFAKNPPTVIMLAGLQGAGKTTLAGKLGKHLKDQGHSPILVAADLQRPNAVNQLSVVAERAGVAVYAPEPGNGVGDPVKVAKDSIEFAKTKVHDIVIVDTAGRLGIDQELMQQAADIRDAVSPDEILFVVDAMIGQDAVNTAEAFRDGVGFDGVVLSKLDGDARGGAALSIASVTGKPIMFASNGEKLDDFDAFHPDRMASRILDMGDLLTLIEQAEKTFSQEEAEKMASKLASKKGQDFTLDDFLSQMEQVRKMGSISKLLGMLPGMGQIKDQINNLDERDVDRTAAIIKSMTPAERQEPTIINGSRRARIAKGSGVDVSAVKGLVERFFEARKMMSRMAQGGGMPGMPGMPGMGGGPGRQKKKQKQAKGKQRSGNPMKRRQQELEEAARKEAADQGGNAFGLPQQGGQDFELPDEFKKFMG

SEQ ID NO: 10186 - protein, 853 aa, Streptomyces avermitilis
VTARSGPSRWTRPSGSGPASADPTRCKAPTEQESLGDEYGRTYGCRGLGTQRLRGGPAAPPPEGARSGPPRRAALAELTDDWLTGLFDAGGAGPRGVSLVAVGGYGRGELSPRSDLDLLLLHDGGDQGAVAALADRIWYPVWDLGLALDHSVRTPAEARKTAGEDLKVQLGLLDARHLAGDLALTAGLRTAVLADWRNQAPKRLPELQELCAERAERQGELQYLLEPDLKEARGGLRDATALRAVAASWLADAPREGLTDARRRLLDVRDALHLTTGRATDRLALQEQDQVAAELGLLDADTLLRQVYEAARVVSYASDVTWREVGRVLRSRAVRPRLRAMLGGGKPVAERSPLAEGVVEQDGEVVLARTARPDRDPVLPLRAAAAAAQSGLPLSLHAVRRMAAAARPLPTPWPAEAREQLVTLLGSGPSTIEVWEALEAEGLITRLLPDWERVRCRPQRNAVHIWTVDRHLIETAVRASELARRVGRPDLLLVSALLHDIGKGWPGDHSVAGEIIARDVAARIGFDREDIAVLATLVRHHLLLVETATRRDLEDPATVRAVAEVVGSQSTLELLHALTESDALATGPAAWSSWRGSLVADLVKRVSAVLAGDAPEEPEAAAPTAEQERLAVEAFRTGGPVLALRAQTEPGATEADNAVPDDPEPLGVELLIAVPDQSGVLPAVAGVLAMHRLTVRTAELRALPLPDGVEGSVLLLNWRVAAEYGSLPQAARLRADLVRALDGSLDIAARLAERDAAYPRRRGVVAPPPHVTVASAASHLATVIEVRAHDAPGLLHRIGRALEKSGVRVRSMHVSTLGANAVDAFYVTGTRGGPLPGEEAATVARALEETLRT

SEQ ID NO: 10187 - protein, 112 aa, Streptomyces avermitilis
MKLITAVVKPHRLDEIKEALQAFGVHGLTVTEASGYGRQRGHTEVYRGAEYTVDLVPKIRIEVLAEDDDAEQLIDVVVKAARTGKIGDGKVWSIPVDTAVRVRTGERGPDAL

SEQ ID NO: 10188 - protein, 446 aa, Streptomyces avermitilis
MAPAITLAAEAPKLSAANTGFMLICSALVLIMTPGLAFFYGGMVRVKSTLNMLMMSFISMGIVTILWVLYGFSLAFGTDKGSLIGWTSDFVGFTGIGKVELWPGYTIPVYVFATFQLMFAIITPALISGALADRVKFTAWSLFVALWATVVYFPVAHWVWGTGGWAFDLGVIDFAGGTAVHINAGAAALGVILVIGKRVGFKKDPMRPHSLPLVMLGCGLLWFGWFGFNAGSWLGNDDGVGALMFINTQIATAAAMLAWLAYEKIRHGAFTTLGAASGAVAGLVAITPSGGAVSPLGAIAVGAIAGVLCAMAVGLKYKFGYDDSLDVVGVHLVGGVAGSLLIGFFASGGGQSDATGVFYGDHSFDQLWKQCAGVFAVLAYSLVVSAILAFLIDKTIGMRVSEDEEIAGIDQAEHAETAYDFSGAGGGAARILPAPLADTATKKVDA

SEQ ID NO: 10189 - protein, 491 aa, Streptomyces avermitilis
VGGNGGSGTNADRRPNELLGSWFVRSGWSKGELARQVNRRARQLGASHISTDTSRVRRWLDGENPREPIPRILSELFSERFGCVVAVEDLGLRTAHQAPSVSGVDLPWTGPQTVALISEFSRSDLMLARRGFLGTSLALAAGPSLIEPMQRWLVPGPAAPREEPEPLAASRRAGRLSRPELDLLESTTVMFRQWDAQCGGGLRRKAVVGQLHEVTDLLQEPQPAATTKRLFKVAAELAELAGWMSYDVGLQPTAQKYLVLALHAAKEAGDKPLGSYVLSSMSRQMIHLGRPEDALELIHLAQYGSRDCASPRTQSMLYAMEARAYANMGQPGKCKRAVRMAEDTFADALESDEPEPDWIRFFSEAELHGENSHSYRDLAYVAGRSPTYASLAEPVMQKAVDLFAKDSEHQRSYALNLIGMATVHLLQREPERSAVLAKEAMEVAKKVRSERVNTRIRKTVDTAVRDFGDLAEVGDLTAQLAVHLPETAEAV

SEQ ID NO: 10190 - protein, 220 aa, Streptomyces avermitilis
MGFTIGGTRGIREIRPGARRRGRSSECTAVAEYTGLWGWDVVAGARAAAGACSCGRAECVRPGAHPLDFATPLPAGATLDEVTEAWAEVPGAAVLLPVGRAFDVIEVAEAAGRHALVRLERMGLPLGPVTATPDGRAHFFVAPGAAAELPELLYRMAWDDTSLDLRALGPGTYITAPPSDLGGLGPVRWLRSPALDSATNPPAARLLLGTLAYVAHRSRA

SEQ ID NO: 10191 - protein, 409 aa, Streptomyces avermitilis
MADTGRVMETVILAVVIAVVVLGALGGLVIGSRRKKPLPPAPPTTPDITAPPAEPHVGDEAEQPRDEPRRTIEEVDLPDKSAAAPVAVEEAPVVEVPAIEVPEPTAGRLVRLRTRLSRSQNALGKGLLTLLSREHLDEDTWEEIEDTLLTADVGVQPTQELVERLRERVKVLGTRTPQELRGLLREELLQLLVPEFDREVRTDSNLDTPGIVMVVGVNGTGKTTTTGKLARVLVADGKHVVLGAADTFRAAAADQLQTWGERVGARTVRGPEGGDPASIAFDAVKEGIEEGADVVLIDTAGRLHTKTGLMDELGKVKRVVEKHAPLDEVLLVLDATTGQNGLVQARVFAEVVNITGIVLTKLDGTAKGGIVIAVQRELGVPVKLIGLGEGADDLAPFEPEAFVDALVGE

SEQ ID NO: 10192 - protein, 490 aa, Streptomyces avermitilis
MSTTASNDGALETHGESHGLETRGLDPVPHSERTARTRELLPTWVAANISVLLLSMGAGLAVSYGLNFWQALVVGVAAPVVSYGLVGLMGIAGKRGGAPGMALSRAVFGQRGNLLPGALIWIARWGWETINAVTGAYALLTVLNILFGIRSNTFLIIVTLLLFVVTTFVISGLGINAVRRCNRWASYLFAGFSVLVLGHLVVDTDWGKVFGQAAGPTPLMITGVGVIAAGGISWAPSSPDFTRYLPRTASSVAIVRNTVGGAGVVVLPMVLMGAVMAVSTPDLASAADPVSFLGEILPLWIAVPYLLIALVGMLLINAMSMYSAGFTAQTLGFRVPRHWAVSVNAVISLVFGGVLMLVATSFMGSFIAFLSLLAVAFSAWVGVFGADMLRRREYDAGALLDTTRTSAYWYRGGFSPAAVAAWAVGLGTGLLFTTSDWFTGPLASGNPVGEYGLGWVATVVVSFLLYVALPKPALPRTPAPATEEPAPLAV

SEQ ID NO: 10193 - protein, 326 aa, Streptomyces avermitilis
MPVTVVRFNLVEPGATPASLSARYRAALEMAAYADDRGITTVQTEEHHGVANNWLPSPFAFAGAVFGATRHIAVTVSAVIGPLHDPLRLAEDISVLDLLSGGRLITVAGIGYRPEEYALFDVDWKRRGRLQDELLETVLKAWTGEEFEYRGRTVRVTPRPFSDPHPLLLVGGSSKAAARRAARLGLPFFPSAHLPELEAYYKDRLIEYGTEGWTMMPSAVTPLLHIAEDPDRTWAEYGEYFLHEARTYASWQSAEIRSAVKSAATTVDELRAEGVYRILTPDECVAQGLDNHVLHPLSGGMPVDEGWRSLHLFCENVLPRLKDLEG

SEQ ID NO: 10194 - protein, 470 aa, Streptomyces avermitilis
VTSTAQAPGAREAHPEHLGHVIFIAAAAAMGGFLFGYDSAVINGAVEAIRSKYDIGSATLAQVIAIALIGCAVGAATAGRIADRIGRIRCMQIAAVLFTASAIGSALPFALWDLAFWRVIGGFAIGMASVIGPAYIAEVAPAAYRGRLGSFQQAAIVIGIAISQLVNWAILNAAGGDQRGKLLGLEAWQVMLGVMVVPAVLYGLLSFAIPESPRYLIEAGKDARAREVLEEVEGKEIDLDARVEEIRLAMYREEKPSFKDLLGGTFFFKPIVWVGIGLSVFQQFVGINVAFYYSATLWQSVGVDPTDSFLYSFTTSIINIIGTVIAMIFVDRVGRKPLAIIGSVGMVIGLALEAWAFSYDLVDGKLPATQGWVALIAAHVFVLFFALSWGVVVWVFLGEMFPNRIRAAALGVAASAQWIANWAITASFPSLADWSLSGTYIIYTVFAALSIPFVLKFVKETKGKALEEMG

SEQ ID NO: 10195 - protein, 1202 aa, Streptomyces avermitilis
VHLKALTLRGFKSFASATTLRFEPGITCVVGPNGSGKSNVVDALSWVMGEQGAKSLRGGKMEDVIFAGTTGRPPLGRAEVSLTIDNSDGALPIEYAEVTITRIMFRNGGSEYQINGDTCRLLDIQELLSDSGIGREMHVIVGQGQLDSVLHADPMGRRAFIEEAAGVLKHRKRKEKALRKLDAMRANLARVQDLTDELRRQLKPLGRQAAVARRAAVIQADLRDARLRLLADDLVRLRVALQTEVADEAALKERKEAAEAELKRALQREALLEDEVRQLTPRLQRAQQTWYELSQLAERVRGTVSLADARVKSATSVPAEERRGRDPEDMEREAARVREQEAELEAALEAAERALEDTVEHRAELERELAVEERRLKDVARAIADRREGLARLNGQVNAARSRAASAQAEIDRLASARDEAQERAVAAQEEYEQLKDEVDGLDAGDADLAERHEAAKLALSEAESALTAAREAVTAAERRRAATAARREALALGLRRKDGTGALLGAKDRLGGLLGPAAELLSVTPGYEVPLAAAFGVAADAIAVSTPASAAEAIRLLRKQDAGRAALLLGGAPDDVPAPEPEHARRPGAAHTDVPPAEHRGGPPYAADLVRGPAELMPAVRRLLRGIVVVGTLEDAEDLVYARPGLTAVTAEGDLLGAHFAHGGSAGAPSLLEVQASVDEAAAELEELAVRCEELTGAQRLAAERRTERAALVEELGERRRSAEREKSAVAQQLGRLAGQARGAAGEAERTAAAVARAQEALDRAVQEAEELAERLAVAEEMPVEEEPDTSVRDRLAADGANARQTEMEARLQVRTHEERVKGLAGRADSLDRAARAEREARARAEQRRARLRHEAAVAEAVASGARQLLTHVEVSLGRADKERTAAEAAKARREQELAAARGTGRDLKAELDKLTDSVHRGEVLGAEKRLRIEQLESKALEELGVEPAGLVADYGPDQLVPPSPAAEGEELPDDPEHPRNRPRPFARAEQEKRLKSAERAYQQLGKVNPLALEEFAALEERHQFLSEQLEDLKKTRADLLQVVKEVDERVEQVFTEAYRDTAREFEGVFGRLFPGGEGRLILTDPDNMLTTGVDVEARPPGKKVKRLSLLSGGERSLTAVALLVSIFKARPSPFYVMDEVEAALDDTNLQRLIRIMQELQEASQLIVITHQKRTMEVADALYGVSMQGDGVSKVISQRLR

SEQ ID NO: 10196 - protein, 93 aa, Streptomyces avermitilis
MNEDVRLVAWVRGRVQGVGFRWFTRAKALEIGGLSGFALNLDDGRVQVVAEGAREGCQGLLDWLQGDDTPGRVDGVTEMWDTPRGSYDGFLIR

SEQ ID NO: 10197 - protein, 311 aa, Streptomyces avermitilis
MGRHRRSAAGRAATGRTSEVTKPRGDSTESYGPENLYGFAAVLEAEREQRSHRKKKVATPVRTGLLGVSAAVALGTVAVAAGVLPGGGKYTVGDSDSVQAGGSPSGFETQQGGTNGTADDRESTSTSRGSDRSASPSAAPSTPSKKPSTTTPSKKPAPTATQSRTATPPSKAPKAPEASASVTVSTETAVAAEVLKLVNEERATAGCSPVAANSALSQLATAFSEDMAARDFFDHTDPGGNDPWDRAATAGVTGLGGENIARGQATAEAVMESWMNSPGHRANILNCDFKTLGVGVHFGAGGPWWTQDFGY

SEQ ID NO: 10198 - protein, 207 aa, Streptomyces avermitilis
VKCCSIRCQGVPIVTTPVVSIAFHSGHGHTAVLAEAVRSGAVEAGAQAHLINVDEITEEQWAVLDASDAIVFGSPTYMGTASGAFHVFAEASSKRWFGQDWKDKLAAGFTNSGSKSGDKLHTLQFFQILAAQHGMNWINLGLHPGWNSSTAAETDLNRLGVFAGAAAQTNIDEGPEAVHKADIATAEHLGRRVAEAARVFALGRAAA

SEQ ID NO: 10199 - protein, 137 aa, Streptomyces avermitilis
MEPIAQPAQGIENGDCPGLAYDVFARSCPSRGTLEHVTGRWGALTLGALHDGSFRFNELRRRVDGVSEKMLSQTLHALERDGLVHRDAQATNPPRVDYSLTPLGRDVAERLLTLIRFVEGRMDEVLVARERYDGARA

SEQ ID NO: 10200 - protein, 437 aa, Streptomyces avermitilis
LWVLSLFGWSQPMTHSTVRLRRGAVTAIAVGTLMVPFAGGAASGAPASATAAATASATAVEPPTPSDSASASTGDFRTLTPAVTKQVDEAVRRVMREANVPGVTVGLWTSDQGQHVRSFGVADKSGGERMSPDLYMRIGSETKTFTVTALLELVDEHKVGLDDPIGKYVDGVPNGDKITLRELAGMRSGLFNYTEDDGFFKALTSDPRRPFTPQQLLDYAFKHPVLFPPGEKFSYCNTNLILLGLVVEKAGGRPLGDFIRQNVLEPAGMNHTSLPADAAFPNPHAQGYTDQTATGEVENATDWNPSWGWAAGAMISDLDDLRTWARTVATGILPDGDSLISPVTQKQRLNTPPTTIPGAGYGLGIFNVQGWIGHNGSLPGYESLTIYLPSAQATLVVLLNTDINHAGTEPSTLFGEAITKIVTPGHVFNLPAQPAAR

SEQ ID NO: 10201 - protein, 286 aa, Streptomyces avermitilis
MPELPEVEVVRRGLERWVAHRTVADVEVLHPRAVRRHTAGGEDFAHRLKGRRVGVPSRRGKYLWLPLETTDTAVLAHLGMSGQLLVQPHDCADERHLRIRVRFADALGTELRFVDQRTFGGLSLHDTTPDGLPDVIAHIARDPLDPLFDDAAFHEALRRKRTTVKRALLDQSLISGVGNIYADEALWRARIHYERPTAGFTRPRTAELLGHVRDVMNAALAVGGTSFDSLYVNVNGESGYFDRSLDAYGREGLPCRRCATPMRRRPWMNRSSYFCPKCQRAPRVTV

SEQ ID NO: 10202 - protein, 276 aa, Streptomyces avermitilis
MSDAKADSTAKKKADNTASSHTLLEGRLGYKLESALLVRALTHRSYAYENGGLPTNERLEFLGDSVLGLVVTDTLYRTHPDLPEGQLAKLRAAVVNSRALAEVGRGLELGSFIRLGRGEEGTGGRDKASILADTLEAVIGAVYLDQGLEAAGELVHRLFDPLIEKSSNLGAGLDWKTSLQELTATEGLGVPEYLVTETGPDHEKTFTAAARVGGVSYGTGTGRSKKEAEQQAAESAWRAIRSAADERAKAAAQAAQTAAEAAERAQGNADASSASA

SEQ ID NO: 10203 - protein, 57 aa, Streptomyces avermitilis
VAVPKRKMSRSNTRHRRSQWKAAVPTLVACERCHEPKLQHIACPSCGTYNKRQVLEV

SEQ ID NO: 10204 - protein, 217 aa, Streptomyces avermitilis
MALNARLDHRNPLVFDTHELGRRPGALQRLTRTIDAPRDLGIQGVIGVPEGAPVELRLRIESVMEGVLVTGTARAQAEGECVRCLEPLEQQLEADFQEMFSYPDADDRGREKAEPVDDAEEDEDRLFLEDGLFDLETVLRDAVVLALPMQPVCQDDCPGLCSECGARLADDPDHHHDAVDIRWAALQGLAGSLEDGEKDEMSGGALPSAHVDEKQEK

SEQ ID NO: 10205 - protein, 363 aa, Streptomyces avermitilis
VDVQKKLDEIVAAVSGARSMPMSASCVVNRAELLSMLEEVREALPGSLAHAQELIGDREQMVERARQEAERIIETAHAERGSLISDTEVARRSRNEADRILSEARQEAEEIRTEADDYVDSKLANFEVVLTKTLGSVGRGREKLLGTGPGVDEQGFEDEDAPERSHDPETLRHNADAYVDVKLGAFEAVLAKTLEAVGRGRQKLHGRIASDDLGALTDDGTPVQHTSDADYLAGLADLGNTPDQPSAPPQTPQAPEIPAQPQYGGQDAYAYQQQTPDPYGYQQQYGQQDAYGYQPTADPYAAYPQQGYDQQTAYDQNQQQGYSQPQTHDSQPQAHDLDEASLFDTSMISAEQLRAYEQGRGGH

SEQ ID NO: 10206 - protein, 159 aa, Streptomyces avermitilis
LRRAVCPGSFDPITNGHLDIIARASKLYDVVHVAVMINQSKKGLFEVDERIELIRQVTAEFGNVEVESFHGLLVDFCKQRDIPAIVKGLRAVSDFDYELQMAQMNIGLSGVETLFVPTNPTYSFLSSSLVKEVAAWGGDVSHLVPPAVLEALNGRLKQD

SEQ ID NO: 10207 - protein, 195 aa, Streptomyces avermitilis
MTRVIAGRAGGRRLAVPPGNGTRPTSDRAREGLFSTWQALLGGPLDGERVLDLYAGSGAVGLEALSRGAGHTLLVEADTRAVRTVRENVKSLGLPGAEVRAGKAEQIVQTPASADPYDIVFLDPPYAVSDDDLREILLTLRTGGWLAGEALVTVERSTRGGEFRWPDGFEPIRSRRYGEGTFWYGRAASTCEDAR

SEQ ID NO: 10208 - protein, 1075 aa, Streptomyces avermitilis
MDLVPALEEPLKKVLGPATAKVMAEHLGLHTVGDLLHHYPRRYEERGQLTHLADLPMDEHVTVVAQVADARLHTFASAKAPRGKGQRLEVTITDGSGRLQLVFFGNGVHKPHKDLLPGTRAMFSGKVSVFNRRLQLAHPAYELLRGADDEAAESVDSWAGALIPIYPATAKLESWKIAKSVQTVLPSVQEALDPLPDSLRDGRGLISLPEALLKIHRPHTKADIEDARARLKWDEAFVLQVALARRRHADAQLPAAARKPKPDGLLTAFDAKLPFTLTEGQQKVSKEIFDDLATEHPMHRLLQGEVGSGKAQPLDSLVLAPTGFRRMGDLREGDEVVVPNGEIALIDGVFPQGVRDVWRIVLSDGSSVECDDEHLWIVGTSCGWHRGQTPKVMTTREIRLDTFKANGSSKWYVPAATPVDLGPDVGLPLDPYLFGLLLGDGSFRHNLRLSTVDDEIRDAAADAVAPDCRLVPVTGSRCDYTIQLKQRSGGVRNPVIQALRRLDLWGKTSHGKFIPEDFKNTSIKNRLSLLQGLLDTDGTVHADGMSVSLRSASLRLAEDVAWLVRSLGGRARVLPEKAAFHVSVALPDEYAPFRLSRKADRVRPRPKYNTFRRGIRAVEYVGRKPAQCISVGHPSHAYVTDNFTVTHNTMVALRAMLAVVDSGGQAAMLAPTEVLAQQHHRSITEMMGELAEGGMLGGAEHSTKVVLLTGSMGAAARRQALLDLVTGEAGIVIGTHALIEDKVQFHDLGLVVVDEQHRFGVEQRDALRGKGKQPPHLLVMTATPIPRTVAMTVFGDLETSVLDQLPAGRSPIASHVVPAADKPHFLARAWERVREEVGKGHQAYVVCARIGDEEDDPKKAKKKSPEDEAEKRPPLAVLEVADQLAKGPLQGLGVEVLHGRMPPDDKDAVMRRFAAGERDVLVATTVIEVGVNVPNATAMVIMDADRFGVSQLHQLRGRVGRGSAAGLCLLVTEMPEASPARQRLNAVASTLDGFELSRIDLEQRREGDVLGQAQSGVRSSLRMLAVIEDEEIIAEAREEAAAVVAADPELGHLPGLRTALEALLDEEREQYLDKG

SEQ ID NO: 10209 - protein, 612 aa, Streptomyces avermitilis
MDSQTSQSSQASQSPHTFQVDLRGLVDLLSHHLYSSPKVYLRELLQNAVDAITARRTEQPEAPARVRLYAEGGTLRVEDSGVGLTESDVHSLLATIGRSSKRDDGLQEARSDFLGQFGIGLLACFVVAERIRVVSRSARTPDAAPVEWTAADDGSYTVRTLPHEARPEPGTTVHLVARAGAADWLSAERVLSLARDFGSLLPYDVRVGDEAITDLPAPWDRSYPSPTTRRVALARHCHDLFGFTPLDSIELNVPLAGIRGVAYVLPSAVSPAQRASHRVHLKGMLLTERAEQLLPDWAFFVRCVLDTDSLRPTASRESLYEDETLAAVREALGERIRAWLTGLAAGDPDRLAAFLSVHYLGVKSLARHDKEMLRTMLPWLPFETTDGRLSLEEFAQRHPVVHFTRTVEEYRQVAPIASAQGVGVVNGGYTYDSELVEALPSVRPGTVVAELDADTVTAHLDAVDPAEELALSGFLSAARAKLDPLGCDVVLRSFHPLSVPALHLDDRAARHEQARAEAEEQADDLWAGILGSLRGSAPRARLVLNHLNPLIRRISSLDDRELIGTATESLYGQALLMAQRPLRPADSALLNRAFIGLLEWATHPSFPEDGAR

SEQ ID NO: 10210 - protein, 991 aa, Streptomyces avermitilis
MGHPPQLPGGRCPMSQTMDFDTLRRAMADNYEQPEGPARNARAEQLLTEAEKLNIPLAVIEALGHQLKVYNYSSEKDKMFVPFARLLRMWDERPEDFDEYEIHSLHWVFKWMSAGMLGQPHIPLASIEKWLGEMEHRYRLAGHSERAVRSAEFSVANHIGDLARAERAYAAWLAADRDSMADCHACELHDQGWWQARKGADADALEVWRPVVEGEYVCAHEPHAILASSLVPLLRLGRLDEARAHHLRGFRLIRPMESMRGAYADHVEFCALSGNEARALELLAERPAYFTDSGEPRSKLDFMAVVALLMDRLVELGLGEQTVPGPAGRVWSARELAAHARAEALALAARFDERNGTAHVSERARERMDRRPLVDRLPLGVRSTRPAPTAPRPPAAPDSAPAPAVERDLRDVLAEARGRSDALRPDAMDAWAAVARAAGDHELDARDRAEIADHEAMSRGPEGAPLFERAAELYAEAGDPGEALAARARGAYVRALTGHSDDALRTINDLHRQVRALFAKDGTGVRQTAAVLVGRARILVHRVHETEGAGTTVAAAEEAVRELLEFAEPHIAQVRLASRAAEARAMLGELAALTGDAMTAAELLAQAAEGFLAAGLPWFAVEYEARLAGIARELGDAVEAERAARSALEHGVEYLEPAGQAQLHLQLAEVLGTTGQFGPAAEHALEAAHWADEAGEGPTFGAWARHQLGGFLLQQGRWAEAAEVLESALPDLTAETHGDGALVQTQWWLGDCHTELGEHREAAERWLRAAEIARHWPEQRDHAMLAHLAAEALGHAGLPAEADRAYTRAGDLWRDLGNVHGLARALRARAWLAAREEDELDPARELMAQAVRECEAALEGATEGEDGARERLVAELGHTHRQFGDLVARSVQDGDRGADFQGAFEEALGHVTRAVAVFAPLGASALDLRTGAELAAGWLEADLHRPAEATARARAVLAAYANRQEADDETARARCAEADRMLELLGTRTGQ

SEQ ID NO: 10211 - protein, 571 aa, Streptomyces avermitilis
VPQVPQTFDALAVRTWCGLALQALGRARAEIDAINVYPVADGDTGTNLYLTVESAATAVEAVFAGHDAMGAVGGTSDAASAGPGRPTLADAVQAMAHGALIGARGNSGTILAQLLRGMAQVLAADSETAHTDGQGLRLALRHAADSAREAVAHPVEGTVLTVASAAADAATGAEDGCGSVARAAYEGACAALAATPGQLAVLRRAGVVDAGGRGLVAVLAALVQTFTGEAPGASGAVVHARVDDEAAAGRPDAGECGDGPPAEGGPAFEVIYLLEADDAAVGRLRSRLDGLGESLVVVGGDGLWNVHVHVDDAGAAVEAGVEAGRPYRIRITHFAAGDVHTGGAGRPPREPAQRAVVAVVPGEGLAGLYAEAGATTVLARAGEPPVSGELVDAVRRAHAREVVLLPNDAELRHTAAAAAEQARTEGVRVALIPTRSAVQGIAALAVHEPERRFDEDVVAMTSAAGATRYAEVAVAERQSWTMAGICQAGDVLGLIEDDVAVIGSDVTETAEIILDRMLAAGGEMVTLVLGDEAPESIAAHLESRVRESYLAVDTVVYRGGRQGPLLLIGVE

SEQ ID NO: 10212 - protein, 61 aa, Streptomyces avermitilis
VAANCDVCGKGPGFGNNISHSHRRTPRRWNPNIQRVRTVVGGTPKRVNACTSCIKAGKVSR

SEQ ID NO: 10213 - protein, 320 aa, Streptomyces avermitilis
MKGTVGELGEFGLIRELTSRLTTTPAVRVGPGDDAAVVAAPDRRVVASTDILLEGRHFRRDWSTAYDVGRKAAAQNLADIAAMGAVPTALLLGLVVPAELPATWPSELMDGLRDECQVAGAAVVGGDVVRGDTITVAITALGDLRNHEPVTRGGAQPGDVVAVTGWLGWSAAGHAVLSRGFRSPRAFVEAHRRPEPPYHAGPAAAGLGATAMCDVSDGLIADLGHIAEASKVRIDIRSGAIDIPTQMNDIGQAVGVDPIQWVLTGGEDHAIVATFPPDVKLPARWKVIGEVLNPSALPQVTVDGAPWSSKGGWDHFGDIE

SEQ ID NO: 10214 - protein, 77 aa, Streptomyces avermitilis
VVQAYILIQTEVGKASTVAETISKIPGVIQAEDVTGPYDVIVRAQAETVDELGRMVVAKIQQVDGITRTLTCPVVHL

SEQ ID NO: 10215 - protein, 163 aa, Streptomyces avermitilis
VDFSRHRPNTFFGLPVLALLIAATGCSSADDNASATVPSPDAKVTELCQNLDKVLPKKVDGLERKDPEPRSALTAGWGSPAIILRCGVERPAEMLDPKASTTEVNGVGWLVREHDDGSYVFTTSLRRAYVEVRLSAEQAKNGAGSLVDLAKPIKKAIPEGIAD

SEQ ID NO: 10216 - protein, 385 aa, Streptomyces avermitilis
MSTENLPQSPEQPPRKPRVAVVFGGRSSEHGISVVTAGAVLRAIDRTKYDVLPIGITRDGRWALTADEPERMAITDRRTPSVEELAESNEGGVILPVDPANREVVYSEPGSVPKALGEVDVVFPVLHGPYGEDGTLQGLLELSGVPYVGAGVLASAVGQDKEYMKRVFTSFGLKVGPYVVIRPREWERDESAARRKIVDFAGEHGWPLFVKPARAGSSIGITKVDDLAGLDEAVAEAQRHDPKIIVEALLRGREIECGVLEFEDGPRASVPAEIPPAQSHAYYDFEAKYIDSTPGIVPAPLTPEETAEVRRLAVEAFEATSCEGLVRADFFLTEDGDFVINEINTMPGFTPISMYPQMWQASGIAYPELVDRLVEAALRRSTGLR

SEQ ID NO: 10217 - protein, 336 aa, Streptomyces avermitilis
VSTPVKAAVFGTGSWGTAFGMVLADAGCDVTLWARRAELADAVNSTRTNPDYLPGVELPENLRATTDPAEAARAADFTVLAVPSQTLRGNLAEWVPLLAPDTVLVSLMKGVELGSAMRMSEVVEDVAKVGADRIAVVTGPNLAREIAARMPAAAVVACANEAVAQRLQAACHTPYFRPYTNTDVVGCELGGAVKNVIGLAVGIADGMGLGDNAKGSLITRGLAETTRLGLVMGADPLTFSGLAGLGDLVATCSSPLSRNHTFGTNLGRGMTLQETIAVTKQTAEGVKSCESVLDLARRHGVDMPITETVVGIVHEGKPPVVALKELMSRSAKPERR

SEQ ID NO: 10218 - protein, 266 aa, Streptomyces avermitilis
VPRRRISFWYRFAAVLCKPPLVVLIKRDWRGMENIPVEGGFITAVNHNSHVDPFAYAHYQYNTGRVPRFLAKAGLFKKGFVGAAMRGTGQIPVYRESTDALSAFRAAIDAVERGECVAFYPEGTLTRDPDGWPMTGKTGAARVALQTKCPVIPVAQWGANELLPPYAKKPNLLPRKTHRVLAGPPVDLTRFYDREMSPDLLKEATEVIMAAVTAQLEEIRGEKAPERPYDPRQVRIEQRRRTAAYERAQAQQKAQQRAQQEEEQST

SEQ ID NO: 10219 - protein, 216 aa, Streptomyces avermitilis
VQWTLVVPLKALARAKSRLADTAGDGLRPGLALAFAQDTVAAALASAAVRDVAVVTGDPVAGRELAALGARIVADEPAGGLNAALAHAAAVVRSGRPDSGVAALNADLPALRPAELARVLEAAVEFPRAFLPDAAAIGTTLLAAAPGRELLPAFGTDSRARHRASGAVELGLGGVNSVRQDVDTGADLRAALALGVGPRTAAAAARLLIPGPQGDR

SEQ ID NO: 10220 - protein, 67 aa, Streptomyces avermitilis
MQATAYTYDSETRSGQVLLDDGTPLPFDGPAFDAGGLRLLRPGQRVRIEVDGEGDARRITLVTLQTF

SEQ ID NO: 10221 - protein, 217 aa, Streptomyces avermitilis
VNKAQLVEAIADKVGGRQQAADAVDAVLDAIVRAVVGGDRVSVTGFGSFEKVDRPARYARNPQTGERVRVKKTSVPRFRAGQGFKDLVSGSKKLPRGGEVSVKKAPKGSLTGAASATVKKAAAKKTTAKKATAAAKKTTAKKTTAKKAAPAAKKTTATAKKTTAKKTTAGAKKAAAKKTTAKKATAKKAPAKKATAKKAPAKKSTARKTTAKKATAR

SEQ ID NO: 10222 - protein, 197 aa, Streptomyces avermitilis
MEAFTTHTGRAVPLRRSNVDTDQIIPAHWLKKVTRDGFEDGLFEAWRKDESFILNRPERTGATVLVAGPDFGTGSSREHAVWALQNYGFKAVISSRFADIFRGNSLKNGLLTVVLEQKIVDALWELTEKDPQAEVTVDLEAREVRAEGITAAFELDENARWRLLNGLDDISITLQNEGDIATYEAKRPSHKPRTLQV

SEQ ID NO: 10223 - protein, 477 aa, Streptomyces avermitilis
MGRTLAEKVWDDHVVRRAEGEPDLLFIDLHLLHEVTSPQAFDGLRQAGRPVRRLDLTIATEDHNTPTLDIDKPIADPVSRAQLETLRKNCAEFGVRLHSLGDVEQGVVHVVGPQLGLTQPGTTVVCGDSHTSTHGAFGALAFGIGTSQVEHVLATQTLPLARPKTMAITVDGELPDGVTAKDLILAIIARIGTGGGQGYILEYRGSAIEKLSMEARMTICNMSIEAGARAGMIAPDETTFAYLKGRAHAPEGEEWDAAVAYWKTLKSDEDAEFDAEVVIAAAALSPFVTWGTNPGQGAPLSASVPDPASYEDASERFAAEKALEYMGLTAGQPLRDIKVDTVFVGSCTNGRIEDLRAAAAIVEGRKVADGVRMLIVPGSARVGLQAVSEGLDVVFKEAGAEWRHAGCSMCLGMNPDQLAPGERSASTSNRNFEGRQGKGGRTHLVSPQVAAATAVLGHLASPADLADENAARTPAGV

SEQ ID NO: 10224 - protein, 238 aa, Streptomyces avermitilis
MDNSSGVGVLDKAALVLSALESGPATLAGLVAATGLARPTAHRLAVALEHHRMVARDMQGRFILGPRLAELAAAAGEDRLLATAGPVLTHLRDVTGESAQLYRRQGDMRICVAAAERLSGLRDTVPVGSTLTMKAGSSAQILMAWEEPERLHRGLQGARFTATALSGVRRRGWAQSIGEREPGVASVSAPVRGPSNRVVAAVSVSGPIERLTRHPGRMHAQAVIDAAGRLSEALRRTG

SEQ ID NO: 10225 - protein, 165 aa, Streptomyces avermitilis
MFAKPVAGRTTAAAEGDVVVLLIGMRINHLWAVHQWLPVFLAMPRMLRELTRDRSRGLLGHVLLTASPRTYYVVQYWESKEKLYAYATSPDMFHHRAWAIINRKERAGKARGHVGLWHETYVAPEGSYESIYADMPPFGLAAAHGVLPVEKRGRRAKDRFAHRSA

SEQ ID NO: 10226 - protein, 214 aa, Streptomyces avermitilis
MRLAELSERSGVPLATIKYYLREGLLAPGRRISATTAEYDEGHLRRLRLVRALIQVGRVPVATAREVLGHVDDDSLGRTIRLGAALWALPQVPEPDEEDENVRAAQHEVDQLLRTLDWTTAQNLSSISPAHRSLVVAVATLRRLGYAWDAELMAPYAQLMHQAAVRDLDFVETHPSEAEKVETAVAAAILFEPVLRALHRLAQEEESARRYGIE

SEQ ID NO: 10227 - protein, 378 aa, Streptomyces avermitilis
LPQRGRGAVVRRAGRARVATGAPRTPSATQAVNTWLYRSCGAFGPAGVHDRATNRPLTVPAGRDRLADGCLIRENRGTHEPLLTDFPTGTATTRTATVLRTADQDDAQGPGLTLTGTTAVNRPTRRPPPGYRRLMDISAVVWDIDDTIFDYGAADRAGMREHLAAEGLLDGYESVEQALARWREVTDQQWLRFSAGETDWEGQRRERVRVFLGQPLTDTEADDWFQRYVAYYEAAWALFPDVLPVLDALAASHRHAVLSNSSLHVQDRKLRVLGVHHRFEAVLCAAELGVSKPAAEAFHAACDALGLPPHQVAYVGDHPEIDGRGAAEAGLLSVWIDRDGAHTATAVASTGPHRIASLAELPAVLGADTRFGVPSTFG

SEQ ID NO: 10228 - protein, 504 aa, Streptomyces avermitilis
VANANSPKSSTPLGEGVPPRVRFCPSPTGNPHVGLVRTALFNWAFARHTGGTFVFRIEDTDAARDSEESYEQLLDSLRWLGFDWDEGPGVGGPHAPYRQSQRMDLYKDVAQKLLDGGYAYHCYCSTEELDTRRDAARAAGKPSGYDGHCRELSAEQKAAYEAEGRTPIVRFRMPDEPITFTDLVRGDITYLPENVPDYGIVRANGAPLYTLVNPVDDALMEITHVLRGEDLLSSTPRQVALYRALIELGIAKSVPEFGHLPYVMGEGNKKLSKRDPQASLNLYRERGFLPEGLLNYLSLLGWSLSADRDIFTIDEMVAAFDVKDVNPNPARFDLKKCEAINADHIRLLDVKDFTERCRPWLKAPFANWAPEDFDEAKWQVIAPYAQSRLKVLSEITDNVDFLFLPEPVFDEASWTKAMKEGSDALLRTAREKLEAADWTSPESLKEAVLAAGEEHGLKLGKAQAPVRVAVTGRTVGLPLFESLEILGKEKTLARVDAALAKLTA

SEQ ID NO: 10229 - protein, 258 aa, Streptomyces avermitilis
VRIARFSIDGNVAFGAVEGDKPDELVLDIIKGIPFADFELSGTKVPLNKVRLLPPVLPNKVVAFGRNYAEHAKELGNEVPDAPFAFFKPSTSVIGPGDPIQYPSFSNELHHEAELAVVIGRMCREVPRERVKDVILGYTCANDITARDVQKREKQWARAKGFDSSCPLGPWVETDLDPSDVTIQLTVNGQQRQLGRTSEMIHSIEDLIVNITEAMTLLPGDVILTGTPAGVGPLNVGDEVAVTIEGIGTLTNKVIKRG

SEQ ID NO: 10230 - protein, 57 aa, Streptomyces avermitilis
MFRNIANPRRTTLAHLTDADELHTPDQPEHSVDLPTQTANPRRTILMEAPVTASVAE

SEQ ID NO: 10231 - protein, 1278 aa, Streptomyces avermitilis
VQGRFKRDGSASAEPEPHGGTDRGSSPQHAQNPGPGEAGKSGGRTGAPKAPTPPAKPTSSGPSSGSRVALRNWRISTRLVSLLALPVVAATSLGALRISDSMDEIQQLDNMKLLTDMTKQATELAAALQDERDQSAGPLAHGATATDFTVKGVRQKTDRARSAFLSGTQEIDDASGNGQLSGVRDSVVGLAGELSNLSSIRNVAYKDSENATQTVEGYHRLITQLLGLSQDMAEATSNPEMIQRTRALAAFSTAKEYASVQRAVIAASLPASNNTFGKLSENDRQYALSALDSQESEISSFNSIYGDGYEDLTKPIDSGNPTIEAADEYAKRALSDKNGIRQQNKRSYKDWVDDDSAKLEQMSKIELTLLNQMEQKARELRNQSEQEAIISGALILIVLGVSLVGAFVVARSMIRSLRRLQDTATKVAQDRLPELVRQLSESDPQDVDTSVESVGVHSKDEIGQVAAAFDDVHREAVRLAAEQALLRGNVNAMFTNLSRRSQGLIQRQLSLISELESREADPDQLSSLFKLDHLATRMRRNGENLLVLAGEEPGRRWTRPVPLVDVLRAAASEVEQYERIELSSVPTTEVAGRVVNDLVHLLAELLENATSFSSPQTKVKVTGHALPDGRVLIEIHDTGIGLSPEDLAAINERLAAPPTVDVSVSRRMGLFVVGRLSQRHGIRIQLRPSDSGGTTALVMLPVDVAQGGKKVPGKPGQGAPGIGGPAAAQASAGVAAARRGGQSGSPSLGAGAPAGNAGRIGAAPQRGQVGAGQGPRAALPGSNQGGRPGAPGGARGPQQGPAAPQQGRPAPAGAGAGAGAFGQNAPGAPQGLQAAQAFNEGPAATRQGGFGDGGSGTRRGGGFGDSTPAAAPPQQPQQPQQQPKESRRRRPQLPGRGGPRAELPGGSAQPRTPSWSDENAQPPVPRASLDAPRGHEEPDALSATSRLPRVDDRQGPGATSEIPRIDDRQGPGATSEFARPDFDTTRPGAEAPQGGNGQFGRPDMFGTGNQAAPTNRFPAQGRPQDASPTGQPPAYGGSQDPSATGQFATPGYDGSGTGQYATPGYDASGTGQYPAPGQGNRQDSSSTGQFERPQAGGPADFGVPRPPAPQRPARPQQPEALPPAAGPGDGRTPLYDTLETNWFHGQQGQQGQQQSNGSAQAPQQQPQSPAAPQRPAPTPAASSWRSTPNDDLVKQAERVRQPSAGGVTTSGLPRRVPRANLVAGTAQQQQHQAGPQVSRAPDDVRGRLTNLRRGIQQGRQAGTGQTGSFPSPTHQQER

SEQ ID NO: 10232 - protein, 137 aa, Streptomyces avermitilis
MSQAAQNLNWLITNFVDNTPGVSHTVVVSADGLLLAMSEGFPRDRADQLAAVASGLTSLTAGASRIFEGGTVAQTVVEMERGFLFLMSVSDGSSLAVLSHPECDIGLVGYEMALLVDRAGAVLTPDLRAELQGSLLH

SEQ ID NO: 10233 - protein, 132 aa, Streptomyces avermitilis
MTPPTASHDPYAQSYGDEGDQPLVRPYAMTGGRTRPRYQLAIEALISTTADPAQLMGLLPEHQRICHLCREVKSVAEVSALLSMPLGVARILVADLAEAGLVAIHQPGGDENNGGAPDVTLLERVLSGLRKL

SEQ ID NO: 10234 - protein, 192 aa, Streptomyces avermitilis
VDFASSDGGGRTTTSAKIVVAGGFGVGKTTFVGAVSEINPLRTEAVMTSASAGIDDLTHTGDKTTTTVAMDFGRITLDQDLILYLFGTPGQDRFWFMWDDLVRGAIGAVVLVDTRRLADCFPAVDYFENSGLPFVIALNGFDGHQPYNPEEVREALQIGPDAPIITTDARHRADAKSALITLVEHALMARLR

SEQ ID NO: 10235 - protein, 1081 aa, Streptomyces avermitilis
VRRSKNGPEPSARGNFTPPPRGGVPAQSGPEPAAVVAPSGSRLSPRNWRVPTRLNAILLIPVLVGLVMGGFQVKGSIDTWQEARDAEKVAKIVASAGEYAEALLNERDVSAAPLLKGDRNNATVKKARALTDQKADAFHQEVVGMPAKAGLQRRLGLVEKAEPQLEQIRKAAYTTAMDPVKTEEGYVTVEHLLMEFSNELGLGTGNITSYGRTVYAIALAKGAESLERSIGLHLLIKPSSDEKIRAQQITSFTSYAYLEQIALQEYVSGGTEQDYARLTQVMKQKTAAGKAKLAEAKSRTEAAGGTFVAPPALDKMIQAIGSGATPAALAQQGITPTTWMSAATLKFDGYSQVEKELVDRAVNDANDIASSAQRDAYINGAIVVVALLAAFILAGLMARQMSRSMRQLRNAAFNVAEQRLPMLVDQLSRTDPGRVDTRVQAIPITTTDEIGEVARAFDQVHREAVRLAAEQALLRGNINAIFTNLSRRNQSLIEGQLTLITDLENNEADPDQLENLFRLDHLATRMRRNGENLLVLAGEEPGRRWDQPVPLVDVLRAASSEVEQYERVELSGVPEAEIHGRAVTDLVHLLAELLENATTFSSPQTKVRVTATRLPDGRIMVEIHDKGIGLTAEDFADINHKLANPPTVDAAISQRMGLFVVGRLSDRHGIRVQLRPSGEQAGTTSLVMLPDVITHGGGGEQQVQRDEFTVSQIIPEQQNFAGGGEAFQVEPMRTAAELGFDDSRYTEVPDDIRELDPVGRSLMREERRAALEAQAHGPQDGSEGQRYQDEFDASQQPAYGNGQNGYPEQQAGYDQQTAYEEQQQPAYEEPYFAPNGDFSQTGEFPATGEFAPNGDFASNGGYPEPSYAEPNQESNSGGGRTASETFSAFDEPSYQDDWPKQDDYQSGYRSEYAPEAESSQAADVSERDHVGFTRPGPAPSAAHALTDAGLPRRGSTGNGNGNGPQRVSPDPSAAPAGTETGGMGSNWRSSNDERWQQASQLKKPKAGGVTSSGLPRRVPKANLVEGTADSTPQGGPQVSRAPEDVRGRLSNLRRGVERGRNAGSDTNGQGLGPDSTYNQER

SEQ ID NO: 10236 - protein, 137 aa, Streptomyces avermitilis
MSQAAQNLNWLITNFVDNTPGVSHTVVVSADGLLLAMSEGFPRDRADQLAAVASGLTSLTAGASRIFEGGAVNQTVVEMERGFLFLMSISDGSSLAVLAHPEADIGLVGYEMALLVDRAGTVLTPDLRAELQGSLLN

SEQ ID NO: 10237 - protein, 194 aa, Streptomyces avermitilis
VATPPGGSSSGNWSYGPGQGQGQGEQNRYNFPSAPSPRRQPYAPQGPQGPGPSPYDQPSAPRIQPVQPQRRSPEPAPAGSSSNPLVRPYAMTGGRTRPRYQLAIEALVHTTAQPHQMQGQLPEHQRICNLCREIKSVAEVSALLTIPLGVARILVADLAEAGLVAIHQPGGDENAGGQPDVTLLERVLSGLRKL

SEQ ID NO: 10238 - protein, 174 aa, Streptomyces avermitilis
VVAGGFGVGKTTFVGAVSEINPLRTEAVMTSASAGIDDLTHTGDKTTTTVAMDFGRITLDQDLILYLFGTPGQDRFWFMWDDLVRGAIGAIVLVDTRRLADCFPAVDYFENSGLPFVIALNGFDGNQPYNPDEVREALQIGPDTPIITTDARHRADAKSALITLVEHALMARLR

SEQ ID NO: 10239 - protein, 64 aa, Streptomyces avermitilis
MNPPDIRVEKGHAEPEEVAAITAILLARAATAPAASPARRGRPKAGWRRLEREPGFRAPHSWHG

SEQ ID NO: 10240 - protein, 531 aa, Streptomyces avermitilis
MTVLDETPGETSGEPTDARGRVAELHEIRAQALAGPSEKATDAQHAKGKLTARERIELLLDPGSFQEVEQLRRHRATGFGLEAKKPYTDGVITGWGTVEGRTVFVYAHDFRIFGGALGEAHATKIHKIMDMAIAAGAPLVSLNDGAGARIQEGVSALAGYGGIFQRNTKASGVIPQISVMLGPCAGGAAYSPALTDFVFMVRETSQMFITGPDVVKAVTGEEITQNGLGGADVHAETSGVCHFAYDDEETCLAEVRYLLSMLPQNNRENPPHAESSDAADRRSDVLLDLVPADGNRPYDMAKVIEELVDDGDFLEIHERWARNIICALARLDGRVVGIVANQPQTLAGVLDIEASEKAARFVQMCDAFNIPIVTLLDVPGFLPGVDQEHGGIIRHGAKLLYAYCNATVPRISLILRKAYGGAYIVMDSQSIGADLTYAWPTNEIAVMGAEGAANVIFRRQIAEAEDPEAMRTRMVKEYKAELMHPYYAAERGLVDDVIDPAETREVLIKSLAMLHTKHADLPSRKHGNPPQ

SEQ ID NO: 10241 - protein, 775 aa, Streptomyces avermitilis
MHMTPNRRTFLRAAVLAAGITATVTATGAPSAYADDEYDTLRRRWLVLALGAGYDPTAEPYASRLRRTGELARGYRATMAPAAASLWPGHPFDPPSGITQSYSRLWTMTQAYVQEGTGSTGDAGLLADIVRGLDHVSATVYNPTTTRYGNWWEWQIGSPRLLMDIVAALHDRLSAARRAAACAAVGHFIPDDMLRDYSGTSTGANRVDLCRGVALSGILGRAPDRIALARDALSPVFPYVTQGDGLYADGSFVQHTWVAYSGTYGQVLLDGLGRLFSLFAGSTWDVTDPNRQIILDSVEQAYAPLIHDGLVMDSVNGRAISRGYLKSDDLHVMRGDHFHGQALIAAIALLAGGAGPQERARWHARIKGWIERDDVTPILTAPQFGVADLARLHAVADSGVRAAPEPAGHHLFAHMDRAVHRGRGFAANISMSSERIASYECGNGENPRGWHTGAGMLLWWSGRTDQYTDWYWPTVDWYRLPGTTVSTKRLADRAGGEWGEPKPAVRWVGGVTDGVYAAVGQQVKGLGSTLEARKSWFCVADSVICLGAGITCRDGVPVETVVDNRNLGEGGTQAFVRGHGWAHLEGHGGWVLPAGGELRALREDRTGAWSDINTTSTTERRTRRWQTLWLDHGTDPVDATYAYVLLPGASRAQVAAHAADRHRLSVLANDARRQAVHVGSLALTAANFWSAGTAGPLAASAAASVLVRRRGRTATLCVSEPSRTGQPLEIVWDHPVGRVVRADPAVDIVAAGRRLRVRVTPGMACATHKCEVTLS

SEQ ID NO: 10242 - protein, 169 aa, Streptomyces avermitilis
MQFRRKFRSALTALALVVAPGVAVVGTATDAFAVTKISHATATSMFRGAGITWSSSGGCSDRNNPSCTSFEQLNLATAQGAQTLKQATGCALNITGGTETGHASGTYSHWNGYKLDYGKSTCVTTYIKNTFTYIGLRGDGAPQYRSGSGNIYADEGNHWDVLYYNCGGC

SEQ ID NO: 10243 - protein, 206 aa, Streptomyces avermitilis
MGIFGRKNTTDTTSTTATAPTAAVSPELAALTGTYTIDPAHTTIGFVARHAMVTNVKGGFQEFEGTLHLDGGDPAKSSAVIEVRMDSIDTGSSDRDTHLKSSDFFKTDEFPTMTFRSTKAEALGGDDYRITGDLSLLGVTKPLSIDLEFNGAARDPFGNERVGFEGKTEILRSEWGLTWNAALETGGVLVSDKIKLVFDISAIKQA

SEQ ID NO: 10244 - protein, 456 aa, Streptomyces avermitilis
MKAVLLPGVRLRGLFLSLIALVAAALAVLSTGAPPGHAATSVSAVAEALRESPVYVDPAASAQLSAADADALAKKIEDADKPVFVAVLPAGFPTRNLFTDLRTDTGVTGLYAIRLGDRFDARADSAVLSRSAVQNLVKSVQGEDTKTQLNDFTDRALRNMGGSAPSSWDSSGGGGVSSTSLIGVGAVLVAGGAGAYTLVRRNRRRKEEEQRAALDKLRVVVDEDITAFGEELDRLDFHPAEAGADDAMRADYERALDAYERAKSSMAAAERPEDVRAVTEALEDGRFSLAQLAARREGRPLPERRAPCFFDPRHGPSVTDATWTPAGGAPREVPVCAADRARLSDGLAPAVREVDTEYGRRPYWDAGPAYGPWAGGYFGGGLLPGLLVGTLLGGMMSSPSYASDYGSGYGDFGSGGYAGGDVSGADFDASDFGGGFGDGGGGGGDFGGGGDFGGGF

SEQ ID NO: 10245 - protein, 1011 aa, Streptomyces avermitilis
MRRTALLVSAAMLTGLLPLAGAAAAVGADDPAPVPVDQFEGEVPFASPPAEGIFTWGGDTDDPPQLALTARADAPEGDKVLTGTYDISGYGGFTHDFAFDRPAHDWSAHQGIRFWWDGRGNGKKVAFEIKDGGANGEASELWTTSFTDDFTGWKQIEIPFTDFTYRTDYQPVGGIDQVLGLTGMWGYAVTLPAGVKGQFAMDGVELYGRGDQSLRASVVTDSAVHPVKEGRTADVRVSVATTGSAPIDEPVTVAYEATGGTAESGKDYTPVKGSVTFPAGTASGTSRTIQVPTLKDRSAEPAETIPLKLTVTGAKAPAETPQVVIDAHGLPYLDPKLPVKKRVADLVSRMSLEEKAGQMTQAERGALTAQGDIAAYDLGSLLSGGGSTPTPNTPEAWAKMIDAFQLRAQATRFQIPLIYGVDAVHGHNNLTGATIMPHNIGIGASRDPGIARRTGAVTAAEVRATGIPWDFAPCLCVTRDERWGRSYESFGEDPALVKSMETVIQGLQGARDGKDLKDDDKVLATAKHFVGDGGTAYGSSTTGTYTIDQGVTKVTRQELEAVQLAPYQTAVDRGIGSVMPSYSSLDILGDGQGAVKMHARADMINGVLKDRMGFDGFVISDWKAIDQIPGDYASDVRTSINAGLDMIMVPYEYKDFRTTLIDEVKAGRVSQKRVDDAVSRILTQKFKLGLFEKPYADTSGASRIGSSAHRAVAREAAAESQVLLKNAGGVLPLKKSQKVYVAGSNADDLGNQTGGWTITWQGSSGKHTDGTTILDGMRKAAGSGGAVTYSKDASAPTSGYDVGVVVVGETPYAEGVGDVGNGNDLELTAADKAAVDKVCGAMKCAVLIVSGRPQLIGDRLGDIDALVASWLPGTEGDGVADVLYGKRAFTGQLPVTWPKSEAQLPINVGDTTYDPQFPYGWGLTTLTKVPAGGAATLKALAVAAAVAERTGSGKAGRALVGKARLLVQQKAGSGPGITAAVAGPFADADHLLLTGKYGAAVAKLTEAYRAA

SEQ ID NO: 10246 - protein, 647 aa, Streptomyces avermitilis
LTRVRGRHLLTPRTPHSPTPEGRRAMRRSTRAARLLLAGLLSTAGLTAVSTAPAHAAGEQVTAWLTTTDDTGGRHVVRGLQAQTPFAFQSGSGGSGENITVDENTRYQTFTGGGASFTDTAAWLMNSSGALSATTRNAAMTKLFSPTDGIGLSFLRNPMGASDLARYGYSYDDVPAGQTDPNLTSFSIAHDLADVVPLTKQALQLNPSLTVMASPWTAPAWMKDSGSLNGGWLKSEDYGAYANYFVKYLQAYKAQGVNVSYVTAQNEPTCCSGYPSMSWNASGLAYFTKSELLPKLQAAGLTTKVLAHDWNWDVYDSYAASTVDDAAVRSHPNFGGIAWHGYGGDIAKQTSVHNQYPTLDAFGTEHSGGTWIANQQREDMSNIIDYTRNWAKSVTKWSLAVDQNMGPHNGGCGTCTGLVTVHNGDGASGTVDYTVEYYTMGHLTKFVRPGAQRVASTASASVPNVAWRNPDGSKALIAYNDASTAKTVTLNWGSQHATYSLPGKTSATFTWSGTQSGGGDQTGSFVGLAGKCLDVASSSSANGTAVQLYDCNGSTAQRWTVKADGSVQALGKCLDVTSASTADGAKIQLYDCNGTAAQRWSYNASTGDVVNTAADKCLDVTGNSSANGARAQIWSCTGAANQKWKLQ

SEQ ID NO: 10247 - protein, 534 aa, Streptomyces avermitilis
MTETSELDDSFHVFDTTLRDGAQREGINLTVADKLAIARHLDDFGVGFIEGGWPGANPRDTEFFARAQQEIDFKHAQLVAFGATRRAGAKASEDPQVKALLEAGAQVITLVAKSHDRHVELALRTTLDENLEMVRDTVSYLCSQGRRVFVDCEHFFDGYRANPEYAKAVVRAAAEAGADVVVLCDTNGGMLPAQVQAVVATVLADTGARLGIHAQDDTGCAVANTLAAVDAGATHVQCTANGYGERVGNSNLFPVVAALELKYGKKVLPEGALREMTRISHAIAEVVNLTPSTHQPYVGVSAFAHKAGLHASAIKVDPDLYQHIDPERVGNTMRMLVSDMAGRASIELKGKELGVDISGDRELVGRVVERVKERELKGYTYEAADASFELLLRAEAEGKARTYFEVESWRAIVEDRPDGTHANEATVKLFAKGERIVATAEGNGPVNALDRALRVALEMIYPQLAKLELVDYKVRILEGKHGTSSTTRVLISTSDGTGEWSTVGVAENVIAASWQALEDAYTYGLLRAGVEPAE

SEQ ID NO: 10248 - protein, 443 aa, Streptomyces avermitilis
MALMGREHWKTIWVGSAGNMVEWFDWFVYASFATYFAGAFFPDGNPTAQLMNTAGIFAVGFFMRPVGGWLLGRVADRRGRKTALTLTVTLMSASAVLIAIAPTYAVAGYGGAFVLLLARLLQGLSVGGEYAASATYMTEATDPKKRGFASSFQYVSMTVGQLIGLALLIILQRTLSEDALAGWGWRIPFVVGAAGAAVVFYLRRTMLESEVYEESADGDAAVGEKGSLRALWEHRREAFLVVALTMGGTLAYYTYTTYLTKYLSNTAGLPKQTATLVSFCALLVFACVQPLAGALSDRIGRRPMLITFGVCATFLTVPVMTLLSKVDSFWPAFGLALFALVMITPYTALSAVVKAELFPTGVRALGVALPYALANSLFGGTAEYVALWFKDGGIESGFYWYVAACAAVSLVVYVTMRETRDVDLHRVGDGRKSSHERTARLAS

SEQ ID NO: 10249 - protein, 447 aa, Streptomyces avermitilis
VIGSTSDGLVPGNTDMPATPTTALTALRTPHPPTGGESMHPRTRTAPALLFAVCLTALAAYPAAADDPVPTTERVSVTLDGAQIDDPSYRPQLTSKGGVVYTSDGPVWSTDHNGVSDAYRNSERVSYNMGAARSYDPSACHTARMIAFVSDRTPAGGTTPSVYVRNTPVGKLSYASHGYQGVPFTWAGQPAMSADCQWMAFSATLPATPDHVEQPRVYRYRIYDGTIEQVSPDSADGSRAAVRPSISADGRYVAYQSSIPHPGGPANDSDIYVRDLETGTLEKASVGRHGRPADRASTGPSLSADGRHVAFDSYASNLAPGDTNGTVNVFVRDLDAGTTRLVKGAGRHAYTAEAALSGDGLHLAYVSAGIRGSRGVPAVYLRDLATGRTRLISVDTRGHRNDRAAGNPSVNPDGTAVAFDSASPDLVPGDTNGTVDVFLRRLGSPEA

SEQ ID NO: 10250 - protein, 206 aa, Streptomyces avermitilis
MAGAGRARKNAPPREEVLAAAMDMIAERGLEKLTMAALGREVGMSSGHLLYYFHSKDELLLQTLEWSEGRLGIERGRLLTRTAPARERLDAYVDLYVPDGHRDPHWTLWLEVWNHSQNADEQGRERQAAIEGAWHRDLVALLAEGVSRGEFRPVDPDRLAARVRALLDGFSIHVAIGLRGTDRGQILGHVREFLDESLGRPGLADT

SEQ ID NO: 10251 - protein, 346 aa, Streptomyces avermitilis
MSTPAADGFRMPAEWTPHERTWMAWPGPNPTFDHPDDLAESCRAWADVARAIRRFEPVTVVCGPGRSAEARDLLGPGIDTVERDLDDAWMRDIGPTFLTDGKGGLAAVDWTFNGWGAQSWARWEHDAKIAAYVGDLAGAKTYASKLVNEGGAIHVDGEGTVLLTETVQLGAERNPGWTREQVETEIHAHLGTSKAIWLPRGLTGDYPPHGFGTLGHVDIVAAFARPGVVVAHHQPDPAHPDHEVSKEVIGLLKAATDAHGRRIEVVEVPAPTVLEADGHWADYSYINHYLCNGGVVLCGFDDPRDETAAGIFRRLFPERTVTLVDARTIFSGGGGIHCITQQQPKN

SEQ ID NO: 10252 - protein, 556 aa, Streptomyces avermitilis
MNPYAYAATHGPRAGDRVRLGDSGLTIRVESDAQQYGDEFLAGFGKTARDGLHLKAAAVRDTCDVVISNVVVIDAAQGIRKVSIGIREGRICSIGRAGNPDTLAGVDVVVGTGTSIVSGEGLIATAGAVDTHVHLLSPRIMEASLASGVTTVIGQEFGPVWGVGVNSPWALRHAFSAFDAWPVNIGFLGRGSSSDPAPLVEALAEGGASGFKVHEDMGAHTRALDTALRVAEEHDVQVALHSDGLNECLSVEDTLRVLDGRTIHAFHIEGCGGGHVPNVLKMAGVPNVIGSSTNPTLPFGRDAVAEHYGMIVSVHDLKPDLPGDAAMARDRIRAGTMGAEDVLHDLGAIGITSSDAQGMGRAGETVRRTFAMAGKMKAEFGAPEDHDNARVLRYLAKLTINPALAHGLAHEVGSIEVGKLADIVLWRPEFFGAKPQLVLKSGFPAYGVVGDPNAATDTCEPLVLGPQFGAHGATPAEISVAFVAQAALDQGNDRMPTRRRRVAVRGTRGIGPADLRLNSRTGAVDVDQRTGLVTLDGDPIRSEPADSVSLNRLYFL

SEQ ID NO: 10253 - protein, 227 aa, Streptomyces avermitilis
VRLTPTERDRLLLFGAAELARARRARGLRLNVPEATALIADTVCEAARDGRRLAEAIAAARAVLGPDDVLPGVADIVTEVHVEAVFDDGSRLAVVTDPIGGGLGDQAPGALLPGPEHTEPEAVVRVLVTNTATVPVSVTSHFHFFEANPRLDFDRAAAYGMRAAVPAGSSVRFGPGESVEIGLVPVGGDRIAIGFAGLVDGPLDAPGAKEEALRRAAACGYLGVEQR

SEQ ID NO: 10254 - protein, 362 aa, Streptomyces avermitilis
MTTPTIELKPSASPLSDAEREAILASPGFGRHFTDHMVTIKWTEGRGWHDGQLVPYAPLSLDPATMVLHYAQEIFEGLKAYRQPDGSVASFRPDMNAKRFQASARRLGMPELPVETFIEACDVLVQQDASWVPAHGGEESLYLRPFMIATEVGLGVKPANEYLFLVIASPAGAYFPGGVKPVSIWLSEDRVRAVPGGMGDAKTGGNYAASLLAQAEAAEKGCAQVAYLDAVEHKWVEELGGMNLYFVYGNKIITPALTGSLLAGVTRDSLLSVARDLGYESEEGRVSIDQWQADTENGTLTEVFACGTAAVITPVGTVKRSSAEWQHSGGEPGEVTLKLREALLDIQRGIGEDKHGWMHPLG

SEQ ID NO: 10255 - protein, 347 aa, Streptomyces avermitilis
MARSINLAVIPGDGIGQEVVAQGLKVLSAALPSDVKLETKEFDFGARRYHATGETLTDADLDALKQHDAILLGAIGDPSVPSGVLERGFLLKLRFAFDHHVNLRPSKLLPGVETPLAGQPEIDFVVVREGTEGPYTGNGGTIRTGTPHAVATEVSLNTAFGIERVVRDAYARAQARPRKKLALVHKNNVLVHAGHLWTDIFNKVGEEFPDVTTEYMHVDAATIYLVTQPERFDVIVTDNLFGDIITDLAAAISGGIGVAASGNINPSGAYPSMFEPVHGSAPDIAGQGKADPSATILSVALLLRHLGYEAEAARIEEAVSADLAERVGKPARSTDEIGDALTVRVAG

SEQ ID NO: 10256 - protein, 549 aa, Streptomyces avermitilis
VAVHASRVNPSAAVHPYVWRSLGFAGKFTGMDTPNVGIPERLARRMSMAEQYEYLRTKLSRRGVLLTAGGVAGGLLTGCAGSGTATGTPSSAPATGTVHGSAVAPFGRHLAFGADPKTQMRISWQVPLAVQKPYVRVGLKPTDLSRRMAAEVRDLHTPGLTGQRFAVDQYYLHAALDGLRPGTRYYYGVGHDGFDPASRERLSTVGSFRTAPAAPETFVFTAFGDQGVSYDALANDKVILGRHPSFHLHAGDICYADTTGHGEESDIYDPRVWDQFLAQTESVAKSVPWMVTTGNHDMEAWYSPNGYGGQSARWTLPDNGFDPQKAPGVYSFTYGNVGIVALDANDVSYEIPANKGFTGGRQTAWLDRRLGELRASASVDFVVVFFHHCAYSTSTHASDGGVRDAWLPLFAKHQVDLVINGHNHVYERTDAIKGGRVGRAVPVGASTDPTRDGIVYVTAGGAGKSLYSFPDGVKDSYEGNVADRESVDTFHWTEARHRKHDTVEWSRVRYTGFSFLSVEAETGAAAKLKVSALAQSGERIDYFEVRRGA

SEQ ID NO: 10257 - protein, 43 aa, Streptomyces avermitilis
MAETTVRRRVRHISPASESDRKNAAAALQRALDRRDNGGKTGH

SEQ ID NO: 10258 - protein, 189 aa, Streptomyces avermitilis
VVVGVRDTGPMAIRLRTAHTVDLTAAELRSVRSLLDGAFEGGFDDEDWDHGLGGLHVLVYDARGLAAHGSVIQRRVLHRGRSLRVGYVEAVGVRAEARRSGLGGRVMAELERIVEGAYDLGALSASEKGAALYAARGWQVWPGRIGALGPDGIVRLPGEEGSTFVRAAGAGPLDPAYDLVFDWRDGDVL

SEQ ID NO: 10259 - protein, 289 aa, Streptomyces avermitilis
MTTHRIHHRTATVRGHEIHYREAGPAGAPVLLLLHGFPTSSHMFRDLMPLLADRYHLVAPDHLGFGRSSAPAATEFPYTFAGLAEITDEFTEQLGLKEYALYIQDYGAPIGLRLALAHPERVTAIITQNGNAYEDGLGAEAWAPVLALIAERTPATEEPVRALSGPEGIKWQYLHGVPDPTLVSPDAYEHDAALMARPGQSEIQLDLISDYGSNFALYPAFQEYFRTSQVPLLAVWGGHDEIFVPAGALAFQRDLPTAEIHLLPTGHFALETHAGQVAALMDDFLARRV

SEQ ID NO: 10260 - protein, 543 aa, Streptomyces avermitilis
MDAVTQVPTPVNEPVHGYAPGSPERARLEAKLKELAENPIELPMTIGGEKRLGGGERFEVVQPHNHKAVIGTGAHATQQDAQDAIDAALAAAPAWRAMSFDDRAAIILRAAELLSGPWRETLAASTMLGQSKTAQQAEIDCPCELVDFWRFNVKYARDLLAEQPPANSPGVWNRLDHRPLEGFVYAITPFNFSAIAGNLPTAPALMGNVVVWKPSPTQTHAAVLLMRLLEEAGLPKGVINLVTGDGIEVSKVALEHRDLAGIHFTGSTKTFQYLWKTVGNNIEKYRSYPRLVGETGGKDFLVAHPSADRAVLKTALTRGAFEYQGQKCSATSRAYLPASIWNSGFKEEFAAEVDYLTMGDVTDLSNFVGAVIDERSFAKNKAAIDRAKSDPTCTIVAGGEYDDSVGYFVRPTVVECSDPENEVFKTEYFGPFLAVHVYEDDAYDEMLTQMESASDYALTGAVVSNDRAAAAYTMDKLRYAAGNFYINDKSTGAVVGQQPFGGGRASGTNDKAGAPQNLMRWTLTRAIKETLVPPTDYTYPHMG

SEQ ID NO: 10261 - protein, 308 aa, Streptomyces avermitilis
VLGPVILAASRSDRMRRFVSAAPGTKQVVARFIAGESVDQVVPVVQDSAAKGLEVTLDVVGEDITTREQAYAARDAYLELIGRLKELDLGTQAEMSVKLSMFGQALDGGHELALANVRPVVEAAAAIGTTVTLDAEDHTTLDSMFAIHEELRKDFPGTGCVIQAYLFRTEADARRLAANGSRVRIVKGAYKEPAEVAYQQKSEIDKAYVRVLRILMEGEGYPMIGSHDPRLISIAQELARRAGRKLDEYEFQMLYGIRGEEHLRLAAEGHRMRVYTAYGTDWYGYFMRRLAEKPANLRFFARSMLTRG

SEQ ID NO: 10262 - protein, 399 aa, Streptomyces avermitilis
MRENARVKADYKGDYQELVDEISALLGAPATLENRDFELIAFAAYDSDGDGGFDEATLDPVRTRSILTRRSTPAVRKWFEGFGIAQAAGPVRIPPTPEAGVHRGRVCLPVRHRGVVLGYVWLLDTDPGPSTEQLAAAMEVAARIGALLGDEAQAGADLTRELRAVLTAERGWQRDMAVAELRTALGPRGDSLHTVVCVAPWPSADPDDAPSVRTVPGATALCTVPWGTTAQSLALLVRLRSADVLTPALTAAARLLERARGGTAAAAGVAVARSGLVELGTAWQEASAAARAVLAEPRLGPVAEWASIGPFRLLTALPPKAAHDPAVRTLLSPAHRELARTAEVYLDCAGQAGRTAAELGIHRQTLYYRLSRVEQLTGLDLDDGEDRLLLHMALKGARL

SEQ ID NO: 10263 - protein, 498 aa, Streptomyces avermitilis
VKIVMDMNGTSLDELSRSWDEVRENHRDYYNDQYDRTVLDCAARLAADPGGGAAYVWTLGLLVMAPYVNWLPGEGVTTAAVAALEAADEALRDRPCDHASHPYQVHDAEDDPYLTEQLAPLADERADREGQRPRDEWLCPPNVAGFARIALDVVDPGSVTDVPPRLPAEAQDTIDTLSALLHGYPHPGTDIDDEISSQASNLSCAEPADRAGHLLVVRAVTWYAVSGMVRTKSVLDDLAEAVEKALPHFAAASCAHEWHATLPDSGPDAAELGVRLSSAGGRGRYERDRTESGRGAPLEHVLCPVFMAEVADRTLTMLRERREVLFGNRDTSHLDAEYLRADGRLEIARIVERLAHHSWNEEYADDLALWAARRHERADGRERAVLLLAAHQATEISYPSPPLSVVRGVLATLRTVAAAPRLERCAHDDEHPPLRYEEFRDAMLHFYAPEEFPPPEECPSPEAWTCPRFAVTVAEECVSGLEGLYEDEDEAEGEPENG

SEQ ID NO: 10264 - protein, 196 aa, Streptomyces avermitilis
MGHREDLLEGAKRCLVEKGFVRTTARDIVKESGTNLASIGYHYGSKDALLAEAYVDLISNVGDTFGAFDEGAATGEPGSLERFEEAWRGVIRSFTEARPIWLLTFEVVTNADRLPTVREHLVKAQDEGRRGLIPMFMGGREEDVDDEALRTLGGFYQTLLNGLCLQWLFDPDSASTAEGLTAGLRRVIEAAAKPTG

SEQ ID NO: 10265 - protein, 490 aa, Streptomyces avermitilis
MLPLLLVSMDVSVLYFAIPSITADLEPSSTQQLWIFDIYAFVLAGLLMTMGSLGDRIGRRKLLLIGAAAFGTASLVAAYANSAETLIAARAVLGIGGATLMPSTMAIVRTMFTDPGQRAKAVGLWSGVMTAGIALGSVMSGVLVEYFWWGSVFLVNLPAMALLLVLGPILLPESKNPDPGRFDLLSVPLSMAAVLPVIYGLKEIPSEGWHASYVVCVTVGLLFAALFVHRQRTAASPLISPALFRAHGFTPAMVLNLISCFAMLGSAFFTTQYLQSVLGNSPLEAALWSLLPSVLIGFAAPVTTQLVQKGVNRAYVVSAGFVVAAGGYGMLALAGTDSMWLVLAGAGVLASGIVTVMSQMMDLAMGAAPLEQAGAASSLMETSAEFGGALGMAVLGSIGTAVYHHEIPASAPAPAHETLGAALAVAQELPGGAGTALIAVARDAFTSGMQAAALAGAVLLLGAAFLATATLRKVAVRESESATPEQVPAA

SEQ ID NO: 10266 - protein, 1004 aa, Streptomyces avermitilis
VPQLPPSVETPFIGRAAELARLTGVLDRARGGDPRAVLVAGDAGVGKTRTLAEAAAHATRTGMTVLTGHCVDLGDVGLPYLPFTEILGTLATDDRLAPALAAHPAVDRLLGGGADGSRLQLFESVAALLADLSEHGPLLLVLEDLHWADQSSRDLLRFLLSRGVLQLPTAGAPAHRLAVFASYRADDLHRRHPLRPLLAELVRLPAVDRLELRPMADAEVTRLVRALRAGPLPDTTVRRIVERAEGNAFYAEELLAATTDTATGTGEPPHESMDGPTPALPSGLADVLLIRLEQLSDTAQQVLRTAAVAGRRVEHDLLREAVQLPDDELESALREAVGRQLLVPDDRDTYSFRHALTREAVYADLLPGERVRLHRTFAGLLTAAGRHDGPPGSHPAKTAAERAHHSRESHNLPDALSASLEAADHAQRLGAPAEELSHLEAALELWPAVAPADRPTTPGLDTVTLTLRASAAAAHAGESHRAVSLTRAALARAGTDTDSELAARVRYTLAGNLMRVDSLKAAFTYSSEALAMIPAEPPSRTWVWAAATHAMAARYVGEDEDAGRVARQALAVAERLELADAQADLIVSLVGLDGHDRRTPEGRDRLRQARELARRAGNVSVEMRALFNLAIGAYETGALDDCLTWLSDGLDRASRTGLLSSPYALELRYLQSLILYTLGRWDECARAAAADAERLPAAAGFAIGPALYVALARGERSAADRAQALLDGPSEWMATLVAGIVLTDAAALRGDPEAAVERVHGTLAALADGAVNERPDVGVRLAALALAAVADAAEEARLTGDAATVRRWTDTAAELLELARTTADRGEDGTEQGPEGVAWLARAEAEWTRTVSGPDVVVWEKAVTAFAYGDPYERARCRRRLAQALLAAGRREEAAEQARAVRETATLLGAAPLLDAVETLVRRGRLAETSPAADGTAVLTARENDVLRLLARGRTNRQIGEELFITGKTASVHVSNILAKLSAASRTEAVVIAYREGLLEPEPT

SEQ ID NO: 10267 - protein, 529 aa, Streptomyces avermitilis
VSSKPVVLIAEELSPATVDALGPDFEIRHCNGADRAELLPAIADVDAILIRSATKVDAEAVAAAKKLKVVARAGVGLDNVDVSAATKAGVMVVNAPTSNIVTAAELACGLLLATARNIPQANSALKNGEWKRSKYTGVELAEKTLGVVGLGRIGALVAQRMSAFGMKVVAYDPYVQPARAAQMGVKVLSLDELLEVSDFITVHLPKTPETLGLIGDEALRKVKPTVRVVNAARGGIVDEEALFSALKEGRVAGAGLDVYAKEPCTDSPLFELDEVVCTPHLGASTDEAQEKAGISVARSVRLALAGELVPDAVNVQGGVIAEDVKPGLPLAEKLGRIFTALSGEVAVRLDVEVYGEITQHDVKVLELSALKGVFEDVVDETVSYVNAPLFAQERGVEVRLTTSSESSDHRNVITVRGTLGNGEEVSVSGTLAGPKHHQKIVAVGEYDVDLALADHMVVLKYTDRPGVVGTLGRILGGAGINIAGMQVSRAVAGGEALAVLTVDDTVSQNVLTELAEEIGATSARSVNLV

SEQ ID NO: 10268 - protein, 333 aa, Streptomyces avermitilis
VAELFYDADADLSIIQGRKVAVIGYGSQGHAHALSLRDSGVDVRVGLHEGSKSKAKAEEQGLRVVTPSEAAAEADVIMILVPDPIQAQVYEESIKDNLKDGDALFFGHGLNIRFGFIKPPAGVDVCMVAPKGPGHLVRRQYEEGRGVPCIAAVEQDATGNGFALALSYAKGIGGTRAGVIKTTFTEETETDLFGEQAVLCGGTAALVKAGFETLTEAGYQPEIAYFECLHELKLIVDLMYEGGLEKMRWSISETAEWGDYVTGPRIITDATKAEMKKVLAEIQDGTFAQAWMDEYHGGLKKYNEYKTQDENHLLETTGKELRKLMSWVNDEEA

SEQ ID NO: 10269 - protein, 175 aa, Streptomyces avermitilis
MSKHTLSVLVENKPGVLARITALFSRRGFNIDSLAVGVTEHPDISRITIVVNVIEALPLEQVTKQLNKLVNVLKIVELEPSAAVQRELVLVKVRADNETRSQIVEIVQLFRAKTVDVSPEAVTIEATGGSDKLEAMLKMLEPFGIKELVQSGTIAIGRGARSITDRSLRALDRSA

SEQ ID NO: 10270 - protein, 616 aa, Streptomyces avermitilis
MTEQATGAHHPQPRPRSGGQQSAPEHVTGAQSLIRSLEEVGAETVFGIPGGAILPAYDPLMDSKRVRHVLVRHEQGAGHAATGYAQATGKVGVCMATSGPGATNLVTPIADAHMDSVPLVAITGQVASKAIGTDAFQEADIVGITMPITKHNFLVTKAEDIPRTIAEAFHIASTGRPGPVLVDIAKDALQAQTTFQWPPTPDLPGYRPVTKPHAKQIREAAKLITQAKRPVLYVGGGVLKAKATAELKVLAELTGAPVTTTLMALGAFPDSHKLHVGMPGMHGAVTAVTALQKADLIVALGARFDDRVTGKLDSFAPYAKIVHADIDPAEIGKNRAADVPIVGDAREVIADLVQAVQKEHSEGHAGDYTAWWKDLNRWRDTYPLGYEQPDNGSLSPQQVIERIGQLAPEGTIFAAGVGQHQMWAAHYVKYEQPATWLNSGGAGTMGYAVPAAMGAKAGQPDRTVWAIDGDGCFQMTNQELTTCALNNIPIKVAIINNGALGMVRQWQTLFYNQRYSNTVLHSGPGADGKQPSAGTRVPDFVKLSEAMGCYAIRCESPDDLDKVIAEANSVNDRPVVIDFIVHEDAMVWPMVAAGTSNDEVMFARDVRPDFGDNEDD

SEQ ID NO: 10271 - protein, 1045 aa, Streptomyces avermitilis
MDQRSDAAGRPTATLVCGGAQTRPRWPSPAQARRSQAARTAGAGPAGPRSGPGPVGPVSSPGALLVRQPALGGGTSLVPQLVLALVCAGYALGSALGWGSQRVALVMGDFGLSAAAGTAAVSCLLYARTRRSRFRLAWLLFALSSAMASLGNGVWGWYEVILHHPVPSPSYADLFFLCFAPPAIVGLLVLAKRPVTKAGWVCLVLDAWLIGGSLLTLSWSLALAQAAKFDGPSVAHTALSLAYPLLDIALVSMVLALHFRRSAVNRSAVNTAIGALALTVMCDALFTSPLLHDNYRSGQLLDAGWFAGSLLLAYAPWVGVRFGQRESGHARVVHEHVPGPRPAGSRPAGPRPPGHPGDRPRAPLQDGGHSRYPATRPIAGSLGALTPYLAAAVCTLGILYNMLNGRNVDRVVLITAGAVVLALVVRQGIMLLDNITLTQELAQKENHFRSLVQGSSDVIMIAAPNGILRYVSPAAAGVYGRPAEDLVGTELASLIHPEDLRCVVHEVRRFLAASHTEEPTTRIECRFKSGYGGWLNVESTVNRHHGGLIFNSRDVTERVRLQAQLQHNAEHDPLTDLPNRALFTKRVQQALSGRRTSDRGTAVLFIDLDGFKAVNDTIGHQAGDELLVQAARRLQDAVRYGDTASRLGGDEFAALIVGDGTRDRTAREGHIMELADRLRVTLSQPYAIGGNDVRVAASIGVAFAEPGLGAGDLLRNADLAMYRAKAAGKGRVELYAPQMQQDVVRKAELATRLRAALHDGEFALLHQPVVSLEDGRITSVTAQARWRSSQGVLFTPAEFLRVSEDSDKAAELGRWILEEAVEQAAERTATGLAVPVGVRMSARRLLDRSLPLGSVEALLTRHGLASGALVIELSDTDPRVSLDELERRLSALRRIGVRIALDGFGSGYAAITALRRLPVDVLKLDRGLVEGVVESARLHKITSGLLRIASDLGLQSVADGVDLPEQVLALRAMGCTHGQGTAFSGPLDEYRLRRALATGQYPVPHGPAEPAFAGGGAGVYTPGVPVVFGGGTALRSHNETPVPPT

SEQ ID NO: 10272 - protein, 313 aa, Streptomyces avermitilis
MTSDVWLPLRAEEIDGLPEDLTYRFWDGGKEFPADPADCAFYVVPYMKGAEIALRPLPEMTSVRVVQTLSAGIDHIQPGLGLLPEGVQLCNARGVHDASTAELTLTLILASLRGIPDFVRGQDREEWRSGFRPALADKSVLIVGYGSVGSAIEDRLAPFELARVARVARSGRETARGPVHPISRLPELLLDADVVVVVTPLTEQTKGLVNADFLARMKDGALLVNVARGGVVDTEALLTELESGRIQAALDVTDPEPLPAGHPLWHAPGVLISPHTGGPTSAFLPRAKRLLVAQLNRFARGEPLDNLVLTTGA

SEQ ID NO: 10273 - protein, 310 aa, Streptomyces avermitilis
MNWAYTGSRQRGDESLRTVHRALDVGVTLLDTADMYGPFTNELLVGRVLKERRSEAFVSTKVGLLVGDQHIVANGRPGYVKRACDASLRRLQTDVIDLYQLHRADPEIPVEETWGAMADLVRAGKVRALGLCAVGARSARRSGARLHDATIRQLERVQQVFPVSAVEAELSVWSKEALDALLPWCAARGVGLLAAMPLGNGFLTGTLTPGEGFEPDDLRARHPRFTAEMMAANQPIVVGLRRIARRHGDEVTPAQVALAWLLAQGPHVVPVPGAKRARWVAENATAAGLRLTARDLADVAALPAARGSWD

SEQ ID NO: 10274 - protein, 387 aa, Streptomyces avermitilis
VQRRAAAAVLAAASLLLASGCSSGDGGTPGADRSTSPGRTAPGSSSSGKTAEATPPAKGSVKVVRTVAQGLKTPWGLAPLPDGDLLVTSRDDGTITRIDEKTGKKTELGSVPGVSAAGEGGLLGIALSPSYASDHMIYAYFTTASDNRIARLLHEEHKPSGEQLGAPDTVFKGIPKGFIHNGGRIAFGPDNMLYAGTGESGNRGLAQDKKSLGGKILRMTPEGEPAPGNPFGDSVVYSYGHRNVQGLAWDDKQRLFAAEFGQDTWDELNAIKPGGNYGWPDAEGRSGDAKYRDPIAQWHTAEASPSGIAYAEGSLWMAGLRGQRLWRVPLKGTEASAAPQAFLKGTYGRLRTVVPAGDGKLWVTTSETDGRGTPGKGDDRILELQVT

SEQ ID NO: 10275 - protein, 90 aa, Streptomyces avermitilis
VRHTLERIPAEGGPVFNMFEELFAPGRKHTNDERKRLELSRTDVNDGDPGRGPIDLSSGKVVVRPPKQPPAAPEPPAAPEPAAAPEPGED

SEQ ID NO: 10276 - protein, 1157 aa, Streptomyces avermitilis
VNTSAGEPPGGAGPGLREDGRTGIGRPREDGRTGTGGSREDSRRGTGRTGVGRSRAGAPSGDTAPSMSVPAVRAAAGIDASAVVGTGGASAVVGIGDASAVLAGLGVGGAPAVAARPPIFAAPLSDPRAMLGTVETRSVSPVFVGRAAELGALADALTRAAAGEPQALLLGGEAGVGKTRLIEEFATAAGRTGAVVAVGGCVEIGADGLPFAPFSTALRALRRQLPDELAAAAAGQEAELARLLPELGEARRGPRDDEEGTARLFELTARLLERLAADRTVVVLLEDLHWADASTRHLLAYLFRTLRSGRLAVVATYRADDIHRRHPLRPLLAELDRLRTVRRIELARFNRTEVGRQIAGILAAEPDPAQVDDIFERSDGNAFFVEELAVAAHEGCCTGLTDSLRDLLLVRVEGLPESSQRVARIVAEGGSTVEYRLLAAVARLAEDDLIEALRAAVGANILIAAPGGDGYRFRHSLVREAVSDDLLPGERSRLNRRYAEALEADPALVPADERAARLASYWYHAHDAAKALPAVLDASVEARCRHAHAEQLRLLERAMELWELAPDSIRAGLRPVDYAEVYPPCGCDPATTPLRYLDLMAEAAVAGRLCGERERALKITRRALRLLEDEDDHHPNSPSGSGRGDPLRAAWFWAQRSRLVQTTARGDGWKELATAQELVRGLPPSEVHAEVLATVANWSMVHEPGPDALMAAERAVEYARMVGARDIELNARLTLGGLLVEAGDIEAGLTELHEVKEQAKALGDAAVLGRLHVNLPSHLEGIGRSQEAVRVLKEGVGLARRLGLLDIEALVWGNLAESLHSLGRWDEAGEAAISSERVGQSAKRRGFHATLHAHFALSRGDLTVARRQLTAAREHFGTHDTMPQHALPLGRIAIGVAAAEGRLLDARAELAAALDTGFPPGTQRYGWPLLLAAATAEADALGLPGAEPGRGEVLEDIHKAAKTLATNVPVWQAYGHWLRAELLRAEGAGTPRDWSETVTAFEPLERPYDLARVRHRLAESLLASGADDDARARATELLRLAGAVADHLGARPLAESVALLAQRARLTLSGTTRQSPPADPAEALGLTSRERDVLRLVAAGRSNRQIAEKLFISPKTASVHVSNILAKLGVAGRGEAAALAHRMRLFPPEAPAAPAAG

SEQ ID NO: 10277 - protein, 100 aa, Streptomyces avermitilis
MRNSPDVAHPPWRRKLRHRNKRSRKPTLHEGHEMFEYELHQIRSADLIREAQNHRLVREALRLRRDARDARKAAAGEPDTEGQSTSHSNRPRRPRFARAA

SEQ ID NO: 10278 - protein, 203 aa, Streptomyces avermitilis
MGTKTVDEAGAETGTEAKSDEAKVDTTKVEKSTETTEATEAKTDAEAAADESDESEVADDEVDGLRGDTQEGPSGVGQGAGAVVSAGLGLVSLTGSWVATVAAARETLVGQLGTSSSATVATQVKEVYGDAWATTALIGGLFALAALIVGVVVLARPAFGAPGKPQPAWIKSVAWGGVALGVIGLLLAVAKYTDIILGLPSAS

SEQ ID NO: 10279 - protein, 191 aa, Streptomyces avermitilis
MYAISLGDDGAELRPLEPWHAEEFLAHLDRGREFITRHIPFGVGATDVDSARAVLRTWADKRATDNGGLHGLWLDGKLVGGVLFRVFDAVNGTCEVGCWLEPAGSGRGLVTRAMRVLIDWAVDGRGIHRVEWRASSANEPSIKVARRLGMSRDGVLRGNSVHRGVRQDTEVWSVLAPEWRAARARTTHNDH

SEQ ID NO: 10280 - protein, 505 aa, Streptomyces avermitilis
VTTTTDELVSYEDALASYDPVMGLEVHVELGTKTKMFCGCSTELGAEPNSQTCPTCLGMPGALPVVNAIGVESAIKIGLALHCEIAEWCRFARKNYFYPDMPKNFQTSQYDEPIAFNGYLDVQLEDGEVFRVEIERAHMEEDTGKSTHVGGATGRIHGASHSLLDYNRAGIPLIEIVTKPIEGAGERAPEVAKAYVAELRELIRALGVSEARMEMGQMRCDVNLSLRPHGREKFGTRSETKNVNSLRSVERAARFEIQRHAAVLNSGGTIIQETRHFHEDTGSTTSGRVKEEAEDYRYFPEPDLVPVAPSRAWVEELRAGLPEQPLARRNRLREEWGVNAHDMQSILNAGAIDPIVATIEAGADAASARKWWMGELARSANESGKALEDLPITPAQVARVAQLVVAGELNDKLARQVIEGVLAGEGTPDEVVEKRGLKVVSDEGALTAAVDEAIAGNPGVADKIRGGKVAAAGALVGAVMKATRGQADAARVKELILEKLGVSEG

SEQ ID NO: 10281 - protein, 80 aa, Streptomyces avermitilis
VSTALTKAKGFKKSKSGTYLSIATTAFGVIGVAKQAKKARLESDTLRLIDAAVSAAAIVTGLAILYRELKRLGDDDVLLG

SEQ ID NO: 10282 - protein, 501 aa, Streptomyces avermitilis
MTDTNVNIIRLTAAEIAAKVASGELTAVQVTEAHLARIDAVDEKVHAFLHVDREGALAQARAVDEKRERGEKLGPLAGVPLALKDIFTTEGIPTTVGSKILEGWIPPYDATLTKKLKAADVVILGKTNMDEFAMGSSTENSAYGPTGNPWDLSRIPGGSGGGSSAALASFEAPLAIGTDTGGSIRQPAAVTGTVGVKPTYGAVSRYGMVAFSSSLDQGGPCARTVLDAALLHEVIAGHDPLDSTSIDAPVPPVVEAARNGSVEGMRVGVVKQFRGEGYQAGVLQRFDESVALLKELGAEIVELDCPSFDLALSAYYLIAPSECSSNLARFDGLRYGVRVGDDGTRSAEEVTALTREAGFGDEVKRRIMLGTYALSSGYYDAYYGSAQKVRTLITRDFEKSFEQVDVIVSPTTPTTAFPIGERADDPMAMYLADLCTIPTNLAGNAAMSLPCGLAPEDNLPVGLQIIAPALKDDRLYKVGAAVEAAFVEKWGHPLIEEAPSL

SEQ ID NO: 10283 - protein, 98 aa, Streptomyces avermitilis
MPGITREEVAHLARLARLELKAEELDHFAGQLDDIIGAVARVSEVADQDVPPTSHPLPLTNVMRADEVRPSLTPEQALSGAPAQEQQRFKVPQILGED

SEQ ID NO: 10284 - protein, 778 aa, Streptomyces avermitilis
MEPTESAAPDSRLRRRSGAWRWGSRRPTGVAPVERSRVWGGSREPGGIRRVARTSGLAGVDGRGPARGNAPGVMPLTAAPGSGALGAGQGPGTSGPDSERHLSWPALPAAVVATAGFVLGAGFYRAFTWNHALFPSGTVGWSLAVLTGVIVGHLVALGRARWWGGTGSGAALTLAVLLLYGWVPAGMVSLTVVVLVGIARRDRWRGGVLHGSVDLLGIGAGALVLAAFGRVPSVETPWDPQSWTVYTVPELALVAVAYLAVTRTLVWYVHTPRTGGVPTVARTALVRQGLLAVALLGIAPLICVVADALPLLLPLFAIPLIALDSTLWIARARAEEQLRDPLTGLPNRQWLLERTWTALDDAERIGARSALLLIDLDRFRAVNDTLGHLAGDRLLLQIADRLRLALPRGAEAARLGGDEFAVLLPVADSTTSATRVARNLVAALGSPLDLDGLTLVLEASAGLAVFPDHALDAEGLLQRADVAMYQAKRDRTGVEVYESKRDSNTPDRLGLLGDLRRALDAGDVELHYQPKVRFDGQVAGLEALVRWVHPERGKVPPDEFIAIAESSGLMPHLTEYVLETALGQVARWRAQGLRVPVAVNVSPRDVHTPGFAGSVAARLARHGVPAGALQLEITEHVLLEDPQRAADTLAGLTGHGVKMSLDDFGTGYSSLVHLRRLPVSELKIDRSFVARLAVDTQDAAIVRCTVDLAHSLGLLVVAEGVEDDETWERLRDLGCDAVQGWLVAAAMPADEATAWLRARGSRGWQRPTAALPAAATDE

SEQ ID NO: 10285 - protein, 730 aa, Streptomyces avermitilis
VAGEQHAQPTSVPAEAREKHAQLAEQIEEHRFRYYVKDAPVVSDAEFDTLLRSLEALEEEYPELRTPDSPTQKVAGGYETEFTAVQHRERMLSLDNAFDDLGLAAWAERVAKDVGTSDYHFLCELKVDGLAVNLTYEHGRLTRAATRGDGRTGEDITPNVRTIAEIPDRLKGDRIPDLVEIRGEVYFPMEKFEELNARLVEAGDKPFANPRNAAAGSLRQKDPRVTATRPLHMVVHGIGARQGFDIDRLSQAYELLREWGLPTTRYARVVDDLDGVREFIAYYGENRHSVEHEIDGVVVKLDEIPLQGRLGSTSRAPRWAIAWKYAPEEVNTKLINIRVGVGRTGRVTPYAQVEPVTVAGSEVEFATLHNQDVVKAKGVLIGDTVVLRKAGDVIPEILGPVVDLRDGTERAFVMPAECPECGTPLAPAKEGDVDLRCPNARTCPAQLRERLFYLAGRKSLDIEQFGYVAAAALTKPLEPAEPPLLDEGDLFDLTIERLLPIKAYVLDQDSGLPKRDPKTGEEKVATVFANQQGEPRKNAISMLDNIAAAKERPLARILTGLSIRHVGPVAAEALARAFRSIDRIDQATEEELKDTDGVGPIVAAAVKQWFAEDWHREIIRKWKAAGVRMEDERSGEDEGPRPLEGLTVVVTGTLEHHTRDGAKEALQSRGAKVTGSVSKKTSFVVVGDNPGSKYDKAMQLKVPVLNEAGFAVLLEQGPEAAAEVALPTEE

SEQ ID NO: 10286 - protein, 335 aa, Streptomyces avermitilis
VSENSEFRFGSATGVGSMPGGDARETAKTVTGSVEDFPFLAELPARGPGADMIGRTAGMLVELYARVEPSGWRIGDRPGRDTKRARSWLGEDLDALEEFTQGYEGPVKVQAVGPWTLAAALELKNGEVALSDPGACRDLAGSLAEGLRSHLEEVRRRIPGAQLVLQLDEPSLTAVLRGQVKSASGYRTHRAVDRQAVEATLRDVVGVHGEGPVVVHSCAPDVPFALLRRAGAAAVSFDFSLLTERDDDVIGEAVEGGTKLLAGVVPGTDGPLSDPAGSVMGVRTLWRRLGLHPGLLAEAVTVTPSCGLAGASPAYARQALAHCVRAARSLADNPE

SEQ ID NO: 10287 - protein, 232 aa, Streptomyces avermitilis
MAGMATHVITGAGSGIGAAVTRRLHARGDELVLHARDAGRAKELAAAFPGAKTLVGDLADPDKLSWAFSHQTLPDHVDSLLHIAGVVDLGPVGELTPKSWRHQLNVNLIAPAELTRHFLPQLRLAHGQVVFVNSGSGLNAHADWSAYAASKHGLKALADALREEEHANGIRVTSVYPGRTASPMQAKVHQQEGKEYEAAKWIDPESVATTILMSLDLPRDAEVNDLTVRPGH

SEQ ID NO: 10288 - protein, 179 aa, Streptomyces avermitilis
MKICVFLSAADLDDRYTRPAREFAELLGKGGHTLVWGGSDVGLMKVVADGVQEAGGRLLGVSVDFLAAKARAGADEMVIARDLAERKALLLERADAVVIMVGGTGTLDEATEILELKKHGHTDKPVVLLNTAGFYDGLKEQFRRMEDEGFLPCPLTDLVFFAEEPVGALAYLEESFGTV

SEQ ID NO: 10289 - protein, 107 aa, Streptomyces avermitilis
MAEGHTITIEQGTERVRVVHGDQVLAESDRPLLLRETGCPVRYYLPPEDVRLDLLKPSETHTHCPFKGTASYWSLPDAADLVWAYPEPKPDVAQIKDHLCFYEVEVA

SEQ ID NO: 10290 - protein, 376 aa, Streptomyces avermitilis
MTETPQRPRRLRVLAAMSGGVDSAVAAARAAEAGHDVTGVHLALSANPQSFRTGARGCCTIEDSRDARRAADVIGIPFYVWDLAERFREDVVEDFIAEYEAGRTPNPCLRCNEKIKFAALLDKALALGFDAVCTGHYAQVIVREDGTRELHRASDMAKDQSYVLGVLDDRQLAHALFPLGDTVTTKDEIRAEAERRGLAVAKKPDSHDICFIADGDTQGFLANRLGKAEGDIVDESGSVVGSHEGAYGFTIGQRKGLRIGTPAPDGKPRYVLDISPVDNTVTVGPAAALDVTALTAIKPRWCGAAPTGPGTYTAQLRAHGGETQVTAELVDGELQVTFAEPVRGVAPGQAVVLYDGTRVVGSATIATTTRTATAVA

SEQ ID NO: 10291 - protein, 218 aa, Streptomyces avermitilis
MGETKGGDADRRIGRRALLIGGAAAAVGTAVLAREELAHLWWRLPGVEKPRVAGAVDFRGAQWVAASSANWRRADRPDDYAVDRVVVHVTQGSFKSAVKVFQDPGHGAAAHYIVRKDGHITQMIRELDVAFHAGNREYNERSVGIEHEGFVESASSFTDAMYEASARLTAGICGRYGIPVDRAHIIGHVEVPGTDHTDPGPHWDWDRYLKLVRRARTA

SEQ ID NO: 10292 - protein, 482 aa, Streptomyces avermitilis
MHRRKFLGGMAGAGFAAVAAGGAALAYLTDAGQNRAGAASTTLTIPELLEGTTSDGTTTFTLEAKTGTSEVLSGVTSTTAGYNQSFLGPTMKWTSGDTVLLNITNSLDADTTVHFHGAHIPPKMDGGPQNAFAAGETWSPTFTVKDEAKTLWYHPHALGTTAEQVTRGLAGMIIVEDDSDASAALPSTYGTDDIPIILQCLAADSSGDVKYDLTGYLSGGLSYPLLCNGTNVDATTLAFTATKSRTRFRLLNASPSDIITVQRGDGGTLTQIATDQGYLTEAAEVESIRLVAGARAEFVMDLSDAVTLQAVVTTGWVRGGSGTYDFLTVTPDASDTPDALPSSLNTITRYDTTDFAARTITLGQSGASMLINGSAGTTMAAMAMISTTLDAEEIWTVTNSTQLEHSFHLHDVPFQLISINGEEPTGVDLGWFDTYEVVGGGTIKIAMQFTDFADDTYMYMLHCHLLQHEDEGMMASLMVTES

SEQ ID NO: 10293 - protein, 389 aa, Streptomyces avermitilis
MAYLDHAATTPMLPEAVEALTAQLSVTGNASSLHASGRRARRTVEEARETLAEALAARPSEVVFTSGGTEADNLAVKGLYWSRRDADPVRTRVLASPVEHHAVLDAVHWLGEHEGATVEYLPVDTYGRVHPEALREAIARNPDDVALATVMWANNEIGTVMPVRELADVAGEFGVPLHADAVQAFGQVPVDFGASGLAAMTVSGHKVGGPYGIGALLLGREYSPVPVLHGGGQERHVRSGTLDVPAIASFAVAGRLAAEQREWFAREIGALRDDLVDAVRGAVPEAILGGDPSGAGRLPANAHFTFPGCEGDSLLLLLDAQGIECSTGSACTAGVAQPSHVLLATGTDPDLARGTLRFSLGHTSTEADVEAVAKAIGPAVERARTAGLS

SEQ ID NO: 10294 - protein, 88 aa, Streptomyces avermitilis
MELTATSTSRTPARDADGMAVASFVLGLIGILALNIVLGPTAIALAAVALWRGTQRRGRALLGLGLGVADLAVLVVAMQLDHTVSWSF

SEQ ID NO: 10295 - protein, 55 aa, Streptomyces avermitilis
MLFLVAALLLLGVVLGAVAHAPLSVSLVAAAVIGLWLVVFAIRERHGHRRRTSTN

SEQ ID NO: 10296 - protein, 208 aa, Streptomyces avermitilis
MSHTLGIRQAQKQKTRQSLLDAALALLEEQSLSSLGLREVTRAVGVAPTAFYRHFRSTADLGVALVEEALGSLHLMIGNTVSDAGDSEERIARAVELIARHVAAHPAHVRFIARERHGGVQPVREAIAEQLARFAEEVKVELAKHPESAGWSDDDLLMLAGLYVDQMLMTASLFLEALEGPEEERERVARVATRRMRLISIGRRHWLG

SEQ ID NO: 10297 - protein, 318 aa, Streptomyces avermitilis
VKSDRLLSILLLLQTRGRVPAHELATRLEVSVRTIYRDIEALSASGVPVYAERGRHGGIELLAGFRTDVTGLTADESRALFILAAQGAHAALGLDAALGSALRKVMTALPAPHRPAAEATSRRVLVDATRWKGGPQPVVDLETLQDAVFADRRLRLRYRHGGDAQPHTYTVDPYGLVSKAGVWYLVADRRAKPQLFRADRVRSATLLADPVRRRPGVELADAWEVLRRQVEERPGGIEVTVRVRRDRLDMFRRLNASSLAALPEDDGESEWVTARLSYGFVREARQLLMFSDLVEVVAPPEVREELARAAASVTELYQ

SEQ ID NO: 10298 - protein, 194 aa, Streptomyces avermitilis
MNTDPRPLYARAAEQIAALIRTVRPEQLAGPTPCGEFDVRTLLSHMAGGTRRIAVVGAGGDGLAVRPFVDGVPDDGWVAAYDEVRAEVEQSWADDARLDALVHVPWGEAPGRIALSGYVMEAVTHTWDLSEALGRPLGLDPELAEFALAIAHRVLPDEQRGDDVPFDSAAPAPEGADAYERLAAWLGRRSLSRA

SEQ ID NO: 10299 - protein, 286 aa, Streptomyces avermitilis
MPEASPLQAVRASIGDSEFDRDTAVTLREPGVYDIDLSAGWTIISAVNGGYLLAVLGRALSDALPHADPFTISAHYLTASQPGPAVIRTDIVRTGRTLSTGQASLFQYDEEGREVERIRVLASYGDLDTLPDDVRTTARPPALPPMDQCFGPEDGPAPVPGSSAITDRLMLKLDPETLGWALGAPSGKGEMRSWFGLADGRDPDPLSLLLAVDALPPTAFELGLSGWVPTVELTVHVRSRPAPGPLRVSITTRNLAGGFLEEDAEVWDSADRLVAQSRQLARVRLG

SEQ ID NO: 10300 - protein, 218 aa, Streptomyces avermitilis
VLQQLFSPSVQHTLDLIGIFVFAISGALLAVRKNFDVFGIAVLAEVTALGGGLLRDLIIGAVPPAAFTDLGYFLTPLLAALLVFFLHPQVERIQLGVNVFDAAGLGLFCVAGTVKAYDYGLNLTASAALGLATAVGGGVLRDVLANEVPSLLRWDRDLYAVPAIVGATMIVLCIHYDALNAFTSGFAVITAFVLRLLAMRFHWRAPRAWHRRSTVTEE

SEQ ID NO: 10301 - protein, 463 aa, Streptomyces avermitilis
MALSRSARLGALATAAASFLVIAASSAPTPGADGIGDSYFPQLGNGGYDARHYDLDVAYNPDTDRLDGRTTLTARATQRLSSFDLDLQKLDVTKVEVNGRRAEFTREGDEIRVTPRGALPKGRTFTVTVTYGGVPQPLGGPIVFGSDYGWMKTADGVFVACEPNAASTWFPSSDHPADKATYDIRIKAPKGLTGISNGRLISTRDKGDTTVTHWRESKPMATYLATATIGKFDVKTGRTPAGTPVYVAIDPVLANSNTVDVYAVTAEATDYWSQIFGPYPFEETGAIVDDMPQAGFSLEVQSKPAYSAVRSESTIVHELAHQWFGDSVSVERWKDIWLNEGFATYAQWLWSEHKGIRSAHDSFRAGYDARPADAAFWQIKVADPQRDTMFASAVYQRGAMTLQMLRERIGDTAFFKLLPAWTKLHKHGNANTGDFIRLAERISGRQLDDLFQTWLFTTGKPTL

SEQ ID NO: 10302 - protein, 508 aa, Streptomyces avermitilis
VSETKKADATEPAAKVPHQGSAPEERDVLLKVQGLTKHFPIKKGILQRQVAAVKAVDGIDFEVRRGETLGVVGESGCGKSTMGRVITRLQDPTGGTIEFEGKDITRLSTAGMRPLRRDIQMIFQDPYGSLNPRHTIGSIVSAPFRLQGVEPEGGVKKEVQRLLELVGLSPEHFNRYPHEFSGGQRQRIGIARALALKPKLVVADEPVSALDVSIQAQVVNLMDDLQSELGLTYVIIAHDLSVVRHVSDRIAVMYLGKIVELADRTSLYEAPMHPYTKALMSAVPVPDPKRRGAKSERILLKGDVPSPISPPSGCRFHTRCWKATEICRTTEPPLLELKPGQQVACHHPENAEDQAPQDTVLLSAAREAIEVVSVGETPQTPAKTADVAVAEKTAEKTAEKAVEETVAEKAAEKAVEETVAEKAAEKAVEKAVAEKTVEKAVAEKAVAAETVEKAAVAETVAESAEPADADTADEPAAVADPAVADPVDEDPAAESAEAESGRQESTDK

SEQ ID NO: 10303 - protein, 365 aa, Streptomyces avermitilis
VTELSKTGAAVGEPTRSPSDAPRAFLEVRDLKVHFPTDDGLVKSVDGLSFQVEKGKTLSIVGESGSGKSVTSLAIMGLHRLGARGKNVQMSGEIWLDGQELVSAAPDEVRKLRGREMAMIFQDPLSAMHPYYTIGNQIVEAYRVHHDVSKKVARKRAVEMLDRVGIPEPAKRVDSYPHEFSGGMRQRAMIAMALVNNPELLIADEPTTALDVTVQAQILDLIRDLQKEFGSAVVLITHDLGVVAEIADDVLVMYGGRCVERGPVDEIFEQPQHPYTWGLLGSMPRIDRDTSDRLIPVKGQPPSLINVPSGCAFHPRCPYADVPKGDVTRTVRPELQQVGGGHWSACHLSQEDRTRIWTEEIAPKL

SEQ ID NO: 10304 - protein, 335 aa, Streptomyces avermitilis
VISYILRRTFAAVILLLVVTAVTFAIFFLLPRMAGQTADQLAQQYIGKSPTAADIATVKHNLGLDQPLYVQYWHFIKGIVSGATYDLGPTTAHCDAPCFGYSFKTHVAVWPQLTSRLPVTISLAAGAAVLWLLSGVAVGVISALKPRSFFDRTFMGVALAGVSLPMFFTGNLALLLFTYQWPIFGRTYVPFTENPAQWANTLFPAWCSLALLYSAIYARLTRSGMMETMNEDFIRTARAKGLRERNVVVRHGLRAALTPIITVFGMDLGLLLGGALITESVFSLHGVGEYAVKAIQDNDLPPILGVTLLAAFFVVIANLLVDLLYAAADPRVRLS

SEQ ID NO: 10305 - protein, 590 aa, Streptomyces avermitilis
MEGNPTIMRRSALAAIAAIGSASLLVAGCSKADDNKDDNNSKSAGANAATKDVVNASTKKGGTVTYEYSDVPDSFDPGNTYYAYMYNLSRLYARPLMTFKPAPGEKGNELVPDLAASAGVPSDGGKTWTYKLRSGLKYQDGTAITSKDVKYAVERSNFARDVLSLGPNYFQQFLVGGDKYKGPYKDKSAKGLKSIETPDDTTIVFKLNRAFQEFDYLVAAPQTAPVPQSKDKGIDYVKSIVSSGSYKFQSYDDGKQAVLVRNENWDPKTDPLRKQYPEKIVVNLKVNAETIDKDVQAGDAIDLGGTGVQAATQAQVVNSAEKKANTDNTYGGRLVYMAINTKVKPFDKLECRKAVQYAIDKVSVQTAEGGPIRGDIASTVLPPDIPGYEKSDVYATSGNKGDAAKAKEQLKACGKSSIKTNISARSDRPQEIDAATAIINSLKKVGIDASLKQYPSGKYFTDYAGVPKFTEKQNLGLIMMQWGADWPSGYGFLQQVLNGSAIGSSGNVNLSQFDNKDVNSLLGKAIGTEDKTARDALYTEIDKKTMDEAVLVPLTYFKVLLYRPTTYTNLVSTAAFSGQYDYLNIGSTKK

SEQ ID NO: 10306 - protein, 332 aa, Streptomyces avermitilis
VTAPIETTGAAAEAQPEAVLVGAEKGQIEGRSLGQIAWSRFKRDKVAVVGGVIVILLILVAVLSRPIQALLGLDPNAFNQDLIDPNTSLPKGSFGGMSGDHPLGVEPKFGRDIATRVLEGSWVSLVVAFGATILSNVIGAILGVVAGYYGGRVDTIISRLMDTFLAFPLLLFAIAISATLQGGAFGMEGLPLHLSVLIFVIGFFNWPYLGRIVRGQTLALREREFVDASRGMGAKGPYILFRELLPNLVGPIIVYSTLLIPTNILFEASLSFLGVGIQPPQASWGGMLREAVTYYQVDPQYMIVPGLAIFVTVLAFNLLGDGLRDALDPRSR

SEQ ID NO: 10307 - protein, 268 aa, Streptomyces avermitilis
VSASGTAAAGQVEHMLRQVTPGRYDAYEALLRALATPSAGQIWMLLWHGQAGSPDAQYGNMEVDGYGYAPCVTSAQELSASGWNRSYEVVDGLDVARTLYPDHFGLWLNPHAPGGGVGIPWLDLRRIATGLERQPAGPLRLSEPGIEVPQFYALLTQNAHRTPAVRSLRRAWVQPALGAPYLAIGLDVYDTSPPAVDSVRGMMQQSIGAVPDGLPVSTVAMSDAYDPVAMWLRANARPFYDREAHAAPAPAPAPAAGGYGYPPARGGY

SEQ ID NO: 10308 - protein, 260 aa, Streptomyces avermitilis
MDIPAQAHPHSHSHGGWPGNELEEVLSASLGVPASPSTGARIVEVLGHSFVWVPLPGGGGPHSGPLDLPTLELDGQAFVPVFSSEEQFRQVVGNHMSYTIAPAVEFARGLPPQVGIAVNPDGVVGVPLPPDAVAELCRVGRTPLDGPASGGRVRLFEPDWQDDPVDFLAAASAEFAETGIVVSARRCMAAIETSDPVMFIGVELSSWEADARTLPLDALGRALGRVPVDRPVNMVFLDVAQDPVGEWMRAQVRPFYQHGY

SEQ ID NO: 10309 - protein, 228 aa, Streptomyces avermitilis
VKRITAYATTSGIALPEQPGVPARDACGPQPAAVVRDLRDRAGRSPHGLTFGAADLVVVTGLPGSGKSTLMRRAVRGARVDSQDTRDRWDTRLAGFLPYAVYRPLVRLAHYAGLRRALRSGAGVVVHDCGTQAWVRRWLAREARRRGGTLHLLLLDVTVGTALDGQRERGRGVSRYAFLRHRKAAGHLLRSVEKGNLPEGCGSAILMDRTAADVLNRIDFAAGVATAA

SEQ ID NO: 10310 - protein, 372 aa, Streptomyces avermitilis
MSSNAPRHTALDALHRSLGATMTDFAGWDMPLRYGSERDEHLAVRSKAGLFDLSHMGEITVTGPGAAALLNYALVGNIASVGVGRARYTMICRADGGILDDLIVYRLQEQTYLVVANASNAQVVLDALTERAGGFDAVVRDDRDAYALIAVQGPESPGILKSLTDADLDGLKYYAGLPGTVAGVPALIARTGYTGEDGFELFVDPADAEKLWQALTEAGAPAGLVPCGLSCRDTLRLEAGMPLYGHELSTSLTPFDAGLGRVVKFEKEGDFVGREALTEAAALAEKNPPRVLVGLIAEGRRVPRAGYPVVVGGEVIGEVTSGAPSPTLGRPIAMAYVDAAHAAPGTAGVGVDIRGSHEPYEVVALPFYRRQK

SEQ ID NO: 10311 - protein, 125 aa, Streptomyces avermitilis
MSNPQQLRYSKEHEWLSGAEDGVSTVGITEHAANALGDVVYVQLPEVGDTVTAGETCGELESTKSVSDLYSPVTGEVVEANQDVVDDPSLVNSAPFEGGWLFKVRVAEEPKDLLSADEYTEFSGS

SEQ ID NO: 10312 - protein, 420 aa, Streptomyces avermitilis
MSLLNTPLHELDPDVAAAVDAELNRQQSTLEMIASENFAPVAVMEAQGSVLTNKYAEGYPGRRYYGGCEHVDVVEQIAIDRVKELFGAEHANVQPHSGAQANAAAMFALLKPGDTIMGLNLAHGGHLTHGMKINFSGKLYNVVAYHVDETTGQVDMAEVEKLAKESRPKLIVAGWSAYPRQLDFAAFRRIADEVGAYLMVDMAHFAGLVAAGLHPNPVPHAHVVTTTTHKTLGGPRGGVILSTAELAKKINSAVFPGQQGGPLEHVIAAKAVSFKVAASDDFKERQQRTLDGARILAERLVRDDVKAVGVDVLSGGTDVHLVLVDLRDSELDGQQAEDRLHEVGITVNRNAIPNDPRPPMVTSGLRIGTPALATRGFQAADFTEVADIIAEALKPSYDADALKARVTALADKHPLYPGLK

SEQ ID NO: 10313 - protein, 455 aa, Streptomyces avermitilis
VAISVFDLFSIGIGPSSSHTVGPMRAARMFARRLRNEELLDPVASVRAELYGSLGATGHGHGTPKAVLLGLEGASPRTVDVEGADDRVATIKESGRIRLLGEHEIAFDFSEDLVLHRRKTLPYHANGMTLWAYDASGAELLSKTYYSVGGGFVVDEDAVGEDRIKLDDTVLKYPFRTGDELLRLTRETGLSISALMLENERAWRTEEEIREGLLGIWRVMQACVSRGMSREGILPGGLKVRRRAAVSARQLRAEGDPLARAMEWITLYAMAVNEENAAGGRVVTAPTNGAAGIIPAVLHYYINFVPGADEDGVVRFLLAAGAIGMLFKENASISGAEVGCQGEVGSACSMAAGALAEVLGGTPEQVENAAEIGMEHNLGLTCDPVGGLVQIPCIERNGMAAAKAVTAARMAMRGDGSHKVSLDKVIKTMKETGADMSVKYKETARGGLAVNIIEC

SEQ ID NO: 10314 - protein, 184 aa, Streptomyces avermitilis
MLRGIDVSAYQSSAYDTDGLSFVFIKATEGRSYVNPKLTAQVKTARDADCVVGFYHFLWPGNITAQAEYFVSKAPEKAGDLLAVDWETTGDGTHATNAEKDRFIRELKELRPNHRVVLYTNRNFWLNIDTTSYAGDGLWIADYVTAGKPRIKAKWRFHQYTDHPVDKDVADFDTLADLRDWATP

SEQ ID NO: 10315 - protein, 117 aa, Streptomyces avermitilis
MHEELFEELRGAGFTVAAGELGENVTTRGIDLLGLPTGALLHIGDEAVVEVTGLRNPCAQIDTFQKGLLKQVVGSDDGAVAFKSGIMSVVRAGGVVRPGDSIEVELPDGPHLPLRTV

SEQ ID NO: 10316 - protein, 220 aa, Streptomyces avermitilis
MKIGIIGAGNIGGNLTRRLTALGHDVSVANSRGPGTLTALAEETGATPVPVEEAARGAAVVVVTIPLKAVPDLPSGILDGAADDVAVIDTGNYYPRQRDGKIDAIEDEGLTESRWTARQLGHTVVKAFNGTYAQDILDRARPAGAPDRLALPVAGDDAAAKQVVRDLIDELGFDTVDAGTLDESWRQQPGTPVYGLQEGRDAVTKALAEASPERPADFRA

SEQ ID NO: 10317 - protein, 70 aa, Streptomyces avermitilis
VADVEEARKQFERIDTDGDGFITAAEFKTALAQGGDWNVTESVASAIIASRDLNGDKVLSFDEFWTHLNK

SEQ ID NO: 10318 - protein, 308 aa, Streptomyces avermitilis
MIDDGTGLFTIGQLARRTGLSVRTIRYWSDEGALPPVTRSSGGYRLYDAGSVARLELIRTLRELGLGLDDVREVLAGETTVAEVAATHVTALDAQIRALKVTRAVLSTVARRGSTAEEMTLMNKLARLSAAERRRILEEFADEMFRGLDTADPVIRERMRNTAVDLPDEPTPEQVDAWVELVELLQDPEFRAQMRAAAEFNAADRGHDSPAGASLWFVRRLVQLAADARQRGIAPEAPEAEEVLRELLGEADGAADRAAVLERLEATSNDRVARYRELLAVVKGGGPLPAHREEFGWVVAALRARPGR

SEQ ID NO: 10319 - protein, 238 aa, Streptomyces avermitilis
MTDALRDILDAAARGVFPPADGGITVVPQHSHRDAGVLAFTAHSVVFTDEDPAWVYDTLRALDCDALAATMNPRFLAAFMERTGRTTDTIDLMTVAPPLPDGPPLALREIDDPGHPRAVRARTRRDGIRVWAADGGVLVLGRGIGGRLEAAVEVDEDVRHRGLGRTLATAARHLGGGEPVWAQVAAGNARSARAFQAAGYRPVGAEALLSASPQSPQSPQSPQSPRSPQRKMPVWPSE

SEQ ID NO: 10320 - protein, 398 aa, Streptomyces avermitilis
MHHPIEKHLRRTLAAGAALVSLALLAGCDGDSRDRADEALATKAAVPPAEKKPVVDGLPGMPPVLDPKDVYAADRPGRLSPVVKDFPSRVYVPNTNSNTVTVIDPSTYEVIETIPVGAQPQHVVPSWDMKTLWVNNDRGNSLTPIDPKTGEVGKAVDVHDPYNLYFTPNGTYAIVMASLDRELVFRDAHTMKRMKTVPVSCYGVNHADFSLDGRYFIVSCEFSGELLKVDTERMKVIGQQKLPFDGAMPQDVKISPDGKKFYVADMMADGVWVLDGDTFGEPRFLHTGKGCHGLYVSRDSREMYISNRGEGTISVFDFAEDRLTKKWNLPGGGSPDMGGVSADGKVLWLSGRYNSEVYAIDTRTGVQLARIKVGSGPHGLAVYPQPGRYSLGHTGIFR

SEQ ID NO: 10321 - protein, 296 aa, Streptomyces avermitilis
MVRVTTPAPLPQPDSEPDSATVVVRAAPNRRSALRAGAGLAAAGALATGGSATGAGAHPASASRATGTSHAGSSRAPGIPHAPSSPVSAPAPRAFPGQPAQITHGPRTRPRVALSFHGQGDPAVAEKLLGEAESAGARVTVLAVGTWLDEHPGMARRILDGGHDLGNHTLRHIDINAMSEPDAYAEILGCADRLRRLTGSIGTWFRPSRTSRASPLVERVARRVGYPHVLSYDVDSLDFTSPGAPAVTRQVLGGVRPGSVVSLHFGYADTVAALPALLHELDRRGLRAVTTTELLS

SEQ ID NO: 10322 - protein, 202 aa, Streptomyces avermitilis
LLLAYAFRMVRNGGFRGVYSFGTPPKAPPGGHHGGMAGLEGIEPPRQHASATAARWSPAVEDERALKALELFGNPAEAEVPLPSRPESAATARRLAQVVVLRHWGLSPKMTEDAVLLVSELVGNAVRHTGARVFGLRMRRRRGWIRIEVRDPSRGLPCLMPVQEMDLSGRGLFLVDTLADRWGVDLLPRGKTTWFEMRVADR

SEQ ID NO: 10323 - protein, 255 aa, Streptomyces avermitilis
MTVHLEVAEGVGTIRLDRPPMNALDVATQDRLKELAEEATRREDVRAVVLYGGEKVFAAGADIKEMQAMDHTAMVVRSRALQDSFTAVTRIPKPVVAAVTGYALGGGCELALCADYRIAAENAKLGQPEILLGLIPGAGGTQRLSRLIGPSRAKDLIFTGRMVKADEALALGLVDRVVPVGEVYEQAHAWAAKLAQGPALALRAAKESIDVGLETDIDTGLAVERNWFAGLFATEDRERGMRSFVEEGPGKAKFL

SEQ ID NO: 10324 - protein, 413 aa, Streptomyces avermitilis
VNGRPISGASVDAHSHRSKGILALLLGVLLLAVTACGGGGGSDSGSGDGKGKDSGQADTKSSQAVVTIAPKDGADDVATSGALKVTAAKGKLTEVKVEDTKGNPVDGKITGGGAGWTPSTHLASATKYKVHAVAKDADGHESAEESAFTTLTPKNTFVGIYTPDNGAKVGVGMPFSVHFTRGITHPEDVEKAITIKTEPAVDVKGHWFGNDRLDFRPQEYWKSGTKVTVNLNLDGVEGRPGVYGKQAKTVTFTIGRDQVSTVDAKTHKMVVKRDGKVYKTIPITTGKPGYDTWNGQMVISERLRVTRMNGETVGYGGEYDIKDVPDAQRLTNSGTFIHGNYWGGGAFGNYNASHGCIGLRDVRGGGDRSVPAGWFFDHSMIGDVVIVKNSHDRTVAPDNGLNGWNMSWEKWIA

SEQ ID NO: 10325 - protein, 409 aa, Streptomyces avermitilis
MHVQTRRARRAGAALAAVLTWAGLLAGASACTSPGISHGVDEVFGKPPAAEDVIHVWPDDDSKAVHADQPLKVRVPGGRLESVKVVKSQDAQDSPVPGHISGDGQSWQPDDKRLALAAKYRVDAVALDERGHRSARHTTFTTFVPDERFIGYVTPENRSTVGTGMIVSLEFNREIVNRAAVERAIRVSAKPAVEIRPHWFGKDRLDFRPQEYWKPGTKVTVGLNLRDVEGAPGVYGLQYKTVSFSVGRDQVSLVDAVEHTMEVRREGELLATVPITAGAPKTTTYNGKMVVMEMLEVTRMNSRTVGFGGEYDIPDVPHAIRLTASGTFLHGNYWAPDAFGNTNVSHGCVGLRDVKGGSSDTPAGWFFDRTLIGDVVEVVRSNDKKVAPDNGLGGWNMGWKEWKAGAAVK

SEQ ID NO: 10326 - protein, 749 aa, Streptomyces avermitilis
VSSAAEQEAVQEERAGEEHAARPAAVLNGRRPAAPAPPVWPGAPTPLGARFRTGPDGVTGTNFALWAGGAEAVELCLFDETGAEIRVPLTELTHEIWHGFVPGVLPGRRYGYRVHGRWDPWTGARWNPAKLLLDPYARAVDGDFSLPPEVYGHVRDWPQQQVADTVRDDRDSAPYVPKGVVVHDDDDWADDHRPKTPWADSVIYELHVRGFTKTHPGIPEELRGTYAGLAHPAAIEHLVGLGVTAVELLPVHQFAHEDHLLRKGLRNYWGYNSIGYFAPHAGYAAAGTNGQQVGEFKRMVRALHAAGIEVILDVVYNHTAEAGELGPTLSLKGIDNRGYYRLQPDARRYADYTGCGNTLHVVQPHVLRLITDSLRYWVTEMGVDGFRFDLAAALARSMHDVDMLSPFLAVIAQDPVLRRVKLIAEPWDVGSGGYQVGAFPPLWTEWNDRYRGAVRDFWRGALPDVRDLGYRLSGSSDLYAWGGRRPYASVNFVTAHDGFTLRDLVSYERKHNEANGEGNRDGSDDNRAWNCGAEGETDDERVRSLRRRQLRNLLTTLLLSTGVPMLVAGDELGRTQRGNNNAYCQDNEISWVDWELLEEPGWRALRDLTARLIALRHAHPVLRRRAFFSGRAHSADGLRDLAWFTPRGAEMTERDWYAPAATLGMYLSGRDIPGRDARGVPVVDDSFLAVLHAGHRPVSFVLPGPPWAERYEVVVDTSREDQAAAPGTAHRAGATVTVAARAVLLLRVG

SEQ ID NO: 10327 - protein, 653 aa, Streptomyces avermitilis
VGSRGSIPRTCRSQDRRPPLVRPKLGGRCQCRTVGSLLMSTTLAAAEDRSDHAGRSSVRTLLRLWPYVRPVRVRLFTAALVAVVASCTGLVIPLVLKWLVDGPVADRDTRGIWLGALYLLLLGFAEALLFGLRRWLVARPLSRVEADMRADLYRHLQRLPVAFHDRWASGQLLSRGTTDLMLLRMFLAFPLTFLLVNGVTILVGVIIMLVQDWTLGLVILGPAIPVVIMCALFERRYAEVARRAQDQVGDLTTVVEESVLGIRIVKGFGRHRSQARAFRELTRTLRGTELAKARLLAAIWAVIVTLPELAIGAALVLGTIQVADGDLSAGTLVAFLSTALALRWPVDSIGFLLAMSQEAATATERYFEVMDAEPESADAVAAPAAPAGADGLRFHDVRFRYPDAPSDAPPVLDRVDLHIRPGETMALVGATGTGKTTLTALIPRLHEVTSGRITLDGADITAMPRQALRELVAVAFEEPTLFSATVGENVLMGADDSAGEQELDRALAVAQADFAHALPQGTATQVGEQGLSLSGGQRQRLALARAVVGRPRFLVLDDPLSALDVHTEAAVEAALRRVLAETTALVVAHRPSTVLLADRVALLSGGRIAAVGTHQELLRTNAEYAHLMSGADRAEEAEEAEKAEEAEELEADR

SEQ ID NO: 10328 - protein, 620 aa, Streptomyces avermitilis
MTAPTTTAPDLTDDGEDPVGTPGGGDPFDRDTLPTPPGATGALLRSLLAPLRARVVVTSGLLLLQQAAVQLGPLLVAYAIDSAVPAFRRDDHGPLIAVGVAYLLCAALSGGLQYAFILASARVNQDVLLDLRGRIFRHAQALSIDFHERYTSGRLISRSTTDVESLRELLSEGLQELIAVILSFVYISAMLLWLDLGLGAVAVASFGPLYLLVRLYRRRAGRVYRLRSTAIAAVIVKFAETMNGIRPVRAFRREAVNDADFRVLNGRHQRTNGDALLEMARYVTGSRLVANTAVAGIVLWGAYRVSSGSLELGVLAAAVLYLRRLYDPIDRLGMFLNSYQSAAASLEKIAGLLAQTPSVPEPSEPRALPALESAHPGREVVFDAVRFTYRTGGEVLPTFSLTLPAGQTVAVVGSTGAGKSTLAKLLARFYDPSAGRVLLDGVDLRELTVPELRRGVVMVTQEAFLFSGTVAENIAIGRPDATREEIERAAKAIGAHDFISALPDGYDTDVRKRGGRISAGQRQLVAFARALLADPAVLILDEATSSLDVPGERAVQRAMLTVLKGRTAVVIAHRLSTVEIADRVLVMEHGRIVEDGSPAELVAGTGRFADLHRAWRDSLV

SEQ ID NO: 10329 - protein, 573 aa, Streptomyces avermitilis
MIDAYEDPGDPDCRGGGRYLWWLVMRQRGRCAAGALFGSTWMVLLAATPYLMSRAIDDGLAPGDRTALIGWTAALFAVGAFNAWLSIMRHRTMTRVRMDANFRTVKVVVGQAVRLGAALSRQVGAGEVVTIGVGDVQTISQSLTVVGPGVGAVVAYTVVAGLLLSVSPPLAAVVLLGVPLIAVLVGPLMGRLQGAETEYRERQGVLTERIGDLAGGLRVLNGLGGKGLFADAFRRDSRRLREQGYRVGAVTSWIEALGVGLPTLFLAVVTWLAARLAARGDITVGELVSVYGYVAVLVGPVAFFIECGYQLSRGVVAARRVVRFLSLAPLADDGTADAPAEPSVLSDPESGVRVVPGRLTALAGARPADAAEVVDRLGRYAPSAATWGGVRLDAVALGQVRERILVADNEADLFAGPLRDLVGGRRGPDGWDEAALARAVHAAAADDIVLGLPDGLETAVTAQGRTLSGGQRQRVRLARALLADPEVLLAVEPTSALDAHTEATVADRLHTARSGRTTVVTTTSPLVLARADTVYYLVDGKVAARGSHRELLGGEPGYRALVARDADAEEALR

SEQ ID NO: 10330 - protein, 588 aa, Streptomyces avermitilis
VTTGTSGHLPVAEPAGVRRAAVRLVRADGRAFAAVLVLNALAAGAGLAGPWLLGRIVDGVGAGGGVRAVDRLALGILLCSLAQLLLARWARYVGHRFGERTLARVREEFVDRTLALPASVVERAGTGDLTARGTADVAAVGTTLRDVGPDLLIHTLEALFLLGAVFVLAPLLGAFGVLGLTGIWCALRWYLRRARDGYLAEGAATSEVAEILAATASGARTVEAFGLQERRIGASREALETSRRTRLYTLYLRTVFFPVVEVSYIVPVAGVLLIGGALHARGVMSLGAVVAAALYLRQLGEPLDQILMRVEQLQSSGASFARVEGLARAPRSGPADSAAPADDRIDVTGVRYAYERGGEVLRGVDLTVRPGERLAVVGPSGAGKTTLSRLLAGVDAPSAGTVTVGGVPVVGLEPERLRRQVVLVTQEHHVFLGTVRDNLLIAEPSATDDALWAALAAVGADGWVRELPDGLGTVLGSGGCATDGSQAQQLALARVVLADPHTLILDEATALLDPTTARHTERALAAVLEGRTVIAIAHRLHTAHDADRVAVMEDGRLTELGTHEALVAAGGAYAALWHSWHGDEPSPS

SEQ ID NO: 10331 - protein, 681 aa, Streptomyces avermitilis
VLSSSSSHRRTSHILRRRAGAVALVGVTALLAAAVQSGAANAAPDQAPTGKVKPGAVTLKLTPSQRAELIRDANAAKADTAKDLGLGAKEKLVARDVLKDHDGTVHTRYERTYDGLPVLGGDLVVDTSKSGKTERVVKATKAAIKPASLKPQIASAKAEQQALTAAKSAGSKSTKADRAPRKVIWAADGKPTLAYETVVGGLQDDGTPNQLHVITDAATGKKLYQYQGIKNGIGNTQYSGQVTLTTTQSGSTYTLNDGARGAHKTYNLNHGSSGTGTLFSQTNDTWGNGTTSNAATAGADAHYGAATTWDFYKTTFGRSGIKNNGVGAYSRVHYGNAYVNAFWDDSCFCMTYGDGSGNADPLTSLDVAGHEMSHGVTSNTANLNYSGESGGLNEATSDIFGTGVEFFAANSSDVGDYLIGEKIDINGDGTPLRYQDKPSKDGASKDSWYSGIGSIDVHYSSGPANHFFYLLSEGSGAKVINGVSYNSPTSDGLPVTGIGRDKALQIWYRALTTKFTSTTNYAAARTGTLAAAGELYGTTSTEYKAVQDAWAAVAVGARSGGGGGGGTSYESTTKVSIPDNAGAVTSSITVTGRTGNAPSNLQVTPNITHTWRGDLVIDLVAPDGSTYRLKNFSSSDSADNVTDTYTVNASSETANGTWQLKVQDQAAQDVGTINSWKLTFP

SEQ ID NO: 10332 - protein, 554 aa, Streptomyces avermitilis
VTSLYARHKRTTLAIATAVAAGALLATGVTTGASAQTPVSDAGKKATLAGAPLQLSAAARTSLIKKAEAATPETAQQIGLGTKEKLVVRDVVKDADGTLHTRYERTYNGLPVLGGDLVVHQSKSGTTEGVTKATKATIKVASLKPQITSAKAEKQALTVAKSAGSEKTSADRAPRKVIWAGNGKPTLAFETVVGGLQDDGTPNQLHVITDAATGKKLYEYQAIETGTGKTLYSGTVTLNTTLSGSTYQLTDGTRGSHKTYNKSHTTTSSAGTLFTDADDTWGTGAASSSTTDQTAAADAAYGAQVTWDFYKNTFGRSGIKNNGVAAYSRVHYGNAYVNAFWDDSCFCMTYGDGSGNTHPLTSLDVAGHEMSHGVTANTAGLNYSGESGGLNEATSDIFGTGVEFYAANSSDVGDYLIGEKININGDGTPLRYMDKPSKDGGSADSWSSSVGNLDVHYSSGVANHFFYLLSEGSGSKTINGVTYNSPTSNGSTVTGIGRAKALQIWYKALTTYFTSTTKYAAARTGTLSAASALYGSTSTEYKAVAAAWSAVNVS

SEQ ID NO: 10333 - protein, 168 aa, Streptomyces avermitilis
MSFTYEDVGATRENGYCPPGFHSLHVRTRIGEGEEVFRRASHAVVTWEMHRAMGVGIDASADAAAPGVDVTVSLAGMIKAPCRVVWTVDEPRRAGWAYGTLSGHPECGEEAFVVNRTGDGTVWLTITAFSRAAKWYARAGGAATRGLQHAYARRCGVVLRRLCESVAD

SEQ ID NO: 10334 - protein, 196 aa, Streptomyces avermitilis
VSHVAQPPAPISRKRTTALALPPRGAAVERAQAPSTPEPFMVTVTPPDTWVYALRLPHDPRAARVARMTVRATLSGHGMGEVVDVVELLTSELVTNAYRYAKGPASLRLTALGGGRLRVGVWDSSPHIPAPFDRPPGDRVPCAPVDAVGGRGLFLVQEYADWWGGWRLGDDQMGHGAGKLLWFEVGRRRAVAERRV

SEQ ID NO: 10335 - protein, 284 aa, Streptomyces avermitilis
VPPSTTPTLRQQRLGSELRRLREHSGLTSTAAADLLGLKQAQVSSIEAGRYAVSADRVRTFARTYSCADPALIEALAEMTGGRTRGWWDEYREYLPAGLADLAELEHHATELRVALSLHIPALLQTTDHARAMLREAVPPFLPYELEHRLSYRIKRQEILNRSAPLPYTALLHEAALRMQYGGADVARDQLAHLLERSEQDNITIRVIPFTSPHFPGNGQSFDYAVGPTPQLDTVQLDTHHGGCEFLDTEAQLAKYRTVLDRMENCALEPAESRKFIEHIMQSH

SEQ ID NO: 10336 - protein, 62 aa, Streptomyces avermitilis
VHISAWQKSTYSPDGSNCVYVAATPTGTVHLRESDDPDVILTTTRNPLLSLIRSLKEDSQRR

SEQ ID NO: 10337 - protein, 878 aa, Streptomyces avermitilis
VKAIRRFTVRPVLPDALHPLSDLARNLRWSWHAETRELFQSVDPERWAASDGDPVRLLGSVPHARLAELAEDRRFLRRLGAAADDLTDYVTGDRWYQSQAEAPSRAAELPAAIAYFSPEFGVTAALPQYSGGLGILAGDHLKAASDLGVPLIGVGLLYRHGYFRQSLSRDGWQQEHYPVLDPHELPVVPLREDDGALAQVSLALPGGRRLQARIWLAQVGRVPLLMLDSDVEENDHGERGVTDRLYGGGSEHRLLQEMLLGIGGVRAVRTYCRLTGHAEPEVFHTNEGHAGFLGLERIAELCDTGLDFDAGLESVRAGTVFTTHTPVPAGIDRFDRELVARHFGPDAELPRIDVERILGLGMETYPGGEPNLFNMAVMGLRLGQRANGVSLLHGQVSREMFSGLWPGFDPDEVPITSVTNGVHAPTWVAPEVFRLGARQIGAQRTEDAMTVGGSERWDAVAEIPDQDIWDLRRVLREQLVTEVRERLRASWRQRGAGTAELGWIDGVLDPDVLTIGFARRVPSYKRLTLMLRDRDRLMDLLLHPERPVQIVVAGKAHPADDGGKRLVQELVRFADDPRVRHRIVFLPDYGMAMAQKLYPGCDIWLNNPLRPLEACGTSGMKAALNGCLNLSVLDGWWDEWFQPDFGWAIPTADGTATDEDRRDDLEATALYDLLEGRVAPRFYERGQAGLPDRWIEMVRQTLTHLGPKVLAGRMVREYVERLYTPAALAHRALTPEPARELATWKSRVRAAWPRVTVDHVETSVATTTAELGTTLSLRVRVGLGDLDPDDVEVQAVAGRVDGQDRITDATAVPLKPVGGPDLEGRRVYEGPLSLDRTGPFGYTVRILPTHRLLATSAELGLVAVPSEDVGEGAGVLLR

SEQ ID NO: 10338 - protein, 402 aa, Streptomyces avermitilis
MARTSSARLRWAGGLTAVTTAAVLSAVTLPAQAAPQGRILGAGDPGSVSGSYLVTLKGGTSAPSAAGKSVAGKYGARISHIYGAALNGYAVQANEKQARRLAADPRVASVAQDTEVALDHYQKNPPSWGLDRIDQNDLPLDHGYTWPESSGAGAGVTTYVIDTGIRVTHRDFGGRASYGWDFVDGDRTAGDGNGHGTHVAGTIAGTTYGVAKQAKVVAVRVLDNEGSGTTARVIAGIDWVTRHAKKPAVANLSLGGFANAQLDAAVRNSIASGVTYAVAAGNDGLAAGLYSPAHVKQAITVGAGDRKDARASFSNWGPRLDLFAPGVAITSASNASDTAKATFSGTSMATPHVTGAAALELAAHPEATPAQVSKALAARAATGRISGGGPGSPDKLLQVNSP

SEQ ID NO: 10339 - protein, 701 aa, Streptomyces avermitilis
MPATHHSPAPPASSTDSPPIRRGDAGPPAPETPSAGTTPGIGRIPVLDIRPLVDHGRRPAKAVVGEEFEVSATVFREGHDAVAANVVLTDPQGRSGPWTPMRELAPGTDRWGATVSATAAGRWTYTIEAWGDPVTTWRRHAGIKIPAGIDTELVLAEGAGLYERAAAGVPKSKGRREVILAAADALRDTGRPAASRLAAALTAEVDKVLARHPLRELLTSSEPLPLLVERERALFGSWYEFFPRSESGRVDRPVHGTFRTAAERLPAIAEMGFDVVYLPPIHPIGSTFRKGPNNTLSAAAHDVGVPWAIGSPEGGHDAVHPDLGTIEDFDVFVRRARGLGLEIALDFALQCSPDHPWVEKHPEWFHHRPDGTIAYAENPPKKYQDIYPIAFDRDMPGLIAETVRILRFWMGHGVRIFRVDNPHTKPVVFWERVIGEVGRTDPDVIFLAEAFTRPAMMRALAAVGFQQSYTYFTWRNSKRELTEYLTELSGEAAAVMRPNFFVNTPDILHEFLQRGGRPAFEVRAVLAATLSPSWGVYSGYELCENTPVRGGSEEYLDSEKYQLRPRDWAAAEREGRSIAPLITSLNEIRRRSPALRQLRDLHFHHTDKEEVIAYSKRSGSNTVVVVANLDPHHTQEATVSLDMPQLGLDWAAFVPVRDELTGESYHWGRANYVRLEPGHRPAHVLTVLRPSSPQIGGSPTR

SEQ ID NO: 10340 - protein, 572 aa, Streptomyces avermitilis
MIVNEPVPDTFEDTPAKDRDPEWFKRAVFYEVLVRSFQDSNGDGVGDLKGLTAKLDYLQWLGVDCLWLPPFFKSPLRDGGYDVSDYTAVLPEFGDLADFVEFVDAAHQRGMRVIIDFVMNHTSDLHPWFQESRSNPDGPYGDYYVWADDDKQYQDARIIFVDTEASNWTFDPVRKQYYWHRFFSHQPDLNYENPAVQEEIVSALRFWLDLGIDGFRLDAVPYLYQQEGTNCENLPATHEFLKRVRKEIDTHYPDTVLLAEANQWPEDVVDYFGDFPSGGDECHMAFHFPVMPRIFMAVRRESRYPVSEILAKTPAIPSSCQWGIFLRNHDELTLEMVTDEERDYMWAEYAKDPRMRANIGIRRRLAPLLDNDRNQIELFTALLLSLPGSPILYYGDEIGMGDNIWLGDRDAVRTPMQWTPDRNAGFSSCDPGRLYLPTIMDPVYGYQVTNVEASMSSPSSLLHWTRRMIEIRKQNPAFGLGSYTELQSSNPAVLAFLREAPSTGGNGDDLVLCVHNFSRFAQPTELDLRAFSGRHPVELIGGVRFPAIGELPYLLTLAGHGFYWFRLRKDAV

SEQ ID NO: 10341 - protein, 466 aa, Streptomyces avermitilis
MSEAVTRATRTSPGLLASLDPLLREWLPRQRWFAGKGRPVTGFSLVAATELLPPTAKLGLLHLLVRAHQPDVPTHGAMTHPGDCYQLLIGVREALPPRLAPALIGHPDDGPLAGRTVYEALHDPRPAEVLLEALRARARIGELRFERDTRQEIPDGLMPRLMTAEQSNSSIVYGDTFILKLLRRIVPGVNPDLELPLLLAREGCPRVPAPTAWLLADLEGPDDSYVLGVLQPFVKGAADGWELALRELAKGEDFSTQARALGRATAEVHTALARATPPVTLGHAQVRLLVDGMTERLEAAAQAVPTLRTYAPGLRSAFETLGELAAEGRTWNAQRIHGDLHLGQCLRSPSGTWSLIDFEGEPSKSLAERRLPQPVARDVAGMLRSFDYAAHSHEPRVPGWADTCRAAYCTGYAEISGLDPRTDPVLLRAYETDKAVYEVVYEARHRPEWLPVPMAAVHRLSADAAP

SEQ ID NO: 10342 - protein, 838 aa, Streptomyces avermitilis
VIPRPPSDDRANQNGDGSKKTGAKKTGAKKAAAAKKTAGKKATPAAKATAAKGAVTKKTGKGKATAKKAVADKAAAKATVPQQAVPKQAVSKRAVSKKAVPRKAVVKAALDIPEAPVSPAVAPDDRDRLLSGTHHAPHSVLGAHPVPGGVAFRVLRPYALSVTVVTDDLRTELHDDGAGFFTGLLPLRAVPDYRLHVAYEGTVHETEDAYRFLPALGELDLHLINEGRHEELWTALGAEPMTHQGVPGTRFTVWAPNARGVRLAGTFNFWDATAFPLRSLGSSGVWELFVPGVGEGELYKFEITRPDGSKTLRADPVARRTEAPPRTSSIVHASHYAWADEAWMAARGERPVHESPFSVYEVHLPSWRPGLTYRQLAEQLPAYVADLGFTHVELLPVAEHPFGGSWGYQVTGFYAPTARLGTPDDFKYLVDALHRAGVGVLMDWVPAHFPRDDWALAEFDGRPLYEHEDPLRAAHPDWGTLEFDYGRREVRNFLVANAVYWCEEFHIDGLRVDAVASMLYLDYSREEGQWSPNEFGGRENLDAVAFLQEMNATVYRRVPGVVTIAEESTAWEGVTRATHDNGLGFGLKWNMGWMHDSLGYVQHEPVHRRFHHHEMTFSMVYAYSENYVLPISHDEVVHGKGSLVSKMPGDWWQQRATERAYLGFMWAHPGKQLLFMGQEFAQGAEWSETHGPDWWLLDPAYGAEPDHRGMRDLVRDLNTVYRHEPALWERDTDPSGFAWVTGDAVEDNVFAFLRHAADGTPLLAVSNFSPVVRHDYRLGVPDDIPAWHETLNTDGARYGGSDVTNPHPVKPEPQGRHGRPASIRLTLPPLSTLWLRPA

SEQ ID NO: 10343 - protein, 482 aa, Streptomyces avermitilis
VHGRCGMRSGMEAQPYATAPAGSPRLESLRVEPLLTSEFDADPAGVYERLRRTYGPVAPVGLMGVPVWLVLDYHEVLEVLRDDSQWRRDIRYWRARAQGQLPRDWPLLAGYEVRQTMFLDGDEHHAARLTHHSALRPFQDGHSPQGWELRAAVARYADELIALLAAESGSAGYADLGAQYTRPLLLMVTGKLFGCPVGLGDELVMDLWRMLDGGPDAGPATDRAAAVMTRLAAHRRQRPGDDLTSYLLLADPGMTDEQLGRELLMNAVYLNDITGNMVMNTLLEVLRGNATVRRSVSDGHLGETFHRVALVNPPVANMCFRFAAGDVRLGAFWIRAGDVVSPSAAAAHQDLLTIGTSPLGDATASTRAHLGWGAGQHQCPGAARELAGMIVTTAVGRIFDHFTKAELTLPADQLPWRSGPVVRGLRLLPVRYELRGTPSESHPVPPPRHDGEAPDTAPTADHRSRGLLSALRRLMTGTGRAG

SEQ ID NO: 10344 - protein, 775 aa, Streptomyces avermitilis
LSNSGSNTEGSTAGAVFTDDELRLEQEFIDGLYARVDALRGVTEVSVTDALAQGNTPMQARLERDVLVAERSGLLAALNAVDESLCFGRIDLTSGVSHHIGRIGIRADDTEHTPILIDWRAQVARPFYLATGHTPMGLRRRRHLTTDGRRVTDLHDELLDLGDATRTGHEDPTGDAVLLAALNSARTGRMSDIVQTIQAEQDRIIRAPHRGVLVVEGGPGTGKTAVALHRAAFLLYEYRELLAKRAVLIVGPNPAFLGYIGEVLPSLGETGVLLATVGELFPGVKATAADNPRASAVKGRAEMAEVLAEVVRDRQALPDPVITIEHDRDVLMLDDGLVRVARDRTREAKLPHNVAREYFEGHILNTLTDMVAERIGTDPFDGSNLLDAADITQIRDELAENREVWSAIDRLWPRLTPQRLVADFLAEPEGYVSAEDAAAIRRPVTRAWTTADVPLLDEAAELLGEDDRLARALADRERNTQVAYAQGVLDVSYASRTYEFEDKDEEDSEVLSAHHIIDAERFAERHEEEDHRSAAERAAADRTWAFGHIIVDEAQELSPMAWRLLMRRSPTRSMTLVGDPAQTAEAAGVGSWEEILAPYVQDRFDHTRLAVNYRTPSEIMDMAAAVVRAERPGFEPPSSVRSTGVRPWVRATDDLPSAVAEAVAELTPAEGRLAVIAPRELHRKLAARLDGVTAGAEPDLTHTVVLLDPRQSKGLEFDSVLVVEPARYGTSDLYVALTRATQRLGVLHTGELPKALADGEPHPADGTPAPGITKR

SEQ ID NO: 10345 - protein, 104 aa, Streptomyces avermitilis
VTEVTDADFEAEVIGADLPVLVEFTADWCPPCRQMGPVLSSLAFEEGDRLKVVQLDVDTNPETTNAYKVLSMPTFMVFRGGEPVKSMVGARPKRRLLEELADVL

SEQ ID NO: 10346 - protein, 142 aa, Streptomyces avermitilis
MRIGELATRAGTTTRTLRYYESRGLLPARRGSNGYRTYDEDDLKLLRQIRTLQDFGFDLEETRPFVECLRAGHPEGDSCPASLAVYRRKLGELDALIGELQAVRAQVGDQLARAELARDELAAEAGVPGGPEPVCELGGQTR

SEQ ID NO: 10347 - protein, 149 aa, Streptomyces avermitilis
VAFDALDRQILELLQSDGRIRLSELGRRVRLSPAAVAERVRRLEAAGAITGYGAHVSPARLGYGVRAFIRVNPHAGYSLRHPRTLELLARPEITEVHHVVGEDCWILKVAVADTLHLEEILEQTSALGRTTTSIVLSSPVERKPLLPPH

SEQ ID NO: 10348 - protein, 298 aa, Streptomyces avermitilis
VREVCVIGGNRYFGKRLIARLMAAGDRVTVINRGSSAPPPGTIHLVADRNEERSLESALGSRTFDVVVDQVCYTPRQAAIARRVFAGRTRRYLMTSTVEVYEYEDSPAPVREDALDPRTVAVDLDLPWDDPQFLDSNYGEGKRQAEAVLAADPAFPYAAVRVAHVLGGDDDFTGRLAHYAERMRTGEPIAVPAVNHPATYIHVAEIADFLAWAAGADFGGPVNAASHGPLTTEELCAAVAAHIPGGTAVFREVEVGEVSPFSFARSYAMDNSRAERLGFTFGDASEWLHRAVAETLGR

SEQ ID NO: 10349 - protein, 284 aa, Streptomyces avermitilis
MAQRDTGGRLGAEFFTPGDSSFTAFLAAHRPALLSTRGLLPDGVRAAPDRVPHGTTVLALAYRDGVLIAGDRRATMGNLIAQRDLEKVHPADDYTAVAFAGTVGLALDMVKLYQVELAHFEKVEGVPMTLRAKATRLAGMIRQNLGQAMQGLAVVPLLVGYDLAARAGEHGRIFSFDVTGGPYEKTDFHAEGSGSPYARGALKKLFHPGMSRREAALAALQALYDAADDDSATGGPDISRRIFPVVSVITEDGFERLPESETEDLSREMVEQRHTRPDGPTAAM

SEQ ID NO: 10350 - protein, 575 aa, Streptomyces avermitilis
MRLVMNEPVERMDRPYARRWWALLVLCLSLLIIVMANTALTVAAPDMTQDLGLSSADLQWVIDGYTVPYAALMLLLGAIGDKYSRRGALVLGLVVFGGGAVAGSLVDSATGVIAARAVMGVGAALIMPATLSLLAATFPRAERAKAITLWTATAGLAIAAGPLVAGALLQNHGWSSTFLINVPIAFVAVIGTFVLVPPSRAAHHHRIDYVGGLLSVVWIGSLVYMIIEGPHFGWGVKAVTAAVAAGVGFVLFIGWELRHPRPVLDVRRFAHRRFAGSNLAVALFFLAVFGAFYYLTQHLQFVLGYDALDTGVRMLPLAGAVFVGSALTGYLTPRVGMKITVTAGMVGGTAALALLTRVDAASSYGDFVLPLVILGLAIGLALSPCTDAIMGAFPEAELGVGGAVNDTSLELGGSLGIAILGSVLAGSYSSHLSDATTGSKLPASALSQAQDSVGAGYAVARGIGDKARHLGEQAAQAGSTEQAARLKVQSGQLADGARQMADAVGSAFADSVAHTSLVGAVVLGVGTVLVGVLLPRKEAAVREVEQEQEQEQEQEQEQGQGRKQEEEELVDSEAR

SEQ ID NO: 10351 - protein, 205 aa, Streptomyces avermitilis
MADMTTGNTSRADANRRRILDVALAELLRDPDASMDQIARVAGVVRRTVYGHFPSREALISTLVDGAVEAVAAAHAAGRESVADPAESLARSTLAVWEIADRYRILVALAQRSVTVQGIRDRLTPVRQACVELLRRGLEQGVFESPLPAAALAYVHEQMLFALMEAVNDGLLAAEEAGRSAAVTMLTAAGVPASRATGLVAKLSD

SEQ ID NO: 10352 - protein, 470 aa, Streptomyces avermitilis
MMPTTSSRRAAVSTAQTAPAAPAAKRDRTHYLYIAVIVAVALGIAVGFAAPDFAKELKPIGTGFVALIKMMISPIIFCTIVLGVGSVRKAAKVGKVGGLALGYFIAMSFVALAIGLVVGNIVHPGSGMHLTEAVKGVGHTQAEAAAEGPVDFLLGIIPTTFVSAFTEGQVLQTLLVALLVGFALQAMGRTGEPVLRGVEHIQKLVFRILGMIMWAAPVGAFGAMAAVIGETGMDALKALATIMFGFYITCFLFIVVVLGTLTKLVAKVSLFQLLKYLGREFLLIVSTSSSESALPRLIAKMEHLGVSRPVVGITVPTGYSFNLDGTMIYLTMASLFIADAMDQPMSIGQQIGLLLFMMIASKGAAGVSGSGIAVLASGLQSHKPALVDGVGLIIGIDRFMSEARAVTNFAGNAVATLLIGTWTGEVDKERVNRVLAGELPFDEKTLLDDAEDDVRAEVPEQGGEKELAKA

SEQ ID NO: 10353 - protein, 565 aa, Streptomyces avermitilis
MRFPHVPRPRSLAGQLFAMQAVLIAVLVAGYALFTYVSDRSQAEEAARRQTMAVARSVADAPSVRAAIRTSDPSAALQPYALQVQRHTGVDFVTIMNPRGIRWTHPNPDLIGERFLGHTTRALKGESFTETYTGTLGPSVRAVTPIRDGTRIIGLVSAGIKVEAITKRVQDQVTALIGVAAGALTLGGIGTYVINARLRRSTHGMNAAELSRMHDYHQAALHAVREGLLMLDGQFRVALINDGGRELLGVTGDVIGRSVAELGLPAALTGALLSAEPRVDEVHLTAARVLVVNTSPVSGGERRGTVVTLRDVTELQSLMGELDSERGFTTALRSQAHEAANRLHTVVSLIELGRAEEAVDFATAELELAQALTDHVVSAVSEPVLAALLLGKAAQANERGVELVVSEESALDDGLLPPSLPARDLVTILGNLIDNAVDAAQGSMRARVTVTVFTDASGLVLRVADTGAGVDPAYAEAVFQRGWSTKPATASGGRGLGLALVRQAVARHEGKLTVAEADGGGAEFEVRLPLPTVGPAGAAGGSEPTRRHGGASEPALPALPGGDDV

SEQ ID NO: 10354 - protein, 225 aa, Streptomyces avermitilis
MTEPIRVLVVEDDPVAADAHVMYVGRVPGFTAVGKAHTGAEARRALDRTPVDLLLLDLHLPDVHGLQLARSLRAAGYHADVIAVTSARDLAVVREGVSLGVVQYVLKPFTFATLRDRLIRYAEFHAAAGEASGQEEVDRALATLRAPGPAALPKGLSAPTLERVTRALRDSAEGLTAAGVAEAVGISRITARRYLEHLVESGRAGRSPQYGQVGRPELQYRWVKG

SEQ ID NO: 10355 - protein, 465 aa, Streptomyces avermitilis
VPVRPTAARPRTTAPLLLAALLTVSAGGALTACGSGSGSDPDTVKVSFKQSMDNSIKVTDTYLAGIKKQFEKENPGKKVELVPIKAPDSEYYTKVQQMMRSPKTAPDLVYEDTFLINSDITSGYLKPLDPYLAKWRDWDQFLDTAKAAAKGEDGKTYGVPDGTDTRGLWFDKGVFEKAGLPADWQPKTWDEVLSAARTIKKKVPGVTPLNVYTGKPAGEAATMQGFEMLLYGTGDGTADPLYDTATKKWITAGRGFKDALRFVETVYQEKLGPDVSDALDPNFSTAVRGELLPKGKLGIDLDGSWLPQDWLKGSGHEWPEWSSRLGLAAMPTQDGRAPGKVSMSGGWTWSIPAKAGNPDLAFKFIETMQTAANARKWYIANSGIAVRKDVAEDPAYTKAQPGIKFFTDLVASTHYRPAYPAYPKVSTAIQEAMEGVTTGDMSVDKAASGYDEALKTATNNQVIEK

SEQ ID NO: 10356 - protein, 309 aa, Streptomyces avermitilis
VSADTRAAPGRPLTGKAAAPRRKGARRSLVRALPAAPAVVLLVLFLAGPIGYCAYIAFTDLQLTGQAHASFVGFDNFRAAFKDEAFLNAVWLTLVFTVLSSLVGQNTLGLALASLMQRASKPMRTLVGGIVITAWVLPEVVAGFLLYAFFRREGTLNAILDGLHLPSQNWLFTLPILAVSFANVWRGTAFSMLVYSAALNEIPKEITEAAEVDGAGGWRRMWHITLPMIRRSIGTNLMLNTLQTLSVFGLIWVMTRGGPGNRSQTLPLFMYEQAFQKSMIGYGTAVALLLLVVGSLFSLVYMRLLRTEV

SEQ ID NO: 10357 - protein, 279 aa, Streptomyces avermitilis
MPRTPASRRTAHRLAADAGLLVVAAAFALPLAWVVLSSLDAHAGLEVKVPDGLTLDNFDAVLKPDITFTPLLNSLILCGGATLLTVACAALAAYPLSRFRSRLNRPFLLTILFATSLPITAVMVPVYALFVQVNLIDTLQGTIFFFAASQLPFAIWLMKNFMDGVPKELEEAAWTDGASSFQSLIRVVLPLMGPGVAVVTVFAFVMMWGNFFVPFMLLLTPDQMPASVSINDFFGNRGTVVYGQLAAFSVIYSTPVILLYVLVARRLGGGFALGGAVKG

SEQ ID NO: 10358 - protein, 238 aa, Streptomyces avermitilis
VRVHPPQAHQPTPPFNALAARRLRSALGMGPEHVAYGMRASYGLPYVTPDLVVAWERGITAPSSPELTALAGVLWCSPGELIGAPRTLREHRVAHGLAAEDVARAVGLELLVYQRMEETDEWRGNERQSSALADLLELSLPDFITVTGRDAKLAELLRSAVTTRWQAYVRPVGKMVPLDRRLLEDALQELHHAYQGQMVATLSWGGGGPAADEAGDAGRDFLDRIVENFWSTVQRSTY

SEQ ID NO: 10359 - protein, 341 aa, Streptomyces avermitilis
MRIGVLTAGGDCPGLNAVIRSVVHRAVTMYGDEVIGFEDGYAGLLDGRYRALDLNAVSGILARGGTILGSSRLQRDRLREACENAQDMAREFGIDALIPIGGEGTLTAARMLSDAGLPVVGVPKTIDNDISATDRTFGFDTAVGVATEAMDRLKTTAESHQRVMVVEVMGRHAGWIALESGMAAGAHGICLPERPFDPAHLVKMVEERFARGKKFAVLCVAEGAHPVVGSMDYSHGAIDQFGHERFQGIGTALAAELEHRLGKEAKPVILGHIQRGGTPTAYDRVLATRFGWHAVEAAHRGDFGRMTALRGTDVQMVPLAEAVTELKTVPKDRMDEAESVF

SEQ ID NO: 10360 - protein, 696 aa, Streptomyces avermitilis
VTRSVYVTGIDRGDGRQVVELGVMELLTRQVDRVGVFRPLVHDGPDRLFELLRARYRLAQDPATVYGMDYHEASALQAEQGTDELMSTLVDRFHLVARDYDVVLVLGTDFADTQFPDELALNARLANEFGAAVIPVVGGRGQTAESVRAETRNAYRAYEGLGCDVLAMVVNRVAREDREELAARLDSLLAVPCYVLPDEPALSAPTVAQITHALGGKVLLGDDSGLARDALDFVFGGAMLPNFLNALTPGCLVVTPGDRADLVVGALAAHSAGTPPIAGVLLTLDERPSDEVLTLAARLAPGTPVVSVAGTSFPTAAELFSLEGKLNAATPRKAETALGLFERYVDTGDLLKRVSAPSSDRLTPMMFEHKLLEQARSDKRRVVLPEGTETRVLHAAEVLLRRGVCDLTLLGPVDQIRKKAADLGIDLGGSQLIDPVTSQLRDSFAEKYAQLRAHKGVSVELAYDVVADVNYFGTLMVQEGLADGMVSGSVHSTAATIRPAFEIIKTKPDTKIVSSVFFMCLADKVLVYGDCAVNPDPNAEQLCDIAVQSAATARQFGVEPRIAMLSYSTGTSGSGADVDKVREATELVRLRRDDLKIEGPIQYDAAVEPSVAATKLPGSDVAGQASVLIFPDLNTGNNTYKAVQRSAGAIAVGPVMQGLRKPVNDLSRGALVQDIVNTVAITAIQAQSPHEKATAQ

SEQ ID NO: 10361 - protein, 405 aa, Streptomyces avermitilis
VSPTRVLVLNSGSSSVKYQLLDMRDSSRLAVGLVERIGEGTSRLKHTPLTTGVSRELTSPVADHAAALKTVAEELAKDGLGLDSPELAAIGHRVVHGGRSFTEPTVIDDDVLAEIERLIPVAPLHNPANLTGIRTAMALRPDLPQVAVFDTAFHTTMPESAARYAIDVKTADEHRVRRYGFHGTSHAYVSRATAKLLGRAPKDVNLIVLHLGNGASASAVRGGRCVDTSMGLTPLEGLVMGTRSGDMDPAVIFHLMRVGGMSTDEVDTLLNTKSGLIGLCGDNDMREIRRRVDEGDEQAALAFDIYIHRLKKYIGAYYAVLGRVDAVAFTAGVGENAAPVRAAAIAGLEELGLVVDSERNAVRSDEPRIVSPEDARVAVAVVPTDEELEIAQQTYALVGTAHHLT

SEQ ID NO: 10362 - protein, 476 aa, Streptomyces avermitilis
MRRSKIVCTLGPAVDSHEQLVTLIEAGMNVARFNFSHGTHAEHQGRYDRVRAAAAETGKAIGVLADLQGPKIRLETFAEGPVELVRGDEFIITTEDVPGDKHICGTTYKGLPGDVSKGDQILINDGNVELRVVEVDGPRVKTVVIEGGVISDHKGINLPGAAVNVPALSDKDIEDLRFALKMGCDLVALSFVRDASDVKDVHKVMDEEGRRVPVIAKVEKPQAVENMEAVVAAFDGVMVARGDLAVEYPLEKVPMVQKRLVELCRRNAKPVIVATQMMESMITNSRPTRAEASDVANAILDGADAVMLSAESSVGAYPIETVKTMSKIVTAAEEELLSKGLQPLVPGKKPRTQGGSVARAACEIADFLGGKGLVAFTKSGDTARRLSRYRAAQPILAFTTDEGTRNQLALSWGVESHVVPFVNSTDEMVDLVDSELQNLKRFNDGDVVVMTAGSPPGVPGTTNMVRVHHLGEGKRA

SEQ ID NO: 10363 - protein, 432 aa, Streptomyces avermitilis
VSADEVHGESSSALAQVRSGPRHAAPRKPLFTRFHMPAGKAIAIAAMPTAVLMGMGFTPTLAQADDQPLSKSELADEYKNCVAALEDGASASATPSPSASASDDASDKGDSAEPSPSASASSDKTSSSDSGSDDKAEPTPSASASASSSSAGTSDKSSGGDTSTATPSASESSGNVLEEIGDAIKDVLTPDSPSASATPTPTASASASASKDTSDTVKDTTDKVTDTVKDTAQDATNTASKAAEDATEKAKEAADEATSSATPSPSASASSTTDPKDCKAATDDQGGIDNSINLPDDPWTLKASSLKLEGADYQGVVKVRTAGGKVKKVLKYVISQGTEIGDLHQLVVGDGGKTYHVQAGEGTKSTISDGKTIMYTESISGNLFGLIPVTFDPENPPPLNIPLIYFTKVTVIQAGQFGGTLHVPGLHQYITG

SEQ ID NO: 10364 - protein, 188 aa, Streptomyces avermitilis
MSAETSVQSAGSFTRLRLRFRDWRGSRPFWAGLFTMLGGVPIAYFPYATLKLGTMSIAMATTAGAGSLIIGVLLFTLGLTMWFQQATRIFAGVAAIVLALVSLVVSNIGGFILGFLFALIGGALSASWAPGKPAADAGRRAASQDPAGDGGAGTAPENAAGGPGEPHPLPDPVHGAGAEDSNGGYRVG

SEQ ID NO: 10365 - protein, 116 aa, Streptomyces avermitilis
MTTAKRFHLVPPRTWDSIFPPSRTYISWPWLPPDGGSTGQGWEKCYVLGKESAGTRRHVLRPNHRRSPPSDNHWSRLTHITHNLPDRLHRTAETPLSRSRRHWPPSPARWGPRKTR

SEQ ID NO: 10366 - protein, 214 aa, Streptomyces avermitilis
MESQVRGGTRWKRFAVVMVPSVAAAACVGVGLAQGALAASFSVSGQEFKVSADHLHGDGFAQYGGIDSGYTSTDGKTKTVRPVAISSFDTAEITKMCQSVKTEIPLIGKTIYLRLDAGPDDKHKVEAEKLYIDVAQLDADATFKNIDIGVAVKDKTRGPAVKSGENALPGGFAQQAESADLYGVEQTAWATTAGTFKLSGLKMRLGTDSKMECF

SEQ ID NO: 10367 - protein, 328 aa, Streptomyces avermitilis
MQPRNMSMSGVVDLAAVKAAQEAKAKAEQARAEAARQGGGGTAVSAVPPSSLVIDVDEAGFERDVLQRSTEVPVVIDFWAEWCEPCKQLSPVLERLAVEYNGRFVLAKIDVDANQMLMQQFGVQGIPAVFAVVAGQALPLFQGAAGEQQIRGTLDQLVEVAEQRFGLTGLTVATDAEPGAAQEAPPIPAGPYDALLEAAVQALDAGDFGGAVQAYKNVLSDDPGNTEARLGLAQAELLQRVQDADPQRVRVEAAEKPGDAQAQIAAADLDLVGGHVDDAFGRLIQTVQRTAGDDRDAVRLRLLELFEVVGADDPRVTAARRALARALF

SEQ ID NO: 10368 - protein, 211 aa, Streptomyces avermitilis
MQCRTSAPRTGRPRSAAADAAILAATREALVELGWSKLTLGDVATRAGVAKTTLYRRWAGKNELVVDAVAELFDELELPDLGSLAADIEGVVLQFAAILARPEARSGLMAAVAESTRDDALRERIRASIVDRQKRLVLAGRSRAQARGELPPEEDAQEAARTVDLIFDMVAGAVVHRTLVSAEPVDAAWAQSFTRILLLGLAGASAGPHGA

SEQ ID NO: 10369 - protein, 566 aa, Streptomyces avermitilis
MDADAIEEGRRRWQARYDASRKREADFTTLSGDPVEPAYGPRPGDAYEGFERIGWPGEYPFTRGLYPTGYRGRTWTIRQFAGFGNAEQTNERYKKILANGGGGLSVAFDMPTLMGRDSDDRRALGEVGHCGVAIDSAADMEVLFKDIPLGDVTTSMTISGPAVPVFCMYLVAAERQGVDPSVLNGTLQTDIFKEYIAQKEWLFQPEPHLRLIGDLMEHCASKIPAYKPLSVSGYHIREAGATAAQELAYTLADGFGYVELGLSRGLDVDVFAPGLSFFFDAHVDFFEEIAKFRAARRIWARWLRDVYGAKSEKAQWLRFHTQTAGVSLTAQQPYNNVVRTAVEALAAVLGGTNSLHTNALDETLALPSEQAAEIALRTQQVLMEETGVANVADPLGGSWYVEQLTDRIEADAEKIFEQIRERGLRAHPDGRHPIGPITSGILRGIEDGWFTGEIAESAFQYQQALEKGDKRVVGVNVHHGSVTGDLEILRVSHEVEREQVRVLGERKSGRDDTAVTAALDAMLAAARDGSNMIAPMLDAVRAEATLGEICDVLREEWGVYTEPAGF

SEQ ID NO: 10370 - protein, 112 aa, Streptomyces avermitilis
MKKSVLTRYRVLAYVTGVLLVLLCLSMIAKYGFDVDGAADFTRVVAIAHGWLYVVYLVFAFDLGAKAKWPVAKQLWVLLAGTIPTAAFFVERRISRELEPRVADDAPAVAKA

SEQ ID NO: 10371 - protein, 144 aa, Streptomyces avermitilis
VPSMAAITSIMRAHQILLAEVDAVVKPYGLTFARYEALVLLTFSKAGELPMSKIGERLMVHPTSVTNTVDRLVTSGLVDKRPNPNDGRGTLASITDKGREVCDAATRDLMAMDFGLGAYDGEECAEIFAMLRPLRIAAHDFDEE

SEQ ID NO: 10372 - protein, 529 aa, Streptomyces avermitilis
VGLSASLFLGRLGIPHMLVEKHAGTSKHPRGRGNNVRTMELFRVAGAEQAIRKAASTLADNHGILQTSSLTDDEGEWLFKEIDPGGGLARFSPSGWCLCSQNDLEPVLLKSARGLGGDIRFSTEMLSFDQDAEGVTALMKNRDTGAHTTVRAEYLIAADGPRSPVRERLGIRQTGPGDLFHNVSITFNSRALADAVGDRRFICCYLTNPEADGALLPVDNVEKWVFHAPWHPEQGETLEDFTDERCVSHIRRAVGDLDMDVEITGRAPWHAAERVAERYASERVFLAGDSAHEMSPTGAFGSNTGIQDAHNLAWKLAAVLNGWAGPGLLQSYEAERLPVAQATSARASARSAEHSHPGYAPAPGAGGGGGGRQGGVLKVALGYRYPRGAVIGADPAGPVVPEQMAMAGEPGSRAPHMWLLRSGARTSTLDLYERSFVLLSGAAEDAWHRAATSVAERLAVSLDSYRIGKDPHAELVPENGTDWAELHGTTPRGAVLVRPDGYVAWRSEGPLAEPEATLYEIMASLLDLA

SEQ ID NO: 10373 - protein, 374 aa, Streptomyces avermitilis
MTTSERVSQSAFDGSRLRVVLLLDLHDGAQKQFLEAYEQLRNQVASVPGHISDQLCQSIENPSQWLITSEWESAPPFLAWVNSEEHVETVQPLHSCVRDTRSLRFSVLRETGNISAPLPQSEKGRLQATARVGDGVVRHALTFTVKPGSEPMVAKILAGYSSPQAQVDENTRLRRTSLFMHGNRVVRAIEVEGDLMAALRHVSRQPEVMAVEEAINPYLEQDRDLSDPGSARVFFTRAALPAVHHVSVGTGEPSDVERHALFYPAKSGSGMALARLLAREDEAAADDPANPIHCSTIFQRDDIVVRLVDVRGSIEDDPVLALGLKGDRNGAVLSRLLDADALGVDGAPTTEKEISRFLERSDMQLITDRSSSAS

SEQ ID NO: 10374 - protein, 147 aa, Streptomyces avermitilis
MTTPRPRIVDLSETEPNTRRGGDLRAMLTPTAVGAKSGFMGLAIVQPGERIGEHYHPYSEEFVYVVSGRLEVDLDGETHPIQPDQGLLIPINMRHRFRNVGDVEARMVFHLGPLAPRPKLGHVDTEETDGLEGAGQAMTPQRTEAVS

SEQ ID NO: 10375 - protein, 421 aa, Streptomyces avermitilis
MTRRVAVTGVGIVAPGGVGVPAFWDLLANGRTATRGITLFNPEGLRSRIAAECDFDPAAHGIDAAAAERADRYVQFAMVAAREAVGDAGLGPEKEDPWRIGVSLGTAVGGTTRLEHDYVAVSETGRRWDVDHRLADPHLHRAFSPSTLASEVAEQFGAHGPVQTVSTGCTSGLDAIGYAFHAVQEGRVDVCIAGASDSPISPITMACFDAIKATSPNNDDPEHASKPFDKHRNGFVMGEGGAVLILEELEHARARGARVYCEIGGYATFGNAYHMTGLTREGLEMARAIDGALAHARLDGSDIDYVNAHGSGTQQNDRHETAAVKRSLGDHAYRTPMSSIKSMVGHSLGAIGAIEVLACVLALVHQVVPPTANYTTPDPECDLDYVPRTARQVKLRNVLSVGSGFGGFQSAVVLTRPDGRT

SEQ ID NO: 10376 - protein, 416 aa, Streptomyces avermitilis
MKPQQKRRAAITGIGVVAPNGLSTETFWKSTEKGLCVLDRVTREGCDHLPLRIAGEVRGFDPVALIEERFLVQTDRFTHFAMAAADLALEDARLGRTYTGDEPFGIGVVTAAGSGGGEFGQRELQRLWGQGPRFVGPYQSIAWFYAASTGQISIRGGFKGPCGVVASDEAGGLDALAHAARAVRRGTDVVVAGAAEAPLAPYSMVCQLGYEDLSTSDDPACAYRPFTGAACGFVPAEGGAMLVVEEETVARGREAAIRAFVAGHGATFTGASCWAQSREGLAHAIRDALNEARCAPEEIDVVFADAFGVPEADRAEALAIADVLGAQGRRVPVTAPKTGIGRAYCGAPVLDVAAAVLAMEHGLVPPTPNVFDPCYDLDLVTGSARPAELRTALVLSRGLMGSNAALVLRHGAHALS

SEQ ID NO: 10377 - protein, 94 aa, Streptomyces avermitilis
MPSHEKEKEMDNQLTVQELAALMKKAAGVTVDVKELEDRLDSGFAEFGLDSLGLLGIVGELENGHGAVLPPDAERCRNPREFLDLVNNNIVAGA

SEQ ID NO: 10378 - protein, 159 aa, Streptomyces avermitilis
VSGHTENDIIIAAPLDLVWDMTNDIESWPQLFSEYASVDVLSRENGTTTFRLTMHPDENGKVWSWVSERTPDREKLTVTARRVETGPFEYMNIRWVYSQTPDGTRMHWTQDFAMKPEAPVDDAWMTDNINRNSVVQMELIRDKVEQHARERRTASVTTD

SEQ ID NO: 10379 - protein, 108 aa, Streptomyces avermitilis
MHQALIVARMAPGSAPDIAKVFAESDSGELPHLVGVTRRTLFQFNDVYMHLVEADRPPGPAIAEVAGHPAFRDISDRLSTYVSAYDPTTWRSPKDAMAQEFYRWERES

SEQ ID NO: 10380 - protein, 331 aa, Streptomyces avermitilis
MQLRELVFGAACAAAVRAAAKLGVADALGEKPATAEELAAVLGTEPRPLLRLLRALSCYGIFAQNDDGRFVHTSMSRLLREDDPHSLRYISLWCTEPWTWDAWPRLDEAVRSGGSVFHELYGKGFFDYLHEDAHDSAQVFNQAMTTSSEQSARDVAELLDLTGVSTVADIGGGQGHVLASLLEKHPDIRGTLLDLPRVVEKADPRLRDGGPLAARARIVGADCREEIPVEADLYIIKNILEWDDDSTRRTLRNVMTKARPGARVVIIENLVDDTPSMKFTTSMDLMLLLNVGGAKHTKESLVTRMTEAGLTVGEIRPVNAYLHAFECTVPA

SEQ ID NO: 10381 - protein, 352 aa, Streptomyces avermitilis
MNKKDFAYLGCAAIVVASGLSCIPAANAATAHVVHPGESIQKAVDAAQSGDTIVISPGTYHQSVLVTKSGLTIRGAGERTVLMPAATRAADKCAAAGNGICVEGTSAHPVTRTSVRSLTLTGYKKNGLWASNTDKLTVRDVAADKNKNWGIAIERSVRSVLEENVARGNAESGVFLSNTVDTEAGATDTRGTVVRHNRLEGNRIGLTVRRLRNVTVEENELSANCSGLFAVGDEGKPHAGALAIRGNGVHENNKYCAKTARLPYIQGSGIVLTGTEDTVVEYNDIRDNVGKSVFSGGVVLYKSFVGTPNKRNVIRDNVLSGNSTADLANRDTGTGNKFEHNSCQRSEPAGMC

SEQ ID NO: 10382 - protein, 210 aa, Streptomyces avermitilis
VSETTKTKLLEGALRALSEQGIAKTSARAIAAAAGVNQALVFYHFGSVDELLAAACRHGAEQVVARYRARLDEVATLAELLALGRELHEQEKAEGHVAMLGQLLAGAQTQPRLAPATAAGLDLWIAEIEKVLTRVLTPTPLGEFADPAGLARAVAASFVGIELYEGVDAEGAGAALAALDQLALLLTALEDLGPVAQRAVRHTLRRATRG

SEQ ID NO: 10383 - protein, 226 aa, Streptomyces avermitilis
MTSIFRTVMGADFDRLHPELRRRFSVGLTSGEACTGRGVMERIWHGGRFVKPFLALGGTRNILVPRAGRRIPFTIENVPYKDTFGRETVTFVRTFDLPGGPRRFDAQMVLSPKGDRVLDYLGTHQHLASDLHFRAEPDGSLLIRSGEHRFREGPVDVRVPELIGGEAQVRESFDDRTGRFRIQVRVVNRYVGPLFGYEGSFEADYTDIRTCGVRPGLRPVREERRA

SEQ ID NO: 10384 - protein, 250 aa, Streptomyces avermitilis
MGLYIETRIRRDLDDLWTHTQDPARHQRWDLRFTEIDYLARGEGEPQRFRYATRVLPFLTIAGTGVSAGEKERPDGTRTSALRFASPHPLSLLAEGSGYWRYVPDGDGIRFLTGYDYRPRWGLVGVATDRLLFRPLMGWATAWSFDRLRLWLERGITPERALRRWAAELALRVLVIAAGCTGFGFGRLLLLTGPFAPMLCYAMPLLASVAVALALFLPPAPGTPAARRCLRTPPTRTRAPRLLATLERQS

SEQ ID NO: 10385 - protein, 97 aa, Streptomyces avermitilis
MIVAFSVTPLGVGVDVGEYVADAVRVVRESGLPHRTDAMFTSVEGEWDEVMAVVKRAVAVVEERAPRVSLVLKADIRPGVSDGLTSKVETVERHLSA

SEQ ID NO: 10386 - protein, 114 aa, Streptomyces avermitilis
VDVKTAAALHRLRLISLPEAISFPILLVCSVLKRTTEFDAVFPMGLIHGLLFTFYVIFWADAWNRAKWSKKKAAGYFLLAIPPFGGLFAERKLKREAEDAVIASRARREGTVNA

SEQ ID NO: 10387 - protein, 210 aa, Streptomyces avermitilis
MFRLQGSKVLAVDMTGDAVKAKNGSMVAYDGQMAFKKLSGGGEGIRGMVTRRLTGEQMTLMEVKGQGTCWFADRASEINLVSLQGDKLYVESSNLLATDAGLRTGTSFTGLRGASQGNGLFTTTVEGHGQAAIMSDGPAVVLRVSSQYPLTVDPGAYIAHQGNVRQSFQSGVTFRTFMGEGGGEAFQIRFEGDGLVYVQPSERNTIAGDV

SEQ ID NO: 10388 - protein, 219 aa, Streptomyces avermitilis
MCDMPFREINSKMIEATVAPGQRLFSQRGAMLAYKGEVSFTPNVQGGQGGVMSMLGRRMAGEATPLMTVEGSGTVFFGHGGHHIEVINLTGDTLYVEADRLLAFDGTLQQGTMFMGSQGGVMGMVRGQVTGQGLFTTTLKGHGAVAVMAHGGVIEVPITPQRPVHVDPQAYVAHHGDVRNKLSTALGWRDMVGRGSGEAFQLELSGSGAVYVQASEEKL

SEQ ID NO: 10389 - protein, 265 aa, Streptomyces avermitilis
VSAYGAAGPVIHDPMTLPVDDNVNKYTFCVELKGSQWFLQKGKMIAHYGSIDFNGIGHGRLDRLVRTSFHSPLHASDWVVAEGSGKMLLADRAFDVNSYDLDDGNLTIRSGNLLAFQPSLALKQSIVPGFLTLIGTGKFVAASNGPVVFMEPPIRVDPQALVGWADCPSPCHHYDHGYMTGVMGGLRAMTGLGGASGEEHQFEFVGAGTVLLQSTETLMAEQAMGAVPQEPGVPGGGGVPGHQGQQAGAPRLPGQLGDLQRRFGL

SEQ ID NO: 10390 - protein, 158 aa, Streptomyces avermitilis
METETATRWLTDAEQCAWRTHLEVNRLLTYQLERDLQPFSLTMNDYEILVNLSESEGVRMRMSDLAAATLQSKSRLSHQITRMENADLVRRENCESDRRGLFAVLTEHGMETMRKVAPHHVASVRRHFIDLVSPEALEELHKTLRPVAEHLRAQRGKP

SEQ ID NO: 10391 - protein, 332 aa, Streptomyces avermitilis
MSASSARPSYAALLRIPHARRTFTAALVGRLSYGVVSLAMTLTVARGTGSYAVAGTVMALFGAMSVVLSPARAALIDRYGPRRALIPMASLYAGLLAAFAAAAWLPGAPSVALGAPAAAAGACTPPLGPTMRAVWGEVVEDKLLLQRAYSLDGVAEEILFVSGPLLVGVVVRCAPPAAGVALSALLVWAGTLAFALSPVVAGVRPAAAKPAARSGGRPRGGRALVQPVVVATGVGLSLGAVDLLVMAFAQQHRHGDDVVAWVLAALSLGSALGGLLNGAVDWRTSARVRLPLQACGLGLALLAAGLAPASAPWPWPWPAPASSSPRPSPRPT

SEQ ID NO: 10392 - protein, 318 aa, Streptomyces avermitilis
MQDVSSLVAQAREGRPRAVARLISLVEGASPQLREVMEALAPLTGNAYVVGLTGSPGVGKSTSTSALVTAYRKAGKRVGVLAVDPSSPFSGGALLGDRVRMSEHASDPGVYIRSMATRGHLGGLAWAAPQAIRVLDAAGCDVILVETVGVGQSEVEIASQADTSVVLLAPGMGDGIQAAKAGILEIGDVYVVNKADRDGADATARELNHMLGLGESRGPGDWRPPIVKTVAARGEGIDEVVEALEKHRAWMEEHGVLTERRLARASQEIETIAVTALRRRIGDLHGDRRLSALAERIVAGELDPYRAADSLVEGVTEG

SEQ ID NO: 10393 - protein, 400 aa, Streptomyces avermitilis
MSGTNSTTSVIVAGARTPMGRLLGSLKSFSGADLGGFAIKSALDRAGIGGDQVQYVIMGQVLQAGAGQIPARQAAVKAGIPMSVPALTINKVCLSGLDAIALADQLIRAGEFDVVVAGGQESMTNAPHLLPKSREGYKYGAVQMIDAMAYDGLTDAFENIAMGESTEKHNTRLGIGRADQDAVAALSHQRAAAAQKNGIFEAEITPVEIPQRRGEPVVFSQDEGIRGETTAESLGKLRPAFTKDGTITAGSSSQISDGAAAVVVMSKAKAQELGLEWIAEIGAHGNVAGPDNSLQSQPSNAIQHALKKEGLAVDDLDLIEINEAFAAVAVQSMKDLGVSTEKVNVNGGAIALGHPIGMSGARLVLHLALELKRRGGGVGAAALCGGGGQGDALIVRVPKV

SEQ ID NO: 10394 - protein, 163 aa, Streptomyces avermitilis
VIARTLRNHLPERCTDSMLTRIDHIGIACFDLDRTVEFYRATYGFEVFHSEVNEEQGVREAMLKINNTDDGGASYLQLLEPTREDSAVGKWLAKNGEGVHHIAFGTADVDADAADIREKGVRVLYDEPRRGSMGSRITFLHPKDCHGVLTELVTSAAVESPEH

SEQ ID NO: 10395 - protein, 1258 aa, Streptomyces avermitilis
MDRLKTEREKAIQHAEDLGYQVEVLRAKLHEARRTLASRPAYESADLGYQAEQLLRNAQIQADQLRADAERELSQARAQTQRILQEHAEQAARLQAELHTEAVTRRQQLDQELAERRQTVESHVNENVAWAEQLRARSEQQARRLVEESRAEAEQALAAARAEAERIAAEARQRLNTDAESARAEAEALLRRARTDAERLLNAASTQAQEATDHAEQLRSSTATESDAARRQASELSRTAEQRMTEADAALREARAEADKVLTEAKEAAAKALASAESANEQRTRTAKEQVARLVSEATKEAETTKASAEEVVADAKAEAEKILTEAADKARSLTAEETASQLTKAARTAEDVLNKASEEAKSTTKAATEEAERIRREAETEADRLRAEAHDIAEQLKGTAKDDTKEYRAKTVELQEEARRLRGDAEQLRADAVAEGERIRSEARREAVQQIEEAAKTAEELLAKAKADADELRTAATTDSEKVRTEAIERATTLRRQAEETLERTRNEAERHRAEAVEQSEAIKEDAERAARELRDDSERAIEARRAEAADELTRLHTEAEQRLASAEQALSDARAEAERIRREAAEEADRLRTESAERIRTLQAQAETEADRLRTEAAADASTSRAEGEAIAVRLRSEAVAEAERLKSEAQDTADRVRAEAQAAAERLAAEGAETLAAAQEEATRRRREAEELLGSARQEADQERQRAREQSEELLAVARARVEEAQAEAVRLVEEADRRATEMVANAEQTAQQVRDSVAGLHDQAQEEIAGLRSAAEHAADRTRTEAQEEAGRVRADAYAERERATDDANRIRREAAEETDAAKSLAERTVSEAIAESERLRSDAAAHAQRVRTEASDAIANAEQDASRTRAEAREDANRIRSDAAEQADTLITEVTAEAERLTAETNVEAERVRAESVAKAEKLISDATGDAERLRAEAAETVGSAQQHAERIRSESQRLKADAEAEAERVTTAARAEAERTLDEARKDANKRRSEAAEQVDTLITETAAEADKLISEARQTAQKTTADAEGQADTMVGVARNEAERLVSEATVEGNSRVERARTDADELLVGARRDATAIRERAEELRDRITSEIEELHERARRESAETMKSAGERCDALVKAAEGQLAEAEAKAKDLVAEANSEASKVRIAAVKKAEGLLKEAEQKKASLISEAEQIKVEAIREARAAVEEGKRELEVLVRRREDINAEISRVQDVLEALESFEAPSGGKDGGVKAGAAAGATRSGGKVSEG

SEQ ID NO: 10396 - protein, 312 aa, Streptomyces avermitilis
MSDTSPYGFELVRRGYDRAQVDERISKLVSDRDSALARITALEKRIEELHLETQNAQAQVTDAEPSYAGLGARVEKILRLAEEEAKDLREEARRASEQHRELAESAAQQVRNDAESFAADRKSKAEDEGVRIVEKAKSDASQLRQEAQKDAQSKREEADALFEETRAKAAQAAADFETNLAKRREQSERDLASRQAKAEKRLAEIEHRAEQLRLEAEKLRTDAERRARQTVETAQRQAEDIVADANAKADRIRSESERELAALTNRRDSINAQLTNVREMLATLTGAAVAAAGTPSTDDEPISRGVPAQQSR

SEQ ID NO: 10397 - protein, 316 aa, Streptomyces avermitilis
MIELDGLTKRYGEKLAVDDLTFSVEPGIVTGFLGPNGAGKSTTMRMMLGLDRPTAGDVLIDGRHYDRLKNPLKYIGALLDAKAMHGGRSAFNHLLCLAQSNGIPKARVHEVLDMVGLTAVAKKKAKGFSFGMGQRLGIAGALLGDPRILMFDEPVNGLDPEGIHWIRNLMKSLASQGRTVFVSSHLMSEMALTADHLVVIGQGRLLADTSMADFIQQNSRSYVRIRSPQRERLLDVLHGAGITVVETGGGTLEVDGGKSELIGELAAGHQIVLHELSPQQASLEEAFMRLTAESVEYHAHPQGPPQDWGDAWKKGA

SEQ ID NO: 10398 - protein, 256 aa, Streptomyces avermitilis
MSAAQVVRSEWTKIRSVASTVWTLSLAVVVTIALGMLISALAGNEFDKMDPRDRLSFDPTFISFAGMSLGQLAMIVFGVLVVSNEYSTGMIRSSLAAVPQRGTFLFSKIAVAAGLALVVGIVTSFAAFFLGQAMLGSHRASISDTGVLRAVIGGGLYMTLIAMFSMGVAAMLRSPMLSLGILMPFFFLISNVLGNVSATKKIGRFLPDQAGSKIMQVVTPLGDDTPYGPWGGLGIMVLWVVLALAGGYALLKRRDA

SEQ ID NO: 10399 - protein, 443 aa, Streptomyces avermitilis
MIEAVGLTKRYGDKTAVYNLSFQVRPGSVTGFLGPNGSGKSTTMRMILGLDNPTSGQVTIGGYPYRRLPNAPRQVGALLDAKAVHGGRHARNHLLSLAQLSGIPARRVDEVLGVVGLQDVARRRSKGFSLGMGQRLGIAAALLGDPQVLLFDEPVNGLDPEGILWVRNLMKSLAAEGRTVFVSSHLMSEMALTADHLIVIGRGQLLADMSIRDFISANSADFARVRTPETDPQQREKLTAALTEAGGHVLPELDGALRVTGLPLPRISDLAHSSDVRLWELSPHQASLEEAYMRMTQGAVDYRSTIDEKAGLQQPLPPGVQPPMPVPGQGQPGWYAPPSPQQGGQPFAMPQGQPLPQGQAAAGPYGAPYGAPAAPAAQAPGGPNPYAQPAASGPGPARPGARGSRGPCGLGRAPQRPLRPPRSRAPHPHSPSRPPPRPPPLPT

SEQ ID NO: 10400 - protein, 289 aa, Streptomyces avermitilis
MSTPQPPMPQPAAPAPTWQAASGGSYTSPIPIIRTHLGHALASEWTKIKSVRSTIWTLGVFLFLVIGIGLGAGALVSGSDTDMHGDSPLALGFFGLLLGSICIITLGVLTTASEYGTGMIRTTMVACPTRSRVLLAKSVVFFAVAFVVTTVSASFVAFAQSAMLEGSGAGTPSGGEWLKGTVGVGLYVALLGLLSLIVGSIIRHSAGAITIMIGVLLAPLVIAMFMFADSLRDLQQALFEYSIPNQLAVFYDNSLSGSGPSGWDPLWIMLGVTAVAFGGAYLLLEKRDV

SEQ ID NO: 10401 - protein, 110 aa, Streptomyces avermitilis
VSPRRNRPKGAGSSGGSAAEERSGRYGGWQSTESWQGEEWSVRHVAGASAEGKTYRCPGCDQMIPSGVPHVVAWPEHAGVDDRRHWHKACWNAKDRRTLRVQRSRNAPRF

SEQ ID NO: 10402 - protein, 342 aa, Streptomyces avermitilis
MHVGSFVLAAQFPGQGQGEALHRAVRSAEVAEEAGLDTVWLGEHHFVPYGTCPSAITLAALLLGRTRRIRVGTAVSVLPTVHPVALGEQAALLHLTSGGRFSLGVGRGGPWVDLEVFGSGLEAYEKGFPESLDLLVRWLREPSVAGTGERFTFREVPVVPRPSESLTDASGPEVVVACTSPASVRLAAERGLPMLLGMHVGDEEKAGMVALWRQHARASGLGAGEIAGAAHVSAGICQIADRRTDAVETLTKAMPGWLRQGLDAHVTVDGRPRAMRDPLAYTELLCGLHPVGSPRLCADRLAATSERTGISRFALLVEGSGDLAATEENVRRLGTEVLPHLG

SEQ ID NO: 10403 - protein, 130 aa, Streptomyces avermitilis
MSLDVSPALLEQAERGEVDEADFVDCVRTSLPYAWEMISSLVAQLKVDGGAFADNQTPPPDEQARGQLLRALASDAIRGALQRHFGVRLAFQNCHRVAVFPLDTSVDQKLARFTSVRSQLLNQSPEFRDC

SEQ ID NO: 10404 - protein, 223 aa, Streptomyces avermitilis
MRLVIARCSVDYAGRLTAHLPSAPRLILVKADGSVSIHADDRAYKPLNWMSPPCTLKEGSGDEEGVWTVINKAGEKLIITMEEILHDSSHELGVDPGLIKDGVEAHLQELLADRIETLGDGYTLIRREYMTAIGPVDILCRDATGQTVAVEIKRRGEIDGVEQLTRYLELLNRDPHLAPVRGVFAAQEIKPQARVLATDRGIGCTVLDYNAMRGIEDDKLRLF

SEQ ID NO: 10405 - protein, 847 aa, Streptomyces avermitilis
MDPNNQEPEEYGHDGDGETPRQRPPRDSLTSDFGQHTPVVARTVQLVSGDYLLTVNPVDGSEIEACPPGERPPRPVKFAPAERAETARAAQPPVPPGPARPRLPLLERQEERERLVRLLARGRSVRLTGPAGSGRTVLLDAVAEDCADLAPDGVVRLTGYRRTASDLLHDLFAAVYKSDLHRPEREELLRLVHEIGAVVVLDDVEFGGSALDELLDATPECAFLISATPDVPAPSADSLLEEVFLGGLDRAGGLELLERAVGRVLTEDESNWAGDLWFESEGLPLRFMQAGALLRQRDELRADPNAFDSLGFYDDAPSPRLSASLEPGDTPDAPSDAEDGHDLPLPSLAEGAAPASLLASRLSASARETLKFAVALGGEVPHQTHLPALVDDTHADAALAELLSCALVSPVGSRYRLAAGVQAQLEAAGYATGADARALAAAQHYAWWAGHPSVTPERVSAEADAVLAALTVLVPLTTPPGENEESAAVLLARHATPAFAAGLHWSAWERALRAGAEASRLAGEVGDQTYFHHELGILALCCGQLDRARAELEASIGLRGALADKRGTVAGRRALALVADRSGAALPGGRTAAGEEVPDARYEESASPPGGVPAGFGLPEPSGDGTTLVTHRTEPTPARQGPVSVKGIVGGARRNLVAAGAGVLLAGVLGTVVTLGMTSNNNDDPPAEKVGVNPSASQGIDDDSLGADKPRKDTGDSGVAGVPTDPGPDGTYGTADDPAPSASARPSDDPTGTKGTTPSTSPSKSPSKSPTTKPPTSSKPTTSNPTTTPPTSTPPATTTPPPTTTAPSTTDSASGPASSSAPATGSGTASAPQSSGAGSPSDSDPVI

SEQ ID NO: 10406 - protein, 107 aa, Streptomyces avermitilis
MHIRGDHAELVVGGRLDVRSAADARTVLHSAVDDGVGDLILDLSELDSWDATGLGVIMGAHRRAGRCGRRLVLRDVPPQMQRLLVATRLHRILAIEGGIGVESLPRV

SEQ ID NO: 10407 - protein, 282 aa, Streptomyces avermitilis
VTGKLAVIGAGLMGSGIAQVSAQAGWDVVLRDVTDEALTRGTDGIKASYDKFVSKGRLSADDAGAALARITTTTDLDAVADADIVVEAVFEKLEVKHEIFRALDKIVRDETVLASNTSAIPITKIAAVTERPERVVGAHFFSPVPMMQLCELVRGYKTSDEALATTREFAESVGKTCIVVNRDVAGFVTTRLISALVVEAAKLYESGVATAEDIDLACKLGFGHAMGPLATADLTGVDILLHATSNIYTESQDEKFAPPELMRRMVDAGDIGRKSGQGFYKH

SEQ ID NO: 10408 - protein, 213 aa, Streptomyces avermitilis
MAEGLRERKKRQARQHISDVATGLFLERGFDEVTIAEIAEAADVSVNTVYNYFQAKEDLFLDRAKGSVARLSRFVRARDTGESAAAAVLRELRGEVEAVSPQVGLFEGYDRFMKVVEAAAGLRARLGHMNQQSLELLEETLRTETGADPDDPMPSLMAGQIGWAHTTLLALIGREMMAGRSPGEVSREALGLLDDMEELFSERVLNYAVREAG

SEQ ID NO: 10409 - protein, 260 aa, Streptomyces avermitilis
MAIISTAGLARTFRTKRGPVEAVRGIDLTVRPGEILGFLGPNGAGKTTTLRMLTTLLPPTGGAATVAGCDLVSDPVGVRRAVGYVAQSGGVDPNVTAREELVTQGRLYRLTRLQASERAAELARDLDLADLLDRRTAALSGGQRRRLDIAMGLTHRPRVLFLDEPTTGLDPGSRADLWDLVRRLRDEHGTTVFLTTHYLDEADALSDRLVIVDKGVVVAEGTPSALKLAHGGSIDATLQDTFLAITGRGPSPADSAPVAV

SEQ ID NO: 10410 - protein, 249 aa, Streptomyces avermitilis
MLFQDTALIYGRYARQTLHSKFQIFFGMLMPLLYLLLFGPLLTHLPLGSHGSSWQVLVPGLLLQLGLFGSLFSGFSIIFEKNYGVVERMRVTPVSRLALLLGRVLRDATLLVFQAVLLVLTALLMGLRAPLAGMLIGFAFVALLAVSLSSLSYAVALKVDRPQEFGPIINAVSLPSMLLSGLMLPMTLGPDWLDVLSHVMPLRYLVDAIRDAYLGQYATSAMLYGVLVALGFATLAVTVGTRVFRTAGA

SEQ ID NO: 10411 - protein, 190 aa, Streptomyces avermitilis
MVNLTRIYTRTGDQGTTALGDMSRVAKTDPRISAYADANEANAAIGTAIALGGLDEEIVKVLVRVQNDLFDVGADLSTPVVENPQFPPLRVEQFYIDKLEADCDLFNGELEKLRSFILPGGTPGAALLHQACTVVRRAERSTWAALEVHGEDMNPLTATYLNRLSDLLFILARTANKGVGDVLWVPGGER

SEQ ID NO: 10412 - protein, 207 aa, Streptomyces avermitilis
VPFPHWRRRSGSAPPGVWKGDREERAVIVTLVIACEVAFWVLLAAGLTFRYAFRMPRTGLALLLCEPLLEVVLFAVTAIDLRNGAEPDWKHGLAAVYIGFTVGLGHSTIKWADARVAHRFAGGPPPVRPPKYGVARAVHEWRVAGRWILAAVVATALLQAAIWYVGSGGETDSLRMWQMRMVWLIGINVIIALSYTLFPKQKRAKLR

SEQ ID NO: 10413 - protein, 394 aa, Streptomyces avermitilis
MAVRLPRPHHHDVRIAVGGLLGGLLLWGLGLSPRNPHDSVVLWPAHWAVLVPLVVTAGCELLRRTRPRAALLIGTAAVVADTVTLGSVVTVVMFTDLMYAAVLYGTPASARRLPWLTGLLTVIGGVGPAAVWGDPDGLLIGVGVGVVAFAPAATGSVVRNHREAAEAARLRAEQTALLAEMDRSQAVTAERARMARELHDMVANHLSAIAIHSTAALSIDEPGTSREALGVIRENSVAGLAEMRRLIGILRDGDGEGEPVATPTLDGLAALVDGARTNGLDVTLDADPGRVPAPVELAAYRIVQESLTNALKHASPGRVAVTLAARDGSLAVRVTSPYGDRDGPRAPGSGAGLVGMRERVALLHGTFEAGPENSGRGTVWTVRATLPITHGGTE

SEQ ID NO: 10414 - protein, 213 aa, Streptomyces avermitilis
MIRVLVAEDQSAVRAGLVLILRSAPDIDVVGEAADGEQAVALARELRPDLVLMDVQMPRLDGVSATRRVVAENLADVLVLTTFDLDEYVFGALRAGACGFLLKNTEARQLLEAVRTVARGEGLISPAVTRRLIAEFAAKPVREPGPDPVILDVLTRREREVLSCLGRGMSNAEIAARLDMAEATVKTHVSRLLGKLELRSRVQAAVLAQELGV

SEQ ID NO: 10415 - protein, 607 aa, Streptomyces avermitilis
MRFGHRAVAGFATLLLPLAGLVGLASPAQAAGSATATYAKTQDWGTGFEGKWTVKNTGTSSISSWTVEWDFPSGTSVTSAWDADVTSSGTHWTAKNKSWNGTLAPGASVSFGFNGAGSGSPSNCKLNGDSCDGATTPGDAAPSAPGTPTASGITDTSAKLSWTAATDDKGVKNYDVLRDGAKVATVTTTSYTDTGLTAGTDYSYTVQARDTADQTGPVSGAVAVHTTGGGTTPPPTGSAVKLGYFTEWGIYGRNYNVKNLVTSGSASKITHINYAFGNVTGGKCAIGDSYADYDKAFTADQSVSGVADTWDQPLRGNFNQLRQLKAKYPNIKVLWSFGGWTWSGGFGAAAANPAAFAQSCYDLVEDPRWADVFDGIDIDWEYPNACGLSCDTSGSAAYKNLMSALRAKFGSNNLVTAATTADGSSGGKIDAADYAGAAQYVDWYNVMTYDFFGAWDAQGPTAPHSPLTSYSGIPKAGFTTADAMAKFKAKGVPASKLLIGIGFYGRGWTGVTQDAPGGTATGPAAGTYEQGIEDYKVLKTSCPATGTIAGTAYAHCGSNWWSYDTPATIGTKMAWAKSQGLGGAFFWEFSGDTGNGELVSAINSGLG

SEQ ID NO: 10416 - protein, 150 aa, Streptomyces avermitilis
VSMVLALTVCGLVVALVVVGLFVFGLRRRLIQRSGGTFDCSLRWDVPEKGDSNGKGWSYGVARYNGDRIEWYRVFSYAPRPRRVLERSAIEVAGRRAPEGEEELALLSDAVILVCLHRGTRLELAMSEDALTGFLAWLEAAPPGQRVNVA

SEQ ID NO: 10417 - protein, 124 aa, Streptomyces avermitilis
LAAELHVELVAADRQVWSGEATLVVARTTSGDIGVMPGHQPLLGVLESGPVTIRTSDGETVVAAVHGGFISFADNKLSLLAEIAELADEIDAQRAERELERAKAEGDATAERRADVRLRAVSAR

SEQ ID NO: 10418 - protein, 478 aa, Streptomyces avermitilis
MTTTVETAVATGRVARVIGPVVDVEFPVDAMPDMYNALHVEVADPANAGEKKTLTLEVAQHLGDGLVRTISMQPTDGLVRQAAVTDTGTGITVPVGDFTKGKVFNTLGEVLNVDEKYDGERWSIHRKAPRFDELESKTEMFETGVKVIDLLTPYVKGGKIGLFGGAGVGKTVLIQEMIYRVANNHDGVSVFAGVGERTREGNDLIEEMSDSGVIDKTALVFGQMDEPPGTRLRVALAGLTMAEYFRDVQKQDVLFFIDNIFRFTQAGSEVSTLLGRMPSAVGYQPNLADEMGLLQERITSTRGHSITSMQAIYVPADDLTDPAPATTFAHLDATTVLSRPISEKGIYPAVDPLDSTSRILDPRYIAQDHYDAAMRVKTVLQKYKDLQDIIAILGIDELGEEDKLVVHRARRVERFLSQNTHVAKQFTGVDGSDVPLDESITAFNAIIDGEYDHFPEQAFFMCGGIEDLKANAKELGVS

SEQ ID NO: 10419 - protein, 305 aa, Streptomyces avermitilis
MGAQLRVYKRRIRSVTATKKITKAMEMIAASRVVKAQRKVAASTPYATELTRAVTAVGTGSNTKHPLTTQAETVTRSAVLLLTSDRGLAGAFNSNAIKAAEQLTARLEAEGREVDTYIVGRRGAAHYNFRERKVTELWTGFTDEPTYADAKKVAGPLIEAIEKETADGGVDELHIVYTEFVSMMTQTAIDARLLPLSLEEVAEESSTQGEIRPLYDFEPSAEDVLDALLPRYVESRIYNALLQSAASKHAATRRAMKSATDNAGELINTLSRLANAARQAEITQEISEIVGGASALADATAGSDR

SEQ ID NO: 10420 - protein, 529 aa, Streptomyces avermitilis
MAELTIRPEEIRDALENFVQSYKPDAASREEVGTVTVAGDGIAKVEGLPSAMANELLKFEDGTLGLALNLEEREIGAVVLGEFSGIEEGQPVHRTGEVLSVAVGEGYLGRVVDPLGNPIDGLGEIETSGRRALELQAPTVMDRKSVHEPMETGYKAVDAMTPIGRGQRQLIIGDRQTGKTALAVDTIINQRDNWRTGDPKKQVRCIYVAIGQKGSTIASVRGALEEAGALEYTTIVAAPASDPAGFKYLAPYTGSAIGQQWMYEGKHVLIIFDDLSKQADAYRAVSLLLRRPPGREAYPGDVFYLHSRLLERCAKLSDDMGAGSMTGLPIVETKANDVSAFIPTNVISITDGQCFLESDLFNAGQRPALNVGISVSRVGGSAQHKAMRQVSGRLRVDLAQFRELEAFAAFGSDLDAASKSQLERGQRMVELLKQAQYQPMPTEDQVVSVWAGTTGKMDDVPVADIRRFEKELLEFLHRKYQGLMTSIKEGAKMSDDTLTAIADAIADFKKQFETSDGKLLGEDVPAAGK

SEQ ID NO: 10421 - protein, 273 aa, Streptomyces avermitilis
MTAHGASREATAAARERLDALTDSTSVDVVQLADELAAVTALLDREVSLRRVLTDPAQAAEAKAELAGRLFGSQIGGPATDLVTGMVRSRWSQSRDLVDAVEELADIADLTAAQRAGVLDDVEDELFRFGRIVSSNPALRAALTDRTADKAARSELVHSLLGGRATATTERLVTRLVTTPRGRSLEAGLESLSKLAAERRDRLVAVVTTAVPLSDTQKQRLGAALATLYGRQMHLNIDVDPEVLGGMRVQVGDEVINGSIADRLEDARRRMAS

SEQ ID NO: 10422 - protein, 186 aa, Streptomyces avermitilis
LTEGTDVILVQLAAEEAQNPLIPEVPELVIGLLAFAIVFFVLGKKLLPNINKVLEERRAAIEGGIEEAEAMKVEAQSVLEQYKAQLAEARHEAARLRQEAQEQGATLITEMRAEGQRQREEIIAAGHAQLEADRKAAAQALRQDVGTLATDLAGKLVGESLEDHARQSRVIDRFLDGLEEKAEATR

SEQ ID NO: 10423 - protein, 80 aa, Streptomyces avermitilis
MSALQTLAAVNIQGNLGAIGYGLAAIGPGVGVGIIFGNGTQALARQPEAAGLIRQNQILGFVLCEALALIGLVMGFVYPS

SEQ ID NO: 10424 - protein, 269 aa, Streptomyces avermitilis
VSDAKTLAFETDCHIFEGCGFPTPGLHSFVFEPIFTVGGFEFNKPILLVLLSTIIVIGFFWAAFNKPKLIPGKLQMIGELGYDFVRRGVVYETLGKREGDKYVPLMVSLFFFVWMMNIWSIIPVAQFPATSIIAFPAGLAAVVYVLWVSLTFKKHGFVGAFKNITGYDKSLGPVFPVVMFFEFLSNLLIRPFTHAVRLFANMFAGHVLLLIFTIASWYLLNGIGIAYAGVSFLMVLVMTVFELFIQALQAYVFILLSCSYIQGALAEHH

SEQ ID NO: 10425 - protein, 137 aa, Streptomyces avermitilis
MQSNDARTLLHCALPTAAAGVVGVAVSAAVAGGKGALGAGFGTVLVLLFMCSGLVVLLRTARSLPHLFQMMGLLLYTTQILLLMILLTIFRGTSVFNPKCFALTLLAATLVWIAAQVRSHMKAKVLYVEPDSARTPS

SEQ ID NO: 10426 - protein, 272 aa, Streptomyces avermitilis
VMGAGLAEVCARAGLDVLVTSSGEDGLARGRGRLERSLAHAVRKDRISDTAREETLARVSFTTDLAAFRDRQLVLEAAPEDEPTKLRIFQALDRAVEDPEAILATNTSALPVMRLARATDRPGQVLGLHFFNPAPVLPLVEVIGSLLTRDRTRRIAAEFATTVLGKQVVHAGDRSGFVVNALLIPYLLSAIRMCEAGFAGAQDIDKAMTLGCSHPMGPLALADLIGLDTVAAIGTALYEEFKEPTHAVPPLLSRMVDGGLLGRKSGQGFYTY

SEQ ID NO: 10427 - protein, 450 aa, Streptomyces avermitilis
MTLLTEAVRAGAPPQELERAPLPGEYTAAYIQAEDARMFDGVADKDIRKSLRVGQVPMPELAPDEVLVAVMASAVNYNTVWSAMFEPVSTFRFLRQFATQGGWARRHDLPYHVIGSDGAGVIVRVGSGVRRWGIGDHVVMSCVQPDDQEPATQADGMLGAEQRIWGFETNFGGLAHYAVVRASQLIPKPAHLSWEEAACNPLCAGTAYRMLVGDRGARFKQGDVVLIWGAAGGLGAYAVQLVKNGGGIPVGVVSSPAKAEAARRLGCDVVIDRQDIGLDDRTADDPRAVIEVGKRLGTAIRKRVGEDPHIVFEHVGRATFAVSVFVVRRGGTVVTCGSSTGYQHGYDNRYLWMKLKRIIGSHAANLQEQWECNRLVSLGRIVPTLSAVYPLEEIGEAARSVQTNQHIGKVGVLCLASGPGQGVTDPERRADLGEERLNPLRGLTPTRQAG

SEQ ID NO: 10428 - protein, 167 aa, Streptomyces avermitilis
MSVSEKEAETSAEQEFTRPPAPEKMRDLDFLLGDFRAEWTNFTADPATTGTAAWNTASTFHGHAYEMTQRVEAHDLTGRFVVQWVESESSFSGYYYDDWGNRTLLTSEGWQDGYLAFTGECFGFGKSFLLKEQYEIVDEKHYVKRGFIKFDEGDWIPADEVHCHREA

SEQ ID NO: 10429 - protein, 3970 aa, Streptomyces avermitilis
MAADLRQAHRRIKKLEADDTEPIAIVGMACRLPGGVGSPDQLWDLVRRGEDAVTGMPTDRGWELGELYDPDPDHPGTSYATEGGFLRGATEFDAEFFGVSPREALAMDPQQRLLLETAWEALENTGLDPRSLAGSRTGVFTGLMYHDYASGPGALPDEVEGYLSTGMAASVASGRISYFLGLEGPAVTLDTACSSSLVALHLAVQALRDEECDLALAGGATIMSTPATFVENSRQRGLARDGRCKSFAAAADGVGWGEGSALLVVERLSDARRRGHQVLAIVRGSAVNQDGASNGLTSPNGPSQQRVIQQALASARLGVADVDVVEAHGTGTTLGDPIEAQALLATYGRERSAEQPLWLGSVKSNIGHTQAAAGAAGIIKMVQAMRHEQLPRTLHVDRPTPEVDWSEGAVELLTENRPWPRGDRPRRAGVSSFGISGTNVHVILEEPAPADLDADGPAGASGSAGADGPAGADGSVTSIASGTSDTSGASIASGASVAGAQVVPVVLSAATPAALPAQAARLHAHLLDHPDLPLDDVACALATTRTAFEHRAVLLAGDRAELLDSLAELGRGGSPAGLVSGLAGEVRGAFLFTGQGAQRPGMGRELYEAFPAYARALDAVCAELDARLDRPLLPLLLAAPDSEEARLLDRTLYTQSATFALGVALFRLLEEWGVRPRLLSGHSVGELTAAHVSGMLSLADASELVTARGRLMQELPEGGAMVSVAATWDEVLPLLAGHESVAGVAAVNGPGSVVVSGDEDVVTAVAAHFTGLGRRTRRLPVSHAFHSPLMDPVVDPLRQVAARLTFGPPAIPVVSSVTGTLLEPAAWADPAYWARQAREPVRFHDVVRALDAEGVTVFLELGADAALTSMAEETLASMAEETLAETGTAGAVVAPALRRNRPEVRTLTALLAQAHTAGVPVDWAAFFAGRAGRRVPLPTYAFQGTRYWLRGVPGAGDMAAAGLAPAEHPLLGAVLVPAAGGGRLFTGRLSTDSLPWLADHAIGDTVLLPGTAVAELALWAGTYLGLDSVGDLTLELPLVLPSSGGLRVQLAVGAPDESGEREFALYAQAEESAEEVWTRHAGGTLTTARTRPGDELTAWPPAGAEELDVDGFYADLADAGFQYGPAFQGLRAVWRRGEEVYVEVRLPDEVATGAGEFGLHPALADAALHASAFVPGEFGREQRGRLPFAWRGVALHAAGASFLRVRLTPTGADSLSLFFADAAGEAVATVDSLVVRPAGRIAAPDGASDALFVPSWAPVGAAEPEGRWAVLGSGPLTGLAGAERHPGLAGLGAALDAGAGMPEFVVATAGPSEGSGGADAADDLAGQERDLAGQAHDLAGRALDLVRSWLADERFADSRLVAVTWNAVAVGEGDPLDPVQAAAWGLLSSAVTEHPGRIVLVDVDGTPRSLAAVRSAAGSDEPRVALRDGRAFAPRLTRAVADDAVAGDAVPREIDPHGTALITGGTGTLGALLARHLVTRHGVTSLLLTSRRGPHAPGATELVAELTAAGAHVTVTACDTTDPEQLATLLTTIPTEHPLTTVIHTAGTLDDATTTKLTDTQLHTVLQPKIDAATHLHHLTLHHPVTTFVLYSSAAGQLGTAGQANYAAANTYLDALAHHRRTHGHPATSLAWGFWNQRSDMTAEVDEQTRRRMAGAGVLPISEEQGAALFDAALALDAPVAVPLPLDLGALRAQAAVGTLPPLFRGLVRAPVRRAAGAVDGAGAQGAFAARLRALPRADQIRLLVDLVRTHAATALGHPTPDGLDARRTFRELGFDSLAAIELRNGVGAATGLRLPATLVFDHPTPSAVAEVLLGELTGGQEASPAPRASAAVEPGEPIAIVGMACRYPGGVASPEELWELVAAGRDAIGDMPEDRGWNVEELYDPELARPGTSYVREGGFLYDAAEFDPEFFGISPREALAMDPQQRLLLETSWEALERAGIDPRAVRGSRTGVFAGVMYHDYGADQAVLPEEVEGFIGTGSAGSVASGRIAFTLGLEGPAVTLDTACSSSLVALHLAAQALRTGECDLALAGGVTVMSTPGVFVELSRQGGLSPDGRCRSFAESADGTGWGEGAGLLLVERLSDARRNGHPVLAVVRGTAVNQDGASNGLTAPNGPAQQRVIEQALANARLGGADVDVVEAHGTGTTLGDPIEAQALLATYGRERSAEQPLWLGSVKSNLGHTQAAAGAAGIIKMIMAMRYGVLPRTLHVDRPSPEVDWSPGTVELLTEEREWPDAGRPRRAAVSSFGISGTNAHVILEQPPADDEPGTSGTVPGGVVPWVLSGHDRAALYAQAERLVAHVAARPELSVADVGRTLTGRARLSHRAVVLGGDRDELLAAAAGLARRAGEPDEALPPGVVEGSVLGDDRVVFVFPGQGAQWAGMAAELLVSAPVFRARIEECEEALRPYVDWSLLAVLRQEPGTPPWDRVDVVQPALWAVMVSLAALWRSYGVEPDAVLGHSQGEIAAACVCGALDLADGARVVALRARAIGSTLAGRGGMVSVALPSAAARELIAGWPGRVSVASVNGPVSTVVAGDPDALDELLARCADDGVRARRIPVDYASHTSQVAEIEGDLAAELAGLTPRSSAIPFFSTLTGAPLDTAKLDAGYWYQNLRHTVEFEAATRAALDQGFTVFAEISPHPVLVPSVQDTIDDTGRTAVAVGSLRRDDGGARRFFTSAAELGVLGVGVDWPAVFDGTGARQVDLPTYAFRRRRFWLESRRGAGDLSATGLEAAGHPLLGAAVSLAGGEGVLLTGRLSGRSHPWLLDHAVSGTVLLPGTAFVDLAIRAGDHLGRPHLEELTLQAPLLLGSGPKDEVTVQVRATPDGETGTCTVTVHSRTGEDDWTLHATGTLGLDAPEEPAPDPAWPPAGAEPVDTEGVYDGLAEGGYHYGPAFQGLRAVWRRDGELFAEIRLPDGEREEAAHYGVHPALLDAALHAMVLAGDQEAGVKLPFSWTGVHLYATGATAARVRLTPSGDQLALLLTDETGRPVVSVRSLVTRPAALAAPGRSTGGALEEALLHLHWTPLTVTVDEPAPSYALVGADLFGLAGDRAGVRVGADLDELGAADGPVPDIVVHCLAPGAPGDPAAAAHTAAQETLDRVRAWLADERFGSARLVFVSSGAVAAGDDEDVTDLGNAASWGLVTSAVSEHPDRFALVDLDGTAESREVFAAALGCAEPRLAIRGGTVTAPRLARAQAHPALLPPPGPTPWRLESTGRGTIENVALVPCPEVLDPLGPGQVRIAVHAVGLNFRDVVVALGMVEGQNGIGGDVAGTVLETGAGVGNVAVGDRVLGLCSDSFGPVAVCDHRFLAPMPDGWSYEQAAAVPITHLTAYYGLVDLADVQPGDSVLVHAAAGGVGIAAVQLARHLGAEVYGTASPGKWRTLRDHGLDAGHIANSRTLEFEQWFMEGSSGCGMDVVLDCLAGEFVDAGLRLLPRGGRFLEMGKTDKRDPARVAAAYPGVAYQAYDLMEAGPDRIQEMLVAVLELYRAGVLVPPPVTTYDLRRAREAMRDLSQAKLVGKAVLTVPRGIDPHGTALITGGTGTLGALLARHLVTRHGVTSLLLTSRRGPHAPGATELVAELTAAGAHVTVTACDTTDPEQLATLLTTIPTEHPLTTVIHTAGTLDDATTTTLTDTQLHTVLQPKIDAATHLHHLTLHHPVTTFVLYSSAAGQLGTAGQANYAAANTYLDALAHHRRTHGHPATSLAWGFWNQRSDMTGHLGDAEVERMERAGMRPLDNEEGLALFDLACGADVPLQVITRLTASALRADPDSVPPLFRGLVQGTSRRVVRSGGDGAELRTRLTGLPPAEQLRRLLDLVRSNAATVLGHASAGAIAAEQSFSELGFDSLTAVEFRNRLGAATGLRLPATLVFEHPTPAALAGELLTQLAPAGLSGAEAALSQVDALEAALAAVTADDGDRDRVTRRLRGLLAQWSTGDAEPAAADALDDLDAASTDDLFDAIDQGFGL

SEQ ID NO: 10430 - protein, 1907 aa, Streptomyces avermitilis
MSDEEKFRDYLKRAVTEARGLQRRLREVEDKAREPIAIVGMACRFPGGAQTPEDLWHMVSEGVDAISGFPDDRGWDLDRLYRTDAEESGASTTLEGGFLHGAGEFDADFFGISPREAIATDPQQRLLLETSWEALERAGVDPRSLRGSVTGVYFGGTGGDFAGLLAASPQALDGYMLTGTSSSVLSGRVSYVLGLEGPAVTVDTACSSSLVSMHLAVQALRKDEISLALAGGVSVLATPGAFPEFSRQGGLASDGRCKAFSSDADGTGWGEGVGVLVLERLSDARRAGHPVLAVVRETGINQDGASNGLTAPSGPAQRRLILRTLDDAGLATADIDVVEAHGTGTKLGDPIEARALLATYGQDRPADRPLWLGSIKSNIGHTQYAAGVSGVIKTVMALRHGVMPKTLHVDEPTPHVDWSSGAVRLLTENRPWPGHGRPRRAAVSSFGVSGTNAHLILEQAPEAAGATDSATDSETESESQSKSEEHGAVVTPPLIPWAISGRGEAALRAQAQRLLDRLSERPDLEPLDVGLALARTRSAFEQRAVVLGADRTELVAGLRSVAEGAAVGAGVVAGRAAESGVVFVFPGQGSQWVGMGRELWDASPVFRARMEECGQALSPYVDWSLRDVVFRDAGDPLWSRVDVVQPVLWAVMVSLAAVWRSFGVEPAAVVGHSQGEVAAACVAGGLSLEDGARVVAVRSRLVLEKLSGKGGMVSVALPVGDVEERLARFEGRIGVAAVNGPTSVVVSGEPDALDELLAECEESGVRARRIAVDYASHSAQVDALNDDLLAELADIRPKSSTVAFHSTVTGEQVDTSGLDARYWLRNMRETVAFEAAVRATLDEGHRNLLEISPHPVVTMAVQEVIDAAGVMAQVSGSVRRDEGGLGRLLTSLAEAYVAGAPVDWARVFDGTGARPVDLPTYAFQRQRYWLRLPSAGSGDVTSVGLRSPGHPLLGAAVEPAESDGLVLTGRVSLREHPWLADHRVMGTVPLPGTAFVELAATAGDLVECPHIEELTMQAPLTLPETGGLDLQLTVSAPDETGRREIGFFARADDEIAAAAWTRHGTGVLCPAGPVPEAAPAVWPPRGAEPVELGDLYGQLADGPFAYGPAFHGLRAAWTRDRKVFAEVRLPQELHEQAGEYLLHPALLDAALHAVGLGELLDTGGQPLRPFAWNGVSVHATGATALRVTLTPAGANAVSLYAADGTGAPVVTVGSLLLRPVDVTEPGARPPAAAHSSLLSLTWTPVPLPAVGAVPWAVLGDRPSWAGPDSGAVCHADLDALAASVAAGDPVPGFVVLDPAAGGRDDDGHPAVARERAARVLESARAWVSEDLDERLAPVPLVVVTRDAVGTSADDPVTGLGSAPLWGLVRSVQSENPGRFVLLDTDGDPESGRSVPGAVASGEPEIALRGGSALVPRLSRMAVTELPDPTPGTRPGTGGTGLDDVPGTGLDVPGTGLDALDPSRTVLVTGATGGLGTLVAGHLAERHGVRHLLLLSRRGPEAEGAEELVGRLEKLGATVTLVACDAADREALAAVLAGIPAAHPLTAVVHCAGTAENALLAALTPELIDRVFRAKVDAAVHLHELTEGLDLSAFVLFSSIAGTLGGTGQGNYAAANTFLDALARHRRGRGLPATSLGWGLWAAERGMGGGLTDAASAGTPMRGVSALPSDEGLALFDLGWRCAEPVVFPARLNGAALRAQAAAGSLPPVLRGLFRGPARRTAEAGGQDSGAQLRRRLAELMPVERQETLLALVRDRIAAVLGHASSDRIETDRPFRDLGFTSLTAVELRNRLNAATGLRLPVSLVFDYPTLGELVELLAGKLVPDGTEPAARPEDDREAAVRRTLLSIPLARLREHGLLDTLLALADDGGAQPEAADRSDEIKSMDVAALLAMARSTTASSTASTTAQ

SEQ ID NO: 10431 - protein, 404 aa, Streptomyces avermitilis
MAEAPSEPIAFPFPDPPSVCELPPELAEIRDGQSVVEVKFPDGISGWMVTKHADVRKVLVDSRFSSKVMATAAAAMSETETGKLMNESLVGMDAPEHTRLRKLVTKAFTARRVETLRPRITELVGQLLDELETLPRPVDLVKNFSVPLPVRVICELLGVPAGDQDTFHAWSNALLGDWQQVVEKEAATVSLVNYFGELIAVKRENPADDLISELIAISDGDSTLTEREIIALSIGILSAGHETTANQISMFLVTLLHNPEELDKLRDNREAIPKAVDELLRFVPLTTTGGIIPRLTTAEVELSGGQVLPAGAVVLPAVATANRDPEVFEDGERLNVTRENNPHLAFGAGIHHCLGAQLARIELQEALGAILDRMPQVRLAVPESELRLKSASIIRGLESLPITW

SEQ ID NO: 10432 - protein, 3613 aa, Streptomyces avermitilis
MTEDKLRTYLRRVTAELQQTRQQLQDSQDRAREPLAVVGMACRLPGGVDSPEQLWQMVMDGADGVSGFPDDRGWDLSSLFDSDPDRPGTTYTREGAFLRGAGDFDAGFFGISPREALTMDPQQRLLLETSWEALERAGIDPHTLRGSRTGVFVGGTAIEHTVKLMNSPTDQGYAITGGSASVMSGRVSYVLGLEGPALTVDTACSSSLVALHSAAQSLRQGDCSLALAGGVAVMATSSAFVTFARQRGLAADGRCKAFSDDADGIGWGEGAAVVLLERLADARRNGHPVLAVIRGSAVNQDGASNGLSAPNGPSQQRVIRQAVANAGLALADVDMVEAHGTGTSLGDPIEAQALLATYGQDRHDGRPLWLGSLKSNIAHTQAVSGVAGVIKTVLALRNGVLPKTLHVGKPSTQVDWSAGAVELLTEGREWPETGGPRRAGVSSFGISGTNAHVILEQAPEEDSAEPQPVDAPEPPLTTSPATVPWLISGQTEAALRAQAGRLQAHLDAHPGLGTADVAHSLLASRSKLAHRAVLFAGQGARSGDRPTGLTALADGLDVPGLVRGTGDAGTGVVFVFPGQGSQWVGMGRDLWDASPVFRARMEECGQALSPYVDWSLRNVVFRDAGDPLWSRVDVVQPVLWAVMVSLAAVWRSFGVEPAAVVGHSQGEVAAACVAGGLSLEDGARVVAVRSRLVLEKLSGKGGMVSVALPVEGVEERLARFEGRIGVAAVNGPGSAVVSGEPDALDELLAECEESGVRARRIAVDYASHSAQVDALNDDLLAELADIRPKSSAVAFYSTVTGERLDTSGLDARYWVTNLRERVRFEPVVRLLAEQEYQVFVESSPHPVLTVAIQETQEGVFGTGTAVGSLRRDEGGADRFLTSLAEAYVAGAPVDWSVLFAGMPVRRVDLPTYAFQHERYWIEDVVAPGADGVVDPVDAAFWGAVENADLQGMAALVDGAEPEVWEPVVPALSAWRRGRQERSVLDSWRYRTVWRSVTVPSVGRLSGTWLVVTPGGAGPVEEVRRALEAAGAEVVVLAWEAEEGREALAGRLTGAGEVSGVVSLLGWDEEAAPVATVTLVQALADAGVEAPLWVLTQGAASVGAEDVVHPVQTQVWALGQVAGLEQPGSWGGLVDVPGVWDERVASGLTAVLAAGEGEDQVAVRSSGAYARRLVRAPLGANPAPVRDWNPHGTVLITGGTGGIGAHLARWLAKEGAERLLLVSRSGEQAEGAAELATELGGLGAEVTFAACDVSDRDALGHVIAGIPAEHPLTAVFHTAGVSGYAELATATPEHYETVLSAKTRGARNLDALTAELTLEAFVLFSSGAAVWGSAGTGAYAAANAYLDGLAWNRRARGLVATSVSWGGWKATGMAADGTEEQLARRGVRAMEPALAIKALRQALEQDETALTVTDMDWARFTPGYTIARRRPLIEDIPEVARALSEDSEPAPDDGTDSALRQTLAGLTAPEQHDRLLELVRSEAATVLTHRTTDDITAGRPFRDLGFDSLTAMELRNRLNTATGLRLPATLVFDHPTPQRLAGHLHEKLFDSATETALPVLRTTDDDPIVIVGMACRFPGGVRGPEDLWRLLVDSRDEMTDFPADRGWHGLAMNAFIEESGGARQGAFLAEAGDFDAAFFGISPREALAMDPQQRLLLETSWEALERAGFDPVGLRGSRTGVFVGGTPQEYTTVLMNSSEAGGGYALTGASGSVMSGRVAYALGLEGPAVTVDTACSSSLVSLHLAGQALRGGECDLALVGGVTVMATPGAFVEFSRQGGLAGDGRCKAFAAGADGTGWGEGVGMLAVQRLSDAVRDGRPVLAVVRGSAVNSDGASNGLTAPNGPSQQRVIRQALASAGLSAADVDMVEAHGTGTSLGDPIEAQALLATYGQDRPADRPLWLGSVKSNIGHTQYAAGVAGVIKSVLALRNGLLPKTLHVDEPTPEVDWSAGAVELLTEGREWPETDGPRRAGVSSFGISGTNAHVILEQAPSVEERTPVSAVDGLLVPWVVSARSEEALRAQARRLADHVRGSDLRPADVGLSLAVTRAGLEHRAVLTGRDREDFLVQLAALAEGAGAAGMVRGVAGEGGTAFLFTGQGAQRLGMGRELYERFPVFAAAFDGVCAQLDLLLERPVKEVVFTDAPALDRTVFTQAGLFALEVALFELVGSWGVRADVLLGHSIGELAAAYVAGVWSLADACRIVAARGRLMQALPEGGAMVAVEAAEDELPVLPGGVSVAAVNGPRSLVLSGDEEPVTALAQAFAEQGRRTKQLAVSHAFHSARMEPMLAEFAETLAAVEFRPPRIPVVSNVTGGMADAEFTTPAYWVRHVREAVRFADGVATVLARGVDRFLELGPRGALTAMAEETLDHTGADAVCVPVLHPERPEADCLTLALGRIHASGAPVDWSGLFAGTGARTVGLPTYAFQHKRYWLDSRTTGSGDPASIGLTATGHPLLGAGVALPDSDGFLFTGRLSLATQPWITDHAMLGTALLPGTAFVELALRAGGQVGCELIEELTLEAPLVLGEQGGRAVQVLVGGLDETGRRAITLHSRPDGEGDDQPWLRHASGVLAENTGAEPDAEPMTVWPPDGSTAVAVEDFYPDMAEAGFTYGPVFQGLRALWTKDGDLYAEVRLPEEAGDADSGFGVHPALLDAALQPLALGVLGGTPDREAVKGGMPFAWTGVRLHATHATVARVHLAPVGRGEVSVLVNDESGLPIATVGSLTMRDPALEQFTASAPRQDALFDLKWTPVPLGSREVSGEWAMLGFDPLEIRPRLVEAGLTGTPYLDPQSLIDTVESGKPAPSVVAMSCFGGDQGGIVAATHDAVHRVLEVIQHWLADERLTGSKLLLLTRGAVPAAGTDRTEDVAASAVWGLVRTAQSEHPDRIVLIDLDDDPASYRALPKALGTGEPQLALRAGSPCVPRLARHTGPADGAPGFGPDGTVLVTGGTGALGAVVARHLVTAHGVRHLVLAGRRGERAPGAAALLAELTELGADTRILACDVSDRDALAVLLRDIPADRPLTAVVHTAGVLADGTVESLTPDRFDTVLRAKADAAWHLHELTQDAPLREFVLFSSAAGLLGSQGQGNYAAANSFLDALAAHRREAGLPGTALAWGWWEQPGGMGGDLGRAERARMARGGVTPFTAESGMEAFDRALGAGQEALLVPMRLNTTAARAASEQQVPPLLRGLVRAPQRRAARSDVRATSHLHEQLAAADQAERQALLAELIRGEVAQVLGHSGAEAIEDGHGFVELGFDSLTSVELRNRLNERTGLRLASTVVFDHPTPLALAAELSEQLGTPAAPMAAAPAAGQAAAGPAEDTGSGRGADALGDLAVINGVEALYRRSNELGRLDLGHSVLRNSVDLRVSFSDPQEVKGGPSLVRLGEGAQYPKIIGFPSQSVWASNQELVSMATPLRGTRDVWSLMLPGFVTGQPVAADVDAAAEYALRLIEELVDGEPFVLAGRSSGGRIAHEVTSRLEDRGLAPRGLVLIDSYMAGYDATSYIVPVMESKAVELEKDFGQMTGTRLTAMAAYFGMFEHWQPKEIATPTLLVRASECYGIEPGEVQPPAEQWQAAWPLPHEAIDVPGNHYTMLEGNGDVTAAAVHEWLTRHEA

SEQ ID NO: 10433 - protein, 4685 aa, Streptomyces avermitilis
MNSSMSEVVDALRASLLENERLRQQNQRLTTASAEPLAIVGIGCRYPGGVRDTEDLWRLITEGRDAMSGFPTDRGWDRWDIPTARTGAFLHDAGDFDPAFFRISPREAMAMDPQQRLLLETSWEALERAGIDPATLKGSRTGVFIGGAPQEYGALVMNSAEGAGGYALTGAPGSVLSGRISYVLGLEGPAVTVDTACSSSLVALHLAVKSLRTGECDLALAGGVLVLVTPSIFAEFSATGGSAGDGRCKAFAASADGTGWGEGAGVLAVQRLTDARRDGHPVLAVIRGSAVNQDGASNGLSAPNGPSQQRVIRQALANAGLSAADVDMVEAHGTGTTLGDPIEAEALLATYGQDRPADRPLWLGTLKSNIGHTQAAAGVSGVIKAVLSLQHGLLPKTLHVDEPTPQVDWSAGAVELLTQAREWPETDGPRRAGVSSFGISGTNAHVILEQAPEPEGAEVPESAEAPGAEGRPALSGPVPWLVSGRTEAALRAQAARLAEHLAGRPEATPLDVGFSLARTRSAFEQRAVVVSADRDELIAGLRSVADSGDGAGVAGVVAGRATADSGVVFVFPGQGSQWVGMAAELLDSAPVFRARMEECGEALAPHVDWSLLAVVRQEEGTPSWSRVDVVQPVLWAVMVSLAAVWRSFGVEPAAVVGHSQGEVAAACVAGGLSLEDGARVVAVRSRLVLEKLSGKGGMVSVALPVGEVEERLARFEGRIGVAAVNGPGSVVVSGEPDALDELLAECEESGVRARRIAVDYASHSAQVDALNEDLLRELADIQPRSSSVAFYSTVTGERLDTSGLDARYWVTNLRERVRFEPVVRLLAEKGSSVFVESSPHPVLTMAVAETGEVADRAVVTVGSLRRDDGGADRFLTSLAEAYVAGAPVDWSVLFAGMPVRRVDLPTYAFQHQRYWLDDVALPGQSGFSDDPADAAFWGAVERADVQGVAALVDGAEPEVWEPVLSALSAWRRGRQERSVLDSWRYRTVWRSVTVPSVGRLSGTWLVVTPGGAGPVEEVRRALEAVGAEAVVLAWEAEEGREALAGRLTGAGEVSGVVSLLGWDEEAAPVATVTLVQALADAGVEAPLWVLTQGAASVGAEDVVHPVQTQVWALGQVAGLEQPGSWGGLVDVPGVWDERVASGLTAVLAAGEGEDQVAVRSSGAYARRLVRAPLGANPAPVRDWNPHGTVLITGGTGGIGAHLARWLAKEGAERLLLVSRSGEQAEGAAELATELGGLGAEVTFAACDVSDRDALAHVIAGIPAEHPLTAVFHTAGISGYAELATATPEHFTDVLSARVLGARHLDELTAELGVELEAFVVFSSGAAVWGSGSNGANAAAGGYLDGLVRRRRARGVAGTSVSWGGWQATAMAVGDTAEQLSRRGVRLLDPVLAVQALRQVLEQDEVSVTVTDMDWALFTPGYAMARRRPLIEDIPEAGEALSGAAGAGETLDSAGVGLRERLAAMTETERQATLLGLVRGEAAQVLAHGSTAEITPTRPFKELGFDSLTAMDLRNRLSKATGLRLPATLVFDYPNPEQLAALLRTELVDGLPGTAGPAAPAVRPVDDEPLAIVGMACRYPGGVRDADDLWRLIVEGRDELSDFPTDRGWDRWGAPAVGQAGFLHEAGEFDAAFFGISPREAASMDPQQRLLLETSWEAVEQAGIDPWSLRGSSTGVFVGGGPQDYPAVLMGSAEAGGGYGMTGALGSVMSGRVSYVLGLEGPAVTVDTACSSSLVALHLAAQSLNNGECELALAGGVTIMATPGAFAEFDTLGGMAGDGRCKAFAASADGTGWGEGVGMVVVERLSDARRNGHEVLAVIRGSAINQDGASNGLSAPNGPSQQRVIRQALANAGLSAADVDMVEAHGTGTTLGDPIEAQALLATYGQDRPADRPLWLGSVKSNFGHTGAAAGVAGVIKAVLALRNGLLPKTLHVDEPTPQVDWSAGAVELLTQAREWPDAERPRRAGVSSFGISGTNAHVILEQAPEPEGAEVPGSAEAPGAEGRPALSGPVPWLVSGRTEAALRAQAARLAEHLAGRPEAAPLDVGFSLATTRANLEHRAVVLGSTSEELTRGLNAVAEAAISPAVIRGNGTDTGVVFVFPGQGSQWVGMGRDLWDVSPVFAESMVACERALSPLVDWSLRDVVFRDAGDPLWSRVDVVQPVLWAVMVSLAAVWRSFGVEPAAVVGHSQGEVAAACVAGGLSLEDGARVVAVRSRLVLEKLSGKGGMVSVALPVEGVEERLARFEGRIGVAAVNGPTSVVVSGEPEALDELLAECEGSGVRARRIAVDYASHSAQVDALNDDLLAELAGIRPKSSTVAFYSTVTGGRLDTSGLDARYWVTNLRERVRFEPVVRLLADQAHGLFVEASPHPVLNMAVAETGEVADRAVVTVGSLRRDDGGADRLLTSLAEAHVAGAPVDWSVLFAGTGTRRIGLPTYAFQHQRYWLEDAAAPGTDGVVDPVDAAFWGAVERADVQGVAALVDGADPEAWEPVLSALSAWRKGRQERSVLDSWRYRTVWRSVTVPSAGRLSGTWLVVAPGEGAPAERIEEALVGAGAEVVVLAWETEEGREALAGRLAEAGELSGVVSLLGWDEKAAPAATVTLVQGLADAGVEAPLWVLTHGAASVGSGDVIRPVQTQVWALGQIVGLEQPGSWGGLVDVPEVWDERVASGFAGVLAAGEGEDQVAVRSSGAYARRLVRAPLGANPAPVRDWNPHGTVLITGGTGGIGAHLARWLAKEGAERLLLVSRSGERAEGAAELAAELGGLGAEVTFAACDVTDRDALAHVIAEHPPTAVFHTAGVASYGTVRELDLADLDAQMAAKTLGARHLDELTTERGLELDAFVVFSSGAAIWGSAGNGGYAAANAYLDGLAWDRRARGLAATSVSWGGWKATGMATDDTAEQLARRGVRPMDPARAVEALRQALEQDETALTVTDMDWERFTPGYTMARRRPLIEDIPEVARVLSEDSADVLGDDSAGSALRTELAALGQAEQLDLLLDLVRGEAARILAHSSTAEITPERPFKELGFDSLTAMELRNLLNTATGLRLPATLVFDYPNPRQLAAHLRTELIGAGPDLVPAADVVRADADEPLAIVGMACRYSGGVSSPEDLWQVVVENKDGMSDFPSYRGWDRWNLASLRRAGFLHEAGDFDAGFFGISPREAMAMDPQQRLLLEASWEAVERTGIDPHSLRGSDTGVFVGGTAVEYGALLMNSPASQGYAVTGSSGSVMSGRISYTLGLEGPAVTVDTACSSSLVALHLAAQALRGGECSLALTGGVGLMATPGAFAEFDTLGGLSVDGRTKAFAAAADGIGWGEGVGMVVVERLSDARRNGHEVLAVIRGSAINQDGASNGLSAPNGPSQQRVIRQAVANAGLALADVDMVEAHGTGTTLGDPIEAQALLATYGQERPADRPLWLGSVKSNIGHTGAAAGVAGVIKSVLALRNGLLPKTLNVDEPTPKVDWSAGAVELLTQAREWPQGERPRRAGVSSFGISGTNAHVIIEEAPAAEETPAAPDEAAPAAPALVTPVVPWVFSGRSSGALCGQAGRLGGLVEREPGLDVTDVAFSLATTRANLEHRAVVLGGDAAGLLDRLRSVAAREPDAGVVSGTTAAGGRVVFVFPGQGSQWVGMGRDLWDVSPVFAESMVACERALSPLVDWSLRDVVFRDAGDPLWSRVDVVQPVLWAVMVSLAAVWRSFGVDPAAVVGHSQGEVAAACVAGGLSLEDGARVVAVRSRLVLEKLSGKGGMVSVALPVEGVEERLARFEGRIGVAAVNGPTSVVVSGEPDALDELLAECEESGVRARRIAVDYASHSAQVDALNDDLLAELADIRPKSSTVAFYSTVTGDRLDTSGLDARYWVTNLRERVRFEPVVRLLAEKGSSVFVESSPHPVLTMAVAETGEVADRAVVTVGSLRRDDGGADRLLTSLAEAYVAGAPVDWSVLFAGTGARRVDLPTYAFQHQRYWLEGVSVGGEIQEASADAMDAAFWDAVEREDLADLTEVLDTSGGTGPDPAAAAEAWLPALSAWRKGRRKQTTLDSWRYRTEWRTNDRPLSARLSGTWLVVAPSDGAPTERMERTLAGAGAEVVVLAIEAGTDRAELAERLAGTPEAAGVVSLLAWDEHTAVASTLTLIQAHGDIESAAPLWVVTRGAASVDSGDEIRPVQTQVWALGQIVGLEQPGSWGGLVDVPEVWDERVASQVAGVLAAGEGEDQVAVRSSGAYARRLVRAPLGANPAPVRDWNPHGTVLITGGTGGIGAHLARWLAKEGAERLLLVSRSGERAEGAAELAAELGGLGAEVTFAACDVTDRDALAHVIAGIPAEHPLTAVFHTAGVAGHGPLADLDVTDLDTQTAARIAGARHLDELTAELGVELEAFVVFSSGAAVWGSGSNGANAAAGGYLDGLVRLRRARGVAGTSVSWGGWQATAMAVGDTAEQLSRRGVRLLDPVLAVQALRQALEQDEVSVTVTDMDWALFTPGYAMARRRPLIEDIPEAAQVLRDAEEIEDGPEDGAAGADLRKRLAGLTDPERQATLLGLVRGEAAQVLAHGSTAEITPTRPFKELGFDSLTAMDLRNRLSKATGLRLPATLVFDHPNPQRIAEHLRAGLAQDGQQGIADVLDIRRELTRIGEALNSVAPDARAREDIVDHLRDLITQLGTGTGAAEQDTTDLEAATDDEIFDFIDRDLGVS

SEQ ID NO: 10434 - protein, 3939 aa, Streptomyces avermitilis
MANEQQLRDYLKRVSADLHRTRQRLTEIESQGTEPIAIVGMACRYPGGVSSPEDLWRLVTDETDAIGPFPTDRGWDLDGLHHPDPDHPGTCYAEAGGFVEDIASFDAAFFGISPREAQSMDPQQRLLLETSWEALEHAGLDIHALRGSRTGVFAGLNQQDYGTLLAAAPDGLDSYGSTGTSNSVLSGRISYVLGLEGPAVTVDTACSSSLVTLHLAAQALRSGECDLALAGGATTLSTSAVHVALSGQRALAPDGRSKAFSAAADGAGWSEGVGVLAVERLSDARRLGHRVLAVLRGSAVNQDGASNGLTAPNGPSQQRVIRQALANAGVSPAEVDVVEAHGTGTSLGDPIEADALLATYGQAKTAGRPLWLGSLKSNIGHSGAAAGVGGVIKMVQALRHGLLPRTLHAEEPTPNVDWSSGAVELLTEARPWPASDTPRLAAVSSFGISGTNAHVILEQAPEETPEEAPEETPGEAPGATAPPLLPWVLSARGEPALRAQARALREHLLARPGASDADVALSLAVTRTGLEHRAAVLAADRDGFLDALDALATDRPAEGVLRGSPPVDGKVVFVFPGQGSQWAGMARELLDTSPVFAAKAAACAAAIEEFVDWKVLDVLREKPGAASMERIEVIQPVLFTVMVSLAELWRSYGVEPDAVVGSSQGEIAAAHVAGGLTLQDAARVICLRSALLAETLVGKGAVASVALPADEVRERLTRWADRLSVAGVNGPRIVAVAGDDDALAEFIAECARDNVRARIVAATVPTHCALVDPLRERLLDLLAPVAPRTGTVPLYSTVTGGRLDTAAMDAGYWYDNTRAPVLFEPVVRALLAEGHSAFVESSAHPVLAMGVEQTVDAAGASGVVVESLRRDEGGLGRMTASLAKAHLGGVRVDWPAVFAGTGARTVELPTYAFQRTRYWTEAGDRTGDVGSVGLSSVDHPLLGALVRMADGDGAVLTGRLSLRAQTWLAGHGVSDRVIFPGTGFVELAVLAGDQVGCGRIEELTLHTPLVVPESGAVVVQAQVEAADETGARAVSVYSRADDASADTVWTRHASGVLVAEPGEEPEGITGTWPPEGAEAVDISGMYDRMAAAGYQYGPEFRGLSRVWHRDGEVYAEVALPADQRSAAERFGLHPALFDAALHAMFTWGDDDGGVGMPFSWTGVRLHATGCSRLRVRLSRRGENGITLLLADEAGAPVVSVDTLVVRRMTEAALSTVRADALYRLDWKTVRAEEPAPRCVVLGADPLGLCDALPGTPLAAGTEELAALVAADGAAVTALLPVAGDGSTDRVGEPVVDTVALLQEWIADGRLDDTRLVVVTRGAVAATAGEDVTDLAAAGVWGLLRSAQNEHPGRFGLLDLDTAAGSRAALGAALASGEEQLALREGQVRTPSLARWDPAGTILPPAGEPAWRLENTRPGTIEGLTAVPYPQALEPLGPRQVRIAVRAAGINFKDVVVALDLVPGLTGLGGEVAGVVTGTGAEVTHHRVGDRVFGLSTEVFGPVTVADERTVHRIPDGWTFEEAASVSVAYLTAYYGLVDLGGLRPGQSVLIHAAAGGVGSAAVQLARHLGAEVYGTASPGKWDTLRACGLDAAHLANSRTLDFEQWFLESTGGRGMDVVLDCLAGEFVDAGLRLLPRGGRFLEMGKTDKRDPAQVAEAYPGVAYQAYDLPEAGLDRIHAMLGILAELFESGVLAPPHLNTWDIRDTRAAFRALSQAALIGKAVLTLPGEPFPAHGTVLITGGTGMLGALLARHLVTEHGVGSLLLTSRRGPDAPGASELAAELTAAGAQVTVAACDIADRGQLAALLADIPAERPLTAVLHTAAALDDGLVESLTADRTRAVLRPKVTGALNLHELTKDLDLGAFVLFSSMAGTMGAPGQGNYAAANVMLDALAAHRRAHGRPGLSLAWGFWAQRSEMSGHLDDRDMRRLSRGGIVPMTSDEGLAVFDLACRTGSAQLVPAKLNPAALAGTSGRVPPIMRALVPTPARRAGRRPADTGGGSLRERLTPLTGTERMRILLQLVRSHVATVLGHSDPDAVGSTAPFRELGFDSLTAVEFRNRLTGAVGFRLPVTVVFDHPTPSELADFLAAELLGDLAEPAAPAAPVPAVARTDDEPLVIVGMACRYPGGITSPEQLWDLVIGERDAVSGFPEDRGWSTGAPADGSVPQQGGFLDRVAEFDAAFFGISPREALTMDPQQRLLLETSWEALERAGIAPGTLRGSRTGVFVGAATSGYTSLFPRGSQALAGYGVTGASTSVVSGRVSYVLGLEGPAVTVDTACSSSLVALHTAAQALRSGDCDLALAGGVAVMTSPFLFDDFAKQGGLSPDGRCKAFAAGADGTGWAEGVGVLAVERLSDARRLGHRVLAVLRGSAVNQDGASNGLTAPNGPSQQRVIRQALERSGLTAPDVDAVEAHGTGTTLGDPIEAQAILATYGRDRTEDRPLLLGSLKSNLGHSQAAAGVGGVIKMVQALHHGVLPRTLHIDEPTPHVDWTAGAVDLLTETRPWPETGRPRRAGVSSFGVSGTNAHVILEQAAEPDPAPAAATALPLTPWLLSGHDEQALRAQAKTLLTHLRQRTEDSVTDVAHSLATRRTALEHRAALPVTDRDDALTRLAEFAAGRTPDGLLLGTAGEGGLALLFPGQGAQRPGMGRELYETFPAFARAFDEVCAHIDPLLGRPLRETVFTAEAAELDRTALTQPALFALEVALFRLLASWGVVPDYLLGHSVGEIAAAHAAGALDLADAAGLVVARGRLMQALPPGGAMLAVQADEREATEALTAVLGEHADTVDIAAVNGPRSVVLSGAAASVDALTAHFTERGRRIRRLGVSHAFHSPLMEPMLDEFAELVAGLSFAPPRIPVVSNLTGAVLGADEFADPRYWVRHARHTVRFADGVDALVGAGVTGFLELGPDATLTTMAEDCLDTAPTGVCAALLRRDATEPTTLLTALARAHVHGVTVDWDAVFEGTGARRADLPTYAFQRTAYWPAESTADRGDLSSAGLDGTGHPLLGAMVGSASGGDTLFTGELSLAAQPWLADHRILDSVLFPGTGFLVLALWAGSRLDAGEVEELVVHSPLILPEHGGVTVQVVVGETTREESRPVAVYSRAASGTEWTKHAEGLLAAGPPPEQPATPPAVWPPDGAEPVRLEDFYADLTTTGTAYGPVFQGLTAAWRHSDGIYAEVALPPQTTDDAKAFGVHPALLDAALHTLAFLPSAARDSGPFLPFSWRNVSAPAPGATACRILLAAGPGTDEVAATLWDGDGQPLVSVGGLSLRTVSRAQLGTSVAASSLFRMDWTPAPEPEAAGHPAVRWAVVGPAVTDAPDIDPYPDLDALRRHLAEGGPAPDHVLFPCAPGTPTGFDADAARTAVHAALDTLRTWVEDEHFVKSRLVLCTRGAVEARPGEGVRDLAQSAVWGLARSAQLEHPDRLLLVDLDTDTGLADLTRAQALVQASGYGTDDSDDFDGTGDSGDTADAAQFAIRAGTTLVPRLARHPVDTPPQGRPWPADGTTLITGAGGMIGGLLARHLVQEHGVRHLVLAGRRGEAAPGTAELRRDLADAGADVRVVACDAADRDALAAVLDAIPQEAPLAAVVHAAGVVDDGLLGTLTGEQVDRVLRPKIDAAVNLHDLTAHLGLRAFVVCSSLAGALGGGGQSAYAAANAYLDALCRRRRADGLPALSLAWGPWESSAGMTAQLAAADLRRIARAGMLPLAPDDGLALFDAAHATGEPELLPFRFEPGGLSTADRAALPGALRALVPAPRRRTSGLAHGPSGLRDRLRPLPQDDRTTTLENLIRAEVASVLALPSADAVPVTKAFKSLGFDSLMAVDLRNRLSTLTGVRLSATLVFDHPNTRVLAAHLLTGMRLDTAGATDPALLALRGLESAVRSMNPDADDRGAMATRLRVLLATLEEAGDEEAADGSDLDSVSAEELVSLLDDEFGLS

SEQ ID NO: 10435 - protein, 4840 aa, Streptomyces avermitilis
VDDDKLVDYLKRVTADLKRTRQRVQELEAGAAEPIAVVSMGCRFPGGIASPEDLWECVRTGTDTISGFPTDRGWRTGHLRGDFRLAGGFLADAAGFDAGLFGISPREALAMDPQQRLLLETSWEVLERAGLDPTTVRGADGGVFVGMADQKYGPRDGELLDQVKGLVLTGTTSSVASGRIAYSLGLQGPAITIDTACSSSLVALHLAVRALRSGECSFALVGGAAVMAEPQLFAEMAEQGGMAGDGRCKAFAAAADGTGWGEGVGVLLLQPLSTAREQGLPVLATVRGTAVNQDGASNGLTAPNGPAQRRVIRKALADAQLSVGQVDAVEAHGTGTRLGDPIEAGALLATYGQDRAGDEPLWLGSVKSNIGHTQAAAGMAGVIKMVLAMRHGLLPRTLHVDEPTPQVDWSAGAVRLLTEEQTWPSTGRPRRSAVSSFGISGTNAHVVLEHDPAASGADGAPEPGPDTSPAAPVPWTLSAASEEALRAQARRLHRYADGDPGRRPLDIARSLARGRARLAHRAVVLGADRTELLTSLAALGAGEPDPRVVRGRTVPSGPVAFLFTGQGSQRAGIGRELYETFPVFARAFDEVRDRLDPQLAHPLDDILDGRVVDGLPLIEQTGYALAAVFALEVALFRLVEHAGVVPDFVLGHSTGELAAAHCAGVLSLDDACTLVAARGRFVQTLRTDGAMVAVETSETELAELIARADVGDRATIAVVNGPRSVVVSGDADAVERVRARCEERGRKTRKLPISHAAHSVHMEPMLARLREVAEGLEHRPPRIPMVSNLTGAPVPPEANWPEYWVRQVRETVRFHDGIRWLGAQGVTACLELGPGGALIAMARESLGDPGREVALVPTLQHDRPEPATFLSALAELHVHGVAVDWDTPLAARGATSTDLPTYAFQRERYWLPATPAAPRTAEPADRTGRVRYRVGWTPYPDVDTDARPTGTWLVVAPDGDSDGDGHGDGARVAEALGERAVLLTAGPGLAPALARLPEDRPVAGVLALPAESATRWTRLAPRSALRGRGARPASVRHQAPVSVDTEAVPGAAPALLWGLGRVPHSGGGVVDLPAGLDARSLRLLAAVLAAPGDQDELAVRPGGVFARKLLPAQRPRRQRAWRTGGTVLITGDIAGVTPELLQYLSGGGARTLLLAHRPGTPLPDAAVLAAAGGPCTVTEWDLGPLETASVTAVVHLSGIDPDGPSTPDALTAAGPARAVQDRLRTVVRLEELFHDADLDAFVLLSTVAGTWGGAEDLVHTVAHAALESLAERRTLDGRPGTCVGWGPWETPADTGASPVPGLLPLPADLAVSALAEALDADDPVCAVVDVDWSLFHPVLTGRGPRPLVADLPEVRALPAPPTAEVVLAPAADREHQLLELVRAQAAAVLGHASGAAIDPVRPFRDLGFESLAAVRFRDRVAAETGLRLPATLVFDHPTAQAVAAHLLAELSGVRQHEDEVAPTADHDDPIAIVGMACRYPGGVRGPEDLWDLVHCGRDGVGDFPTDRGWDLPALRRLAPDLAMKGGFLPDAADFDAAFFGISPREATAMDPQQRLLLEVSWQALEGAGLDPAALRGSRTGVFAGAAGSDYGVVLEGAPEADGYLTTGTAASVISGRIAYTLGLHGPAVTVDTACSSSLVALHMAVGALHQGECDLALATGVSVISTPGAFVDFARQSGLAADGRCKAFAASADGTNWAEGVGVLVVERLSDARRNGHRVLATVRGSAVNSDGASNGLSAPNGGAQQRVIRQALAAAGLSADDVDAVEAHGTGTTLGDPIEAQAVLATYGRDRPAGQPLWLGSLKSNIGHSGAAAGVGGVIKMVQALRHGVLPRTLHVDEPTPEVDWSAGTVGLLTENREWPHTGKPRRVGVSAFGVSGTNAHVVLEQGPEETPEEAPEEAPEETPGEAPGATAPPLLPWVLSARTPEALRAQAARLAARLAERELPAAAVGHALLTSRSDFEHRAVALGAGHGELTEALRAIAAGEPAGSTVTGVARRAAGRGPVFVFPGQGGQWPGMAAELLDTAPEFAARWAECERALAPYTGFSVTELVRSGTPLERVDVVQPVLFAVMVSLAALWRSYGVVPAAVAGHSQGEIAAACVAGALSLDDAARVVALRAQALRALVGEGGMVSVGIPLAEAERWLPRWDGQVSVAAVNGPSAVVFSGAPAALDDLVAHARDQDVRVRRIDVDYASHSAQVERIEDEIMTALGPVRPGPGQIPFFSTVTADWQDPTGLDAAYWYRNLREPVLLEPSVTALAEQGYDVFVEVSPHPVLGAALTETAELAGAEPVVTGTLRRDEGGLKRVRTALAELWTHGVPVDWTPAFPGRHGTPVELPAYPFQRTRYWPAARPAVAQDPQDERFWQAVDQQDLPTLAGTLGLADEQPLRELVPALSAWRRDRKERAAVESWRYRIEWRRLPEPERRTLPGTWLLVVPTGTGTTDEPLTGTGTTDEPVTGATTGGTADDPVTAAVTALLRERAEQLVVLAVDPGSDPTTLATALRGALGGTEPAGVVSLTGIDGSPHPERPVVPAGAALSLALLRALADARVTAPLWCLTHGAVTTDDDAGPVHPEQAAVWALGRVAALEFPGTWGGLVDLPDPLDDRTADRLAAVLAGLDGEDQVALRPSGVFGRRLVRATPRATAGTGWRPRGTVLVTGGTGALGRRVARWLAREGAEHLVLTSRRGPLAPGADALVTELTGLGVKVTLLSCDLADPAQVTAMVAEAQRDGDPIGAVVHTAGGGGLGPLAEAGPDDLAEAMAAKVTGIAHLEAALDPEQLDAVVYFSSISASWGAGDHGVYAAANGVLDARAEARSAAGVHTVSLAWAPWAGGGMADDPVFDTLSRKGLPLIDPDLAVSALAAVLAEGESSLLLVDVDWERFTPQFTFERPTRLLTELPEARPEPATDDTAPDTAASPLAQRLAALTGPQRTAALRDLVREQAAAVLGHADARSVDPARALKELGFDSLTAVELRNRLSTATGLRLPATMVFDHPTIAELADFLARGLTPEAAVPAEPATVVRVDQDDPIAIVAMACRYPGDVASAEDLWRAVRDEADLITPFPTDRGWPLGRLVDAADPDRPGTSYVGHGGFLHGAGDFDPGFFGISPREAQAMDPQHRLLLESSWEALERAGIAPRSLRGSRTGVYVGLTDQAYGTRLRGSTDGMEGYLVSASANVASGRISYSLGFQGPALTVDTACSSSLVALHLAAQALRDGECDLAIAGGATVMPDPTSFVAFSRQRGLAADGRCKPFAAAADGFSLGEGAGVLLVERLSDARRLGHPVLAVVRGSAVNQDGASNGLTAPNGPAQERVIRQALVNAALPASAVDVVEAHGTGTTLGDPIEAQALLATYGQDRPAGRPLRLGSVKSNIGHSQAAAGVAGVIKMVQAMRHGLMPRTLHVDAPSPHVDWSSGAVELLDRAQEWPRDGAPRRAGVSAFGISGTNAHVILEEAPDTLEEAPDEPAGESTDERADEPTDERADTDTGRPAPGVSVPTAGRPVPVVVSARTQDALRDQAARLTALLDEGGHGVTDLAHSLATTRSVLDRAAVLVAADPDELRRGLTDLSAGAVAEERAEGRLAFLFTGQGAQRTGMGRALYAAFPAFASAFDELCAALDRHLPRPLASVVFAEPGSPEAALIDQTLYTQPALFAVEVALFRLLEHWGVRPDAVLGHSIGELAAAHVAGVWSTADAARVVTARARLMQELPEGGAMLSVAAAEDVVSALLGDAFDEVSVAAVNGPASMVLSGTEEAVTAAGARLAEAGLRTKRLTVSHAFHSPLMEPMLAAYERELAQVTFAEPELPVVSNVTGKPATAEQLCDPAYWARQVRGTVRFADGVDSLLGEEVTTFLELGPDGVLTAMAKESAGAGATGIAVQRRDRDEVRTLLTALGRLHVRTGRVDWPAFFHGTGARRVELPTYAFQHRRYWLDAPTGGVEALAGAGLAGTGHPLLTAAVPLPGTGGSLFSGSLPGIDEERPPSRGDILDLVLWAAGSLGCDRIAELDVPAALPGGPHAPLQLVVAAPDEDGDRDFTLHVGPTDSGDAGDESWTRIAHGTVGGAAARPEPDPAAWPPADAEPVGADAVWRRADELFAELVLTEQEAGDADRFGLHPELLAGLTDLITELAGEPVHFAGVTRYATGATELRVRLTRSGPGAVAVLLSDAEGEPVLSVDRVGVRTGTAPATTPAGAPTGPDSLYRLTWTPVAAVAPEPAGPWAVVGADGLAKALVATQGAEVEAHPDLASLGRSTEHGAAPGLVVLSVDTEPGATVESMRHTTHRTLELVKELLADGRLAGARFVLVTRAAVSTGDGTPVDPAQAAARGLLLSAQAEHPERFVLADLGGRDADAELLAAAVGTALTEAEPQLAVRDGQVLVPRLAQVTERPTDGPAERGPGGEHGTVVVTGATGGIGTEIVRHLATAHGVRHLLLLSRRGPDDPRAAELGRVLAEAGADATFTACDTADRAALADALADVPAEHPVTAVVHIAGVVDDGVLTTLTPDRIDTVLRPKAEAAQHLHELTADLGLSHFVLFSSGVGTFGGAGQANYAAANAFLDALAHRRRAADLPATSLAWGLWETTAGMSAHLSDVDRRRMAQAGVLAFTPRQGLALFDAAWNSDATTLVPMRLDKAVLRGKAAEATLPAPFRGLVRAPLRRASAAGARAAGQSFAQQLAEQSESGRRQLLLDLIHRQVAAVLDYAADAPLDAKLPFRELGFDSLTAVELRNGLIAATGVQLSAALVFDYPTATALAEHLESKVLRSVAGAPLPALTQLDHLEAALATSPPDRATREQLAARLRRLASAWSADELEADDGDITSKLDSASDEELFDFINAEFGKD

SEQ ID NO: 10436 - protein, 6146 aa, Streptomyces avermitilis
MACRLPGAAGPAEFLALLRNGEDAVGAAPGDRRYAPRRGGFLDSVDEFDAGFFGISPREAAAMDPQQRLVLELSWEALEDAGIPPARLGGSGAGVFVGAIADDYATLSRAAGADAATPQTTTGLNRGIIANRVSYTLGLRGPSFTVDSGQSSSLVAVHLAAESLRRGECSVALAGGVNLILAEDSTVAVERFGALSPDGYCYTFDARANGYVRGEGGGVVVLKPLADAIADGDDIHCILAGSAVNNDGGGEGLTVPDRAGQEAVLTAAYEQAGISPAAVGYVELHGTGTPTGDPVEAAAVGAVLGAGRPAGQPLLVGSVKTNIGHLEGAAGIAGLLKAVLAVRHREIPATLHHASPNPAIPMAELGIGVNTALTPWPEQAGPLVVGVSSFGMGGTNCHVVLTEPAGYDAAARPATAGIRPAGTPAPLLVSGRDEQALRAQARKLRDHLDTHPGLPLRDVAHTLAAARAPLARRAVLLAADREDVSAGLARLADGTPGADLVRGTVSPGALAFVFTGQGSQRPGMTAELYRTSAEYAAALDEVCASLDPWLRRPLRDVLFAAEGSDEAALLDRTEFTQPALFAVEVALFRYAEHCGLTPRFLLGHSVGELAAAHVAGVLSLADACTLVAARGRLMQDRPATGAMVSVQATEDELAPFVSESVTLAALNGPASTVIAGDEDAVLAVAAHWAARGRKTKRLRVSHAFHSPHMDGMLTEFRRIAAGLTFGAPRIPIVSNETGTLLTEADARSPEYWVRHARAAVRFLDGVRLLEDQGVTTLLELGPDGVLSAMARDCLRDAGTVCVPLLRGRDRTEPEALLAALAGLYVRGVPMDWERTATEAGARRVPLPTYAFQRRRHWLPEPSASASRPVVNGGGHAGQAGHAGQAGRAGQAGHAGHDGEPAPAVRDRTTPELVRDRTTLELVRDATAQVLGHASPDDVATHEAFRELGFSSLMLAELGERLTEATGRRVPTTLLFDHPTPDALARRLEADGAERTDAGPVSPPAAAAHDDDPIVIVGMGCRLPGGVRSPEDLWRFVAAGGDAISALPVDRGWEFAADFPGEGGFLADVAEFDAGFFGISPREALAMDPQQRLLLETSWEALERAGVDALKLRGSRTGVFVGASPSEYGPRLHETSDADGHVLTGTAPSVLSGRIAYVLGLEGPALTVDTACSSSLVALHLAAQALRGGECDLALAGGVTVMATSGMFAEFARQGGLAPDGRCKAFADGADGTGWGEGVGMLAVQRLSDAVRDGRPVLAVVRGSAVNSDGASNGLTAPNGPSQQRVIRQALASAGLSAADVDMVEAHGTGTSLGDPIEAQALLATYGQDRPDDRPLWLGSVKSNIGHTQAAAGVAGVIKSVLALRNGLLPKTLHVDEPTPEVDWSAGAVELLTEGREWPETDGPRRAGVSAFGISGTNAHVILEQAPSVEEPVTAPADDGLLVPWVVSARSEEALRAQARRLADHVRESGLRPADVGLSLAVTRAGLEHRAVLVAEDEAGFLAHLDALAEGRTPAGVVVEGGTAFLFSGQGSQRAGMGRELYSAHPVFAAAFDEVCAAFDGLLPGALREVVFGGAGLDRTEWAQPALFALEVALFELVSSWGVRADVLLGHSIGELAAAYVAGVWSLADACRIVAARGRLMQALPEGGAMVAVEAAEDELPDLPGGVSVAAVNGPRSLVLSGDEEPVTALAQAFAEQGRRTKQLTVSHAFHSARMEPMLAEFAETLAAVEFRPPRIPVVSNVTGEMAGDEFTTPAYWVRHVREAVRFADGVGAAHAAGVRRYLELGPDGTLTTLAHDTAHDAGRDVAAVPALRGDQPETRTVVTAVGRLYATGLTVDWPAFFAPYGARPTELPTYAFQHRRYWLEPVAPSSAPPANPLRYRTAWASVPDGPRPSLSGTWAVVVPASGSYEDIVAGVTAALRDHGARPVVVEVDPAGPERADVADTLRAALGEDAGGVVSLLGTAGSLSSGVAATAVLVQAWTDLGGGARLWCLTRGAVSVSPSDPLAAPAQAQLWGMGRVAALEHPERWGGLVDLPAVPDDRAWTRLCAVLAGGSGEDQVAVRAAGLFARRLGRAGTRADAAPAGPSPWRTDGTVLVTGGTGALGAHLAQWLAAAGAAHVLLTSRRGPDADGAAELTARLRETGTEVTVAACDVTDRDALAELLSGLPADRPLTGVVHAAGVLDDGVLDSLTPDRFAAVAGPKVTGAWHLHELTRDLDLSAFVLFSSFAGTVGLAGQANYAAANAYLDALAVHRAQLGLPATAVAWGSWSGAGMAADTEAARRQLARTGLVPLAPDAALAALGQVMDDGETAVTVADVDWDRFAAGFGPGRPSPLLTGVPEVRRIEERETGRAGAPAETDRLGGLTGDALRQALADLVSTEVAAVLGLPPTDRVREDTTFRALGFDSLIGVEFRNRLAAATGRRLPPSLIFDHPTPGRLVEHLAAGLDGTGPNTAGEERVAPARTHDDPVVIVSAACRFPGGVTTPEELWQLVLDGGDAIGPFPADRGWDLDRLYDPDPGNPGTSYVREGGFLTDVADFDAAFFGISPREALAMDPQQRLLLETSWEALERAGIVPASLAGSRTGVFVGSNGQDYATLLGESEVEGHVLTGTASSVLSGRIAYTLGLEGPALTVDTACSSSLVALHLAVQALNAGECDLALAAGVTVMSSPEIFVEFSRQRGLSADGRCKAFGPDADGTGWGEGVGTVLLERLSDARRLGHDVLGVVRGTAVNQDGASNGLSAPNGPAQQRVIRQALADAGCVPSDVDAVEAHGTGTRLGDPIEAQALLATYGRDRPADRPLWLGSVKSNIGHTQAAAGMAGVLKTLSAMRHGQLPRTLHAARPTPKVDWTEGAVELLTETRPWPATGARPRRAGVSAFGVSGTNAHVILEQAPAPQPARPAVLPPLLNSPSVPWVLTAKSEEALAAQADRLSARLPEAAPAEVGRSLVTTRATWPERAVLIGDGSPHFAAGLGALAGGAGDPRVVRGTADTRGRVVFVFPGQGAQWAGMAARLWESSPVFAQWMDRCAEVLARLTDWSLTEVIHETQDAPGLDRVDVVQPASWAVSVSLAGLWRACGVEPAAVVGHSQGEIAAACVAGGLSLEDGAALVTLRSRLIAEELSGHGGMVSVALSPADTAERIARWNGGICVAANNSRRSTVVSGEPEALAELLAECEAEGVRARRIPVDYASHSAQVERIERQLTELAAGVAPRPGDIPFHSTTTGGPLDTTGLDADYWYRNLRRPVLFGPVTEELLAQGHDVFLEMSPHPVLVPAVQDAVDATGTTAAAVGSLRRDDGGPERFTLSLAEAFVRGAPVDWTAVLGTSGARRVELPTYPFQRGRFWPEPRTAAATTGGAEEDAPLWRAVDRGDLAAVAAELALPDGESLHDLHDLVPALSGWRRRRKDSALVDSWRYRVSWTPVTAPVLAALTGDWLLVTADPDGEAARWARTALGASVTAQLTSPDGPIPAGPWTGVVSLLGLADRPHPDHPVVPVGVADTVALLSALREAGIDAPLWGLTRGAVGTGRSDQVRAPGQAQLWGLGRVAGLENPAAWGGLVDLPAELDDRAAGLLRAALAAGEDEQEYALRPAGLYVRRLVRAPLDGTAARRSWRPRPDGTVVVTGGTGALGARVARWLAHAGAGHLLLTSRSGMAADGADDLVAELRALGARVTVAACDVADRAQLAAALDTVPDEFPVAAVVHTAGVNRTATLDRTTLAELADVMSAKAAGARNLDELLAGHDLDAFVLFSSGAAIWGSAGQGAYAAANAYADALAADRRRRGLTATSVAWGSWAGGGMVDDDLARDLARGGVRSMDPDRAIGALQQALDHDETTLTVTDMDWERFAGTFTAARPRPLIDAIPEAARAATTDPAAGESELAARLAGSTDGERERELLDLVRTAAALALGHRGAEAITPSKPFKDLGFDSLTAVDLRNRLTAATGVRLPATLVFDHPTPLAAAVELRTRLFGGDALPTSAGSVAPTAAEADDPVVIVAMACRFPGEATSPEKLWDLIAAGKDGIGDFPADRGWSVAADAAFSQTGGFLPDVAEFDAGFFGISPREALAMDPQQRLLLETSWEALERAGVDALKLRGSRTGVFVGAGSHDYGTLLTSLEGGQDYALTGAVGSVLSGRIAYVLGLEGPALTVDTACSSSLVALHLAAQALRGGECDVALAGGVAVMATPDAFDAFARQGGLAPDGRCKAFADGADGTGWGEGVGVLVLTRLSEARRRGHDVLAVVRGSAVNSDGASNGLTAPNGPSQQRVIRQALASAGLSAADVDMVEAHGTGTSLGDPIEAQALLATYGQDRPADRPLWLGSVKSNIGHTQAAAGVAGVIKSVLALRNGLLPATLHVDEPSREVDWSAGAVELLTEGREWPETDGPRRAGVSAFGISGTNAHVILEQAPSVEEPVTAPADDGLLVPWVVSARSEEALRAQARRLADHVAATDLTVADVGYSLAGTRAGLEHRAVLTGREREDFLVQLAALAEGASAAGMVRGVAGEGGTAFLFTGQGAQRLGMGRELYERFPVFAAAFDGVCAQLDLLLERPVKEVVFTDAPALDRTVFTQAGLFALEVALFELVSSWGVRADVLLGHSIGELAAAYVAGVWSLADACRIVAARGRLMQALPEGGAMVAVEAAEDELPDLPEGVSVAAVNGPRSLVLSGDEEPVTALARTFAEQGRRTKQLAVSHAFHSARMEPMLAEFAETLAAVEFRSPRIPVVSNVTGGMAGAEFTTPAYWVRHVREAVRFADGVATVLARGVDRFLELGPRGALTAMAEETLDHTGADAVCVPVLHPERPEDATLLHALATASVTGAAVDWTTPFACARTTELPTYAFQRRRFWPRPAASAGAGDLAAAGLAEAGHPLLTAWLPSPEGDGVLCTGRLSLATHPWLGDHTVLGTVLVPGTAFVDLVGWVGDRVGCGGIRELTLATPLALAEDAAVRLRVVLGAPDDTGCRPVAVYAQPDTEDEGTDWTRHAEGLLAPADASDTPAAPPGPALDAWPVPGAEPLPMDGFYEGLADAGFAYGPLFRGLRAAWRRGDEVFAEVSLPADESGAGFGVHPALLDAALHALGPAAQASDEPGSARLPFSWGEVRVHAVGADLLRVRLVRAADGTVTLDAADAAGRPVVSIGSLVLRPLSPDRLRAGTQAPDDALFATRWIPLDVTGDTGDTARDTVECVLLGEPSAGAWRSHPDLAAYAAALADGKETPGPVLARCPLTTGDPAEAARRSAEWTLDLLQQWLADDRLTDSHLVIGTRHAAPVATPYAAPVDATDADAAPVDAGHEAPVDTAAAALAQSTLAGLVRSAQTENPARITLVDFDTTAPDPAHLTAAVRLGEPEVAVRQGTLYARRLTRPETGRALTVPPGPGPWRLDSTGRGSLDHLALVPCPDAAAPLAEGTVRIAVHAAGVNFRDVLIALDMYPGRADLGTECAGVVLETGPGVTGLAPGDRVMGMVAGAFGPTAVADRRVLARIPDGWSFETAAATPVAFLTAYYGLVDLAGLGAGESVLVHAAAGGVGMAAVQLARHLGAEVFGTASEPKWSTLLDTGLDRAHIGSSRTLDFADLVRETTGGAGVDVVLNSLAGEFTDASLRAMPRGGRFVEMGKTDPRDPERVAADHPGVRYRSFDLGEAGPDRIAEILAHLVELFESGALTPLPVTTWDIRDATDAFRVLSQATLTGKAVLTVPAGSVPFEAGETVLITGGTGTLGTLLARHLVTEHGLRHVTLAGRRGTDTPEVRQLRADLAEMGAEVRVEACDAGDEDAVRRLLEPLTAHHRLAGVVHAAGVTDDGVVSALDRRRLSAVLHPKVRGAWNLHRLTAHLAPRMFVLFSSASATLGAAGQGNYAAANAFLDALAEHRHARGLPASSLAWGLWDQASGMTGRLAERDRQRMSRAGVAPLDSAHGLALFDTALLTGIPALTPARLDLAGLRARAAHQPVPAVLRELVRVRRVAATGTTAPTTGTPGDARTLTERLAALSPAERHRLVLDLVREHTAGVLGHGSADDIDPDQAFKTLGFDSLTAVELRNRLRTATSLTVPATLVFDHPTPAALTAHLLELAAPPEHDPVLQVLGELERLEAGVEALGPVDGAHDEVVARLRRILRKAEAGSAPDGGGEDSSLQTASAAEVLAFIDSEFGDLA

SEQ ID NO: 10437 - protein, 112 aa, Streptomyces avermitilis
VEVGGQTIRAGEGVLCTLSTANRDEGAFTDPDELDLRRDARSHLSFGFGIHQCIGQSLARAEPQIALETLLRRLPGLRLAASFEELRFRDGVGFYGVKELPDPCPALPPDRP

SEQ ID NO: 10438 - protein, 942 aa, Streptomyces avermitilis
VLASAGQGEGGVVLVNAGPGVGRTALLDAFLRKATESGARVCAAAGSSAETEAEFGVVGQLFPPTGPLGAGFRLARAIGSRDAGPGLDADRLFDALCQELRRRPTVIAVDDAQLADAASLRFLRYLVRRLRTAPVMMVLTEPTGPDALPPSFQAELLRHPQCRRLGLLPLSRDGVTQVVSAQVGSDRVPRLAADFHAISGGNPLLVHALLADHRAAHRLSPVPSVPTVPSVSSASSAASASSAASAASAVSAAPAASAAFAKAALAWAYRDEPVLFDVACGFAVLGESATPARVACLVDRGADAVDQVMTALDTAGLLAGGTFRSALVGKALLEHVDVETRAELRRRAARLLHGDGAPATVVARHLLAAPVAEPWAGRTLLAAAEKAMQEGREELSLDCLRLAGQSATTEQERAAVVMARVKIGWEIDPRLVSPWLDELVAALRRGDLRSGDAAWIVKHLAWQDRFPEAVESLSTLAAAGDAGEPGVEAELHFVRHWLRHSCPPLEASVPGPSNPTRPRTPRLRRVSPASYAGEVLGKVLTEGPDDHTVAMAEEILRGCRYSETVVEALEAALLALVYAGRPDRAAFWCDGLLQQAGTRSTGTSVAILSGIRAEIALRQGALPAVEQYARSALSAISLPGWGVAVGSPLAALVHSTTASGMSGVAGAWLNQAVPDGMFRTRHGLLYTHARGHYHLAVDRPAAALDDFLTCGGLAKEWGMDVPTFLPWRTSAAQAQLALGNPGQARALVREQLGRPGGSTARARGVALRLLAATGEPGRRPALLRESVNLLESCGDQVELLRALADRCQALDHVGAPAKARMTARHARNVADACGGDALFRKLFRDEVPDREGDPDGLTGEEQGSASLTAAERRVTALAALGHSNREIGRKLFITKSTVEQHLTRVYRKLGVRNRADLGDLLAGTNLGAGTPAMAMASSAVAG

SEQ ID NO: 10439 - protein, 931 aa, Streptomyces avermitilis
VLIGRGQEIDRLRAAYSSVRSTGRSRAVLVESAAGCGKSEILEDLVRHVESLGLIALRATAIAEERNTPLSVLRSLVNGAPFPDDLVRRFHTMSDAAARMISTEGRDKARRDAAWYELMRTFCTEVRALAQRAPLVVAVDDIHHGDADSLRQLLHLARHCRNVPVLLTFTQSLAGGPADRTFGAELLRQPNLEHIRLPRFCRQDIADMLAEQGRADAGQGTVERYFAVSGGNPLLLRALLEDARLEPDDTVDAQDVGPRAGQAYGRAVLACLDRGGEKAHEVAAGLAVLGGAFTHELLSRLLDISAAALTENLRALRAAGIVVGTSFQHPAAKAAVLDSLEPSHRLRLHQRSAALLHASGAPAALAAEHLHEAGQADGAWAVGVLQQAAEQALLADEARRAVSYLELAHAASADPRGRTEIKIRLGSVTRRVSAADAERHVDDALRGFGAGLLTPSDTGGLAALLLAHGRLEQARSVLEQGRRPGDGDADRTAARRQLAEIRDSVLNRGAWCAGTRAAWHENPAGRPSTGRAGTGLRAWLSGSHAALLAQRIAGTEGLLEITHLTDATFDLVLNAVWTLLALGAVERALHWCDTFLREAKRRDAPGWEAVFAAVRAEGALRGGNLAEAERDARRCFAVLPERHRSALEGSAVSYLVTVQIARGKYEDAARQLSRPMADSLPDTIHWLDYLRARGLYYMATRQYHSALRDFHEVGRLAERWGTDWPALLPWRTDTAEALLRLGEREQGLRLATEQLAMVQDGAPRIKGISLRLQGLASEPAARLGLLNRAVVELSRADDRLELSRTLFDLADAHRETRQTRQAAMVLRRARQLAKSCGAQPPRDRIGSPDAAGASGELFGEGPERNADWGHLSESERRVAGLAASGYTNREISVRLYITMSTVEQHLTRVYRKLKINGREELLAEARAGVQV

SEQ ID NO: 10440 - protein, 252 aa, Streptomyces avermitilis
VSANRVDGNLWVRQFHPAPTAATKLVCLPHAGGSASYFLPVSKALAPGVDVLAIQYPGRQDRRHEKCIDNIAELADAVTAVLEPLADRPLVLFGHSMGATLAFEVALRLERKGIVPLALFASGRRAPSRHRDESVHLRGDDEIIAELKTLSGTRSEVLGDEEILRMVLPAIRSDYKAAETYRYAGGARLTAPIHAHFGVEDPRVSLDEAQAWADHTTGHFELRSHPGGHFYLNDQAPRVIEEIARVSSSVAS

SEQ ID NO: 10441 - protein, 321 aa, Streptomyces avermitilis
VSQDRHDGSTAALGGPSHGGRLLAVSDIHVRHRQNRDIVQDLHPGCAEDWLIVAGDVAESVADITWALSLLRDRFAKVIWAPGNHELWTAPGDPDELRGERKYRHLVDLCRALGVVTPEDPYPVWHGAGGPVAVAPLFLLYDYSFLPPGAWSKSHALRLADDAGVICTDEFLLHPDPYPSREAWCRARVRATRARLDALPDDLPTVLVNHFPLVREPTRVLRHPEFALWCGTTATADWHLRYRAAAVVHGHLHIPRTIRCDDVPHHEVSLGYPREWQRYGRRPDWPVQILTPAPAPAPAPVPVPVPAPPGHRTASPADRRP

SEQ ID NO: 10442 - protein, 260 aa, Streptomyces avermitilis
MIEQLLPPRVRAHEVFADVPVSSLHPREAALVQDAVESRRREFATGRHCARRALASLGVPPGPLLATPRGAPRWPAGVCGAITHCAGYRAAAVARAPGIRAVGIDAEPDRPLPEGVLEAVALPAEQFQVKEHTARHPGVVWGKLLFSAKESVYKAWFPATGRPLGFEEALIDLDPVSSTFRVRVLPTALRAAEPELRDLHGRWLVRHGIIVTAVVVDGPGRDTPHAPSPYDRTKHSAPTGRSADRPGGRPTDRATDRPTA

SEQ ID NO: 10443 - protein, 377 aa, Streptomyces avermitilis
MTGYSTAADANARFRQLVGSGTRAVPVVFDLPTRAGLDSDAPAARGLVGRRGVAVDSIDDMRVLFGGLRLDRVVPSLAVDAPAAPLLVLYQLVAEEHGAPAQRLAGAVRGDVFKEFLARGPGVFPLRPSLRLAMNVFAYCQAELPRWQCLSVCGHHLAGTGADPALEVAFTVAGGIEYLRAAVTAGLDVRTVAPRLTLCLVGGTTGRENRAKLRATRRVWTRTANERFGSGRTAPRLYVRTPRDGLATLACTEDIEAGATALVDRIERLGGTLTVLEHGLAGQLLGRPHGDRPATPRPHPPHQDSLDLQARQTERLAKLRAWRVQPAVDEALLRLRKAAQGDDNVLYPMREALAARATVGEVCDALRSTWGTGPSAT

SEQ ID NO: 10444 - protein, 474 aa, Streptomyces avermitilis
VREYLLTLCITAAVTYLLTGPVRKFAIVAGAMPEIRARDVHREPTPRLGGIAMFFGLCAGLLVADHLENLNEVFADSNEPRALLSGAALIWLIGVLDDKFEIDALIKLGGQMIAAGVMVMQGLTILWLPIPGFGLFALTQWQGTLLTVALVVITINAVNFVDGLDGLAAGMVCIASAAFFMYAYRIWYGYGLEAAAPATLFAAILMGMCLGFLPHNMHPARIFMGDSGSMLIGLVLAAGAISITGQIDPDAMNLFSGSERNTVHQTVPVYIPLLLPLTIIAVPAADLVSAIVRRTWRGQSPFAADRGHLHHRLLEIGHSHSRAVLIMYFWSALIAFGALAYSVNSASMWIVLGIAALSALGLGLLLLPRFTPRAPRWAEHVVPPRYRRRRAARTGSAPALDGLQASVDGDHGDRAATAPAAAAEAREPSALGLHGSTALSELSSSPRTHERERAHERTHERERAHGLSGGTGRK

SEQ ID NO: 10445 - protein, 423 aa, Streptomyces avermitilis
MSVTHVPEAVRPAVAGADFEALRRQDPELAEILIGELDRQSTTLQLIAAENFTSPAVLAALGSPLANKYAEGYPGARYHGGCEFVDVAERLAVDRATALFGAAHANVQSHSGSSAVLAAYAALLRPGDTVLAMGLPFGGHLTHGSPANFSGRWFDFVGYGVDAETGLIDYEQVRTLARSHRPKAIVCGSISYPRHIDYAAFREIADEVGAHLIADAAHPIGLVAGGAAPNPVPYADVVCATTHKVLRGPRGGMILCGGELAERIDRAVFPFTQGGAQMHTIAAKAVAFGEAATPAFAAYARQVVANARVLAERLAAEGLAITTGGTDTHLLTVDPAPLGVEGRTARGRLAAAGMVLDTCALPHGDARGLRLGTAALTTQGMGETEMARVAKLFAGVLRDETDSKTAREEVRELAGGFPPYPGR

SEQ ID NO: 10446 - protein, 221 aa, Streptomyces avermitilis
LTAPDAGRGIGTGITGADGFSGGSFRILHVSTGNVCRSPITERLTRHALADRLGDPLWGGLIVESAGTWGHEGAPMEANAEAVLADFGADASGFVGRELLDDHVIRADLVLTATRDHRAQVISMGHSAGLRTFTLKEFTRLVRAIDPATLPPLEDGVVERARALVRAAAALRGWLLAPTAEADEVYDPYGAPLPFFRSVGDEIHQALDPVVTALTGVPARM

SEQ ID NO: 10447 - protein, 215 aa, Streptomyces avermitilis
MARRYDTNDATDRATGLREAASAVRRGELVVLPTDTVYGVGADAFSSEAVADLLQSKGRGRNMPTPVLIGSPNTLHGLVTDFSEMAWELVDAFWPGALTLVAKHQPSLQWDLGDTRGTVAVRMPLHPVALELLSEVGPMAVSSANLTGHPAPEDCDAAQEMLGDSISVYLDGGPTPGIVPSSIVDVSGKIPLLLREGALSAEELRKVVPDLEVAN

SEQ ID NO: 10448 - protein, 293 aa, Streptomyces avermitilis
VQQHFGGRPPNPRSVLLAEVAQATQRLADAGVPSPRNDAEELAAFVHGVKRGQLHLVKDADFDARYWEMIARREAREPLQHITGLAYFRYLELQVGPGVFVPRPETESVVGWAIDAVRAMDVVEPLIVDLCTGSGAIALALAQEVPRSRVHAVELSEDALRWTRKNVEGSRVDLRQGDALEAFPDLDGQVDLVISNPPYIPLTEWEYVAPEARDHDPELALFSGEDGLDLIRGIERTAHRLLRPGGVVVIEHADTQGGQVPWIFTEERGWADAADHPDLNNRPRFATARRAMP

SEQ ID NO: 10449 - protein, 358 aa, Streptomyces avermitilis
MFEAVEELIGEHADLEKKLADPSVHADQANARKLNKRYAELTPIVATYRSWKQTGDDIETAKEFVADDPDFAAEVKDLEKQREELTEKLRLLLVPRDPSDDKDVILEIKAGAGGDESALFAGDLLRMYLRYAERVGWKTEIIDSTESELGGYKDVQVAVKTKGGQGATEPGQGVWARMKYEGGVHRVQRVPSTESQGRIHTSAAGVLVTPEAEEVDVEIHANDLRIDVYRSSGPGGQSVNTTDSAVRITHLPTGVVASCQNEKSQLQNKEQAMRILRSRLLAAAQEEAEREAADARRSQVRTVDRSEKIRTYNFPENRISDHRVGFKAYNLDQVLDGDLDAMIQACVDADSAAKLAAA

SEQ ID NO: 10450 - protein, 73 aa, Streptomyces avermitilis
LKRDIHPEYVETQVSCTCGASFTTRSTISSGTVRAEVCSECHPFYTGKQKILDTGGRVARFEARFGKAAAAKK

SEQ ID NO: 10451 - protein, 379 aa, Streptomyces avermitilis
MSAESTPEPGIPGSTGTEGPRRRAKGRRRKPPGTRRKALLITAWAAAGVVVLGGTGAGYLYFKLNGNIKSVDINQALGTDRPLKVDDGSENILVLGSDTRSGSNKKLGGGTDDGSARSDTAMIVHIYRGHKKASVVSIPRDTLVERPRCTGRKGTVYPGSSSAMFNSAYSTGGAACAVKTVESMTGIRMDHYLEVDFSGFQDLIDDLGGVRVTTTKDIADKDSHLDLKAGTHTLDGRQALGLVRTRHGVGDGSDLGRIQLQQAFIKALVNQVKHIGVLTSPTKLYDLADTATKTVTTDSELASVKDLASFAGGLKGISSSHMNMVTMPVHYDAANANRVLVDKAKAQLIWKALKDDRAIPKAATHGTATGSAKGVVTSG

SEQ ID NO: 10452 - protein, 688 aa, Streptomyces avermitilis
VSDTTDLMGARVEETAAAPATDASAPATGAGSRRRRGTGLEGMVLAELQQVASGLGIRGTARMRKSQLIEVIKEAQAGGGAPAKAAASAADATETKPKRRATSKARTGDDAAPAEKAERAAKPAAEKAVAQQQIEIPGQPASEDAPAERRRRRATAEAGSPETVAAEAKSEPKAETPAGEAKGDAADGGEGRQGRRDRRDRGDRGDRGERGDRGDRGERGDRGDRGRDRDRRGNKGDEQQGQGGQQRGGGQQQATGRQDRQDRQRDNGPQDDDDFEGGRRGRRGRYRDRRGRRGRDEFGANEPQVADDDVLIPVAGILDILDNYAFIRTSGYLPGPNDVYVSLAQVRKNGLRKGDHVTGAVRQPKDGERREKFNALVRLDSVNGMAPESGRGRPEFNKLTPLYPQDRLRLETDPGVLTTRIIDLVAPIGKGQRGLIVAPPKTGKTMIMQAIANAITTNNPECHLMVVLVDERPEEVTDMQRSVKGEVISSTFDRPAEDHTTVAELAIERAKRLVELGHDVVVLLDSITRLGRAYNLAAPASGRILSGGVDSTALYPPKRFFGAARNIEDGGSLTILATALVDTGSRMDEVIFEEFKGTGNAELKLDRKLADKRIFPAVDVDASGTRKEEILLGSDELAITWKLRRVLHALDQQQAIELLLDKMKQTKSNAEFLLQIQKTTPMPGNGND

SEQ ID NO: 10453 - protein, 305 aa, Streptomyces avermitilis
MAGPAFRAAAVRVRVPATSANLGPGFDALGLSLGLYDDVVVRVADSGLHIDIAGEGSETLPRDERHLLARSLRTAFDLLGGQPRGLEIVCANRIPHGRGLGSSSAAICAGIVAARAVTIGGDGKLDDTALLELATEIEGHPDNVAACLLGGFTLSWMEGGAARAIRMEPADSIVPVVFVPGKAVLTETARGLLPRSVPHVDAAANAGRAALLVEALTRRPELLLPATEDRLHQEYRAPAMPESMALVERLRADGIPAVISGAGPTVLALADEASADKVARLAGEGWAANRLSLDARGASVLPLAA

SEQ ID NO: 10454 - protein, 352 aa, Streptomyces avermitilis
MTHQWRGIIEEYRDRLPVSDSTPVVTLREGGTPLVPAQVLSERTGCEVHLKVEGANPTGSFKDRGMTMAITRAKEEGAKAVICASTGNTSASAAAYAVRAGMVCAVLVPQGKIALGKMGQALVHGAKILQVDGNFDDCLTLARNLSDNYPVALVNSVNPVRIEGQKTAAFEIVDMLGDAPDIHVLPVGNAGNITAYWKGYQEYAADGIARHKPRMWGFQASGSAPIVRGEVVKDPSTIATAIRIGNPASWKFALAAKDESGGFIDEVTDREILRAYRLLAAQEGVFVEPASAASVAGLLKAAEQGKVDPGQTIVCTVTGNGLKDPDWAVAGAPQPVTVPVDAATAAERLGLA

SEQ ID NO: 10455 - protein, 429 aa, Streptomyces avermitilis
MRTRPLKVALLGCGVVGSEVARIMTTHADDLAARIGAPVELAGVAVRRPSKVREGIDPALVTTDATALVKRGDIDVVVEVIGGIEPARALITTAFEHGASVVSANKALLAQDGAALHAVAEEHGRDLYYEAAVAGAIPLIRPLRESLAGDKVNRVLGIVNGTTNFILDKMDSTGAGYQEALDEATALGYAEADPTADVEGFDAAAKAAILAGIAFHTRVRLDDVYREGMAEVTAADFASAKNMGCTIKLLAICERAADGGSVTARVHPAMIPLTHPLASVRGAYNAVFVESDASGQLMFYGPGAGGSPTASAVLGDLVAVCRNKLSGTTGPGESAYAALPVSPMGEVVTRYHISLDVADKPGVLAQVATVFAEHGVSIDTVRQQGKDGEASLVVVTHRASDASLSGTVEALRSLDTVRGVASIMRVEGE

SEQ ID NO: 10456 - protein, 463 aa, Streptomyces avermitilis
MSRSAHPAGPRHADVLPEGHYSAPAADLNALDPKVWSHTVSRGDDGVVRVGGIDVKQLAEEFGTPGYFLDEADFRERARAWRTAFGHDADVFYAGKAFLSRAVVRWLHEEGLNLDVCSGGELATALSAGMPADRIAFHGNNKSEEEIRTAVEAGVGRIVLDSFQEIVRVAHIAQSLGKRQRAQIRVTVGVEAHTHEFIATAHEDQKFGIGLADGQAAEAVRRALALDGLELVGIHSHIGSQIFDMAGFEVAARRVVKLLAEVRDEHGVELPEIDLGGGLGIAYTSEDDPREPHEIAKALSEIVTRECEAAKLRTPRISVEPGRAIVGPTAFTLYEVGTIKPLDGLRTYVSVDGGMSDNIRTALYDAEYSVALVSRASDAEPMLVRVVGKHCESGDIVVKDAFLPADLAPGDLIAVPATGAYCRSMASNYNHALRPPVVAVHDGEARVIVRRETEEDILRLDVG

SEQ ID NO: 10457 - protein, 352 aa, Streptomyces avermitilis
VTPVELSRTVLRAVRCAVDEGELSVAVPVRAVVTPPGPGGCGDYATNIALQLARPAGRPPRQVAEILRPHLSRTAGVAGVEITGPGFLNIHLEAATATIALVREILDGHANGHANGHAIGHAIDSGHDSHGTPYGHTPTLTGQVIPLRIPYDIRAEVVADSLVRIVASQGGRAEVDHVRAGEAVTLRPVPAPEDPAPLGADAARWALLHPAAHDRPRITADHLAQRESNPLFRIRYAHARARALTRCAARLGFHGEPGDVPVDVPGAEVLVRELAGYPHALSAAAAQHAPDRLARHLVATADAFLAFQHTVLPLGDEKPSAAHRARLALAEAAGTVLAGGLSLLGISAPDYL

SEQ ID NO: 10458 - protein, 197 aa, Streptomyces avermitilis
MNRFWGWRGSGVAAPDEGEVGKSRTRSWVPTYSRVVPGASGRVLVVDDNKVIRQLIRVNLELEGLEVVTAADGAECLDVVHQVRPDVVTLDVVMPRLDGLRTAARLRADPRTRDLPLAIVSACTQYEVEAGLGVGVDAFLAKPFEPAELVRLVRQLMERDSEGGGSGGGDGDPASLGSPCGAGGAGGAERAGDRAGT

SEQ ID NO: 10459 - protein, 470 aa, Streptomyces avermitilis
VRRSLTAALAVTTLATPLVLVAAAGPASAAPVPPRTPLVDFNHDGYADLVFSAVGGYEGTTPGQVTVVYGSASGPDTAHAKTFGRATPGVPGDPESGGRFGQETAAADLDGDRYTDLVVNGYDGKAVVLWGSAAGLSGQGSAELPWNGGHVTAGDFNGDGKRDLVTVDFPRSDDPDNDDQGMLISYGPFTREGKAASTQAVATSRTFGPGGFVTGDITGDGADDIVSNHGFEEMAYGSKFWAGGKDGVNTTPKPLAASVGGAIADVDKDGYGDLIVRDIGNNFEDMPYQKGTILIKYGTADGPSTTRTAKITQDTAGVPGVGEEGDEFGSSISAGDVNGDGYADVAVGIPGEDIESVADAGSTVLLKGSRTGLTGTGAQAFQQSTTGVPGASEKEDKFGSQVLLSDTNKDGKADLTATAPLEDGTYADSGAAWHLRGAAGGLTVTGITSFGPKALGALEKGVMFGSWLAR

SEQ ID NO: 10460 - protein, 509 aa, Streptomyces avermitilis
MERPHLATEFLRCTTFTRSGPSPGTSHTFRTGGTVPRRTLTAAIAVTALATPLALFATSGTASAAPVPPRTPMTDFNHDGHADLAVAAPFGTVGGVEKAGYISVVYGTASGPGTARHQMISRATPGVPGDLQGTFAFGVQTLPGDLDGDSYTDLLVASGGDDGEPTVLWGSKDGLTGQNTVLPYRYSEFALGDFNGDGKRDLVVNSDPSDDPDVSGMTIQYGPFTRDGKTRTQDSITTDDGPSGLRSFITGDLTGDGVDDIVTTHGFEEMQHEARFWKGSRTGVGHTSKALGTAYSGTVGDVDGDGYGDLITRDIGSVTEVIDSAPGSITIQYGGSTGPSNTRKKVITQATAGVPGASEANDAFGASLSAGDVNGDGKAEVAVGVPGESLDAATGTGAVILLKGASKAVGGMTGKGAIAYNQSTAGVPGVSESGDDFGRQVSLSDLNKDGKADLTATAPGEDGAFADSGALWNLYGSASGLTTTGAGTLSPVKLGAPEKDAKFGHTLGG

SEQ ID NO: 10461 - protein, 88 aa, Streptomyces avermitilis
MARARMSMQELIRRRRRAGFVGRREELRAFRENFDLPVDDDRHRFLFHVHGPAGVGKAQVVEDRPALADQHLDQLLIAALSTLRVSGV

SEQ ID NO: 10462 - protein, 602 aa, Streptomyces avermitilis
LHHPGWLSSRPKRTSLTRRCIRSPAAVDPQGGGNAVVTIRRAYDAFRTFQTSDSKPLILFSAPAVEIEKWSGVPERRRLAGEETAGFQREQDPARVRELAKFFKDDRNVAQNPLLGALQDATKVHFKEKTPGSPFGRLEIEYEDYSKVPLRDLLQRLTERLEERVGALNDSIVDERKVALLLERESERAEPSGLAEDEQIEEVSNDDRDEVIADNEGGDVNTALLAEETHLVDFYVELKARMRVLQHLGVDDADEIQGFTKAALLGYLKPVVLVDGQHRLRGAVLSAEQLADTPAAEEAVMESVQAGLDPGEAEKQVLLKKSRHLPVSLLMDSSPSEHVFQFVIVNQKAVLMGSALLGTIISTSLGREELQSVRERLKGAGIQLEDSQAIAYLTRAEDSPFRGLVQTGVDGDRPDLLKWSVLQSLVTIFRKLQGGRPYHERTDYARAWRLEYFPNCGLASGDTLDEKLADWSRPDGPWREIFVRFYVHVRDYFGDTQDLDTYNAWGSTGNSNLFNKISLTILACDYFDFIYTQGEALETTDDFDRTLQRWLKDGRVSPSYFNRDWRLEKTKKDQLIVKRLWSQNWHEYRKVPANGLPRKFKP

SEQ ID NO: 10463 - protein, 684 aa, Streptomyces avermitilis
VKLLRLTLDNFRAFYGRQTLDLAVNDSKPAVLIFGNNGAGKTTLLNAFAWALYGKFSADVEQQQRVIHDHKWAETPHGTPVSASVELKFEHAGVIFTVLREVATVKNTDEQIAVAAKLTLNEIKNGESKPVANGQDRIEKILPEGLRRFFFFNGERMEKMFTGEENNDEVKRAIKTLMDLEPMERAITEHLPAAARRLAKEIDKGGDSRLQQLRDQQEGLERQRDDADRRAKKVSRDISSYESEVREMERALRSHSESKPLQNARKKLEWKINEMGGQLQDRYARKREVLSKGGFLAFTSHIDETVIGLAEGMRERRQLPAGIQRDFIEGLLDEGTCMCGTPVPQGSSAYQELDKRRYNAGLADVEARWMYVSGQMKHLSEARQNLLDDLRQATFEIQNCQDEIKSLEEEKSEVDRQLQGVNIEDVQRLEQRRKEYDEKRIDGLAEHRRLEERRVEFEAEIDKMKRLFKSAQAADDASRKVQRQVNLVNEVLDTFREALELKTEEVREQLDAKLKEVFSRIFIKSYEPKLTDSFELLLKSPAGIAIRSTGENQVLGLSFVGAVSEIAKQIHQRKAKDSEDIIGEGGIYPVVMDAPFGSLDFTYQEEISQALPKLTSQIVTLLSNSQASGKVMENLQGAATRMYVLRTVTPNTNAAQETIEINNRAVAYVTHGDFEHTILEEVAF

SEQ ID NO: 10464 - protein, 54 aa, Streptomyces avermitilis
VSEKKTAQDVLSQLSPEGVKLARRVIELERENLHIRSSTTVVNEIVAAVKGLIK

SEQ ID NO: 10465 - protein, 714 aa, Streptomyces avermitilis
VHALEALRHADLGGEYRSDRGNVVDEFYVPALRASTAYDRAVGYFTASVLAVIGEGIEEFTRRAGTMRIVASPYLLAEDITEIEAGYELRAVLEKAALRDLERATEDARAVRGLGKLGVLIAEGRLDVKLAYVTAGSRVGMYHEKIGVFRDDHDLVAFKGSANETLSGLVGNFESIEVFRSWDDRDRERALRISKDFDDLWHDRTPLLRVMPFTDAAKQIIERSTRAAVDPSDDTAIPPSGAPITIAREDLAGMLTIPPLLEVRDYQKRAVTQWFAQRGRGILRMATGTGKTLTALSAAAQVTKMLHKVGEPLLTVVIAPYQHLVDQWAKDIEWFGVHPLRAYESTAAWFPHASQLLDALALHTTRGGVIITTNKTFGETAFQSILQRYRGQLLLIADEAHNLGARHIRSKLPDSAQFRLGLSATPERWFDDEGTAALTDYFGPVVFELGLGDAIKAGALCRYTYKPVIVELNADETDLYIEITEKIGKLFAMQQFSEQADDNSPLGHLLRKRANLLGHARAKLPALRREISQRREEWYQLLYCAEGQHPLSYEDGAAAEPAQIDQVLDLVGNHLHMPAARYTAETKRPERRQVLQRFTDRKLQVIASMRCLDEGVDVPAARTAYLLASSSNPRQFIQRRGRVLRQAPGKTMADIVDFIVVPPTNMPDLQDRTERSMVARELARVTEFAQLADNEAETLDLLRPLRLRYGLLDT

SEQ ID NO: 10466 - protein, 131 aa, Streptomyces avermitilis
VQEPRMPVDHVRLSQPAKDRLSYLKRTTGVTQWNVLCRWALLLSLRDPSTPLVKDIVTDSNVEMSWRTFAGQYGDLYLALLKQRCVAIGEEPNDENIQRVLTVHVHRGIGYLGADKQMATVEGMVGAVVPT

SEQ ID NO: 10467 - protein, 675 aa, Streptomyces avermitilis
MLLRKITLEEFGAYRGKQSLDLTPKKNKPIILIGGLNGCGKTTLLDAIQLVLYGNRARCSGRGTKAYETYLRESINRKADPSRGSAITLEFTVMTGGHEHYYRLVRSWHISGKTLKEFLNVYVDETYGERVKAQRSAEPEGKFNRLLSEGWADHVESLLPLEIASLAFFDGEKIESLANPERAASVIESAVHSLLGVSTVQQLRNDLLALQRRQKLSEEEQHLLDNIRAQEAEREAVVSQYDIAHQELAHSRSELGKAQRKLDSLEKAFADEGGDLFTRRVELENDRKQALVRLAQVRTELTQLAAGPLPLLMVAPLLDDVRQQARIEQEAQQSAQVLEVLEERDRWLLELMPDATRAEVLKRLDDDRAERAAKTQLAVDLRLPHDALAQLTVLDELLQRDTQRSAQLLHSAAELAEHLDQLDRQLAGVPAQDKVEALQAARGEQIVEVTRCETTRDRATAKLEDLKRRREHVTTLLERAHKEFVRTKVKAEEVERVIKYSEKARDTLERFGSALLERHISRLEVAVLQSFKVLMRKQGLVRDLRIDTDKFILTLADADGEAIDPARLSAGERQLLAVSLLWGLMRVAGNRLPSVIDTPLGRLDSRHREHLVDRYFPNASDQVLLLSTDEEIDEYLLGRLEKSVAHTYTLVHDDTEFTTAVVEGYWWSAGASHAG

SEQ ID NO: 10468 - protein, 525 aa, Streptomyces avermitilis
MTTIPLNLGLTPVRRKPFGGRSLEEVVNELTEEIRELYTADQVPWVIGYSGGKDSTAVLQLVWMALKGLPAEQRTKAVHVISTDTLVENPVVAAWVSASLGTMQDAAQAQGLPVEPHRLTPEIKDTFWVNLLGRGYPAPRPKFRWCTERLKIKPSNAFIRSVVAAHGEAIMVLGIRKTESQARARAMEKHEKRRVRDRLSPNANLPNSLVYSPVEDWTNDDVWEFLMQKPNPWGYTNQDLLTMYQGASSDGECPLVVDSTTPSCGSSRFGCWTCTLVDEDKSMSAMIQNDEEKEWMTPLLELRNKLDAPFDEWKEGEEIPAGRKVGDPKPDKPARDFRRMNGKVMLFKDDAIHGPYLQSFREEWLKDLLDAQTWIRAHAPEHVQNIELITLEELHEIRRIWVFDKHEVEDSLPRIYQEATGESFPGGPLDEQLVMGSDEMDVLKQVCDGDDLHYNMVRELLAVERKYRTMARRSGLFQALEQAVQKGYYEDHEDAVEFATRKQKWRDDIAENLTFDDENELDAPA

SEQ ID NO: 10469 - protein, 379 aa, Streptomyces avermitilis
VQTEAASKTAGRAATRASTGFEYTFPAIRGVQAGREFYASMCPLRLIPKIFLFDEDDLSAELRAQRVLNKGRLPALARYILDNPDDYVFSALTASVDGDMAFECQGAEGSAHRTGQLRIPMDARFLINDGQHRRAAIELALKEKPDLGDETIAVVFFHDTGLSRSQQMFADLNRHAVRPARSIGVLYDHRDLNAQITRALTERSAIFKGFVEMEKSTLSARSRKLFTLSALYYGNQSLLQGLDLKQDEAIKLTQSFWEAVDTALPEWAMVRGKQLSAQEMRRDFIHSHGIALHALGRVGNALLRESVKEAAWKRRLVPLTDVDWTRGNIDWEGRAIVGGRVSKSHQNVTLTVNYLRKHLGLELSPEERRVEDAYLRGEA

SEQ ID NO: 10470 - protein, 384 aa, Streptomyces avermitilis
VSAVVAYLDVAATTRVDPRVAEVVLHWMTEDFGNAGSRTHEYGARAKKAVQQARSYLADTVGAKTEEVIFTSGATESNNIALLGLAPHGERTGKKHIITSAIEHKAVLEPLLHLAETRGFTVDVLEPGASGRITVEQVMEHVRPDTLAVSLMHVNNETGVIQPVAELAERLRSTPTYLHVDAAQGYGKIAGDLTAPIDLISISGHKIGAPKGVGALITRRRGWDKAPLEPIMFGGGQERKLRPGTLPVPLIMGLHEAARIFHESRDNWEREARAMREQILEALGKTRFRVNGDQAHTVPHILNVSFDQLNAEALIVRLKDQVAIATGSACTSASYTPSHVLQAMGLPDDVAANGLRFSWFPPQARDFDPLPIAETIARMQPQEG

SEQ ID NO: 10471 - protein, 478 aa, Streptomyces avermitilis
MQQIWGSERRRTAIGRMALSVPARQALADRQLVAERTILDYGCGRGDDVRALQQLDCQVVGWDPYYRTDTQLVATDVVLLTYVLNVIEDPAERRQTLKQAWELTSTLLVVSARLTWEKSKVHGEGFGDGLLTSRQTFQHLYATSELREYVEQVTGARVVAAAPGVIYAFRDEGARLSYLAQRVIPDAAWLASEDTASAVSAVVDFFERRGRAPRIEEMPRTVAELLAHLRPGEVKRLLRDGADAERADAGAKRSTLNTLLYLAVELFNGRGPFASLPVGLQQDVRTFFSSYKEACQRADRLLFKLRDDGYVRNAMNASAAGKITPTALYVHRRALGRIPTVLRLYEHCASIAAGRPEQWTVAKLKHQGRAVSWLDYPDFDKDPHPRIWSSYMVDLQTLQTSHLSYENSANRPLLHRKHEFLAPDDPDVPRYRRLTESEMRAGLYKRPHLIGTENGWEAELVRCGRQLRGHRLVRRTET

SEQ ID NO: 10472 - protein, 165 aa, Streptomyces avermitilis
VCDVSAPGRHSSTGRGDRVGPGRRHRDTEPSTPPSPGNAVLMTLARSLPDNATEWWIFLGTFVLYVLGRWFFAWQRARREGDSHPMRTAFAEEDDPAASHAAMVGGFRSYRQFFGFVGSAVAVVLVAALTEGWLRHALLWIIVPLLVIALSYLDFRQALKARSEA

SEQ ID NO: 10473 - protein, 323 aa, Streptomyces avermitilis
VLPGPGEREVPTEIEDTLHWIAKASRPLNDLADPVTAREVLDSFKIHLDGKAAAAETVRRKRYSFVNALHYAVDLGEFKENPLIAVRWQKPKVSSEVDPRLVVNPQQAVSLLHAVSYVGGYRRARGRRLVGLFACMYFAGLRPAEDIGLSEADLTLPEHGWGTVLLHRTRPSVGKQWTDSGESHDDRGLKNRPAEDMRPVPIPPQLVSMLLEPLDTFGTASDGRLFYSEGGGVVASSTYSRAWQEARTLALPSAAVASPLARRPYDLRHSALSTWLNAGVDPTEVAERAGNSVEVLLGRYAKCIDGRQEIANRKIEELLREYE

SEQ ID NO: 10474 - protein, 112 aa, Streptomyces avermitilis
VKSLDVKIWGVRKRPSKRPSYDVRWSVAERVFSETFRTKALADHYRTKLMRAARDGDEFDDVTGLPDSMAETRAELSWYAFTLKYLAMKWTAERSADPANPAQLGFRAAWTG

SEQ ID NO: 10475 - protein, 232 aa, Streptomyces avermitilis
VIRLDGPDDPPPSWANVGLLTDAIRAAALHRYTTVSVPAAGDEPARTFQWGTQLDIRPVKAFNDGTDITEQAVASYVTKYATKAAETTGTLDRPIGNREAAVLLGVPDHARRLIDACFDLEPLYPDRRLRAWAHMLGFRGHFSSKSRHYSTTLGTLRRTRADYRAAQGRQDRGLEDTEPDTVLVLASWQYAGHGHTPGESALAATIARDLQLNRETAREALSDQLALEGAHL

SEQ ID NO: 10476 - protein, 278 aa, Streptomyces avermitilis
MKSSRTSPRFLALALGLGLASSALAVAVPASAQTVATPSDSADTSVAGYDGSAEEAANNKAFFEAVLKSVAEKRAAQPSGQAVTLHYDASKAPSFRSQIASAAATWNSSESNVKLEEASSGADFSYYEGNDPRGSHASTDGHGSGQIFLDYTQAQQNDSIRVVTHETGHVLGLPDNYSGPCSELMSGGGPGPSCTNRYPNATERARVDELWAGGGAQAPGTGSQPAGGPSAAPSAPSAPSVAPGTGNQPAGGPSAALPVRPVGPGQGPWRPHLRTLWN

SEQ ID NO: 10477 - protein, 188 aa, Streptomyces avermitilis
VASGRLRGMGMFKRANEAESADQAGERADLSLLLLQGEDMIEQLGRAHMSWGLGSADRWDLDQTTGIITWTFPDKTAAAPAQILGSFSPGSGSWLWAWANKSILPDMSRDARSFRDWADDNGHPALAQPKIEADEKAAATLVALAVRVTKATGYYRGPGGNSAVIITFGPVTLTAADGSVSNFNINID

SEQ ID NO: 10478 - protein, 165 aa, Streptomyces avermitilis
MDNTRASATPRNWAGYQQAVVDIRLADRTVRVVPGPQGTAEGHFPEPAGRTIHVITACNPYGRTASAEDNGRAQALLFEEIGRRRLAWWPAAGGTVCGAHVEESAALVGLSDAEARELGRHFGQDAVFAWTPDAWRLLSCSSDETAVSGWTMSTQQPRDPGSCLT

SEQ ID NO: 10479 - protein, 71 aa, Streptomyces avermitilis
MGMHPMPTPARCPRCGRTLVGPPAERVKADGFPAEVTYETDPLCGARWHVWDKTSPLRRRARPYVDGTGPR

SEQ ID NO: 10480 - protein, 547 aa, Streptomyces avermitilis
MTSEPRAAGTLPPDETRAARKPTWRTEPHRRSKPRMPHARYDQRVRALVEVRGGPDDWEEAQRCFEEHGWPVRGFSTETGGEPPRGPALDPDPEARVYEIEVRLFGAAKACDRGAAHRVRKAMRGARLEAYVRFAEPVRRDREMFSHWRVVDSARHRARPPHSWRRTVSRLALRCGWYDAGGVVSGHPRQALRLARTHTPQIAGAGVRPLDGRWRGTVRYWPEEETEHRLFHAVSWSLLTAAALVFAAGRSGFAWWFWVTVAGLGAAGGVRAGARLAREGRRFGVVTVLLLMAFLTASGLGLVDGEGHGWTRRQILMTALVLGVMSGLWLLVRQWSWGEWVAWAVPLVATLALSSFLAAGSVLHALYADGLSLSPDDLEVPAVWQVLAAAKLLTLLSPLLVVPAWWGIARHRHHSYAAPGERLNVALNACFFLLMLGVVTLQALDSASTAVHRTTEAAERGDDPPSYFGVEPEWTCVEPAVPLTRLSGEGPHLSPKHPYLSFGVTAGTAILWDRTTHEPLKLQSSQIRLTPAESGTTRCTKPTTGAS

SEQ ID NO: 10481 - protein, 416 aa, Streptomyces avermitilis
MAPRRVVVTGLGAVTPLGVGVGELWRGLLEGECGIRELDGEEFEGLPVRVAGTVPVDPATLLPRPQARRMNRAAQFAVLAAREAWRDAGFDGAGTAESGLDPARVGVSVGAILGDASVLVGGDRKLRAKGPRSVSPLTTPMTVPSQAASQVSLALRITGEARTVTSACASGTEAIGLAIDRIRYGHVDIALAGGAEAVVTPAIMASFAAMRALSHHGLTEGSPSRPFAKDRDGFVNGEGAGFLLLETEEHARARGARIYCEAAGWGLSADAHHMAAPDPSGSGVALALRRALKDAGGHVVDVVHVNAHATATVEGDLAEANALRAVLGGPVPVTALKGHLGHLQGAAGGVEAVATALTLHHGLIPPTIGCAIQDDEIGLDVVTHSARPLPAGGDLALSNSFGFGGHNAVLALRRVG

SEQ ID NO: 10482 - protein, 366 aa, Streptomyces avermitilis
VLHVRSIWNGAISFGLVSIPIKLVNATESHSISFRQIHLEDGGRIRYRKFCELEDREVTQDEIGKGYEDADGTIIPITDEDLAQLPIPTARTIEIVAFVPADRIDPLQMDTPYYLSANGVPAAKPYTLLREALKRSQKVAVAKFALRGRERLGMLRVVEDVIAMHGLLWPDEIRPPESVAPDASVTVRDKELDLADALMDTLGEVDLNELHDGYREAVEALIEAKASGEKVPSAPADEPGGKVLDLMAALEKSVRAAKESRGEGTGSETGSETRDRTGAKKGKATGKDTGKEAQAEVTRLRRKTARAAPKEVGGKKSTSTAKKATAKKAAPKKTTAKKTTAKATSAKKTTAKKTPAKKATPRKRSA

SEQ ID NO: 10483 - protein, 293 aa, Streptomyces avermitilis
MTPITEVAGRRLALSNLEKVIYPATGFTKGEVLHYYATTADALLAHLHDRPISFLRYPDGPDGQVFFAKNVPPGTPDWVVTAEVPRSEGPARMVLVQDLASLMWAANLVTEFHTHQWRIGTPGQADRLVFDLDPGPPATIVECCEVALWLRERLAADGIESYAKTSGSKGLHLLAALEPTPSGRATEYAKELAVAAEKDMPRLVLHRMTRSLRPGKVFVDWSQNAARKTTAAPYTLRARAEPTVSTPVTWEEVADCTAARPLAFQAPDIAPRLQEHGDLLAPLLDPGHAAPLP

SEQ ID NO: 10484 - protein, 267 aa, Streptomyces avermitilis
MSGLRVVPTWRHGQERLYVCLADGRNVAWYDREAARVNVLGEDWREDVLDALGPFLTGPVTVGPPPVPTPAELARLTLHPDDDLAPNRPGEALVIDLDRDPGPAHRLRPDPRRRALAAEQAVGEALDRLEGAGWHTLHSVPLPGGDRIHHLVIGPGGLFSVHALYARKQRVLVADPMVGVGRREPRPVLRWVRADADRASYALTAEVRPVLAVVGPTALDVTAPLRAVRVLREADLSGLARLGGVLKPADAEALHAMARDRHTWLQV

SEQ ID NO: 10485 - protein, 159 aa, Streptomyces avermitilis
MPAPDSPWSEIVPGLWMGGHEFQGPAGQLEFAVVRDEFDLVLTLLRLPGHGPDEGVEHHVWPIPDGPLDGTQLAGVIRLAQTAAEALEQGRRVLVRCYHGYNRSGLVVAHALIRSGRSAEEAIRLVRTRRSHWALHNDLFVAYLRAGLPTARLLEELTE

SEQ ID NO: 10486 - protein, 296 aa, Streptomyces avermitilis
VPPLRHTGATRSPSRAGLSPSRAGLSPSLTGLSPSPTGRARRALRRAGRAALGTLTAALLLTAATGCGDSGGLRGAGATPTAVGPTKLWPQLPAATTAALDYGEADTETVKGVTAPGDDIHEVDPVDVMRADIAAHPAQYTGPKAPYHEIVRQIGNCGKKGARGRACPILQAYYRDLTGDGKDDMVLGIRFPGNQLAVRAYTFEHHKLVQVMSTTDAVVSVEVAGREVIIRSPSILPGYEFRTVWQWDAHQHAMLAARDEILRVGTAPPASRGTPSPSPPATPEPARSPTPSESTR

SEQ ID NO: 10487 - protein, 431 aa, Streptomyces avermitilis
MSPAGRRVGLLGRLPRWTAALAWKAAVFITVMCCGLAALLGVLVHVSVTDQTVGEARGRALDRLTQAASAYQAGDRLPPGADIDPPGLPARLKELATDGRRGTMVGRNDPEPTMWAAGPADGGRTLAVRVDYAQGAHTIDALDRAIVWSSALAIGATLLVGAFAVTRVTRRLHGTAQVARRISAGDLDARVNDPRTKDPTRPQDEVAAVAGALDTMASTLQSKLLSEQRFTADVAHELRTPLTGLHAAAELLPPGRPTELVRDRVAALRTLTEDLLEISRLDARRERLELDSEPLAPLAERVVRASGTRTEVRVVRDARVETDRRRLERVLGNLVANAHRHGRGPVVLTVDGPVVTVRDHGDGYPAYLVAHGPQRFRTEGGAKGHGLGLTIALGQAEVLGAPLEFANAPDGGALATLTLPHMHRNGPIVAT

SEQ ID NO: 10488 - protein, 455 aa, Streptomyces avermitilis
MIQPGWPGTKAVADPLAPDLRLPRRRGIEFSLLVVAVLLSVYGYCAVGLAKRGTVPPGAAGYGAGLGVLALLAHLAVRFRAPYADPLLLPIAVLLNGLGLVLIYRLDLETPADHAAPAQLNWSTLGVALFIAVVVLLRDHRVLQRYAYVSVVGALALLTLPIFFPAVNGARIWLRIAGFSIQPGEFAKVLLAVFFAGYLAANRHALTYAGRRVWKLQFPTGRVLGPIVAIWLLSLGVLVLERDLGTSLLFFGLFVMLLYVATGRTGWIAVGLLLAVGGALAVGRLEPHVHSRVQDWLHPFASIDAGQGPNQLAQSLFAFASGGMLGTGLGLGHSILIGFAAKSDFILATAGEELGLAGLSAIFLLYALLVERGYRAGLALRDPFGRLLAIGLASIVALQAFVIAGGVTGLIPLTGMAMPFLAQGGSSVVTNWIIVALLIRISDSARSQYDGTAAP

SEQ ID NO: 10489 - protein, 485 aa, Streptomyces avermitilis
MTRYIRRAAALCALLLVALLVNAARVQIVQSSTYDDNPANRRPTIARYGQPRGDIVVGGQPVTGSKDTGEQLRYERTYHDGPLYAPVTGFASQVYGTTGLENAADGILAGTDPMLSLLPLWNGVSRDRNPGGKVVTTLAAGAQRAAYEGLAGRRGAVAAIEPSSGRILALVSAPSYDPGELSGTNSAVTSAWDRLNGDPARPMLNRAIRQTYPPGSTFKVVTAAAALDAGVIRDLDAPTRSPDPYPLPETRISLTNEAEDCEDASLRYAFEWSCNTVFAKLGVDVGLKDMTATAAHFGFNDKGLRIPFPVAPSNFDTKLDAPQLALSSIGQFDTRATPLQMAMIAAAVAGGGSVKSPYLVERTTTSAGGTVSATSPRTLHQAMNPSTAARLREMMTDVVRKGTGKNAAIRGATVGGKTGTAQHGIGNSGTPYAWFISWAQADNALEPAVAVAVVVEDASARRGDISGGGDAAPIAKAVMEAVLRS

SEQ ID NO: 10490 - protein, 368 aa, Streptomyces avermitilis
MPTHELYAKDPGDSHWQVPASGAARFSWEYDDGRDRLLALYQKGKDKQWDGQRRIDWGLEVDPHDPLGTPDEAMTLYGTPYWAKLTDRDKGELRKHYASWQFSQFLHGEQGAMVCAARIVESVPDLDAKFYSATQTMDEARHAEIYGRFLHEKIGMLYPVNDNLQALLGDTLRDARWDMPYLGMQVLIEGLALAAFGMIRDTTDKPLPKQILAYIMQDEARHVAFGRMALRDYYSQLSDAELREREEFVIEGCYLMRDRLRGIEVLENFGIPRAEAERYSEQSEFLHLFRQLLFSRIVPCVKDIGLWGKRLQQAYVDMGVFEMGNSNLDLLMAQDEEIAERLDAERFAAEEKERVAEVTEAIEAGTES

SEQ ID NO: 10491 - protein, 311 aa, Streptomyces avermitilis
MTTVTEGVADGLRDALGLLKDREQVAERLLDSSAKHSFDPDKELDWEAPFEEGKWFWPPELVSLYDTPLWKRMGEEQRMALAQHEAAALASLGIWFEIILMQLLVRHIYDKAATSAHVRYALTEIEDECRHSKMFARLISRGGTPYYPVSRLHQNLGRLFKTISTTPGSFTATLLGEEVLDWMQRLTFPDERVQPLIRGVTRIHVVEEARHVRYAREELRRQMVTAPRWSQEFTRVTSGEFARVFSLAFINPDVYTNVGLDKQEALAQVRASGHRREVMQTGSKRLTDFLDDIGVLRGVGRRLWQSSGLLA

SEQ ID NO: 10492 - protein, 241 aa, Streptomyces avermitilis
MTSQAPPPAYRRLSVEERRSQLLEAALALFAHRAPEEVSLDDVAEAAGVSRPLVYRYFPGGKQQLYEAALRSAAEELEQCFAEPPQGPLSRRLGRALDRYLAFVDQHDTGFSALLQGGSVVETSRTTAIVDGVRRAAAEHILDHLEVREPGPRLRMTVRMWITAVEAASLIWLDEEKNPPLDELRDWLVEQFVACLAATAGRDAQTADVLRAALATEPADGAAGELVRRVLPVLGDATHLL

SEQ ID NO: 10493 - protein, 121 aa, Streptomyces avermitilis
VKSEDTPFVGGPLDGRVLPILLGPTGHPPKTYRVPVPDAAGGPPTVLVYRREQAAQSKRLGLHKGWKYVYDPEGDSGGGRIRWPWSKPAPTPATQPDGTPDSAPDRKPDATPDGKPDAADG

SEQ ID NO: 10494 - protein, 471 aa, Streptomyces avermitilis
VSGRLLRLVCTAAMTAGALLSPGQATAAPPPDPDSTATAPDTTETAPDTTATAPDTTETAPDPTATAPGSAGPDVSDATSMGRLLTDLQRLYRQAEQATESHNATTEKLRRQQAEVARLDRQLTQARLSLQDSHGAVGRLARQQYQGSTGISPYVRLLLARDPQHALEEGHVIGQLAQARAKTVERLTGNEQRSDRLAREARAALDRQLTLAERQKKERDDVQGRLDQVEARLATLSTDQRAELVEFEKNGEAQAQRKFVASGSLSSARIPSRQGDKALRYAVQQLGKPYEWGAEGPKSYDCSGLTSQAWAHAGRAIPRTSQGQWAALPHVPLKKLRPGDLVIYFPEATHVALYLGNGMVVQAPRPGSQVKVSPIAANPVLGAVRPDPRAKPLRHYAPLALPGTTAKEPALPEVPAKGRGGPKGHGAVPHVVPPPGHTVAPPRGHAVAPPRGHAVVPPRGHARPQPARARV

SEQ ID NO: 10495 - protein, 417 aa, Streptomyces avermitilis
MRKILVVGAGQSGLQLALGLQSHGYEVTLMSNRTADEIRSGRVMSTQCMFDTALGHERDLQLNFWESQAPKIEGLGVSVAAPGSFDPGPSQRAIDWVGKLDGYAQSVDQRVKMAGWMETFAQRGGQLVIHGAAVSDLDYFSRAYDLVLVSAGKGELVSMFGRDASRSPYSEPQRALAVAYVHGLGPRPEHPDYDAVRCNLVPGVGELFVMPTLTTSGRADILFWEGIPGGPLDVFKGVNDPGEHLSLTLELMERFTPWEYARATKVELTDGNGTLAGRYAPTVRNPVGRLPGGGLVLGVADVVVANDPITGQGSNSASKCAAAYLASIVEHGEKEFDETWMRATFDRYWDTAQHVTKWTNAMLGVPPEHVLNLIGAAGALQPVANRFANGFDNPADFENFFYEPEKTEAYLASVAGS

SEQ ID NO: 10496 - protein, 208 aa, Streptomyces avermitilis
VDSVVSDVSDLVEPDEELKAWQTDRTRAPIATKIVVAGGFGAGKTTLVTAVSEITPLQTEALMTQASEDTDDLTGTPDKLTTTVAMDFGRITLDDDLVLYLFGTPGQQRFWFMWDDLVRGAIGAVVLADTRRLSDCFPALDYFESCGLPYVVAVNHFDGSEKFEPEDVREALTVPAHIPVMIMDARRRISVIETLLALVGHALEVSPE

SEQ ID NO: 10497 - protein, 138 aa, Streptomyces avermitilis
MSTSDKSSANKLPVRGGGRKPARVRPYSLTGGRTRFGHVLLVETFVAALEAPAERRELTNGSLNTRVMPEMRAIVELCRRMRTVAEIAALLRMPLGVVRVLLSDLADQGKIRVYGTGHGPGQPDRALLERVLSGLRRL

SEQ ID NO: 10498 - protein, 141 aa, Streptomyces avermitilis
VPGLLSVAVVSSDGLLLLSSDPGRNAEARAGLEGRPKGPRGSSADLATIVSGIGSLTIGAAKLMDSGAVKHTMVAMDEGSVFVMSISDGSLLGVHGSADCDMSVVAYHMALFVGRAGHVLTPELRSELRKSLEDESTGSAR

SEQ ID NO: 10499 - protein, 974 aa, Streptomyces avermitilis
MRAPVQKTRPRRTGKQTAPEEGASSESAGKGRAAHVRNRLIIAVAVVAAAVAGAGAPSVVAASGQLNDSQNLVTLTGQTQQALTLAHSLADERDEVTSYVAAGRPKSKAPAEQQSARVDRQVEEVRADPDAPTALRKDLDAIDAVRRAALTGKSTALEAHQAYSATITELHALAEELAERLPPRAGSGAHALAELDGAVQQSAAARGLLLAALNIPRSTQTTINPATGLPTTSDSSSAADTKQRDALTAAAQQAAVRSDAAIADFRDTAPQAARASYDSTVNGPEVASAEKYLAGLTDQPTLSDSELGISVKKLDAALSARVELMRGVESSLYEHRGKDLAQLRDDDVTALEIRVALLGALILVTLGIATAMARTLTRPLSVLRRGSARLAADPAAEEPVKFTGRNDEFAQVVRSVNALHAHAVALHERQTTLEADRKHLIGQRQTMADDREQLRAEIATATAHLEQVRQSIHGTFVNLALRTLGLVERQLAVIEGLEEREQDADRLATLFKLDHFATVMRRHSENLLVLAGAEHVQQHAGPVPLVDIVRAAVSEIERYERVRIAALPPHAHLVGFAADDLSHLVAELLENATSFSPPDVSVEVSGWLLENGEVMLSVQDEGIGMTTERMRQLNSRLADFDPEDAYDQESGEGLGLGLYVVARLAHRLGVRVQLREQKQGGVAAVVVLPGTLLASAPEAVVSTTGPLAGGAASLSLPGADAEANSNVLYARSTVAVPDSTAAEQDSPDSLDSPDSPDSTAVVPEPAAGEDPLIAAAERAVRERDEDAVTGESAGREPEPEPEQVPEPTSPETTMELLAPVPAAEEPAPAAGLPARTATDPFAIGPDAHERTVDEGEAPSAAEEPGTPRLTAKGLPKRTPKISAPAPVPRQRPGGVDAEALRRRLGGFHQGARSGQRVIEAEIAEKTAETKAPTDRPADRSTGRPTDRPAPEHTAPHGTAQDVEASGGTVEEASS

SEQ ID NO: 10500 - protein, 262 aa, Streptomyces avermitilis
MRTELVSESGDPARPNEDFAALALPASGQGGTLIVLDGVTPPRGEYGCLHSVPWFCARLGGALTELSVSRQDLALPEVLAHAIRATARAHADTCDLSHPRTPQATVVLARWSETVMEYLVLSDSVLLTEAPDGTVTAVLDDRLSRLPRTSLVTDAVADATVRNKEGGFFTAAADPSVAARAVTGTLDRGAVRALAALTDGATRWTEKFAEGDWKALFTVVRKEGGQALVDRVRALERADSERRVHLRRSKTHDDATVVFVEW

SEQ ID NO: 10501 - protein, 171 aa, Streptomyces avermitilis
VHEDGNGAGRPVGTGLPGSGVDQGTGRKGDREFLSLERELTVFLRRARANQGEMAREVHPDLESAAYGLLVRLDECGRQRATALAAYIGVGKATMSRQLRALEDLGLVAREPDPADGRAWLVHLTEEGRRRVGRVREARRARYVSQLAHWDQREVAELARLLHQLNLGMEK

SEQ ID NO: 10502 - protein, 272 aa, Streptomyces avermitilis
MSVHRSGTAHRPRLLAAGILLAAFSLLFTHPAPAATTPARGSAYMGMGVLAHDGRNGTPSTGDATQTEGVDVSSHQGNVAWSTLWSSGVKWAYAKASEGTYYTNPYFAQQYNGSYAVGMIRGAYHFATPDTTTGATQADYFVDNGGGWSRDGRTLPGALDIEWNPYGAACYGKSQSAMVSWISSFLTRYKARTGRDAVIYTATSWWTQCTGDYGGFGTADPLWIARYASDPGTLPAGWSYYTMWQYTSSGPTVGDHDKFNGALDRVQALANG

SEQ ID NO: 10503 - protein, 811 aa, Streptomyces avermitilis
LTAEGEIMASTSTPLTLPVLPLDDEVVLPGMVVPLDLNDADVRAAVEAAQAAARSEPGKPKVLLVPRVDGAYPGTGVLGTVEQVGRLADGDPGALIRGRGRVKIGAGTTGPGAALWVEGTQVDETVPDPLPGHVTELVKEYKALATSWLRKRGAWQVVDRVQAIDDVSALADNSGYSPFLSTDQKVELLETADPVARLKLATEQLREHLAEQDVAESIAKDVQEGVDKQQREFLLRRQLEAVRKELRELNGEQDGEESDDYRARVEAADLPEKVREAALKEVEKLERASDQSPEGSWIRTWLDTVLELPWNERTEDAYDIQGAKAILDAEHAGLEDVKERITEYLAVRKRRQDRGLGVVGGRRGGAVLALVGPPGVGKTSLGESVAHAMGRKFVRVALGGVRDEAEIRGHRRTYVGALPGWVVRAIKEAGSMNPVVLLDEIDKVGSDFRGDPAAALLEVLDPAQNHTFRDHYLEVELDLSDVVFLATANVLEAIPEALLDRMELVRLDGYTEDEKVVIARDHLLPRQLERAGLEKDEVTLDESALRKLAGEYTREAGVRNLERAVARLLRKVAAQHELGERKLPFTVADADLRGLIGRPHHVPESAQDPAERRTAVPGVATGLAVTGAGGDVLYVEASLADPETGAAGLTLTGQLGDVMKESAQIALSFLRSRGAELELPVGDLKDRGVHIHFPAGAVPKDGPSAGVTMTTALASLLSGRPVRTDVAMTGEVSLTGRVLPIGGVKQKLLAAHRAGITTVVIPKRNEPDLDDVPAEVLEKLDVHAVTDVRQVLELALSPATNGAAPEVPVAA

SEQ ID NO: 10504 - protein, 289 aa, Streptomyces avermitilis
VFALSDHRKSPDARRPQGCGGAEVLPGEPGASPRNSEDRRARPRYSHSVIPKQLKWPLPGVTVNELVRTWVDGWVVSRGAAPPVVEPWGYTVDVGQPEHITRHVLAATNDGVERAAVRKVAGAVTGAGVWLKVFADPAVVGPWLGEGWWVDPEPAHLMSVSLKPVSLRGAEACAGAAAADRAVPEGYRLRAWSRGGVTRVIVAAPDGSWAARGQTAPTGATAVVDQIETSPAHRRRGLGTLVLRALARAAVDQGAETGVLAGTPEGRALYETLGWTVAAPLTSAKFTGA

SEQ ID NO: 10505 - protein, 316 aa, Streptomyces avermitilis
LRVVSVIDSDAMRHEVWGATEGAPHVDRTVDRAVATADAALMAPESGAPPLDGLPRQRTTPLAVPPSAGAVPSPASAPSSSAGPAPVPPSVARSVPRRLPRLWLLLPSPLGTPFTLAYALVLVATSLVAEYADPSFVHVLHQASSTDVAHLMRDPLLVLVASALWVAGGVTSPYALGFLLVLTALERRTGGRRTAGVFLLGHVLATLATEVPVGFAVLAGHLPGSSLHRLDYGISFGVAACVGALAGLLTPWPRCTILVVFGGSLVADLVEFADPMTDWGHLMALSIGVGMWPVVRRWQRARTSSRPAAAANASDC

SEQ ID NO: 10506 - protein, 225 aa, Streptomyces avermitilis
MTTSYDSPVVIDRREGPHGEVVLRRHGTLLQIIANGCFLMDTSDGRSERLLVDAARDALDERPEPSVLIGGLGVGFSLAHAAADARWGRITVVERERAVIDWHRDGPLSTLSAPALADPRTEIVEADLVAYVNETSATYDALCLDIDNGPGWTVTEGNDSLYSKAGLAACARVLKPGGVLAVWSAQPSPDFEGTLRNAGFLGVRTEEVPVARGVPDVVHLAVRPG

SEQ ID NO: 10507 - protein, 245 aa, Streptomyces avermitilis
MEQTHTSHNGAAATPGAQRRVLVVEDDPTIVDAIAARLRAEGFLVQTAGDGPSAVDTAEAWQPDLLILDIMLPGFDGLEVCRRVQAQRPVPVLMLTARDDETDMLVGLGVGADDYMTKPFSMRELAARVHVLLRRVERAVVAATTPRTGILRLGELEIDHAQRRVRVRSEDVHLTPTEFDLLVCLANTPRAVLSREQLLAEVWDWADASGTRTVDSHIKALRRKIGAERIRTVHGVGYALETPTP

SEQ ID NO: 10508 - protein, 368 aa, Streptomyces avermitilis
MSDGPAARRGPGDPWGGVRPFSIKTKLGALVVISVLITTGLSMIAVHTKTELRFITVFSMIATLLITQFVAHSLTAPLDDMNTVARSISRGDYTRRVRENRWDELGDLAHTINLMADELEAQDRQRKELVANVSHELRTPIAGLRAVLENIVDGISAADPETMRTALKQTERLGRLVETLLDLSRLDNGVVPLRKRRFEVWPYLSGVLKEANMVASARASLATGSGSHTRTDVHLHLDVSPPELTAHADPERIHQVVANLIDNAVKHSPPHGRVTVKARRGPAPESLDLEVLDEGPGIPESEWHRVFERFNRGAVSAPHGPGSDGGTGLGLAIARWAVDLHGGRIGVAESQRGCRIQVTLPGLPSLPS

SEQ ID NO: 10509 - protein, 1276 aa, Streptomyces avermitilis
VSPQSPSNSSISTDDQAGKNPAAAFGPNEWLVDEIYQQYLQDPNSVDRAWWDFFADYKPGAAAASAPAGTAAAGAAETTTPAPAAPTAAAPAAPAAPAPAAPAPAPAAPAPAAAPAVPKPAAAAPAPAAAKPAAAAPAQPKAAAATEAAEGPTFVPLRGPAAAVAKNMNASIEVPTATSVRAVPVKLLFDNRIVINNHLKRARGGKISFTHLIGYAMVQAIKAMPSMNWHYAEKDGKPTLVKPAHVNFGLAIDLVKPNGDRQLVVAGIKKAETLNFFEFWQAYEDIVRRARDGKLTMDDFTGVTVSLTNPGGLGTVHSVPRLMPGQSVIMGVGSMDYPAEFQGTSQDTLNKLGISKVMTLTSTYDHRVIQGAASGEFLRIVANFLLGEGGFYDEIFEALRIPYEPVRWLKDIDASHDDDVTKAARVFELIHSYRVRGHVMADTDPLEYRQRKHPDLDITEHGLTLWDLEREFAVGGFAGKSLMKLRDILGVLRDSYCRTTGIEFMHIQDPKQRKWIQDRIERSHSKPEREEQLRILRRLNAAEAFETFLQTKYVGQKRFSLEGGESVIPLLDAVIDSAAESRLDEVVIGMAHRGRLNVLANIVGKSYAQIFREFEGNLDPKSMHGSGDVKYHLGASGTFTGLDGEQIKVSLAANPSHLETVDPIIEGIARAKQDIINKGGTDFTVLPVALHGDAAFAGQGVVAETLNMSQLRGYRTGGTVHIVINNQVGFTAAPESSRSSMYATDVARMIEAPIFHVNGDDPEAVVRVARLAFEFRQAFNKDVVIDLICYRRRGHNESDNPAFTQPLMYDLIDKKRSVRKLYTESLIGRGDITLEEAEQALQDFQGQLEKVFTEVREAISTPGEAPAPEPQPEFPVAVPTAVSQEVVKRIAESQVNIPDHVTVHPRLLPQLQRRAAMIEDDTIDWGMGETLAIGSLLLEGTPVRLSGQDSRRGTFGQRHAVLIDRVTGEDFTPLQYLADDQARLNVYDSLLSEYAVMGFEYGYSLARPDALVMWEAQFGDFVNGAQTVVDEYISAAEQKWGQTSGVTLLLPHGYEGQGPDHSSARIERFLQLCAQNNMTVAQPTLPSNYFHLLRWQVHNPHHKPLVVFTPKSMLRLKAAASKTEEFTTGAFRPVIGDDTVDAAAVRKVVFCAGKLYYDLEAERKKRGATDAAAAETAIIRLERLYPLPGAELQAEIAKYPNAEKYLWAQEEPANQGAWPFIALNLIDHLDLAVGADVPHGERLRRISRPHSSSPAVGSAKRHQAEQEQLVREVFEA

SEQ ID NO: 10510 - protein, 1330 aa, Streptomyces avermitilis
VDERPEGGDAQGAREGRDARGDGEPDEVVSGELLPYDDIAGVAAASVGLHALADDLAGERRELAVELRKFFVVLRLSVRRYAALRPYSPSSVSRYLSGDLVAPDHFVATLMDDVGRELGRPLSAQARGRVTGLQRAALRSSNSRAWKVQELEDRLAAAHQDAQVARTQADAVATLLHAERQRVAGVEEERQELARTLEAHQATSGAELDVLRAQQHRVRAERDTLRRRVADLEAALAAAEHRVAEAEQRCADLEHELLTADAAAAAEESAAAEQERARQQAELGSLRDEVARLRVAAERVPETSPARGTQAPRTSVHGAEADATGPVSGDRSAAAPADVPGAASSVTIVYAGFNRAWAAWIGDRLERWGVRAVLMLWDVPADIPLIDLLRDLKLAEGRILIVVSEWYFQLGLRSHDEWNEALREVVAPDPSRFVAVSVTNAPVPSAAAVLAAVDLTDTGADEAERRLLARLVGLPGDSLPAASGGERRGPRFPAATPEVWGGVPRRNTRFTGRESLLSDAYSLLKGAEPGAGVLTLHGMSGVGKTQLAVEYVYRFSSEYDVVWWVGADNRGVFRQTLAELASRLGLSTGAEYGERLRAVRDSLRRGDPYARWLLILDGADDPDQIEDLVPTGPGHVLITSRNLKWGEHNSELLEVPVYDRPESVAFIRRRAPRLAEADADRLAEALEDLPLLLDQTAGWLNDSDLSVGEYIALLDGGIDQDVVKVSADFPIAFRTAWSILLNKVRETVPEAVDLLRLCTFFAPGLIPVRFLREMPHNELPETITGLLNDRLLWNKAIHQLRQYSVVRLESHEAATDGSTSSGESLYLHRMVHQIVRNDMPEDERHEFAAVVRRALASADPGRPTDTRHWGEYAEIVPHLKYADVLDSPDPGVQRLVLNCLGYLHLSGRYAAGVELAERALEAWRELLGDTHPVIWELTAHHTNLLRSTGDYRRTEAVDRAAVEHLREERGELDPDHLRAAAGLAADLRGLGRYGEALELTRRLLTSCLDLLGEQDSRTLDAQHDLGFSLRLLGRYEEALDVDRRTLEARRALLSGRHPGILLSETSCATDLRLLGHYAEAESAQATNARAQRAVMGSDNPQTLRAEHNLALCQYRAGDREKAGKLFSRVLERYERTLGETDPLTLAAAVSQSCFAREYGDIDQAGAASESLIARYEAMLTDGHPFTIGARANHVLLLRQVGARDEARFGAEKALTAMAAAMGESHPWTLGCAINAAAVRQFIGDVESAAELSGSTVARATDALGRTHPLTLSARVAQAADLRGLREHRRAEEIEQEVLADLAATLGSRHVHTVSARSRNRPYWDFEPQPT

SEQ ID NO: 10511 - protein, 54 aa, Streptomyces avermitilis
LTHQVAHLRAHTRKETLMNRKHALKASLALLGAAVSGGVRAVVSWLLQIGTDGS

SEQ ID NO: 10512 - protein, 107 aa, Streptomyces avermitilis
VRVSAGLPVRGPGHPCERGPPGRAYPGETAGYCVPAGPACPHLTESTLYFTDRGIEELEKRRGEEEVTFEWLAEQLRTFVDLNPDFEVPVERLATWLARLDDEDDEE

SEQ ID NO: 10513 - protein, 389 aa, Streptomyces avermitilis
LGTFTPFTPQVFTRTGVLTFDIRDISCLGRDRKTRYDVSHPAPAEEVCTMSEWSVAEPRKLTFDDPVTALHVRIVNGTVNVVGTEEGSARLEVSAIEGPPLTVTQKGGTLTVAYDDLPWKGFLKWLDGKGWRRSAVVSLAVPMSTRVEVGVVGAGAVVSGIDGPAEVKGVTGDTTLVRLSGPVHASTVSGSVEAQGVTGDLRFSSVSGDLTVVEGSGPSVRAESVSGSMIVDLDPADRPTDIHLSNVSGEIAIRLPHPADMEVEANTTSGTVSNAFEDLRVSGPWGAHKITGRLGSGSGKLKAMTVSGSIALLRRPQAEDEPWDAEPPTPGDAPRPKDMPRPKDTPRPKDTPRPEDAHQPEDTRRTASVPKDAVPDEDSTDGPTEKKGL

SEQ ID NO: 10514 - protein, 358 aa, Streptomyces avermitilis
MPPVFAHGRLRLYLLKLLDEAPRHGYEVIRLLEERFQGLYAPSAGTVYPRLAKLEAEGLVTHTTEGGRKVYAITDAGRAELADRQGELADLELEIRESVAELAAEIRADVRGAAGDLRREMRAAATEARRGPEAGAKDDGRHGEYGDKESWRVAKEEMRRVKQEWKEQARRAKDESRRAREEAQRARHQAKEAQEHARAQAQEELQRIARRVQEQVQDHFARGDWPTGVRDGLSELAKEFGEFGKDFGREFGKDFGFGRTETKEGPRTPADAGTGPTAGAEYSVTPEDFPADYEPAWAHEDSTGDPARDLDRLLDRFRDDIRDAARDHGVTEEQLRYARRHLSTAAAHLGATLRTPKA

SEQ ID NO: 10515 - protein, 188 aa, Streptomyces avermitilis
MFERFTKDARAVVTGAVGHCERAREEKVDEAHLLLALLDREASRGSFALASLGLAGRRSEVERDLAEARRRGGLSRADAEALTGLGIDLTEIVSRVEEAHGAGALAVGGTGGGRRGAGRRPFTRGAKDLLTESLRIAVAHRDRHIGDEHLLLALTARPGVPAEVLADHGVTYEAVTRVLYGGGAAKAG

SEQ ID NO: 10516 - protein, 69 aa, Streptomyces avermitilis
MTEATDLAERAGDRDPRIGLRAVSALRRLLEQLEAVQVRSARNQGWSWQEIAAELGVSRQAVHKKYGRQ

SEQ ID NO: 10517 - protein, 321 aa, Streptomyces avermitilis
MFAAYAARIDRDQPLSGLELGERPAPEQRPGWTTVKVRAASLNHHDLWSLRGVGLSEDKLPMILGCDAAGVDEDGNEVVLHSVIGQTGHGVGPNEPRSILTERYQGTFAEQVSVPTWNLLPKPKDLSFEEAACLPTAWLTAYRMLFTNAGVRPGDSVLVQGAGGGVATAAIVLGKAAGLRVFATSRDEAKRKRAVELGAVEALEPGARLPQRVDAVIETVGAATWSHSVKSLRPGGTIVISGATSGDRPSHAELTRIFFLELKIVGSTMGTKDELEDLLSFCAATGVRPVIDEVLPLDRAREGFERLESGDLFGKIVLTTT

SEQ ID NO: 10518 - protein, 407 aa, Streptomyces avermitilis
VAAEIVNPRSDSSTDQEGGAEPLDSFDPAFALHRGGKMAVQATVPIRDRDDLSLAYTPGVAKVCTAIAEQPELVHDYTWKSSVVAVVTDGTAVLGLGDIGPEASLPVMEGKAILFKQFGGVDAVPIALGTTDADEIVETVVRLAPSFGGVNLEDISAPRCFEIERKLQERLDIPVFHDDQHGTAVVTLAALRNAAKLTGRTLGELRAVISGAGAAGVAIAKFLLAAGLGDVAVADRKGVVSKDRDDLTPVKRELAEITNKAGLSGSLESALAGADVFIGVSGGTVPEPAVASMAEGAFVFAMANPNPEVHPEIAHKYASVVATGRSDFPNQINNVLAFPGIFAGALQVRASRITEGMKIAAADALADVVGDDLAADYVIPSPFDERVAPAVTAAVAAAARAEGVARR

SEQ ID NO: 10519 - protein, 319 aa, Streptomyces avermitilis
MTASTIRRSTAIRSRIAAVGAIAVAGTLLLTGCGDQTKSKSNESGSSSSGSAPLADKLPESVRNAGVVKVGSDIAYAPVEFKDNSGKTVGIDPDLAEAMGKQLGVKFEFQNGTFDTLITGLRSKRYDIAMSAMTDTKDRQEGVDSTTGKKVGEGVDFIDYFTAGVSIYTPKGKTQNIKTWSDLCGKKLVLQRGTVSEDLAKSEAKKCPSGKTISIQAFDNDQQAQTRLRAGGADAGSSDFPVAAYAVKTSGGGKDFQIVGEQVEAAPYGIAVAKSNTQLRDALQAALDAIIKNGEYDKIIAKWGVEDGSVKAAQINGGK

SEQ ID NO: 10520 - protein, 312 aa, Streptomyces avermitilis
VTVDIDKTTGPEGTPPGGPEAIKAIPVRHYGRYVSAVIAIAILIAIIYAFGQGKINWHAVPDYFFDDRILTGVGKTLLLTVLSMLIGIVGGILLAVMRLSKNPVTSSIAWFYIWFFRGTPVLVQLIIWFNLGLVFEYINLGPIYKDYWSSFMTPLLTALLGLGLNEAAYMAEICRAGLLSVDEGQTEASHALGMSHNKTLRRIVIPQAMRVIVPPTGNEVINMLKTTSLVSVVQYPELFRYAQDIGQTSGAPVEMLFLAAAWYLIMTSVLSIGQYYVERYYARGSSRSLPATPFQKIKANMLSLGRPRGGTA

SEQ ID NO: 10521 - protein, 263 aa, Streptomyces avermitilis
MTANVTKTDATTPMVKSEGVHKSFGAVEVLKGIDLEVKTGEVFCLIGPSGSGKSTFLRCINHLEKINAGRLSVDGELVGYRQKGDKLYELKDSEVAVKRRDIGMVFQRFNLFPHMTALENVMEAPVQVKGVSRAKARERAGQLLERVGLADKAKNYPSQLSGGQQQRVAIARALAMDPKLMLFDEPTSALDPELVGDVLDVMRDLAESGMTMIVVTHEMGFAREVGDSLVFMDGGVVVESGHPRDVLTNPQHERTQSFLSKVL

SEQ ID NO: 10522 - protein, 261 aa, Streptomyces avermitilis
VRPSEEGASMTTTTGTDWHAWQESWDRQQEWYMPDREERFRIMLDMVEALVGPEPRVLDLACGTGTITARLLARLPNATSTGVDLDPALLTIAEGTFAGDERVSFVTADLKDPEWPARLPYDAYDAVLTATALHWLHSEPLAALYGQVAELVRDGGVFMNADHMIDESTPRINAAERAQRHVRMDQAKADGALDWAEWWALAAQDPVLAAPTARRFEIYGEHADGDMPSAAWHARVLREKGFGEARPVWRSPSDTLILAVK

SEQ ID NO: 10523 - protein, 209 aa, Streptomyces avermitilis
VELAYYSDYAVRLVNSEEPARGKDALTSVEAVRDLFGGNASAARRATDADVTRFRSVRARLRAVFEAADGGDETLAVDLLNSLLLEFPVSPQISGHDHRDDDGRPLWHMHLADHPSNATAGYAAIATMGLAFHLTEYGVDRLGLCEAAPCRNAYLDTSTNRSRRYCSDRCATRANVAAYRARKRLEADRTESTGRAAESAQSASANGER

SEQ ID NO: 10524 - protein, 144 aa, Streptomyces avermitilis
MPELSQETERGRAVLPFGAAEVTGPSMVPTLQHGDRLLLQYGARVRPGDIVVLRHPFQQDLLVVKRAVERREGGWWVLGDNPYAGGDSTDYGTVPEEFVLGKVRFRYRPRKEGQRSPFALALWALSAARPVLSVRSASRRLRAR

SEQ ID NO: 10525 - protein, 131 aa, Streptomyces avermitilis
MLSRLFAPKVKVSAHCDLPCGVYDPAQARIEAESVKAVQEKMAGNDDPHFQARATVIKEQRAELAKHHVSVLWSDYFKPPHFEKYPELHQLVNDTLKALSAAKASTDPATGQKALDYIAQIDKIFWETKKA

SEQ ID NO: 10526 - protein, 169 aa, Streptomyces avermitilis
VHDTKNQDVNEELNDELAEKPGEEAHAELDVDAFTTAIENFNRFYIRLPMLEKLSFTTLSVLDTLAFGGSPMRLTDLARTEQVSQPGITQLVTRLERDGLVERRSDPSDGRAVLVHITEAGRKIGRSRHEDRTRHLTPLVAQLAPEQRQAIADALPALARLAEIGRGRP

SEQ ID NO: 10527 - protein, 334 aa, Streptomyces avermitilis
MTVRVGINGFGRIGRNVFRAAATRGADLEIVAVNDLGDVATMAHLLAYDSILGRFPEEVTAEPGAIRAGDTTVKVLAERDPAALPWGDLGVDVVIESTGIFTDAAKARAHVDGGAKKVIIAAPASNEDVTVVLGVNQDAYDPERHTIISNASCTTNCLGVLAKVLHDAVGIESGMMTTVHAYTQDQNLQDAPHKDLRRARAAGLNIVPTSSGAAKAIGLVLPELQGRLDAFALRVPVPTGSVTDLTVTASRSTTVEEVKEAYAKAAAGAYKGLLSYTEAPIVSTDIAGDPASCVFDAELTRVLGSQVKVVGWYDNEWGYSNRLIDLALLVGDTL

SEQ ID NO: 10528 - protein, 311 aa, Streptomyces avermitilis
MALRPQCAVVFDCSTTATEVSQGDESVTNVTGDYTDCTPLLGDRAALDSFYEEHGYLFLRNVLDRDLVKTVAEQMREGLVALGAADPHATLEELTIDSFESVDEVAMHDYVKYDAFWNNPSTIKVFEQVFGEPVFVFLSTTIRYYPSQAGSEEPSFHYLTPFHQDGFYIGPNQDFRTFWIPLIRTTRESGGVALADGSHRRGKRDHVLNESFRRFGHPVRGIPPTEVSEDEHLLHSPMEPGDILLFHAHMCHKSIPNLSKDPRLMRMSMDTRVQPAKSHRGFNAMTPWTESAKDASKGIMAKITGTPTDVE

SEQ ID NO: 10529 - protein, 484 aa, Streptomyces avermitilis
MDLTSETSPAGGPVEKEDLVRQGSDKPAGLSGAGLAVILTGFALSIADFFIVNVALATVKHDLHASDAELELVVSGYGITYALGLVMGGRLGDAFGRRRLFRDGLIAFTITSALCGFAPNVTFLIAARLLQGAAAAMLVPQVLGTIQAATDGASRARAISLYGATAGIAAVAGQIIGGFLLMLDIGDSGWRSVFMINVPIGLVALLLVRRMPATKADRKPGLDLLGTALFGVTMVCVLMVIVEGRSLGWPVWLWSLLVVAAVAAVTLVRVERGLEARGGSPLLPPSILARHSMRTGLMAVVPFSIGFGSFLFVYTLVAQDKLGLGALASAGVLSPFASSFFVVSLFTPKITARIGRRIVSVGAVVQGTGLLLLALLIGVEWPHLPLLLVLAVLAFTGIGQALIGPTLLRMVLADVPPASAGTGSGVLVTSQQTATALGVTVGGTLYLTLASSLGDASGAVLVLVLLALFSAVIFALSLRLPEPR

SEQ ID NO: 10530 - protein, 270 aa, Streptomyces avermitilis
MHLQPSTAVVTGAASGIGFALSARLAQAGARVVMTDIAGDGLAGAVEELAAHGADVTAVVADLTDPAAVQELADTAFGRLGDIDVVCNNAGVVGPVGMPLWSVPLDEMHAVFDVNYWAHVHVARAFVPRLLDSGRPSHLVQTASMSAFVVGAGTASYAASKHADLAAARSLRADLDGTPVRVSVLCPGRVDTPMTRGLVAPRNATGNTTISADEAADAVWNALGSDRFYIFTNADAQTRLGDQFNDVWRHLAREKYWTESSSPSVNSSRP

SEQ ID NO: 10531 - protein, 594 aa, Streptomyces avermitilis
VVDIEAVRAKYREERDKRVQADGGRQYLSAQGEFAHYADDPHAKPIERAPVSDEVDVTIIGAGIGGLLLGARLREACAFDTIRLVDKAGDVGGTWYWNRFPGLRCDVESYVYMPLLEELGRLPSEKYATGAEIFEHCQAIARTYDLYDEALLQTSVTELSWDEDSSRWLVRTDRGDLVRSRFVAMAIGSLHRPKLPSIPGTEAFQGHSFHTSRWDFAYTGGDISGGLEKLGDKRVGIVGTGATAVQCIPHLAESAAHLYVFQRTPSTVSVRNNRPTDPGWAAGLEPGWQQRRMDNFHALTSGVDQDVDLVQDGWTEITSKLAAILPKSAADADPKDIGTAVELADFHKMEELRKRVDAIVHDKDTADALKPYYRLFCKRPCFHDGYLDTYNRPNVTLVDTQGRGVERLTPTSVVAGGREYPVDCLIFASGYESEFGVPYTNRTGFSIVGRDGIRLSEKWAEGARTFHGLQVNGFPNCFILSKAQSGLHVNVPYMLNEQSKHVAYILKAVQQRGRQVVEASATGEKEWVETILRLANRNLDFTESCTPGLFNNEGNPRNVAILNSSYGGGSVGFVNILKRWREADDLADLELREG

SEQ ID NO: 10532 - protein, 306 aa, Streptomyces avermitilis
VSRAMDITRIPGSAIGAVVAGADFSGTIDDTQVEEIWQALDQHLVLVFRGHKDPSNDDLLMFARRFGHVPKTGLTTGASPDHNEILLISNILDENGQKIGVGNAEWMDWHTDYSFRPRVSRIGFLAAVELPPSGGGQTLFTDMYTAYESLPDDLRQRLHSYRARHSLRSGYEDVIEEEYQGEVSIEGPTAKPFVAPEDGTATVHQLIARNPRTGRRAVYANPLNTKRILELDVTSSKEVLQQLFAKPGEPELTYAHEWLPGDIVMWDQLGTVHAKRAFDPTERRLLRKVVTIFDDPAEPWHPEDAA

SEQ ID NO: 10533 - protein, 58 aa, Streptomyces avermitilis
MEQTVRSGNGAAGGILGHSSAGLRNDRHDGALTPGAAPQRSSTVDPVHLVDPVKGVAS

SEQ ID NO: 10534 - protein, 337 aa, Streptomyces avermitilis
MTVTPESLHRSRDAITPALRTALHLLDEETRHQAAYHLGWIEADGTPADGGGGKAVRPALALLSAQAAGAPAETGLPGAVAVELVHNFSLLHDDLMDGDEERRHRRTVWTLWGASGAILTGDALLALAQEVLLDCGLPTGAAAARLLARTTRDLIRGQVQDVAFERRAHVPIEECVDMAAGKTGALLSASAAIGAVLAGAPVTTVDALALYGQQVGLAFQLTDDVLGIWGDPAVTGKSVHSDLRARKKSLPVTYALNQGGTVSVELATWLSAPGEPDEAELRRAADLVAAAGGRDWATAEAARRMALGEAALRGVDLDAAARDELIALGHFVVDREV

SEQ ID NO: 10535 - protein, 336 aa, Streptomyces avermitilis
MPQDVDFHIPFPSRRSPDFERARADHLSWPRALGLIGTDAAAERHSRGGYADLAARFYPSATGADLDLGVDLMSWFFLFDDLFDGPRGEDPQETRKLTDAVAAALDGPLPTSAPPIAHGFADVWRRTCQGMSPAWRARSARHWRNYFSGYVDEAVSRHLNTPYDSAGHYLAMRRQTIGVQPTVDLAERSCHCEVPQRVFDSAVLFAMLQIATDTNLILNDIASLEKEEARGELNNMVFILMREHGWTRGRSIAHMQDGVRTRLEQFLLLEACLPKVYDTFELTAQERESAEKYRMDGVRSVIRGSYDWHRSSGRYAADYAIAASYQGYLEELGSTL

SEQ ID NO: 10536 - protein, 449 aa, Streptomyces avermitilis
MSQHTFVAGTAPGAVPVVGHAWQMMRRPLHFMSSLSAHGDLVKIRIGPTSAYVPCHPELLRQVLTNDRVFDKGGVFYDRARDIAGNGLVTCPYRDHRRQRRLMQSAFQRTQLERYSTAMRAEIDATAARWHDGTVIDAFPELYGMALRTVARTLYSTPVTEELAQRVEQAFDTVLNGLFRQMFLPHSLRRLPTPANLRYRNNLRFLHDTVQDLITEYRRDDTQRDDLLSALLASRDEDGGRLGDTEIHDQVITVMAAGTETVAGTLTWIFHLLSRHPEIEARLYEEIDTVLDGKPPHWDDLPSLSLTDRIITEALRMYPPAWIFTRLTASDVDLAGVRLPEGTTIVFSPSSVQRHSEAYDDASRFDPDRWLPDRTSAVARQAFTAFGTGARKCIGDLFARTEATLALATMLSQWRVTVEPDADVRPVALATVYHPRRLRLRLTARTPGQ

SEQ ID NO: 10537 - protein, 153 aa, Streptomyces avermitilis
MANLEDLVRLRKARDRMDREYAEQLDIAALARTALMSPGHFQRSFRAAFGETPYSYLMTRRIERAKALLRRGDLTVTEVCLAVGCTSLGSFSSRFTELVGETPSAYRARSHEHGAPIPPCVAKGLTRPRRGRPVYGRADTAGGTWTTGPSVTS

SEQ ID NO: 10538 - protein, 144 aa, Streptomyces avermitilis
MNMDTDPGVMLSQCFIAVDDHDKALAFYRDVLGLEVRNDVGFEGMRWVTVGSPLQPDVEIVLEPPGANPDASEADRQAMAELLAKGMLRGVIFSTPDCDALFARVEASGAEVLQEPMDQPYGVRDCAFRDPAGNLLRFKQRSAA

SEQ ID NO: 10539 - protein, 256 aa, Streptomyces avermitilis
MAPVRPGRERSMSEPIRWAYAFVDRPAAEFVRAVDFWTAVTATERSESRGDQGEFVSLLPGAGDACVKAQGVRDGTGGAHLDLAVANVPALVGAARRLGAEVVAEHPGWAVLRSPGGQLFCAVPWHGESARPPVVEGSRLDQLCIDLAPAVYDLDVAFWSDLTGWTSHPGALPEFHLVRPPEGLPIRILLQRLGTDRPTSAHLDLACADIEATRVRHEELGATLVARGARWTVLRDPAGGTYCLTARDPETGSLPA

SEQ ID NO: 10540 - protein, 115 aa, Streptomyces avermitilis
MSEPLLHLTERSLWDAARDRGTYEMATRGRTLQEEGFIHCSLRHQLPGVAALLYGSRAGSDELVVLVVDAERLAAPVRYEAVGPGGEEFPHVYGPIPVSAVVDVEVWTGGEAASA

SEQ ID NO: 10541 - protein, 71 aa, Streptomyces avermitilis
MGSDEYACPSCGQPVGTVVRRHKTLGAFVPVWGPAPCRNPRCTAYVPGGGAAAERPGPPEAPPEAPAAKAP

SEQ ID NO: 10542 - protein, 196 aa, Streptomyces avermitilis
MGVAIRTAGEGDREAVVRLLDEAFQHDPVSSWVFPGEAYRRATHHRLMAAFTDIVLGEGRVDLTEDGTACALWLSLPADAHDEEDGPARLREAVDPDNDRVELIGRLTSGIHPSGRAHAYLWMIAVAPGRQGEGLGTALMQPVLDRCDRAGLPAYLEASSARSRKLYERLGFVSTTPALDLPDGPRMWPMWREPRS

SEQ ID NO: 10543 - protein, 394 aa, Streptomyces avermitilis
MGEFLTEAKQSPAEVLERRSPAGPAGRRGPLPAPSTGRQAPAASPPTDPQGPAAQLDGQEAAGILERARASVDPELRRAVDSLPGSMRRIALHHFGWEHADGTPAAGNAGKAIRPALVLAAVRALGGPQSSAVRAAAAVELIHNFTLLHDDVMDRDTTRRHRPTAWTVFGDADAILAGDALQALAHRLLAEDPHPASAAAAARLAACVIELCAGQHADTAMERRGPGEVTLDECLAMAEAKTGALLGCACALGALYAGAEEEDVEALDAFGREAGLAFQLIDDVIGIWGDPSRTGKPAGADLMARKKSLPVVAALAAGTPAAAELAELYAVPHQEGELERTVLAVERAGGRDWAQQQAADRMARAMHELSRAIPDPEAAGGLLALAEFVTRRSN

SEQ ID NO: 10544 - protein, 468 aa, Streptomyces avermitilis
MSVGEEVRAEQGRPQQSLGTSAARNLATTTKSAPQMQEISSRWLLRMLPWVNVQGGTYRVNRRLSYSVGDGRVTFVKTGDRVQVIPAELGELTLLRTYEDQEVLGELAQRCEQREFAPGEVLASFGSRADEVFLLAHGKVEKVGTGPYGDDAVLGVLADGAYFGEQALIDPEAIWEYTARAVTACTVLTLPRRDVDQVAERAESLRDHLQQARAIPEQRTNKYGEKEIDLAAGHTGEPDIPGTFVDYEATPREYELSIAQTVLRLHTRVADLYNQPMNQTEQQLRLTVEALKERQEHELINNREFGLLNNCEYDQRLQPHDGVPGPDDLDELLSRRRGSKLFLAHPRAISAFGRECNRRGLVPESVEIAGNRIPTWRGVPIFPCNKIPVSDTRTTSIICMRTGEDEQGVVGLQQAGIPDEIEPSLSVRFMGINEQAIISYLVTAYYSAAVLVPDALGILENVEIGRWR

SEQ ID NO: 10545 - protein, 225 aa, Streptomyces avermitilis
VGRPVAFRVQASVRGGRDGRPSRSAKEAVMAPPMSAGSFLDRLREEGVTVVEVGDWEHHNRNHKGPWGPVHGVMIHHTVTSGSEHTVELCRDGYEGLPGPLCHGVITKDGVVHLVGYGRANHAGLGDDDVLRAVIAEKALPPDNEANTDGNRHFYGFECENLGDGTDPWPDAQLEAIEKVSAAICRHHGWSERSVIGHLEWQPGKVDPRGFTMTWLRERIRDRLK

SEQ ID NO: 10546 - protein, 311 aa, Streptomyces avermitilis
VSDNGGVTGPDVPEALDLAALRPRLPSPVQAVDDERFARHGVRLLLKRDDLIHPDLIGNKWRKLAPNLRAAAGRPLVTFGGAYSNHLRATAAAGRLLGLATIGVVRGQELADRPLNPSLTRCAADGMRLHFVDRSTYRRKTEPGTLAAILRAVAAEDAYVVPEGGSNSPAVRGCRALGEELRGHADVVALACGTGGTLAGLAAGLGPGQRALGVPVLKGDFLTAEVTALQERAFGGRQGAWSLDDRFHFGGYARTSPGLHAFAADFERRHGLPVERLYVAKMLYGLVALAEEGGFARGTTVAAVITGRPLG

SEQ ID NO: 10547 - protein, 533 aa, Streptomyces avermitilis
MDVLPLLLLVAGSAAVAGAARRTPVPAPLLLVAAGLIASYIPGVPEYTLDPEVVLPLVLPPLLYTAASDSSYLDLRAQLRPVALLSIGYVLFATLVVGWAAYLLVPGLPLPAALVLGAVVAPPDAVAATAVARRVGLPSRITTILQGESLVNDATAITAYKVALAAAVGEGATWAHGVGEFLLAAVGGVAVGLLLMVPLHWLRTHLKEALLQNTLSLLIPFVAYGLAEWAHASGVLAVVVVALYLGHRNYEVDFATRLQEEAVWKMVAFVLESAVFALIGLQLQVVLKGLGEYRGVDAAWYAVAVFLVVVLARFVWVYPATFLPRLLSARIREREENPTWKAPFIIGWAGMRGVVSLAIAFSIPLTVHGQGKGPFPGRNLILFLTFTTVIGTLVVQGLTLPPLIRLLRLPGRDAQAETLAEANAQAQASRVAELRLNDLLDDERNALPPPLADRLRDVLERRRNAVWERLGAVNPVTGESVDDTYRRLSREMIAAERSVFVRLRNGRYIDDEMLRTLLRRLDLEEAAAFREAT

SEQ ID NO: 10548 - protein, 86 aa, Streptomyces avermitilis
MKQCTHADALPHPEPEPLSETCPECLATGTHPVQLRLCLVCGHVGCCDSSPRRHATEHHKETGHPVMRTFEPGESWRWCFVDHVLV

SEQ ID NO: 10549 - protein, 137 aa, Streptomyces avermitilis
VSQIDGEPATQDFVEVRLPAAGAYLSVLRTATAGLAARLDFTLDEIEDLRIAVDEACAILLQQAVPGSVLSCVFRLVDDSLEVTVSAPTTDGHAPSRDTFAWTVLSALAGKVSSAVADDKTVSISLYKQRGAGPGPA

SEQ ID NO: 10550 - protein, 391 aa, Streptomyces avermitilis
VRNGDGPVQDEERGTRELPTEDGGAPCSIGADSLGGGGPSGPRRTADGIDGIPEQARPHPEDHSSAAAEGSQQQEPFGEGGRAARSVPVDGRRDPAGARGEALRTESGGASSKGRRVTGGTMSEHERNAEPSVPSGTQHDPQDRSGARALFIELRMLPDGSPEYAELRNRLVRMHLPLVEHLARRFRNRGEPLDDLTQVATIGLIKSVDRFDPERGVEFSTYATPTVVGEIKRHFRDKGWAVRVPRRLQELRLALTTATAELSQQHGRSPTVHELAEKLAISEEEVLEGLESANAYSTLSLDVPDTDDESPAVADTLGAEDEALEGVEYRESLKPLLEDLPPREKRILLLRFFGNMTQSQIAQEVGISQMHVSRLLARTLAQLREKLLVEE

SEQ ID NO: 10551 - protein, 157 aa, Streptomyces avermitilis
VADGYPAGVSAEQNRVPDTSDAEPRPGRLTAAAALAALEGLALAAGGVWMLVRGVTGDPDDRQQAVTGGITLLVLALLPLLAARGLLLRRGWSRGPAIITQIMALPVAYSLLQADSIAIPAGIALAAVAVTALVLLVNPATTRALGIRRPGNVQDEK

SEQ ID NO: 10552 - protein, 322 aa, Streptomyces avermitilis
MRALLVVNPAATTTSARTRDVLIHALASEMKLEAVTTEYRGHARDLGRQAADSEDIELVVALGGDGTVNEVVNGLLHRGPDPEHLPRLAVVPGGSTNVFARALGLPNDAVEATGALLDALREKRERTVGLGLAAGTPGTEDEAVPSRWFTFNAGLGFDAGVVGRVEQHRERGRRSTHSLYLRQAIRQFLDEPHRRHGTITLERPGAAPVTDLVLSLICNTSPWTFLGNRPVYASPKASFDTGLDILGLSRMSTASVARYATQLLTSSPERGPHGKHAVSLHDLTDFTLHSKAPLPLQMDGDHLGLRTSVTFTGVRRALRVIV

SEQ ID NO: 10553 - protein, 85 aa, Streptomyces avermitilis
MDWRHNAVCREEDPELFFPIGNTGPALLQIEEAKAVCRRCPVMEQCLQWALESGQDSGVWGGLSEDERRAMKRRAARNRARQATA

SEQ ID NO: 10554 - protein, 501 aa, Streptomyces avermitilis
MSEPPGTLADVPSMNELVRQHTALDDSDLEWLHMLVSEWQLLSDLSFADLVLWVPTRDGTRYVSVAQMRPNTGPTSYQDDMVGHLVPRGRRPLLDAALDEGRIVREGDPEWREEVPVRVESIPVRREGRVLGVIARNTNLLTVRTPSRLELTYLQSASDLAQMIAAGSFPFPDQQVDMDASPRVGDGLIRLDGDGIVQYASPNALSAYHRLGLAADLVGHHLGKTSAELAPSRGPVDEALAKVASGWAPREFEIEGEDGVIQLRAIPLKPKGTRIGSLVLLRDVTELRRRERELITKDATIREIHHRVKNNLQTVAALLRLQARRIDSDSGREALEEAVRRVGSIAIVHETLSQNLDERVEFDEIADRVLAMVAEISPGKVTGRRSGRFGILDAEVATPLSMVLTEVLQNALEHGFREGDRGTVEVSAVRGGTTKEARLLVTVQDDGVGLPEGFDPHRSGNLGLQIVRTLVEGELGGTFDMVPAPERGTQVILDIPVRAHK

SEQ ID NO: 10555 - protein, 261 aa, Streptomyces avermitilis
VEVVIVPDARAGGELIAEAMAQLLGRKPEALLGVATGSTPLPIYEALAAQVKSGAVDASRARIAQLDEYVGLPAEHPESYRSVLRREVLEPLGLGMDAFMGPDGTAEDVQGACEAYDKALAAAGGVDLQLLGIGTDGHIGFNEPCSSLASRTRIKTLTEQTRVDNARFFDGDIEQVPHHVITQGIGTILEARHLVLLATGEGKADAVAATVEGPVAAVCPASALQLHPHATVVVDDAAASKLKLADYFRHTYAGKPDWQGI

SEQ ID NO: 10556 - protein, 534 aa, Streptomyces avermitilis
MTTLASGTDTLTRDALTVLQPGFTGTSAPDWLLRRLGEGLASVGLFGRNIASPAQLGRLTAQLRAERDDVLVAIDEEGGDVTRLEVRTGSSFPGNHALGAVDDVALTREVAFELGRRLAECGVNLNWAPSADVNSNPGNPVIGVRSFGADTDLVARHTAAYVTGLQAAGVAACTKHFPGHGDTAVDSHHALPRIDVDASVLHARELAPFRAAIAAGSRAVMSAHILVPALDPDRPATLSRRVLTGLLREELGYQGLIVTDGMEMQAIAGTYGIERGSVLAIAAGADAICVGGGLADDETVRRLRDALVSAVRSGELAEERLADAAERVRALARWTASASVSAQASAAASGSAPEAASDAASAPGGVSTGMGAGAGPGSGAGHDIGLVAARRALTVTCSEAYEPVGEPPFVAVLTPVANIAVGDETPWGVAAELARLLPGTETGSFAGGEGGNGEDTAPAALTAAGDRRIVAVVRDEHRHAWMASALDALLAARPDTIVVEMGVPQATPRGALHIATHGAARVCGRAAAEIIAGH

SEQ ID NO: 10557 - protein, 280 aa, Streptomyces avermitilis
MSAIAVSGRRRSRLGWNLLGLLVFVTAGFPVYWMLNTAFKPAKDAIDPDPSLLPTSPTLDNFHRALDIADFWGPVGRSLIVSLSVVVIGVVVGMLAALAISRFAFRGRKIVIVGILAVQMVPLVAMIIPVFLLLNDLGQYDKLTGLILTYLTFILPFTVWTLRGFIVNIPKELEEAAMVDGCSRTGAFIRVVFPLLAPGMVATSVYGFIQAWNEYLYALMLMSQENQTATVWLGNFTTKHGTEYAPMMAGSTLMAVPIVVLFLLVQRKMAAGLTAGAVKG

SEQ ID NO: 10558 - protein, 329 aa, Streptomyces avermitilis
MSAADTTTPAKVPPPRQAPPPPAVPRKPGRTRTSKDTAVPWALLAPCLLILALVLGYPLVRLVTLSFQKFGQSQLWGFQPPESVGFDNFSLVLGDGEFWAVVVRTIVFAGGSVVFTMVVGMLIALLLQRVSGWVKTLVNIVLVASWGMPIIVATTVFKWLFDSDYGVFNALLSKLPGVDLIGHNWFASGPQGLAVIMLLVVWGAVPFVVITLSAGLTQVPAELEEAARLDGAGAWGVFRYVTLPILKPIIVMLTTLSVIWDMGVFPQVFVMRGGHPEAEFQLLTTYSYDKAFVVNDYGQGSAIALLTVLLLLGVVAVYMRQMLKIGEVE

SEQ ID NO: 10559 - protein, 439 aa, Streptomyces avermitilis
VGRGVCGIPEEGGVKRKLIAAIGIAGMMVSIAACGDNKSGGSDKGADAKELTVWLTVDAQNNWPALVKAADAAVQKKHPGIKIKHEYYGWPDKNTKLDAVLATDKAPDVVEMGNTEMLGYMVKGAFAPVDASKFDNSAAWLDGLKASVTYDGKTYGVPYYAGGRVANWRKDVAASVGVKTPPKTYKELTAALGKIQKKQGSKFSAWYQPTRDWYAAMSFVYDAGGSIAVESGGQWKGNLSSPESVKGLTEFKKVVDTYMHGDKTKDESDRYIVYGQGKSAMIFGAAWEGATSEDPKNDKTGKLKGNLENFVMPGPSGKNIPVFLGGSDLAIPVKSKAQGVAAEWINALTGAKGQKGLMAKGNLPNNKTDLATLKNDPATEVPATAAESNWFVPMAPGWGQVEKAQVLQKMLQNIGTGKKSVEAAAKEADAAIDKVINTK

SEQ ID NO: 10560 - protein, 254 aa, Streptomyces avermitilis
MSTDVSSAENEGGAPIRTARVPKYYRLKKHLLDMTETLPPGTPVPPERTLAAEFDTSRTTVRQALQELVVEGRLERIQGKGTFVAKPKVSQALQLTSYTEDMRAQGLEPTSQLLDIGYITADDTLAGLLDITAGGRVLRIERLRLASGEPMAIETTHLSAKRFPALRRSLVKYTSLYTALAEVYDVRLAEAEETIETSLATPREAGLLGTDVGLPMLMLSRHSLDKDGRPVEWVRSVYRGDRYKFVARLKRPQD

SEQ ID NO: 10561 - protein, 84 aa, Streptomyces avermitilis
MSETPEVKPPVVTPVRVVIALCLIAPFVAMLWVGSYAKVDPTFIGIPFFYWYQMLWVLISTALTMTAYQLWQRDQRARKGGEGQ

SEQ ID NO: 10562 - protein, 538 aa, Streptomyces avermitilis
VNGVALGVFVFFFLAVTVLGFLAARWRKAENEHSLDEWGLGGRSFGTWVTWFLLGGDLYTAYTFVAVPAAIYAAGAAGFFAVPYTILVYPLIFTFLPRLWSVSHKHGYVTTSDFVRGRFGSKGLSLAVAVTGILATMPYIALQLVGIQAVLDVMGVGGGEGTNWFVKDLPLLIAFGVLAAYTYSSGLRAPALIAFVKDGLIYLVIAVAIIYIPIKLGGFDDIFAKAGEAFSQTNPATGKPRGALAPAEAGQWTYATLALGSALALFMYPHSITATLSSRSRDVIRRNTTILPLYSLMLGLLALLGFMAIAAGIKVQNGQLAIPQLFETMFPDWFAGVAFAAIGIGALVPAAIMSIAAANLFTRNIYKDFIKPDATPAQETKVSKLVSLLVKVGALVFVLTMDKTVAINFQLLGGIWILQTFPALVGGLFTRWFHRWALLAGWAVGMVYGTLAAYGVASPTQKHFGGSSKEIPGIGEIGYIGLTAFVLNVVVTVVLTFALKALKAPDGIDETSPEDYTADAGDPGVEVELPPATAGATH

SEQ ID NO: 10563 - protein, 793 aa, Streptomyces avermitilis
VTIAPADPASVTTSVTSAETDGPGTALLRTLTDLTADLPDADPGRVAAAALRGRSARADEAELRELATEAAAGLISEDPAYSRLAARLLTISIAEEAASQGVTSFSASITVGHREGLVADRTADFVRLHTARLDALIDTGADDRFGYFGLRTLHSRYLLRHPITRRVIETPQHFMLRVASGLAEDDTSHAVDEVAALYGLMSRLDYLPSSPTLFNSGTRHPQMSSCYLLDSPLDELDSIYDRYHQVARLSKHAGGIGLSYSRIRSRGSLIRGTNGHSNGIVPFLKTLDASVAAVNQGGRRKGAAAVYLETWHSDIEEFLELRDNTGEDARRTHNLNLAHWIPDEFMRRVNENGVWSLFSPADVPELVDLWGDEFDAAYRKAEEAGLAKKTIPARDLYGRMMRTLAQTGNGWMTFKDAANRTANQTAEPGHVVHSSNLCTEILEVTDDGETAVCNLGSVNLGAFVVGRDIDWERLDATVRTAVTFLDRVVDINFYPTEQAGRSNARWRPVGLGAMGLQDVFFKLRLPFDSPEAQALSTRIAERIMLAAYEASADLAERNGPLPAWEKTRTARGVLHPDHFDVELTWPERWAALRERIAAVGMRNSLLLAIAPTATIASIAGVYECIEPQVSNLFKRETLSGEFLQVNSYLVDELKQLGVWDAQTREALRESGGSVQGFTWVPQDVRDLYRTAWEIPQRGLIDMAAARTPFLDQAQSLNLFLETPTIGKLSSMYAYAWKSGLKTTYYLRSRPATRIARAAQAQAQPEKTIPVQQVSEPDAVACSLENPESCEACQ

SEQ ID NO: 10564 - protein, 338 aa, Streptomyces avermitilis
VMSSETKNLLDPGFELTLRPMRYPDFYERYRDAIKNTWTVEEVDLHSDVADLAKLTPAEQHLIGRLVAFFATGDSIVANNLVLTLYKHINSPEARLYLSRQLFEEAVHVQFYLTLLDTYLPDPEDRTAAFAAVENIPSIREKAEFCFKWINEVEKLDRLETKADRRRFLLNLICFAACIEGLFFYGAFAYVYWFRSRGLLHGLATGTNWVFRDETMHMSFAFEVVDTVRKEEPELFDDELQQQVTDMLREAVEAELQFGRDLCGDGLPGMNTESMRQYLECVADQRLQRLGFAPVYGSENPFSFMELQGVQELTNFFERRASAYQVAVEGTVDLDEDF

SEQ ID NO: 10565 - protein, 169 aa, Streptomyces avermitilis
VSGSWCTGDTSKRQGGHAMRRTTHHRTIALATLTLVLAGCGTQNGSGPGGSGTVSPSPSTTGEGCTAQTELSAADSGRTVCVPTGGVIRLSLDGTRDRPWQPVAVSGGGLEATNSGIVLQPGDAVSAFRAVSAGKARLTSSRPLCVTDPARASCKGLQEWTVTVVVTKA

SEQ ID NO: 10566 - protein, 76 aa, Streptomyces avermitilis
VIGATVVSMNALMDNLAGILTVLVIFVVLALPALIGLAHERRIDRQLREAAGRSHREAGPPQRPQAFVTTTVTVHS

SEQ ID NO: 10567 - protein, 326 aa, Streptomyces avermitilis
MLTNVVAVLLDGVHPFELGVVCEVFGIDRSDEGLPVYEFAVASAEGPTLRTHAGFSLRTEHGLERLETADLITLPAGNSYVSRGYPPELLDALRRAVDRGARLLSVCSGVFVLGAAGLLDGRRCAVHWHHADELARQYPKAIVEPDVLYVDEDPVITSAGTAAGIDACLHIVRKEQGPEVANAIARRMVVPPHRDGGQAQYIERPLPRSPCDTVGEVLVWMEQHLDEEVTVEQLAARAHMSPRTFARRFQQETGTTPYRWILRQRVLLAQRLLEVTDETMDAIAGRTGFGTAAALRHQFVRSLGTTPNAYRRTFRGPATGPLGLAG

SEQ ID NO: 10568 - protein, 456 aa, Streptomyces avermitilis
MTLESVKPEAPEAPQLRNPPLAGGGIPGLGHGWKLARDPLGFLAQLRDHGDIVRLKLGPKTMYAVTTPALTGELALSPDYEIGGPLWESLEGLLGKHGVATANGPTHRRQRRTIQPAFRLDIIPEYGPIMEEEARAFAARWQPGEIIDCTSESFRVAVRIAARCLLRGHYMDERAERLSIALTTVFRGMYRRMVIPAGPLYRLPLPANRKFDRALADLHLLVDEIVAERRASGQKPDDLLTALLEAKDDNGDPITEQEIHDQVVAILTPGSETIASTIMWLLQVLTEHPEHAAKVCAEVESVTGDRTVAFDDVRKLSHTNNVVVEAMRLRPAVWILTRRAVTETELGGYRIPAGADIVYSPYAIQRDPRSYAEHLEFDPDRWLPERSKDLPKYAMRPFSLGNRKCPSDHFSMAQLTLITATVAAKWRFEQVSESSDATRVGITLRPHRLLLKAIPR

SEQ ID NO: 10569 - protein, 363 aa, Streptomyces avermitilis
LFVPAFPHSTSPTTTVIAVPPALSLPVIETDFPRQLHPYWPRLQEKTRSWLLEKRLMPADKVEEYADGLCYTDLMAGYYIGAPDEVLQAIADYSAWFFVWDDRHDRDVIHRRATAWRQLRFQLHTALDSPRDHLHHRDPLVAGFADSMVRLYSFLGKKWNARFACHFHAVIEAYDREFHNRTRGIVPTVEEYLELRRLTFAHRIWTDLLEPSARHEIPAGVREHPGYRRAALLSQEFAAWYNDLCSLPKEIAGDEVHNLGISLIHHEGLTLEEAVTEVRRRVEECIAEFLVAEKEAVHLADGLADGTRAGHELSDAVKACVANMRNWFSTVYWFHHESGRYRVDSWDDRSTPPYVNNEAAGEK

SEQ ID NO: 10570 - protein, 216 aa, Streptomyces avermitilis
MAQQDTDQQHTGVLPVDDDGFVIDAEDCEEREAAYRERGTSRPITVVGNPVLHKECKDVTDFGAELEQLVADMFASQRTAEGVGLAANQIGVDLKVFVYDCQDDEGTRHVGVVCNPKLVDLPADRRRLDDSNEGCLSVPTAYAPLARPDYAEVTGQDEKGNPIKVRGTGYFARCLQHETDHLYGYLYIDRLSKRERKDALRQMAENEPRYPVVAND

SEQ ID NO: 10571 - protein, 326 aa, Streptomyces avermitilis
VRIFGKGRHRPSASWRQATDRAFTLIGDGRYEDAGALLTRAADLEPWLSESWFNLALLHKFRHDWEQARAAGLRAVALLDRETGAPDWWNVGIAATALQDWPLARRAWQAYGLRVPGGATASGEPVGMDLGSAAVRLSPEGEAEVVWGRRLDPARIEVLSIPLPSSGRRWGEVVLHDGVPHGERTTAAGHAYPVFDEIELWAPSPVPTWVVLLEAATEDDRDALEQLAADAGFAAEDWSSSVRLLCRMCSESRMPSDEGDGEHLDPHDHSEPGHPGPLGHRTDGQLWVPERECGIAAPAALVRGLLDGWVADSPDSRGWRDLEEVC

SEQ ID NO: 10572 - protein, 442 aa, Streptomyces avermitilis
VSGPERSEGSEGPERQGLPGQRQTYVPGAVRGRPARVLVLAHGGALLLGAAALADTLWHGVDRPGDALAFGLLVAVGELARWSGAGERASAPLGAAGALAYALLGENAGHPTHHGALQVVAVVVAAALLGCVPHVARGGPTADHLTRRVLTVGFAALCFQPLYERGRLHEWGGPAHALLLVALLLLTALCDALLAAVMAHSRTRWPFGPLLRDELRAMLGIGSAVCATGAVMSLAVAVVGLWALPVFSLPLLLTQFSFRRYAAVRVTYTQTIASLARATEIAGCTPAGHARRVAVLSRAVGRELGLSGPELTVLEYAALMHDIGQLSLVDPVPAGATAVLSADEQRRIALLGGAVVRQTGVNAEVAVVVERQADPYREQPVSARIVRAVNAYEEMVRAAGPGGPLTALEKLRLGTARDYQPEVVESLARVLSRDGLTLPSAG

SEQ ID NO: 10573 - protein, 479 aa, Streptomyces avermitilis
MGAVRAMGSVPARGRVYVLCTAVAALACLAPAATVRVPWWVVALLAGLYAGCEQITFPRVRPGRGEVSGGTGGDGSRPAGRRVPAGMGTLFPVLLAGAFLLPPSAAALVPLPGALLARVERRPRWLRRIWHAAQLALCTWAASRAHGALGGRAAVASPDFPYALVPAGAAVLAFCAVLTALDGGILALAERVPVRGAWRGLFPRSLAPVAVHGLAGLMMAVLWRSPYGPVAALLVLLPMYVSCWVFAQYHRERAAHQATIRALVQAVDIKDGYTRGHSERVGQASMMIARELGMDDERAEVLRFAGILHDVGKLGVPTRLLRKDGPLTPEERRIIELHPEYGHEMVRGIGFLGEARSAILHHHERLDGSGYPYGLTGAQIPEFARVVAVADAFDAMTSTRSYRRARPVAAALEELERCAGAQFDPVMVGALVRALGRQGWHPAVTADENVPPGVCPPAPPVSSRLESRSHRNGVGGGGA

SEQ ID NO: 10574 - protein, 103 aa, Streptomyces avermitilis
MSCGEPHETDCSEVLDHLYEFLDHEMPDSDCTKFEVHFEECSPCLEKYGLEQAVKKLVKRCCGQDDVPTDLRAKVMGRIDLIRSGQTVPEHDVTAAPATPQES

SEQ ID NO: 10575 - protein, 227 aa, Streptomyces avermitilis
VGPVTGTDAGTDNGQAEQPEGQGTSTESTAERSARFERDALEFLDQMYSAALRMTRNPADAEDLVQETYAKAYASFHQFREGTNLKAWLYRILTNTFINSYRKKQREPQRSAAEEIEDWQLARAESHMSTGLRSAESQALDHLPDSDVKSALQAIPEEFRIAVYLADVEGFAYKEIADIMGTPIGTVMSRLHRGRRQLRGMLEDYARDRGLVPAGAGESNEAKGSGS

SEQ ID NO: 10576 - protein, 211 aa, Streptomyces avermitilis
MAEITELIETDAGTARITWHKARKASLVLAVSHGAGGGIEARDLQALARVLPGHGVTVALVEQPWRVAGKKVAPAPKTLDVGWRGLWPAVAKAGLPVIAGGRSAGARGACRTATELGAAAVLALSFPLHPPGKPEKSRADELLGAGVPTLVVQGGNDPFGKPEEFPNGSYELVEVPYGDHGFAVPKRAPLGQEQALAIITDRVVEWTASLG

SEQ ID NO: 10577 - protein, 279 aa, Streptomyces avermitilis
MCGRYAASRGPEDLAGVFEVEKWEPEESLAPDFNVAPTKDVYAVLDRPLKDADTASTSSSVPGRPVRQLRKLKWGLVPSWSKTPEGGARMINARAETVHEKPSYRRAFAARRCILPADGYYEWVTGSQERELEVEGRKKRPRKQPYFVLPADGSVFAMAGIYEFWRDRTLPDDHPGAWWVTCSVITTEAETSPLAVAPAEGPYALADIHPRMPLMLTPDRWDAWLDPARTDTDDLRELLAPPPAGLMRAYPVSTAVSNVRNNGPELLKELEGPEEGTLF

SEQ ID NO: 10578 - protein, 243 aa, Streptomyces avermitilis
MDSTASTSLSSLTDLWDQVFGSQPDPDLWVVIATMVAALAVIVPHNVWRLSRNAITIAHEGGHGLIALLTGRTLTGIRLHSDTSGLTVSRGKPHGLGMILTAAAGYTAPPLLGLGGAALLAAGHITALLWLATVLLIAMLVMIRNAYGALTVLLTGGTFVVVSWLAGPQVQAAFAYAVVWFLLIGGVRPAFELQAKRSRGNAGDSDADQLSRLTRVPAGLWLFLFHAVSLCSLIGGGRWLLEV

SEQ ID NO: 10579 - protein, 446 aa, Streptomyces avermitilis
MTVNPAHTALWPAPHASGAVDATVHVPGSKSVTNRALVLAALASEPGWLRRPLRSRDTLLMAAALREMGVGIEETVSSSSSVGGGSDGSGEAWRVIPAALHGPATVDVGNAGTVMRFLPPVAALADGPIRFDGDPRSYERPLNGVIDALRALGARIDDDGRGALPLTVHGGGALDGGPVAIDASSSSQFVSALLLSGPRFNQGVEVRHTGSTLPSMPHIRMTVDMLRAVGAQVDTPESGGEANVWRVTPGALLGRDLTVEPDLSNAQPFLAAALVTGGKVVIPDWPERTTQPGDKLREIFTEMGGSCELTEQGLEFTGSGAVHGIDVDLSEVGELTPGIAAVAALADSPSTLRGVAHLRLHETDRLAALTKEINELGGDVTETADGLSIRPRRLHGGIFHTYDDHRMATAGAIIGLAVDGVQIENVATTAKTLPDFPDLWTGMLGN

SEQ ID NO: 10580 - protein, 336 aa, Streptomyces avermitilis
MRRYGKHTDEDDIRARPNRKGNRPRSNIRPKHEDAAEGLVITVDRGRLTCLVEDRVVLAMKARELGRKAAVVGDRVALVGDLSGKKDTLARIVRIEPRTSVLRRTADDDDPYERVVVANADQLAIVTALADPEPRPRLIDRCLVAAYDGGLTPLLVLTKSDLASPDELLEMYGALGVPYVVTSREELESGEAVERVRKQLDGKITAFVGHSGVGKTTLVNALVSVERRRSTGHVNAVTGRGRHTTTSARAVPLPDSAGWVVDTPGVRSFGLHHVDPSRVIKAFPDLEPGTEGCPRACSHDEPDCALDQWVTDGHADPQRLYSLRRLLATRERTEGD

SEQ ID NO: 10581 - protein, 107 aa, Streptomyces avermitilis
MAWLLVVVAGLLETGFAVCLKLSHGFTRLWPTVAFCVFALGSFGLLTLSLRKLDVGPAYAVWTGIGAAGTAIYGMVFLGDVVSVLKLVSISFVIIGVIGLQLSGSAH

SEQ ID NO: 10582 - protein, 595 aa, Streptomyces avermitilis
VLEVARLNVDFDGRPAVRDVSLSLSRGEVLGLVGESGSGKSATALAVLGLLPDNATVQGSVRLDGQELVGAGERELTRIRGSRVAMVFQDPLSAFTPVHRVGDQIAEAVRAHQGVSRERARERAAELLDLVGIPASRVRAFPHEFSGGMRQRAMIAMAMANEPDVILADEPTTALDVTIQAQVLDVLRTAQRETGAAVLLVSHDLGVIAGMADRVAVMYEGEVVESGTAVEVFGRPREPYTRKLLGAVPRLDDARPRAELPDSEPVLRVRGLTKTFPLLKGSAFKRRVGSVYAVDGVDLDIRRGETLALVGESGSGKSTTLFELLELAAPEGGSVELFGQRLGSLRKAESKALRRRVQIVFQDPMASLDPRMPVGDIIAEPLRTQGFDRATAARRVPELLTRVGLDPAHAERFPHEFSGGQRQRIGIARALSVEPELLVLDEPVSALDVSVQAGVLDLLDRLKAELGLAYLFVSHDLSVVRHIADRVSVVYLGRTVESGPVEEVFERPRHPYTQALLSAVPLPDPERERERRRTRILLAGDPPSPTQRYDGCRFRARCPLYASLAEEERKRCAHDVPVLDGDGAACHFPRVREVI

SEQ ID NO: 10583 - protein, 302 aa, Streptomyces avermitilis
MTITPVVETVEAAVRPVGRGTVVLRRFVRNRGALAGSVVLVLLFLLAFVGPYVTPWSYSHIDYTALRSGPSADHWWGTNRIGQDVFAQTVRGLQKSLLIGLLVAVFSTGLAAFVGACAGYFGGWTDRALMFFVDLLLVFPSFLIIAAVSPRMPSGGWVVLAGLLAVFGWMITARVVRSMTLSLKEREFVRAARFMGVGPFRIIWRHVLPNVASFLIIDATIAVGGAVMSETALSYFGFGVQTPDVSLGTLIASGTGAAVTYPWMFFYAAGLLVVFVLAVNLVGDGLRDALDPTSRSRKGASR

SEQ ID NO: 10584 - protein, 331 aa, Streptomyces avermitilis
MRDVPAYLAKRLGYYAVLLLAAVCLSYLLASFALDPRAYYEGRQPPVSASAVNHHLTEIGVNDHASLLARFLRWAGHAVRGDLGRTIDGTSVNAEFGRRIGVSLRLLLAGTVLGTVAGVLIGAWTAVRQYRFSDRTVTFASFALLSTPVFLLAILLKTGAIWFNRTTGTDLIQFTGEKSPGLTGGFGAVLQDRAVHLLLPTLSVALFAIAGYSRYQRSTMLDVLGSDYLRTARAKGLGRRAVLLKHGLRTALIPMSTYFSYGFLALFTGAIFTETIFGWHGMGEWFISSIGKNDVNSVVAVNLFAAVTVLLSGFLADVLHAALDPRIRQAS

SEQ ID NO: 10585 - protein, 562 aa, Streptomyces avermitilis
MRRTPAAALVAATAATALLVTGCGSSDDDKPQAQKSAAPAGSQQINAHPLSDIQQGGTLKFAISQYIADFNRYTANGNQGDAATINELVEPSLFTADARGAVRPNENFLLSASVTSTSPQVVTYKLNPKAKWSDGAPLSWRDFRALWKATNGTNKEYEAANTSGYDQISAVGQGTDAHQVKVTFSSPYADWKRLFDPLLPAAGIDTPAKFNKGWTEKIPVTGAAFKISAYDRTAQTITAVPDPQWWGTKPKLDSIVFRALDFSAWTDAYLNKEIDYASAILPEDYKRLAKAAGTDIRTGARWDEVHITLNGARGPLKDVRVRQAVQHAIDRKAIATAFGKDLPVELKTYGSHFFMPNQAGYQDNSGTYGTYDVEAAGELLDAAGWKTKGDTRVKDGKQLALTYALSAGSTSAQEDQAELVQAQLAAVGIKVSIKKVPTNDYFSKYVTIGNFDLVSFRWVDQIFRSEAYPIYRQTAGKNLYENYGSVGSPEIDTLLKKAGETTDATEQAKIYNEADTKIWALGHSIPLYQRPQVLAVRSNLANYGAGGLADDDFTKVGWLKKK

SEQ ID NO: 10586 - protein, 210 aa, Streptomyces avermitilis
MPAARESLLDAAYTALARRPWSAVRMVDVAAVAGVSRQTLYNEFGSKEGLARALVRREADAYLAGVERALATHADPRERLAATAEWTTSAARGNALVRAMLTGCWSERLPSPTLTAVPSASAVPAQRRADGALPSPADFVALVRDRAVAALAGPGTTRSDAFELARSCELVVRLALSCVAAPPGEGGVPDLVKAALTPSHRLGVRTVTSS

SEQ ID NO: 10587 - protein, 266 aa, Streptomyces avermitilis
MPDYRDDLRLAHVLADAADAATMERFKALDLKVETKPDMTPVSEADKAAEELIRGHLQRARPRDAILGEEYGIEGTGPRRWVVDPIDGTKNYVRGVPVWATLISLTEAGEGGYQPVVGVVSAPALGRRWWAAKGHGAFSGRSLSSASRLHVSRVSKLSDASFAYSSLSGWEDQGRLDGFLDLTRAVWRTRGYGDFWPYMMVAEGSIDICAEPELSLWDMAANAIVVTEAGGSFTGLDGRPGPHSGNAAASNGVLHDELLGYLNQRY

SEQ ID NO: 10588 - protein, 130 aa, Streptomyces avermitilis
MLVRDAMSTVVLTIGPAHTLRQAARLMSARRVGAAVVLDEDSCGVGILTERDILNSLALGQNPDAETAGSHTTTDVVFAAPAWTLEDAATAMSHGGFRHLIVLDGSGPVGIVSVRDIIRCWAPARQHIPA

SEQ ID NO: 10589 - protein, 483 aa, Streptomyces avermitilis
VTQGPLTTEAGAPVADNQNSETAGVGGPVLVQDQLLLEKLAHFNRERIPERVVHARGAAAYGTFTLTRDVSQWTRAAFLSEVGKQTETFLRFSTVAGNLGSADAVRDPRGWALKFYTEEGNYDLVGNNTPVFFIKDAIKFPDFIHTQKRDPYTGSQEADNVWDFWGLSPESTHQVTWLFGDRGIPASYRHMNGYGSHTYQWNNEAGEVFWVKYHFKTDQGIKNLTTEEAVNVSGLDPDSHQRDLRESIERGDFPTWTVQVQIMPAAEAAGYRFNPFDLTKVWPHEDYPPIEIGKLELNRNPENIFAEVEQSIFSPAHFVPGIGPSPDKMLQGRLFAYGDAHRYRVGINADHLPVNRPHATEARTNSRDGFLYDGRHKGTKNYEPNSFGGPFQTDRPLWQPISVTGVTGDTEAPVHTEDNDFVQAGNLYRLMSEDEKTRLVDNLAGFISKVSRDDIAERAINNFRQADGDFGKRLEAAVQALRG

SEQ ID NO: 10590 - protein, 138 aa, Streptomyces avermitilis
MSDLLERLRGRGWRMTAQRRVVAEVLDGDHVHLTADEVHARAVVKLPEISRATVYNTLGELVSLGEVLEVATDKRAKRYDPNAHRPHHHLVCARCGAIRDVHPSGNPLADLPDSERFGFTVSDVEVTYRGVCPNCAAA

SEQ ID NO: 10591 - protein, 616 aa, Streptomyces avermitilis
MDVMGDKATLLETGRFAQPADFVQPADIAQPSDRDETGEAAEEARRRLAAEAGDVEAKSVLGAMLLRRGDLDGAEPQLRAATAAGDRAAANNLGVLLHQRGYAEEAAGWWRIAAVAGSAAAAHALGRHHRERGDEPAAEYWLRQSAEQGHALGAYALADLLEHRNDARAEQWMRAAAERGHREAAYRLARALDRKVADAGEPGADNGVIGAGGEEAAQWYRQAAARGHRRAALHLGAILEKRGELKEAGRWYLTSAKDGEARAACALGFLLRDAGDSESAAVWWLRAAQDGDGNAANALGALHAERGETQTAERWYRAAMDAGDVNGAYNLGLLCAEQGRTAQADQWYRRAAYAGHREAANALAILLLQVGDAAGAEPWFSKAAEAGSVDAAFNLGILHAGRGTEEDDAAALRWYERAAAAGHTEAALQVGIALLRDGDEQAAERHLRCAAGGGSAEAAYRLASVLDARRPPAPAHELGEPAHEKTECEEWYERAASQGHRRAQVRVGMLAAARGDVVEAARWYREAAEAGSRNGAFNLGLLLAREGSEPEAALWWTRAADAGHGRAALRLALVYARRGELVEGQRWADRAVSLGPAEVSERAARLRDALRQELSA

SEQ ID NO: 10592 - protein, 998 aa, Streptomyces avermitilis
MPDRGGGPTGPRIRVGRPSRRVRTLLMTLGVLAVLGMAFVMFAGFWTDWLWYRSVKYSSVFTTTLSTKIGLFFVFGLLMAVAVGVNIWLAHRLRPPLSAMSMEQQSLDRYRMGIAPYKKWLLLGITSLVGLIAGASASSQWRTWLMWVNGVPFHQKDPQFHLDVSFYAFDLPWYRFLLGFGFAAAVLSLIAAALTHYLYGGLRITSPGARATAAATGHLSVLLGIFVALKAVAYWLDRYGLAVKSSDFKATGNWTGLRYVDANAYLPAKTILFCIAVICALLFFATLWRRTWQLPVIGFGLMVLSAILIGGLYPAIVQKFQVQPNEQAKEAPYVEKNLKATREAYGIDGAKVTEYPGKSDTTDKTKLRDDADATASVRLLDPNVVSPTFQQLQQMRNYYAFPTNLDVDRYSKDGKDQDTVIGLRELNLNGIPKNNWINDHFRYTHGFGVVAAKGTTADSEGRPVFTESDLPSRGDLKAYQQRIYYGEKTSQYSIVGGPQKEIDYSDDSGEKTTSYQGKSGVNLSSPINRAAYAVAFSEPQILYSGAIGEGSRILYNRTPKERVEAVAPWLTIDGDAYPAVVDNKIQWIVDAYTTTNGYPYASRTTLGDTTADSLTANNNQRAVVAQQNQVNYIRNSVKATVDAYTGKVTLFEWDTKDPVLKTWEKAFPGTVKPKGDIPKSLIDHLRYPQDLFKVQRELLTRYHVKDAQTFLSGSEVWQVPDDPSNKSGNAVPPYYLSMKMPDQQAQTFSLTTTLTPNGRDNLSAFMSVNAEAGTSDYGKIRILKLPTSRTVDGPKQVQSQFNSEQDIAESIRLLKGGDSEVEYGNLLTVPLDGGLLYVEPVYVRGGGLKYPLLRKVLVTYGGNTAFEDTLDEALNKVFGADSTTQPPDEGTTKPPTSSNPTVQEALNDAQKAFDAGQEALKKPDWQAYAKAQKDLEDALKRAEDAQAEADKASGGSKSGDSGKGSGPTSSPSGSASSSPSSSPSSDKSPSSDKSPGSD

SEQ ID NO: 10593 - protein, 182 aa, Streptomyces avermitilis
VTMSNTPMAASPLTRAVLEIDEYASTLGWDQPARLFALVDTARLRTQEPSLAAQLGLADAPETTGLTPIEQDEIPAGKPLDEFLGTIAWPDAVVGCALTVERLMLPPSAEASVPEGLSEKKLAKWVAEHPDRQEVRMTVAVLRDGARESALRLREKDSPTEVLTGSDLVPGLAEALSATFAD

SEQ ID NO: 10594 - protein, 365 aa, Streptomyces avermitilis
MPRRTATMLASTLMLIALLCAGVFIKVPYAEMSPGPTVNTLGEHDGEPVLQITGHKTYATTGHLNMTTVRVTSADYRMNLVEAVYGWLAHDNKVVPHDTLYPDGKTEEQSTQENAEEFSQSQESAKVAALKELDIPVKSWVIVSTVLKDSPAEGRLHAGDVIKAVDGTAVKAPDDVAELVTKHKPGDDVAFTILPAKEQAAAEKSKTYVPRTKKVTITTAKSDDTGAPRAIVGISAGTDHTFPFTVDIKLADVGGPSAGLMFALGIVDKLTPDDLTGGKFVAGTGTIDDDGKVGPIGGIEMKTVGAREKGAQYFLTPKDNCAAAAKDTPEGLTLVKVNTIDDALDALKDIRTGKTADLPKCTTKG

SEQ ID NO: 10595 - protein, 54 aa, Streptomyces avermitilis
MAVLAWLLIPLLTAIGAGLWGSWAGRNRKAAGDGSELAGYARFREAMEKSHSGT

SEQ ID NO: 10596 - protein, 153 aa, Streptomyces avermitilis
MASMNDHPGEQAAQEPVKLLAIRETPLSLDEVFRAVGDDAAGGTALFVGTVRNHDGGADVDELGYSCHPSAEAEMRRVAEKVVAEYPVRALAAVHRIGDLRVGDLAVVVAVSCPHRGEAFEACRKLIDDLKHEVPIWKHQKFSDGTEEWVGAC

SEQ ID NO: 10597 - protein, 370 aa, Streptomyces avermitilis
VSSPDPQVRAARNHSTSPAVRGPVVAVTGAASGVGALLTERLAASDAIKQVVAIDERRGECATAQWHILDVRDPAIADKLRGADVVVHLALDLDLESDAAARTAYNVRGTQTVLTAAAAAGVHRVVLCTSAMVYGALPDNELPLSEDAELRATAEATGVGDLLEIERLARRAPRAHPGLNVTVVRPSVLVGGTDTALTRYFESPRLLVVAGSRPAWQFCHVEDLCSALEYAVLEKVDGELAVGCDGWLEQEEVEELSGIRRMELPSAVALGAAARLHRIGLTPSPAGDLAYTMYPWVVSGSRLHDAGWRPQWTNEEVLAELLEEVAGRHTVAGRRLGRKDATAAGAAGATVALLGTAALVRRARKARRRF

SEQ ID NO: 10598 - protein, 483 aa, Streptomyces avermitilis
VSDTPFGFGLPPEEPENGDEGKKKDQQSGGGQGPANPFGFGSPGAGGPGADNPLAAMFGSINPNDLGAAFQQLGQMLSYEGGPVNWDMAKQIARQTVAQGTQDGTKDASVGPGERSAVEEAVRLADLWLDDATSLPSGAGSAVAWSRAEWVEATLPVWKELVDPVAERVGAAMGDVLPEEMQAMAGPLIGMMRSMGGAMFGTQIGQAVGVLAGEVVGSTDIGLPLGPAGKAALLPLNMAAFGKDLGIPEEEVRLYLALREAAHQRLFAHVPWLRSHLFGAVEGYARGIKVDTAKLEDVVGQFDPQNPEELQQALQQGMFQPEDTPEQKAALARLETALALVEGWVDAVVHAAAKPRLSSADALRETLRRRRATGGPAEQTFATLIGLELRPRRLRDASRLWASLTDARGVDGRDGLWAHPDMLPTASDLDDPDGFVHREQLDFSELDKMLGEAASGGPAAGKPDLKKDDDNKGEDDSKGDTAE

SEQ ID NO: 10599 - protein, 173 aa, Streptomyces avermitilis
VSLFDDTVLVLKGYEDQEELREAYLGHLEAHPDGTWKSCHAGHITASALVVDPERGQVLLTLHKKLRMWLQMGGHCEPGDATLAAAALREATEESGIPGLTLLPGGPVRLDRHPIPAPCHWHFDVQYAVVAPPGAVHAISDESLDVRWFGYDEVADVADESVVRLLEATRSRL

SEQ ID NO: 10600 - protein, 251 aa, Streptomyces avermitilis
MQSPLFGYNEQQTQDRYSLQNSQMLRVVLEGHDDILARKGTMVAYQGLIEFDAEYQNNSQQRARAYTGEGLDLMRCHGQGTVYLSNLAQHVHVMDVDQDGLTVDSSYVLAMDSSLHHEVIAVDSQYGISGSGKYQLNITGRGKVALMTSGMPLLMQVTPDKYVNCDADAIVAWSTSLRVQMQAQTHSSGVWRRRGNTGEGWELSFLGNGYALVQPSELLPPQNAQIGQGLRAQYGMGQQGARAQNQGNVWS

SEQ ID NO: 10601 - protein, 226 aa, Streptomyces avermitilis
MNQPLAGFAPAPVTARMENHGNHMLKVAMQTGNDLFARVGSMVAYEGFVQYEPNPPAVRQIARDWMTGEGAPLMKCTGDGLLYLADYGANVVVINLNGDAISVNATNLLAFDAHLTWGVERVKGLAKFAGQGLWNTKISGQGWVALTSRGKPIVVDCGGGEDETYVDPDALVAWSPNLKVKGKRSFKAQSLIGRGSGEAYQMAFSGQGIVVVQPSEDSTDRLRVRG

SEQ ID NO: 10602 - protein, 558 aa, Streptomyces avermitilis
MAREFQRGHKAKISDLTAGTDLYVGVQITGPGLTFDISCFGLDAEERLSDDRYFIFFNQPKTPEESIQLLGAQAGDTESFRVTLDRIPPQIQKLSFTATLDGAGQMSQVAPGYLRIVAGGEEVARYSFTGSEFSTERAVMLGDFYLKDVWRFAAVGQGFDGGLDALLKNFGGEVAEEEPAVPAQTQSGAAPSFAPPAFGAPAAPAPAPAPAPQPAQGFTPPPGPTPPPAPAPAPSVHAAPTIVGPLHTPPGGTVPPPGPAPYAQPPGQPGPPPGYGQQPPGQTAPMPPGYGQQPPGAPPGYGQQPQYGQVPGQVPPGQYPGQSGAPSPYGVPQGAPQGGAGVAAALSVFKETPTGQRWTQQNKKLIRVDLGIGGQPVLARQGSMVLYQGKVEFSYKGAGFAGRITGNATGQEMQLMRCTGQGQVFLADNATHVHPIELQGDAICVSAENVLAFDESLQYEVRRIEGHGIPGGALFTMQFQGTGTIVVKTHGAPVVLPVTPTTFADCNAVVAWSAASQVIVSSQVRMRRNAYPGDTGESVNLQFRGAPGNFIVVQPYEV

SEQ ID NO: 10603 - protein, 147 aa, Streptomyces avermitilis
VLIPARMSEAEEQRWVTVMLDKLAAQESKRRLGDAELAERAERLSLQYFDGRARPTAVRWVTNQNTRWGSCTPSEGSIRLSHRLQGMPEYVVDYVLLHELAHLLVPGHGPRFWRLLEAYPRTERARGYLEGVVAADRLPHQPAPGAE

SEQ ID NO: 10604 - protein, 407 aa, Streptomyces avermitilis
MHPMVKPALRRGWRDLNTVQFGMAPAHAMVLGPMDTATGSFLALLDGTRGLPLLREEGRRMGLPDGHVDGLVERLAASGLLDDATGGGPGADALRGKGAVLDRLRPDLASLSLVARAPGAGIQRLAARRSLRVQVRGAGRVGVVLASLLAGAGVGEVDVQDTGRVEPWDVAPGGLPAESIGERRNEAARRAVRSAAPERPPRQERASRRTTAGAADPGLSLVILTPRDGLGIHAPDPAAAEPLITSGTPHLYAGVVEGTGVVGPFVLPGESGCAGCLDQGRADRDRTWPRLVAQWRSGRPRQVQACDVALATAVAGVAAGHALAFLDGELPSSAGARWETSVPRLDWHARPVWAHPACSCGAAEKGNGEHTAKEGEPHETMAEQQPSADLPRKARAARLSGTWRAHV

SEQ ID NO: 10605 - protein, 451 aa, Streptomyces avermitilis
MSDLPRKAVTRTAKLAALPLGFAGRATWGLGKRIGGKSAEIVGRELQQRTAEQLFKVLGELKGGAMKFGQALSVFESALPEEVAGPYRAALTKLQEAAPPMPTRTVHAVLQERLGEDWQELFLEFEDKPSAAASIGQVHRGVWHDGREVAVKVQYPGAGEALLSDLNQLSRFARLLGPLIPGMDIKPLITELRDRVSEELDYALEAQAQLAHAEEFADDPDVVVPAVVHQSEQILVTEWIDGIPLSEVIADGTQEQRDRAGQLLARFLFSGPARTGLLHADPHPGNFRLLPDGFDEKAGWRLGVLDFGTVDRLPGGLPTPIGDSLRMTLDGDAESVYELLREEGFVKESIELDPDAVLDYLLPIIEPAQADEFTFTRGWMRSQAARIADPRSPAHQLGKQLNLPPAYLLIHRVTLSTIGVLCQLGATVRLRDELEEWLPGFLLEEESAAEA

SEQ ID NO: 10606 - protein, 107 aa, Streptomyces avermitilis
MNITGTIDRPLTHDPKKQAPMKPSAGEPAGSAIPDFTTTGANDSRQNRTREMQLIPEALARAHMHERLHEAEQERRATRLATARRMQRRAERASMRARRALAMAVMQ

SEQ ID NO: 10607 - protein, 122 aa, Streptomyces avermitilis
VQLEAHAPSVPPSETIPPPGLTEDSTLIPLTALTALDDAIENLGVPVPCRSYDPEVFFAESPADVEYAKSLCRTCPLIEACLAGAKERREPWGVWGGELFVQGVVVARKRPRGRPRKNPVTA

SEQ ID NO: 10608 - protein, 115 aa, Streptomyces avermitilis
LRRREEAIPVISINTSSISTVKMTDRSVVSLCMSGVSNLGTGLSGIRAARPASSLSLAELPIRERNERPTKALEAAVVAQAHAYAFAAGAGSLKQTTQHHTMWAFRGPEPWSDPA

SEQ ID NO: 10609 - protein, 770 aa, Streptomyces avermitilis
VRLPPGRGGEPAALVRLQAPPCGQPPHPPPPTWQHGGVTAATHSTLFPQVPDSADAVLDGLDPEQRAVATALHGPVCVLAGAGTGKTRAITHRIAYGVRAGILQPSSVLAVTFTNRAAGEMRGRLRQLGASGVQARTFHSAALRQLQYFWPKAVGGGLPRIVDRKIQIVADAAAACRIRLDRGELRDVTAEIEWSKVTQTVPADYAAAAAKAAREAPRDPAEIAQIYATYEDLKRDRAVIDFEDVLLLTVGILQDRQDIAEAVRAQYQHFVVDEYQDVSPLQQRLLDLWLGERDSLCVVGDASQTIYSFTGATPDHLLDFRTRHPGATVVKLVRDYRSSPQVVHLANGLLAQARGRAAEHRLELISQREPGPEPVYTEYTDEPAEAEGAARRIRDLLASGVPAAEIAILFRTNSQSEIYEQALADAGVPYQLRGAERFFDRPEVRKAGVALRGAARFGGNDTLLDDVVDLPSQVRAVLSGEGWTSRPPAGSGAVRERWESLAALANLAQDFAAAKPDATLGDLVAELDERASAQHAPTVQGVTLASLHSSKGLEWDVVFLVGVAEGMMPITYAKTDEQIEEERRLLYVGVTRARQHLSVSWALSRSPGGRPNRRPSRFLDGLRPGSVTTTGRGARAGAAGGIERGFAGSATSPAPRRTSRIPARCRVCGRTLSDAGEMKLMRCEDCPSDMDEGLYERLREWRAVQAQRSGQPAFCVFTDKTLMAIAEAVPDDEGDLARIPGVGVRKLNRYGADVLSICAGQEVEVGAEGD

SEQ ID NO: 10610 - protein, 80 aa, Streptomyces avermitilis
MPGTVTMYSTTWCGYCSRLKSQMDREGITYNEINIEHDPDSAAFVEKANGGNQTVPTVLFADGSTLTNPSLAQVKQKIGA

SEQ ID NO: 10611 - protein, 315 aa, Streptomyces avermitilis
VTTWTDRTADRPLSLTAPSGIDRAAHHRLDEAWLAAAWSHPTTRAFVVSGGQVLIDETADGATELVMTPSFEAPLTEAHRYFLGTDDDGVSYFALQKDALPGRIDQSARPAGLREAGLLLSPRDAGLMVHAVALENWQRLHRFCSRCGERTVIAAAGHIRRCPACGAEHYPRTDPAVIMAVTDDEDRILLGRQVHWPEGRFSTLAGFVEPGESIEQSVRREVFEEAGITVGEVEYVASQPWPFPSSLMLGFMARATSTEINVDGDEIQEARWFSREDLKAAFESEEVLPPYGISIAARLIELWYGKPLPRPGTAV

SEQ ID NO: 10612 - protein, 467 aa, Streptomyces avermitilis
MSETPDSAVRTYIDSHRAVFLDDLAEWLRIPSVSAQPDHAADVRRSADWLAAKLKETGFPTAEVWATPGAPAVFAEWPSDDPQAPTVLVYGHHDVQPAAREDGWDTEPFEPVIRDNRLYARGAADDKGQVFFHTLGVRAHLATTGRTTPAVHLKMLIEGEEESGSPHFRALVEEHADRLTADTVIVSDTGMWSEDTPTVCTGMRGLAECEIELHGPDQDIHSGSFGGAVPNPATAAARLVAALHDEHARVAIPGFYEGVAELTARERELFAELPFDEPQWLRTAKSAATYGEAGHTTLERIWARPTAEVNGIGGGYQGPGSKTIIPSSAMVKLSFRLVAGQDPDDIETAVRAWAADRLPAGIRHEITFGAATRPCLTPLDHPALQSVARAMGRAFEQPVRFTREGGSGPAADLQEVLGAPVLFLGISVPSDGWHAPNEKVELDLLLKGVETTAYLWGDLGGSPRHGD

SEQ ID NO: 10613 - protein, 1202 aa, Streptomyces avermitilis
VLLPAMRLIGPPLSVAAASLSDVPARITDPEQLKELLGIPFTPEQTACITAPPAPQVIVAGAGSGKTTVMAARVVWLVGTGQVAPEQVLGLTFTNKAAGELAERVRKALVKAGITDPDVIDPDNPPGEPVISTYHAFAGRLLTDHGLRIGLEPTARLLADATRYQLAARVLREAPGPYPALTRSFPDLVGDLLTLDSELAEHLVRPEELRAYDAELLSSLEGAKLSNAELRKIPETAAARRELADLVVRYRAAKRERDLLDFGDQIALSATLARTRAEVGAILRDEFRVVLLDEYQDTSVAQRVLLAGLFGGGTGHPVTAVGDPCQAIYGWRGASVANLDDFPEHFAHADGRLATRQALSENRRSGGRLLDLANGLAEPLRALHAGVEALRPAPGAEHDGQVRCALLRTHAEEIDWIADSLAHLVRTGKEPGEIAVLCRTATDFAEIQGALVARDVPVEVVGLSGLLHLPEVADLVAVCEVLQDPGANASLVRLLTGPRWRIGPRDLALLGRRARLLVSHARVGADDDPDRRLAAAVEGVDPSEVISLADALDTFLEAPLEDPAEADDGLPFSADARVRFARLAAELRDLRRSLADPLMDVLHRVLAVTGLEVELSASPHALAARRRETLSNFLDVAASFAASDGEATLLAFLGFLRTAAQYEKGLDNALPGGENTVKVLTAHKSKGLEWDVVAVPGLVTGTFPSTQGREKWTAQGKVLPHELRGDADTLPDIEAWDSRGMKAFHEAMKEHQHTEELRLGYVTFTRPRSLLLGSGHWWGPSQKRPRGPSDFLHALYEHCAAGYGEIEAWAEEPEENEENPALHEAAADHAWPLPLDDTALARRRAAAETVLAYLERVASHENAHPSAPSAVHDPTSYDDPDWPPPEDAESPHEDPFDEAYGDLAHDEAPYGEDDVPEEGLLEDDGDDDADWESWSTDRPTVPHQAAAPEARPHPAGPPPLTPEEARTIASWDRDLDALTGELLRARASVTDVPLPASLTASQLLELAADPDGFAQELARPMPRPPQPAARRGTRFHAWVEARFEELRLPMLEPDELPGSEAEIADERDLEALKDAFERTPYAHRTPYRVEVPFQLAIAGRVVRGRIDAVYRKEGNDGTTYEIVDWKTSRTRTADPLQLAVYRLAWAEQQGVPLESVTTTFLYVRSGEVVRPDGLPDRAALERLLLDEPSSGEPPGERVTEGR

SEQ ID NO: 10614 - protein, 1129 aa, Streptomyces avermitilis
VSSSSSTRRLVHPRMRQGSRGAYRLVRTPLARVDPPRLDANQRAVVDHTSGPLLVLAGPGTGKTTTLVESVAARIARGGDPERVLVLTFSRKAAVELRDRMALRMGAARAPQATTFHSFCYALVRAHQDVGLFVEPLRLLSGPEQDVAVRGLLAGQPDLERLGLAHVRWPDELRACLTTRGFADEVRAVLARSRELGLSPGALRSFAARIGRPDWMAASAFLAEYLDVLDLQGVLDYAELVHRAVLLARRPGVAERLAAHYDAVYVDEYQDTDPAQARLLHALAGSGRTLVAFGDPDQSIYTFRGADVNGILDFPDAFPRADGRPAPVEVLRTSRRSGAGLLAATRLLTQRMPLNRLPAEKVRAHRELAPVRDGGHAEVYTYPTPGTELDNIADVLRRAHLEDGVPWGEMAVLVRAGSRTIPTVRRALTAAGVPLDIDGNDLPLRHEPAVTPLLTALKAVAEAEADASGTDASGTHAESSGPAGPAASPEPAGSAEPVEPARESSWLDTETALTLLASPLAGMDAADLRRLGRALREEERAAGNHVPPPSDELLARALAEPERLVAHDPAYARGAQRLGVLLRKARERLAGGRARRRRALWELWDGTPWPQRLARAARRGGAAGRNADRDLDAVCALFATAARAEERTGGRGALNFLEEIDAQDIAADTLTRRAVRPDAVRLMTAHRSKGLEWRLVVVAGVQEGLWPDLRRRGSLLEADRIGRDGLAEPLTPGALLAEERRLFYVAATRARERLIVTAVKAPADDGDQPSRFLTELGVEPKDVTGRPRRPLSVAALVAELRATTVDPRVSDTLREAAARRLARLAALGDEDGRPLVPSAHPYRWWGMYEPTESKVPLRNRDQPVVLSGSALDQLANTCSLQWFLGREVKADAPATAAQGFGNVVHVLADEVASGHTPADLDVLMERLDSVWNALAFDAPWKSAQEKENARVALERFLQWHVMDRAGRTPVASEHDFDVTLEAGSYEVRIRGSMDRVEADGEGRAYVVDFKTGKQAPTAAEVGRHPQLAVYQLAVSEGAVDEAFDGVRPEPGGAELVQLRQGAAKRDGGEALPKVQAQEPLEGEWVGDLLATAAGKVLDERFSPTTGQHCTHCAFRASCSARAEGRHVVE

SEQ ID NO: 10615 - protein, 157 aa, Streptomyces avermitilis
VQMRGRTVCPKPRPGARDTHGRRRVTLSVGWGRMRRMSEESLPADALPEYAERVLDVAERIPPGRVMTYGDVAEWLEEGGPRQVGRVMALYGGAVPWWRVIRADGVLLPGHELRALGHYRAEGTPLKEASRASEGHLPRVDMKRARWDGDERAEGHV

SEQ ID NO: 10616 - protein, 964 aa, Streptomyces avermitilis
MKQQGVHPDDAEGTSGVSSRPDTADAAPTPHEEGPKPQEAAAPQQHQEASPEQHEEAAPESHGEAAPESHGDEKRQAVSEEQRAEPDADRADDAHNEEVEGDEPLLPARVHRPSDLMRLLVGVLAIAVLLAVAAFAHGTTSGLEQDINKGTGQAPDLLIKIAGLVSSIAILLVPVAFAIERLIKRDGLRIADGVLAAVLAHGVTLATDLWVARAAPDSIQEALTQPSPGDIHALTDPVHGYLAPVIAYMTAVGMSRRPRWRAVLWVVLLLDAFSMLVTGYTTPFSIILTVLIGWSVAYGTLYAVGSPNVRPTGRTLMAGLRTVGFHPVSAAREEAPDTTENGDRGRRYFVTLEDGPPLDVTVVDREQQAQGFFYRVWRRLTLRGITTRRSLQSLRQALEQEALLAYAAIAAGANAPKLIATSELGPDAVMLVYEHTGGRTLDSLDDAEITDELLRETWQQVRALQSRRIAHRRLAGDAIVVDRSGMVILTDLRGGEIAAGDLVLRMDIAQLLATLGLRVGAERSVASAVGVLGPDAVADCLPLLQPIALTRSTRATLRRLARERSQREREAVLEASRQSKLARLEEAQQDAGPVVLTKPDKKADKKAVRAEQRAEKRAIDEALDEAREEDLLTQIRHQVLRIRPQAPVEPARLERVRPRTLISFIAGAIGAYFLLTQLTHIEFGTLFSNAEWGWVAAAVLFSALSYFAAAMSLLGFVPERVPFLRTVAAQVAGSFVKIVAPAAVGGVALNTRFLQRAGVRPGLAVASVGASQLFGLGCHILMLLSFGYLTGTEKTPSLSPSRTVIAGLLTVAVLVLVVTSVPFLRKFVVTRVRSLFAGVVPRMLDVLQRPQKLVTGIGGMLLLTACFVMCLDASIRAFGHEETTTLSLASVAVVFLAGNALGSAAPTPGGVGAVEATLTVGLIAVGLPKEVAAPAVLLYRLLTLWLPVLPGWLFFNHLTRKGAL

SEQ ID NO: 10617 - protein, 516 aa, Streptomyces avermitilis
MPNPPRLRAAVLTATAVLLSSSVTGCSHDNDTKDEDLSGQKLSWKDCPAPSESEGGGNAPSPLPDGDEWQCATMKAPLDWAKPRGDTIDIALIRAKTSGEQSKRIGSLIFNFGGPGGSGVASLPAFGKDYEKLRTRYDLVSFDPRGVGRSAGVKCEDDAQLDEYFQQDATPDDTAEQKNLLANTKTFNSACEKHSSRILPHVRTTDAARDMNLMRQVLGDTKLHYFGISYGTELGGVYAHLFPKSVGRAVFDAVVDPTQNPEQGSLGQAEGFQLALDNFAEDCTSKTTDCPIGDTAQDVKDRIATLLKDLDSKPIPGVFPRELTQTAATSGIAQALYSKDFWEYLTEGLEQAYDGDGKVLMLLSDSMNGRNANGQYSNLVAANVSINCADDKPRYTTADVQAKLPQFKAASPLFGDYLAWGLLSCTDWSVAGAADHPDVSAPGAAPILVVGNTGDPATPYEGAKKMVDALGKGVGVEMTYKGQGHGAYDSKNKCVQSAVDGYLLDGKVPAANTVCS

SEQ ID NO: 10618 - protein, 517 aa, Streptomyces avermitilis
MARIARWTALAAAALLVAGCGGGSSDDGKETGEADRSADSSTSSSPSGTPSQLPASLTSQKLGWGRCKATSDSPAPGGDWQCATLKVPLDYAKPDGETIGLALIRSKATGGRRIGSLLFNFGGPGASGVSYLPSYATTVSKLHERYDLVSWDPRGVAASEGVRCRSDRAIQAAESVDSTPDDSTEQQAYLKDSADFGKGCEKAAGKLMSHVSTTDTARDMDLMRQVLGDRKMHYFGISYGTELGGVYAHLFPKNVGRLALDAVVDPSADTVGHAKNQTRGFQRALDDYLKATGQDPKQGSQKIVDLLKRIDAKPLPTSSGRKLTQTLAVTGIVLPLYSEQSWPVLTSALKAAEGGDGSELLLQADSYNDRDASGHYGTTTHSQRVISCLDDRQRPTPEETKKRLPEFEKISPVFGDYMGWDTAGWCHNWPVSGQYDNPEVSAPGAEPVLVIGNTGDPATPYEGARKMADELGKDVGVELTWKGEGHGAYGSGSDCVDSTVDSYLLNGTVPKDGKVCS

SEQ ID NO: 10619 - protein, 392 aa, Streptomyces avermitilis
VSLPPLVEPAAELTVDEVRRYSRHLIIPDVGMDGQKRLKNAKVLCVGAGGLGSPALMYLAAAGVGTLGIVEFDEVDESNLQRQIIHSQSDIGRSKAQSAKDSVLGINPYVNVILHEERLEAENVMDIFSQYDLIVDGTDNFATRYLVNDACVLLNKPYVWGSIYRFDGQASVFWSEHGPCYRCLYPEPPPPGMVPSCAEGGVLGVLCASIGSIQVNEAIKLLAGIGEPLVGRLMIYDALEMQYRQVKVRKDPDCAVCGENPTVTELIDYEAFCGVVSEEAQEAAAGSTITPKQLKEWIDDGENIEIIDVREINEYEIVSIPGAKLIPKNEFLMGTALEALPQDKKIVLHCKTGVRSAEVLAVLKSAGFSDAVHVGGGVIGWVNQIEPNKPVY

SEQ ID NO: 10620 - protein, 249 aa, Streptomyces avermitilis
MSYLTSSATGTASTDLGLGFGIPGYAHPLVAPMEWGELARPGTPLHWVVLNVSGGPGARPDPHCLEAVGRLRNAGVRVLGHLDTTYGVRTFGELISDAHRYLDWYQTGGFFLSRCPTERAALPEIRRTVATLRGLLGGSHIVLGHGTHPFPGYAESADQLVTFSGPWSDYRWSQVAEWTADYPPERFCHFVHGVPRGHLDEALRIARWQGASTIYFTDRTDRGGRDDPWETMPGYWDEIVSRIGTGVSE

SEQ ID NO: 10621 - protein, 319 aa, Streptomyces avermitilis
MRVLLIGANGYLGRFVADRLLADPAVQLTALGRGDDADVRFDLASGSPGALTRFLDAVHPGVVVNCAGATRGGARELTRHNTVAVATVCEALRRSGCGARLVQIGCGAEYGPSQPGSSTAEDAVPRPGGPYGVSKLAATELVLGSGLDAVVLRVFSPAGPGTPAGSPLGRLAEAMRRAMQSGDGELKLGGLGVQRDFIDVRDVARAVHAASLSAAQGVINIGSGRAVRLRDAAAVLARVAGYGGALHELDGPHIPVRPSIGHPRPEPDHAAPAAYPYPDGCGSWQQADVRTARDRLGWRPRINLEESLADIWMEAACRI

SEQ ID NO: 10622 - protein, 343 aa, Streptomyces avermitilis
MHRHRELCERAVDPLEIAAGLEAHGVTDRTAARFRHRDVFSLAEEMYARVPRDAEPAPQPVAAGPRAEGGAWAVLALLPGTLCAATVVGLRLTEGRPRLAVAAAGALAVAIGLRAALGRGPLHAPSHHTTGATRAWTCWLLAYALLGDGLLSAGLEGGPDGPWPLATAPVLALALACAPAAWCARLFAVRARRRLTASRGLEEFAASAKPLLLGTFVLFLCSLGALLALCAALLDESADYPGAGTLGALLLLARLLTARGFTHAPAVVLGVAAAAEATALAAVFAGRLPGCSYLATPVDTVVGAWGPGAVPTLVCGAAALSLLIHTTRTLTRASAHALPPGPP

SEQ ID NO: 10623 - protein, 642 aa, Streptomyces avermitilis
VRIGLLTEGGYPYVSGDARLWCDRLVRGLEQHEFDIYALSRSEQQEDEGWIQLPPQVSRVRTAPLWTAEDDGVGHGRRARRRFAEAYGELAAAVCAVEEPGGSGGPGAFRGAVGAAAGPAAGWDVGGGAGVAVGDVLGDVGGGAVGPEADRFGNALYALAELARDEGGLVGALRSETAVRALERACRARGALREARAARVPDLLDVAARLERALRPLSLDWYEDDGLGSVDLCHAAAGGAAALPGLLARHLAGVPLLVTEYGVQLRAHYLASGGESAPVRALLAAFHGRLAAEVYRQAACITPGNTHARRWQERCGADRAKLRTVYPGMEASRFAEVGESTGCGDPDTLVWVGRIEPAKDLISLLHAFAEIRRQAPKTRLRIVGTAAGAEGVAYLGHCRTLAAQLFPDEAECAHAVGDNPVSFEEIGGPEVPDLAEAYAAGAVVVLSSVVEGFPISLVEAMFCGRATVSTDVGAVVEVIGGTGLVVPPRNPRALAEACVTLLRDPERRERLGAAARARALELFTVEQNVAAFHGIYLEIVSHSPVRRVFVDDTGEPLPFGVPAEAHVPGRWTEVSLLAGGRPRWTAGADAPGAPVRGTTPVRATPLPAVASACPVPAAPGVSAVPAASSGPQEPVVAGEGAR

SEQ ID NO: 10624 - protein, 533 aa, Streptomyces avermitilis
VSLVEVTDLTVEFGTVRAVDGLSLRLEKGAALGLVGESGSGKSTVASALLGLHRGTGARVGGTVKVAGTDVQEASDDELRRLRGGKAAMVFQDPLSSLDPYYAVGDQIAEVYRVHTRAFRRAARARAVDVLNRVGIADAARRARSRPHEFSGGMRQRALIAMALACEPDLLIADEPTTALDVTVQAQILDLLHTLREETGMGLLLVTHDVGVAAESVDDVLVMRHGRAVEHGAAATLLGAPEHAYTRELLGAVPRVDVPRATAGAGAQPAEVVLEAVGMRREFGRGKGAFAAVDDVSVEIRRGETLGIVGESGSGKTTLGRMLVGLLEPTAGEVRHDGRVLSGVNPAVQMVFQDPVSSLNPRRSVGESIADPLRARGERDEGRIRERVGELLERVGLDPAHYDRYPHEFSGGQRQRVGIARALAADPRAIVCDEPVSALDVTTQAQVVALLGELQRELGLALVFVAHDLAVVRQVSDRVAVMRRGRIVEYGPADEVYESPRDPYTQQLLAAVPALDPAVAAERRSARRELASA

SEQ ID NO: 10625 - protein, 332 aa, Streptomyces avermitilis
MSGFTGFVLRRGLGAVVTLLAISVIVYVVFYATPGNVAQITCGPRCSPEQVHQVAEQLKLDDPLYVRYWHFLEGIVVGQDYSTGTSVQHCSAPCLGLSYRTDQQVTQLILTKLPVSLSLVFGAMVLWLILGVGTGVLSAWRRGRLTERVLTGITLVGVATPVFVIGLILMIVVCGQLELLPFPQYVAFTDDPEQWAWNLLLPWLSLALIEAAAFARLTRAAMLETLAEDHVRTFRAYGVGERSIIGRHALRGALSPVIALNANNFGAQVGGAVLTETLFGLPGIGQDLVHAVAVVDLPVVVGMVLVIGFFVVLANALADVLYAVADRRVVLS

SEQ ID NO: 10626 - protein, 360 aa, Streptomyces avermitilis
VSEALVASQAAGTGTPVPAVSGARQFWRRLRAQRAALVAAAVVALLVLVALAAPLLTALEGQDPTTYHPSLIDSARGGVPVGSLGGISGDHWLGLEPQTGRDLFARLVYGARVSLGVALAATLVQVLIAVVVGIAAALGNGWVDQLLSRATDVIVAMPLMIMSLALLAIVPSSFPRPVLVALVIGLIAWGSPAKIVRAQTLTLKQLDYVSAARLSGWGTWRIARRELLPGLAAPVITYSALLVPQNITIEAALSFLGVGVKPPTPSWGQMLTAADVWYQAAPQYLLLPAGALFVTVLALTVLGDGVRTALDPRAASRLRVGTGRKREARAAADAGAPAKADVAAPAQADAGASANKEAKA

SEQ ID NO: 10627 - protein, 572 aa, Streptomyces avermitilis
MRHPSVIARRVAAASVSLVVAAGAAACGPEDNDAKGAGGDSTPRKGGTLTVLNSNPQEDFDPGRLYTSGGGNVPSLVFRTLTTRNREDGAAGAEVVPDLATDTGRPSKNATVWTYTLKEGLKYEDGAAITSADIKYGIERSFAPELSGGAPYLRDWLVGAADYQGPYKDKKGLSAIETPDERTIVFHLNKPEGEFPYLATQTQFTPVPKAKDNGTKYEEHPISSGPYKVVKNENDGERLTLERNTYWSAATDAERKAYPAKIDVRSGLDSSVINQRLSASQGADATAVTTDTNLGPAELAKVTGDKALAARVGTGHFGYTDYIAFNPKVKPFNNAKVRQAISYAIDRSSVINAAGGSSLAEAATTYLPNQKSFGYTPYDHFPAGTSGNPAKAKELLKEAGYKNGLTISLTHSNSKDFETSPEIATAVQDALKKAGITVKLQGLEENDYKDKIHSVKTEPGFFLAHWGADWPSGGPFLAPIFDGRQIVKDGANFNTGFLDDKSVNAEIDAINKLTDLDAAAKRWGALDQKIGEQALTVPLFHPVYKRLYGSAVKNIVISDWTGVLDISQVSVK

SEQ ID NO: 10628 - protein, 516 aa, Streptomyces avermitilis
VGRHSRKGRGDKGGTGSVPVIPEPARGRAQTPVQAPGADGAQASVAAGAQASVQRQPAGGAAQRPVPRFADGTPANGVPRFAEGTPARGVPAGPRLPDGTPARGVPRFLDGTPAHGTPRPFDGTPAHGTPQVRGGHPQQREPGGGWGESGGVPAGAPKAAPPGPRLPGQRRHRGLGPRQDYVDAFGADEDDVFAPRGGAGNRMDPYGPPSPHAPHAHAHAPATDRDGRTGADTEAAADEEPGKEKGGKGRTFTGIAAAAVTTVLAVVVAGQVADGHDDKAAVQSQSATDSARDARDSASRGDDRPTPSGSPSVAALTYGQKMAKVYPLGATLKAAGKFDAIGGFDKAPGGGRKYTYRVDVEKRLGLDGELFAQAVQKTLNDDRSWAHNGARTFERISSGKPDFVITLASPGTTADWCAKSGLDTTEDNVSCDSAATERVMINAYRWAQGSKTYGFGDQIHAYRQMLINHEIGHRLGYGHVTCGKDGELAPVMQQQTKFLDHDGIHCRANAWPYPGS

SEQ ID NO: 10629 - protein, 345 aa, Streptomyces avermitilis
MSSTELPPVPASTVLPRVAPVRVAEGERLRSVGLPGATLTVRSRPPVREGLPPALCVHGLGGSSQNWSALMQRLEGLVDSEALDLPGFGDSPPPDDGDYSVTGHARAVIRYLDAAGRGPVHLIGNSMGGAVTTRVAAVRPDLVRTLTLVSPALPEIRVQRTAVPTALLALPGVAPLFTRLTKDWTAEQRVRGVMALCYGDPGRVTPEGFRAAVEEMERRFALPYFWDAMARSARGIVNAYTLGGQHGLWRQAERVLAPTLLVYGGRDQLVGYRMARRAARTFRDSRLLSLPEAGHVAMMEYPDLVAEAVRELLADTGELGEPAKVSDEAAGSAMADEAGTAGAGS

SEQ ID NO: 10630 - protein, 73 aa, Streptomyces avermitilis
MAIDPTDPETFENEVDGEAELDVEAPEGDAAEQLADIAPEEDDPLTDVNPDRANEADLVEQARVVSLDEDDYR

SEQ ID NO: 10631 - protein, 213 aa, Streptomyces avermitilis
VTAIEQTEAARPRGTRLPRRARRNQLLGAAQEVFVAQGYHSAAMDDIAERAGVSKPVLYQHFPGKLDLYLALLDQHCEALLQAVRAALASTNDNKQRVRATMDAYFAYVEDDGGAFRLVFESDLTNEPAVRERVDRVTVQCAEAICEVIAEDTGLSRAESMLLASGLGGLAQVVARSWLHSDRSVPRDQAVQLLTSLAWRGIAGFPLHGTDAH

SEQ ID NO: 10632 - protein, 94 aa, Streptomyces avermitilis
VLSTARRAAHITDRRRDKVVEVKIGVQHAPREIVLESGQTAEEVERAVSEALAGKSALLSLVDDHGRKVLVPADRLAYVELGEPTTRKVGFSAL

SEQ ID NO: 10633 - protein, 117 aa, Streptomyces avermitilis
MMIAFRTSGVDRLRPICTCVCRAGGTPTMFLEALGSAIIGLALAWAAVYRMPHRLPARSMVLSTGVAGALFGAFLTHSALGPGHVLVSLIGAAVVSAASLSLLLRPAERFRRRSATA

SEQ ID NO: 10634 - protein, 248 aa, Streptomyces avermitilis
VRFMTTPDNAADTPAEPTGVAAQDWAKASVDPQYRAAVVDLLGALAYGELAAFERLAEDAKLAPTLADKAELAKMASAEFHHFEQIRDRLTEIGAEPTAAMDPFVAALDGFHRQTAPSDWLEGLVKAYVGDSIASDFYREVAARLDSDTRSLVLAVLDDTGHAGFAIEKVRAAIDADPRVGGRLALWARRLMGEALSQSQRVVADRDALSTMLVGGVADGFDLAEVGRMFSRITEAHTKRMAALGLAA

SEQ ID NO: 10635 - protein, 759 aa, Streptomyces avermitilis
MTLPVALSGSDVIGQAKTGTGKTLGFGLPLLERVTVPADVEAGRARPEQLTDAPQALVVVPTRELCTQVTNDLLTAGKVRNVRVLAIYGGRAYEPQVEALKKGVDVIVGTPGRLLDLAGQKKLDLKHIKALVLDEADEMLDLGFLPDVEKIINMLPARRQTMLFSATMPGAVIGLARRYMSQPTHIRATAPDDEGATVRNTAQFIYRAHNMDKPEMVSRILQADGRGLAMVFCRTKRTAADLADQLQQRGFASGAVHGDLGQGAREQALRAFRNGKVDVLVCTDVAARGIDVEGVTHVINYQSPEDEKTYLHRIGRTGRAGAKGIAITLVDWDDIPRWQLINKALDLGFNDPPETYSTSPHLFEELNIPAGTKGVLPRSERTRAGLAAEKVEDLGETGGRGARGRGGRPSSADRDRDRDRDRDRERTPRRRRRTRNGETVDAAAVTPVTPAEAPADSADSPASTEPRTPRRRRRTRGGATGEPVASVNGTAVTEAVVTEAARTAVDTAEGTEAAESAKPRRRRTRKTAETPVAAPEVTLEAPATDAAEAPAAPRRRTRKAAETVVDTAEAVATTEEPEAKPRRRTRKAAEAAVDTAEAVATTEEPEAKPRRRTRKAAEAAVDTAEGAAAAAPEAVEAPAAPRRRTRKTAEAAVDTAEAVATTEEPEAKPRRRTRKAAETAVDTAEGVAAEPTEAKPRRTRKTAVAADAEPTEAKPRRTRKTAVAAEAAIPAQTAEEAAEPAKPRRRTRKATAAAEPAES

SEQ ID NO: 10636 - protein, 290 aa, Streptomyces avermitilis
MSRPPTFAPPPGVRAYHLATARGDFAVLDAPAVGPLRGTALLLPGFTGSKEDFIALHGPLADAGYRTVAVDGRGQFESPGPRDDEAPYAQAELAQDVLAQTHAIGAPVHLLGHSLGGQIARAAVLLDPAPFVSLTLMASGPAQISSSQQQRVKLLRDALAVMDLAQVWDAMQAMDAPEETDTGELDEGLDDREDLRRRWLGNSPAQLIATGRQLCVEPDRVAELAAVGLPVHVLSGELDDTWPITLLDDMATRLGAQRTVVRDAEHSPNTDQPLTTARALAAFWDRSRTT

SEQ ID NO: 10637 - protein, 298 aa, Streptomyces avermitilis
MNDDHAALGARIDRTNELLQRMLAEVAKTPSTHAIFVDAGYLYAAAGRLVAGTEDRRAFELDAEGLIEALIDKARTIFADSRLLRVYWYDGARRRIHTAEQQSIAELPDVKVRLGNLNANNQQKGVDSLIRTDLESLARHRAISDAALLGGDEDLVSAVEAAQGYGARVHLWGIEAPEGRNQAEPLLWEVDSQRTFDLDFFKPYVSRRTAATYDASAAIRPTREDVRFVGAQIAAKWLAARGREALVELLPGHPYLPGSVDQDLLVEAEGLLQYSLRGQADLRRALRDGFWEHLQAQY

SEQ ID NO: 10638 - protein, 58 aa, Streptomyces avermitilis
MTRRREKPLRFEIMRLDDVDGTPVDSTVVDAASVNRIVQQAAAIGQRLWIRPTESSAS

SEQ ID NO: 10639 - protein, 201 aa, Streptomyces avermitilis
VFDVAVFGSLFLTLFVIMDPPGITPIFLALTAGRPAKVQKRMAFQAVCVAGGVITVFGLLGHQILDYLHVSVPALMIAGGLLLLLIALDLLTGKTDEPKQTKDVNVALVPLGMPLLAGPGAIVSVILAVQKAGSVATQVSVWAAILAIHVVLWVVMRYSLLIIRVIKDGGVVLVTRLAGMMLSAIAVQQIINGVTQVIRGS

SEQ ID NO: 10640 - protein, 288 aa, Streptomyces avermitilis
VRIDLHTHSTASDGTDTPAELVRNAGAAGLDVVALTDHDSTRGHAQAIAALPEGLTLVTGAELSCRLDGIGMHMLAYLFDPEEPGLLAERELVRDDRVPRAQGMITKLQELGVPVTWEQVARIAGDGSVGRPHIASALVELGVVESVSDAFTPEWLADGGRAYVEKHELDPFDAIRLVKAAGGVTVFAHPAASKRGRTVPESAIGELAAAGLDGIEVDHMDHEPATRARLRGLAADLGILATGSSDYHGSRKTCVLGEFTTDPEVYGEITRRATGAFPVPGTGGSHFA

SEQ ID NO: 10641 - protein, 213 aa, Streptomyces avermitilis
MRGEPSCPKCGGRVRAPGLFADSWQCDVHGAVYPLQPVIPPSVEALGVVVHRAQVPVWMPWPLPVGWLFTGAGCAGDDRSGGRATAVACSGPGPLGGIGELVLVAEELGVGLGARYAGIDGPDPGPYIDVEKPPQAKVLAAGRPTPLWHVSGTPDDRAVFAGEALGLWLWAVVWPEQSGLLMYDELVLTDLRDAGAEMDLLPCGALSPRLLEP

SEQ ID NO: 10642 - protein, 62 aa, Streptomyces avermitilis
LTTTVTSSRVACRRSGSLIFGAKYGAAATANHRTKLQPALATGRGASEMPGPARCRPRCSRR

SEQ ID NO: 10643 - protein, 194 aa, Streptomyces avermitilis
MADVLPLVEARLRAALGEPDARAAVTFLGTDRIEVLRFTAGDVVRYATLGMSAQPMTDPTAVVADQVKGPRAELVLSVRAGGADTDKVLRPLAVLAASPQVEGLVVAPGASLDVGEPLWPGAPFSSVLVAESGGLVEDLELDEPADPVRFLPLLPMTPNEAAWKRVHGAQALQERWLAGGTDLRDPSRRSVPLD

SEQ ID NO: 10644 - protein, 371 aa, Streptomyces avermitilis
MSMIRDLRAAVRPSRPSMRKDGSAYDTTRDPSTPSAVVDCAIYRDGARVATDRPLTPHEAMRQVRRDGGFVWIGLHEPTEAEFAGIAGEFGLHPLAVEDAVQAHQRPKLERYDDSLFTVFKTIHYVEHDQLTANSEVVETGEVMCFTGRDFFITVRHGGQGSLRALRHRLQDDPELLAKGPSAVLHAIADHVVDGYIAVADAVQDDIDEVETEVFSPGRKGTPRGTDAGRIYQLKREVLEFKRAVSPLLRPMQLLSERPMRLIDPDIQKYFRDVADHLARVQEQVLGFDELLNSILQANLAQASVAQNEDMRKITSWAAIIAVPTMVCGVYGMNFEHMPELHWRFGYPVIMSVTVVLCLGIHRALKRNGWL

SEQ ID NO: 10645 - protein, 180 aa, Streptomyces avermitilis
MTEQLLDRALVEEATKKSGLIWVRGDGAPAPDDRAHGVPTRPLWHAWHAGAVCLVGDGPGEQPLPGLVDGGGATVTVRSKDKGGRLVTWSAKVVELAPGSPEWAAAVAELKGKRLNAPDGEAMPERWARECRVLRLEPLGDTAELPTDSLAAAPLPTPATTRHPIPAALPRLLLKRRKRG

SEQ ID NO: 10646 - protein, 254 aa, Streptomyces avermitilis
VTAIPQGRTRRAALVSATCALVVTGTGLTGCSSSDPDAGTNGVGKLPAEKIQSRTRAAAEAADTVRLSGTVVTNGRTYRLDMRLKEDGASGSVTSKGATFRLLRVGRHLFLKAGADFWSHQGGQGGGGSSDAGDAAADKLDDKYVKVPTGDPAYKRFSGFTDKSVLLDGLLTLHGTLATDGHHDQSGVRTIRITGEKGSGGTLDVSLEGKPYPLRLVRAGGAGTLSLTDWGKGFALKEPSKKETVDYGQQLPTS

SEQ ID NO: 10647 - protein, 432 aa, Streptomyces avermitilis
MVAGAPRIFVSHLSGVPVFDPNGDQVGRVRDLVAMLRVGRRPPRLLGLVVELSTRRRIFLPMTRVTGIESGQVITTGVLNVRRFEQRPTERLVFGELLDRRVRLVETGEEVTVLDVAVQQLPARREWEIDRVFVRKGRSGAFRRTKGETLTVEWSAVTGFSLEEDGQGAESLLATFEQLRAADLANVMHHLSPKRRGEVALALDDDRLADVLEELPEDDQIEILSKLKEERAADVLEAMDPDDAADLLGELPEEDVERLLTLMRPDEAADVRRLMAYEERTAGGLMTTEPIVLRPDATVADALARVRNADLSPALAAQVYVCRPPDETPTGKYLGTAHFQRLLRDPPYTLVSSILDDDLQPLAPDAALPVVAGFFATYDMVAAPVVDESGSLLGAVTVDDVLDHMLPEDWRETEFHLDDGPGADGSEAPHGP

SEQ ID NO: 10648 - protein, 198 aa, Streptomyces avermitilis
MAPEREIRERTASGAIAATRPRTRLDQPKPQRRRLLPEWDPEAFGRLSERIARFLGTGRFIVWMTVVIILWVVWNVAAPGEWRFDTYPFIFLTLMLSLQASYAAPLILLAQNRQADRDRVNLEQDRKQNERSIADTEYLTREIAALRIGLGEVATRDWIRSELQDLVKELEERYTDGHGDGRVVFPAERAHGRDVDDR

SEQ ID NO: 10649 - protein, 377 aa, Streptomyces avermitilis
MATEDAVREALATVNDPEIQRPITELGMVKSVEIGADGAVAVTVYLTVSGCPMRETITTNVTKAVSAVEGVTRVDVTLDVMSDEQRRELATALRGGQAEREVPFAKPGSLTRVYAVASGKGGVGKSSVTVNLAAAMAADGLKVGVVDADIYGHSVPRMLGADGRPTQVENMIMPPSANGVKVISIGMFTPGNAPVVWRGPMLHRALQQFLADVYWGDLDVLLLDLPPGTGDIAISVAQLVPNAEILVVTTPQQAAAEVAERAGSIAVQTHQKIVGVVENMAGLPCPHCDEMVDVFGTGGGQSVADGLTRTTGATVPVLGSIPIDVRLREGGDEGKPVVLTDPDSPAGSALRAIAGKLGGRQRGLSGMSLGITPRNKF

SEQ ID NO: 10650 - protein, 244 aa, Streptomyces avermitilis
VRTVGERGRPWGAGRSGPTRARRRPGMETTSRVGAQAPAAEGGQQFPSARRTVDGYLLAPFPWYGLDEAFTGPRWLMQVGTAADGAVEHGSIGHGEEPTVRGESTEDKERFAVVVTVAANPVRRSADGTGLLEATSVSSAAWLAGVGLLSVTWPGQMDHTLRDDWLDQQTETAWVLADDLAGPDWSTLSLPVDGVPSSFHYRESEFGWVLAGSTQEGVHVGAYGRGMSAYGLGFSVIKDIAAYA

SEQ ID NO: 10651 - protein, 148 aa, Streptomyces avermitilis
VFNDIGPLELVTLVVLAVLVFGPDKLPKMIQDVTRTIRKIREFSESAKQDIREELGPEFKDFEFEDLNPKTFIRKQLDNDELGLKEIRNGFDLKKEMAEVTDAVHGRESETSASSSSANGSAGGTVDMTKKREQLEADERPPFDADAT

SEQ ID NO: 10652 - protein, 619 aa, Streptomyces avermitilis
VKSPSATGTSSWSARLRRAGGAVRPTRYPPARRRRTRRPKRPRRRLLRLTWPLPRAPRLPMPKSPPCRRCPAFRPTPRPPVWPTRPSTRPTLLPPRPTLPPVLPTRPSKPRAKPPPRRPCPAPRPMPRAVFPSTGPSRCTIPIPTAPTRYGHAGALGSGLRPSSCPGDHARPTGTPPESASHDCPGTCRALGTPDARRPGHRRMASPTGRPRVAGRSPMSAPWQNYDPWAATSAPVHQTRHRSRAPGRSGASARVRVLVLGAVVLALVSGGIGGAVGVYLERTGGVTDVELPQAGQESEERAADSVAGIAARALPSVVTLHVKGSAAEGTGTGFVLDGRGHILTNNHVVEPAGSSGEISVTFSGGETAKATVVGRDSGYDLAVVKVSGVGGLKPMPLGNSDNVQVGDPVVAIGAPFDLANTVTSGIISAKERPITAGGEKGDGSDVSYVDALQTDAPINPGNSGGPLLDSKARVVGINSAIRSADSSSDQSGQAGSIGLGFAIPVNQAKRVAEELINTGRATHPVIGVTLDMDYTGDGARVGTKSNDGGSPVTRGGPGDRAGIQAGDVITEVDGQRIHSGEELIVKIRAHRPGDRLALTVERDGKEKPVTLVLGSASGA

SEQ ID NO: 10653 - protein, 334 aa, Streptomyces avermitilis
VSGTRPNSAERRIADQHLGDRLSALVDGELGHESRERVLAHLATCAKCKAEADAQRRLKNVFAEVAPPPPSESFLARLQGLPGGGDSDGSGSPLDGGGFGRRLSGRPGVPGGAGVFGVRGETSFGYVPSGPHATALSPSEDRALSGDRGFRIHDVSRHEAERSATRGMRFAFVAAGAVSLAAIALGGVSATGVPTDTAADARGGSGSGSNVTPMRTPGAGAATAPESQRRRSVGPLLGQGQRSLGETAVAPTEVSAPLLPGAPTPAARKLPDLHTLTAPVVAGAAVMSPLIRPLTEAAPVALSSWSTAAGVTAPGLLVAPDATSFPSPTSPTAP

SEQ ID NO: 10654 - protein, 219 aa, Streptomyces avermitilis
VTDIADKHHAATTAQTATFATDADSQAWTPPTWEEIVSTHSGRVYRLAYRLTGNQHDAEDLTQEVFVRVFRSLSTYTPGTFEGWLHRITTNLFLDMVRRKQRIRFDALGDDAAERLPSREPSPQQVFNDAHFDADVQQALDTLAPEFRAAVVLCDIEGLSYEEIAATLGVKLGTVRSRIHRGRSQLRKALAHRSPAARAERRSFAVTGVPVLGGGGASA

SEQ ID NO: 10655 - protein, 174 aa, Streptomyces avermitilis
VSPGTGAALRLLAATVDAKAVAEIGTGTGVSGIHLLHGMRPDGVLTTVDPEPERQQFARQAFRAAGFASNRARFIPGRALDVLPRLADSGYDLVFCDGDRLECLDYLAESLRLLRPGGLVVFEGVFADGRTVDSGPQPAEVGRLRELLRAVRESPDLVPSLLPVGDGLLCAVKR

SEQ ID NO: 10656 - protein, 81 aa, Streptomyces avermitilis
VSYQQARVPSHGAVGDDELVSGRGTSMAAMKPRTGDGPLEVTKEGRGIVMRVPLEGGGRLVVELTPDEADALGDALKKVVG

SEQ ID NO: 10657 - protein, 267 aa, Streptomyces avermitilis
MADTVLYEVSDGLATITLNRPEAMNAMNIATKVAFRDAARTAADDEAVRAILLTAAGDRAFCVGQDLKEHIGLLASDKQSGSGQTMSTVREHYNPIVRALTGAAKPVVAAVNGVAAGAGFGFALAADYRIVADTAAFNTSFAGVALTADSGISWTLPRVIGPSRAADLLLFPRSITAQEAYEWGIANRVVPAAELRAEAQKVARSLAEGPTVAYAALKESLAYGLSHTLDETLEKEDELQARAGASEDHGIAVQAFVNKEKPKYLGR

SEQ ID NO: 10658 - protein, 193 aa, Streptomyces avermitilis
VSSGALAGSDGVLRCPWALSTEDYVAYHDEEWGRPVHGDDALYERLCLEAFQSGLSWITILRRREGFRAAFAGFEIGKVADFTDADKERLLADPGIIRNRLKIEATVANARVLADWPAGELDELIWSFAPDPAARPVPRTLADVPAVTDESTALSKTLKKRGIRFIGPTTAYALMQACGLVDDHLADCVARSH

SEQ ID NO: 10659 - protein, 118 aa, Streptomyces avermitilis
MFMFIFLVVALVVVVAAVTLAVVGGGESAPLPEAAAERLDDPLPPDRPVNRADVEALRFPLAPRGYRMADVDDALGRLGAEIAERDARIADLESALAGARTARVSMDKPVEGDQGDHQ

SEQ ID NO: 10660 - protein, 286 aa, Streptomyces avermitilis
MLRLGKREFGTHEPVIMAIVNRTPDSFYDQGATFHDEAALARVERAVSEGAAIIDIGGVKAGPGEEVTAEEEARRTVGFVAEVRRRHPDVIISVDTWRHEVGAAVCEAGADLLNDAWGGVDPRLAEVAARYGVGLVCTHAGGSQPRTRPHRIAYDDVMADILGVTLGLAERAVELGVPRESVLIDPGHDFGKNTRHSLEATRRLGEMVETGWPVLVSLSNKDFVGETLDKPVKERVLGTLATTAVSAWLGAQVYRVHEVAETRQVLDMVASIAGHRPPAVARRGLA

SEQ ID NO: 10661 - protein, 252 aa, Streptomyces avermitilis
MPTGNPEGKKQPPEEQRLGPVLRRRDQVQSSTTDQRLLDAGGPSDWVHTDPWRVLRIQSEFIEGFGTLAELPPAISVFGSARTKEDSPEYEAGVRLGRGLVEAGWAVITGGGPGAMEAANKGACEAKGISVGLGIELPFEQGLNPYVDIGLNFRYFFVRKMMFVKYAQGFVVLPGGLGTLDEFFEALTLVQTQKVTRFPIVLFGTEYWGGLVDWLKHTLVGQGKAAEKDLLLFHLTDDVDEAVGLVSKEAGR

SEQ ID NO: 10662 - protein, 359 aa, Streptomyces avermitilis
MADTPLDLTLDAAELTARLVDFPSESGSEKPLADAIEAALRALPHLTVDRYGNNVVARTNLGRAERVILAGHIDTVPIADNVPSRLDENGVLWGCGTCDMKSGVAVQLRIAATVPDPNRDLTFVFYDNEEVAAHLNGLKHVAEAHPEWLAGDFAVLLEPTDGQVEGGCQGTLRMFLRTEGERAHSARAWMGSNAIHAAAPILARLAAYEPRRPVVDGLQFHEGLNAVRIEGGVANNVIPDACTVVVNFRYAPDRTEEEAEAFVRAYFADCGVTEFIVDDHTGGARPGLTHPAAAAFMAAVGGEARPKFGWTDVARFSALGVPAVNYGPGAQLLAHKVDERVEAAVIPQAEERLRAWLTS

SEQ ID NO: 10663 - protein, 287 aa, Streptomyces avermitilis
VQYVTGGPGATSCKVVSDERDGASYEFTPEQAVNAATISAVGATRGMPERAVTIALATALQESGLRNIRHGDRDSLGLFQQRPSQGWGTKKQIMDPTYAAGVFYEHLAKVSDYTQLRLTVAAQRVQRSGYPEAYAKHEPDATLLAAALTGHSAATLTCEGRPAPARTGGTDAVRAALVRDFGRDVLQSAGAEVSTGTPSPSPSPKATAAPGAVTVPVPRRTAAEGSTRQRGWALAHWAVANASALHIAHVSYAGREWSRGGYANEWRTAGDSGAKTSTAEVRIVAGQ

SEQ ID NO: 10664 - protein, 149 aa, Streptomyces avermitilis
MSLPLTRRIARAALLVAAGAAAGVGAAGSASAAPELPTAPNLGGLTALDGAHAADTVDGAAQNVTGLAGSTGSKAVKKAVPAVGKTGGKVARTATPAAQKVAGDAAGQAGGLLGDTAKTASGGGLPTDAVTKGGLPTQQLPLKGGLPLG

SEQ ID NO: 10665 - protein, 364 aa, Streptomyces avermitilis
VSAVSDRLPTFPWDKLEPYKARAAAHPDGIVDLSVGTPVDPVPELIQKALVAAADSPGYPTVWGTPELRDALTGWVERRLGARGVTHHHVLPIVGSKELVAWLPTQLGLGPGDKVAHPRLAYPTYEVGARLARADHVVYDDPTELDPTGLKLLWLNSPSNPTGKVLSKAELTRIVAWAREHGILVFSDECYLELGWEADPVSVLHPDVCGGSYEGIVSVHSLSKRSNLAGYRAAFLAGDPAVLGPLLQIRKHGGMMTSAPTQAAVVAALGDDAHVREQRERYAARRTALRDALLSHGFRIEHSEASLYLWATRGESCWDTVAHLADLGILVAPGDFYGSAGEQFVRVALTATDERVAAAVRRLA

SEQ ID NO: 10666 - protein, 106 aa, Streptomyces avermitilis
VTYVIAEPCVDVKDKACIEECPVDCIYEGSRSLYIHPDECVDCGACEPVCPVEAIFYEDDTPEEWKDYYKANVEFFDELGSPGGASKLGLIERDHPFIAALPPMNQ

SEQ ID NO: 10667 - protein, 457 aa, Streptomyces avermitilis
VEISAGGQLEVRITTADVGKRVSVRRWNEDVAGGEKFTDTVGVLTSWDNGVLLITRRGGESVRIAESSLVAGKVVPAAPARRRGPAASYEELARIAARAWQPVERERLGDWQLRASAGFTRRANSVLPVGEPGLPLDEALTVVRDWYAGRELPAYIQTATGAEGTQELLCAELEARGWTREVTAELWIGALAPLADREVSAEVVLSREADEAWLSRYQRKGLNEVALKVLGSGPSVWFATVPGAAGRAPAAIGRCVVDGRWAGFAAVEVDPAQRRRGLATAVMTALARRALEEGASAAWLQVETDNAAARALYAGMGFATHHAYHHYRWASESDVRGELGGRERGAPGEAGVSGEAGVPDEAGAPSEAGAPSESGAPSEAGAPSESSTAGESGALGGSSAPRGISTPDVSSAAGESGDEVCGGSGAGSVGGPGSGPPGASGGGSGDAVDGVGTYRSV

SEQ ID NO: 10668 - protein, 290 aa, Streptomyces avermitilis
MNGHEAAMRPPHPPEPERAAELRRRFADEARSERPDLSALCLLVGAAADGALDEAGIDAAQIDLDRLAGQVPFRPGGPRPWALALAELLGGRCGFRGTPADYQRLESSLLHEVLRRRRGLPILLSVVWMEVARRAGAPVYGVALPGHFVVGFGPPEQQVLADPFDGGRVLTGGDAELLVAGATGAPLDPSMLTPADPLDVVLRILNNIRAWAAARPERSDVALWAVDLSLLLPSHPARLRYDRAQLLVERGDFLTGAMELDAYAEVVEAVDGSAADRIRHQARAARSMLN

SEQ ID NO: 10669 - protein, 204 aa, Streptomyces avermitilis
MSRTIKVLLAEDQSMVREALAALLGLEPDIEVVAQVARGDEVLAAAREHAVDVALLDIEMPGATGIEAAAQVNRELPAVKLVVLTTFGRPGYLRSAMEAGADAFLVKDAPAAQLAEAVRKVLAGERVIDPTLAAAALAGGANPLTDREREVLRAAADGATNAELATALHLSQGTVRNYLSTAIQKLAVRNRTEAVRTARDKGWL

SEQ ID NO: 10670 - protein, 385 aa, Streptomyces avermitilis
VRTGQSPRNVREALRKAMWIVIWLVFLSSPVHDLASGHHTPAATAAGWLGLAAFVGIYLTLVFRNMGRALNGPAVAALVVALGVLAVVLCLSLGPSWLGLFVYVSVACGTTFPLRVAYWTIPLTAVAMLLVGLHGGEQDARNLVLLVVLIGFAMTGVRQLVRTTVELRKARATVAQLAANEERLRLARDLHDLLGHSLSLITLKSELAGRMLPDHPEKAAQQVADIEQVSRQALVDVREAVTGYRRPRLAGELAGMQVALTAAGVTADLPAEPDLDGVPEESESALAWALREAVTNVVRHSGARRCVVELVHRQTLDGPVLELSVEDDGSGGSGSTPGNGLTGLTERLEKAGGSLDAGRVRRGFRLVARVPMASARGPVGTAGTP

SEQ ID NO: 10671 - protein, 252 aa, Streptomyces avermitilis
VTNIFASWGLIKLEIVRALRNRKFLFFSVIYPSALFLLIAGSADSTTKVEGTGLSLPTFFMVSMASFGALTAVLMGNSERIAKERESGWVRQLRLTTLPGRGYVLAKTASAAVISLPSILIVFVVAAAVKNVRLDAWQWLALTGTIWVGSLVFAALGVAIGYLATGDAVRPITMIVYFGLSMLGGLWMPTTTFPDWLQSIAKWLPTHAYAALGQAIELGNAPQAKDIAILAVSFVLFAGGAAWLYRKDTLKA

SEQ ID NO: 10672 - protein, 302 aa, Streptomyces avermitilis
VTTGSVVAFDQVTKTYGDVRAVDGLTLALHPGETVALLGPNGAGKSTTLDLLLGLKHADSGTVRLFGGSPREAIVAGRVGAMLQSGGLMDEVTVGELVKLACDLHPKPFRVTDVLARAGVSQIADRKVNKLSGGQEQRVRFALATAGDTDLIVLDEPTTGMDVTTRHAFWATMREQADQGRTVLFATHYLEEADAIADRVLVLHRGRLLADGTAAEIKAKAGARRVSFDLEGPIDEAPLRALPFLTSVDISGHTIRIQSTDADATVHALYGLGVFPRNLEVAGLGLEQAFVAITAAEESKSK

SEQ ID NO: 10673 - protein, 759 aa, Streptomyces avermitilis
LSRETDSSSAGPNGRGGAAYPSGTPPYGTPMASEDGVDAGRPAAKSDERKTETTLTTRIRINIPGSRPIPPVVMRTPVVDAEAAEDAPAAEAPAPGPVSAISTYDVPAEASAPPGPAAPAGPAAPAEEKTSDWFAPRKSGAPKGQPGGGSTNGAGLPTGSGAQGAPGQGAPGGGGPRPGAAGGPGAGGPRPGASGPRPGGAGGSGPLGARPNGPVPGGQGGQGGTNGAGLPGATGAGPVAPGHGGGTGSFDVSEAVAATTGSFPLPVVGSDNGAEPRRDNLPYFSENDRRGPSGPTGGPVTGDGPAVPPRGPGGPGLGAPGMSSPGGPGLTAPGTGPRGPVGPGAPSTPGAPGGPGRSGGLSDDTAILTPQRFAPDPDMPGYGGPGDNVSGHTVTSGIPVVPSGGQNSPFGPGAHTDGPVPHTPPKLPAPSEPKTATSSKPAKKKGRSKLVLLGVGVVFIGGVVYGAGLLMNHSDVPKGTTVLGVDIGGGTRDEAVKKLDDALGGRTGKALKLSVDGDTVSLKPDQAGLQLDSKATVSAAANSDYNPVSVIGSLFGQQRVIEPVMPVDEEKLQAALERAAGGAGSASDGTIKFTSGKAVAVYGKAGKGIDVAQATKAVEQAYRTQVESDTSTPVKVPTTTKQPTVSNAEVDRMMKKFAKPAMSANVTVQTDAAHAIAFSPQNSLWKFLGVKAVNGKLVEAYDRAALKSLYGNTFDGVLVTRGTGKKTAVTVEDVISALRPALLTTNGAARTAVIDTDPS

SEQ ID NO: 10674 - protein, 139 aa, Streptomyces avermitilis
MSTTGRQQSALAQPVTLPSAGRAAAYLGLFLLGVLVGLAGALVQAAWFPGGLLLALAGAAGLHLGGSYVIGSRAGAVAPAAGWMVAVVLLTASRPEGDFLFGAGVVSYLFLLGGMAVAVMCATLAQGRQPGGDRVRLGK

SEQ ID NO: 10675 - protein, 294 aa, Streptomyces avermitilis
MKDLPDRRLLLVHAHPDDESINNGATMARYAAEGAQVTLVTCTLGEEGEVIPPALAHLTPDRDDALGPYRVGELAAAMKELGVTDHRFLGGPGRYRDSGMMGGEQNHRAGAFWAADLDEAAGHLVAVVREVRPQVLVTYDPDGGYGHPDHIQAHRVAVRAAELAADPAFRPELGTPWEIAKVYWNRVPRPVAEEGFARLRLALPGTRFAKSAAVDDVPGVVDESVITTEIDGTPFAAAKAAAMRAHATQVEVDGPWFALSNELAQPLFTTEYYELVRGERGSPRETDLFEGVAP

SEQ ID NO: 10676 - protein, 298 aa, Streptomyces avermitilis
MDTRDLSVPPHAQSRPPADKHPNRRHSRTGDSGHGGLTHDNARHTTRFTVIGNHLAQHPELSGLAIGLAVYIQSLPAGARVDIKTLAARFPEGVTRIAAALRELEAHGYLRRERQRIPGGRIVTRTISCNQPGRRSEGEPVCSAPARPVAAPERREKRAPKPLPAVPHPAQPAPALLQAATALLAGLRRHDPRLLLSACDTAHLVPGVAAWLERDVSPGAVRHALTSDLPPEGPRRPAALLAHRLAAHLPPPPPFGVPAPPPPAVRSPLQTCDGCDRAFRAPDPGLCRDCRSDLRTAA

SEQ ID NO: 10677 - protein, 164 aa, Streptomyces avermitilis
VIQKTAAPEARLDHPIRNFSVQLSPTPRGARLARLLATEQLRSWELPLDPARQLVAELAANAATHSRVPGRDFRLTLYVVGDTLRIEVTDTCGDLLPRPQDPTSDAESGRGLVLVEAFADRWGVAQGPCPRKTVWAELNLVPLAPDPARTCSGARGALPKELQG

SEQ ID NO: 10678 - protein, 289 aa, Streptomyces avermitilis
VNGKAVQLKEEADEPGWEVDPDDEWGVAVVETVGRQLKLRREALGMRAADFGTAVGYGEDMVYKIESGKRIPRPEFLDRADELLGAGGLLSAMKEDVKKVRYPKNVREIAKLEAQAVELGVYVGLSLHGLLQTPEHARALFEVWQPAYSPEEAERRMAARMARKAIFERSPAPALSFVQEEATLRRPVGGTMVWRQQLEHLLEVGQLRNVTLQVMPTNSEAHPGLSGRIEVLKFSDGTAVGRSDGAYNGRPISDPKQLRILELRYGTIRAQALPPRESLAFIEQLLGET

SEQ ID NO: 10679 - protein, 70 aa, Streptomyces avermitilis
MIHNGSAGDTSELAWFKSSYSDGPDGDSCVEIATTPGTIHVRDSKHADSSPRLALSPKAWAAFVPYASEG

SEQ ID NO: 10680 - protein, 64 aa, Streptomyces avermitilis
VALSISAVVLLAIIVFILIKKSGLKAPHAIVCVLFGFYLASSTVAPTINELTTNIAGMIGSIKF

SEQ ID NO: 10681 - protein, 710 aa, Streptomyces avermitilis
MTTEPLSFPRRQARTQRFTLGAPRAFTVAPDGSRVVFLRSGSGTDRAQKLWVLDLPDGRERLAADPGALLGGASERLSPQERARRERSREGGAGIVAYATDTALELASFALSGRLFTAELRAGTARELRVPGPVIDPRPAPDGRHIAYVAGGALRVVGAEGEGDRALAEPEPAADAATVSYGLAEFIAAEEMGRSRGFWWSPDSDRLLVARVDDAPVRRWWISDPAHPEREPQRVAYPAAGTDNADVRLFVIGLDGVRTEVVWDRARYPYLAHVHWSEAGAPLILVQARDQLSQLFLAVDPDSGTTRMVHADEDRQWLDLFPGVPCWSPAGQLVRIADEGGARVLAVGERPLTGPQLHVRAVLDVTADDVLVAASAGEAAPSPEIGEVHVYRVNELGVERVSQEPGVHSAVRAGGVTVLVSAVPAQPGTQVQVLREGKRAATVPSYAEHPGLPPRVTLTRGGARKIPCAVLMPSDYPGDTPLPVLMDPYGGPHGQRVLAAHNPHLTSQWFADQGFAVVVADGRGTPGRSPAWEKAVKDDLAAITLQDQVDALHALAGDFPLDLSRVGIRGWSYGGYLAALAVLRRPDVFHAGVVGAPVTDLRLYDTHYQERYLGHPVRQPEVYRRNSVIDDAGLVDAAEPHRPMMIIHGLADDNVVVAHSLRLSSALLAAGRPHEVLPLSGVTHMTPQETVAENLLLLQLDFLKRSLGVA

SEQ ID NO: 10682 - protein, 361 aa, Streptomyces avermitilis
MAEPILEVSGLVKHYPLTRGILFRKQVGAVKAVDGVDFALGHGETLGIVGESGCGKSTVAKMLVSLEKPTEGSIKYKGEDVTRLSGKALKAVRRNIQMVFQDPYTSLNPRMTVGDIIGEPYEIHPEVAPKGDRRRRVQDLLDVVGLNPEYINRYPHQFSGGQRQRIGIARGLALRPEIIVADEPVSALDVSVQAQVINLLAKLQDEFRLSYVFIAHDLSIVRHISDRVGVMYLGRIVETGKDAEIYDHPTHPYTQALLSAVPVPDPEAREHRERIILVGDVPSPTNIPSGCRFRTRCWKAQERCALEVPLLAVPAVFRFTSGPAAHDSACHFAETVPMRHSAPGRVVPPEQDPEQDPEQGA

SEQ ID NO: 10683 - protein, 327 aa, Streptomyces avermitilis
MLLDVRDLRVEFRTRDGVAQAVNGVDYGVDAGETLAVLGESGSGKSVTAQAVMGILDTPPGRITGGEILFQGRDLLKLKEEERRRIRGAEMAMIFQDALSSLNPVLSVGDQLGEMFVVHRGMSKKDARAKAVELMDRVRIPAAAERVRDYPHQFSGGMRQRIMIAMALALEPALIIADEPTTALDVTVQAQVMDLLAELRRELNMGLILITHDLGVVADVADRIAVMYAGRIVESAPVHEIYKAPAHPYTKGLLESIPRLDRKGKELYAIKGLPPNLMNIPPGCAFNPRCPMAQDVCRTDVPPLYEVDDGGAARGSACHFWRECLHG

SEQ ID NO: 10684 - protein, 306 aa, Streptomyces avermitilis
MDLATSEAATLERIPGGPEGTGPQGKPRSLWSDAWRDLRRNPVFIISALVILFLVFISVWPSLIAPGSPLKCDLAKAQEGPAPGHPFGYDGQGCNVYTRTVYGARVSVTVGVCATLGVAILGSVLGGLAGFFGGVPDSFLSRVTDVFFAIPVVLGGLVLLSVVTSNTVWPVVGFMVLLGWPQISRIARGSVITAKQNDYVQAARALGASNSRMLLRHIAPNAVAPVIVVATIALGTYIALEATLSYLGVGLKPPTVSWGIDISAASPYIRTAPHALLWPAGALAVTVLAFIMLGDAVRDALDPKLR

SEQ ID NO: 10685 - protein, 307 aa, Streptomyces avermitilis
MGRYVIRRLLQMIPVFIGATLLIFLMVNVMGDPIAGLCGDKQCDPATAAQLKKEFGLDKPVWQQYLTYMGHVFTGDFGTAFNGQEVTELMADAFPVTIRLTLVAIVFEIVIGIALGVVTGLRRGRPVDTGVLLLTLVVISVPTFVTGLLLQLLFGVEWGWIKPSVSPDAAFGELIVPGLVLASVSLAYVTRLTRTSIAENKRSDYVRTAVAKGLPRRRVITRHLLRNSLIPVVTFIGTDIGALMGGAIVTERIFNIHGVGFQLYQGILRQNTQTVVGFVTVLVLVFLVANLLVDLLYAVLDPRIRYA

SEQ ID NO: 10686 - protein, 540 aa, Streptomyces avermitilis
MRGATHAKWAACAAAAALAATACGGGGGGSAPGVLSSSWGDPQNPLEPANTNEVQGGKVLDMIFRGLKRYDARTGAAQNMLADRIETSDSQNFTITIKGGWKFSNGEPVTAKSFVDAWNYGAGLEHNQKNAYFFGYIDGYDKVHPEDGGTQTADTLSGLAVKNDRTFTVRLRQKFSTFPDTLGYAAFAPLPQAFFDDHAAWVKKPVGNGPYLIDSYTKGSKMSLRKWAGYPGDDKARNEGVDLQVYTDNNTAYTDLMAGNLDLADDIPAAQLKNVKSDLGGRYINTPAGIIQTLAFPFYDSKWNQSGSDKVRKGLSMAIDRDRITGTIFQKTRTPAGDWTSPVLGKDGGFQDGLCGDFCTYDPQRAKKMIDEGGGLPGGQVKISYNADSGSHRVWVDAVCNSINNALGNDKACVGNPVGTFADFRNQIGRHKMPGPFRAGWQMDYPLIQNFLQPLYYTNASSNDGKWSDKDFDKLVDRANAETDRAKAVQLFQQAEGVVRDNMAAIPLWYQNGSAGYSDRVSDVALNQFSVPVYNEIKVS

SEQ ID NO: 10687 - protein, 329 aa, Streptomyces avermitilis
VTDESVEKSITSPTPKANESRSPGQLAWLRFKRDRTGVISALVVIFFFVVAIAAPLIATLYGKDPTTTYGINTPGLLGDNSFPIKPNGGISSDFWFGLEPGLGRDVFTFLIYGIRNSLLIAAAVTVLVMIIGVVVGVTAGYVGGKSDWFIGRVIDILLAFPSQLFFVAFTPVVLALFVAPDENTPTWLTVVSLIGVLTAFGWASIARLLRGQVLALREREFVEAAKVTGASPARIIFKELLPNLWTPILIQATLLLPTMVTTEAGLAFLGVGVKETTPDWGVMLGRAADVYQDDITYLLFPGITMVIFVLAFNLLGDSMRDALDPKTKR

SEQ ID NO: 10688 - protein, 587 aa, Streptomyces avermitilis
MSFSRRNFLIATGVVAASSSVLSACSSGDSSGGSGGGKQDAAKAKTTTVKIGTAADSKGPAPEVPGAKKGGTAYLLNDDDFSHLDPQRIYYAWNSLAAIVLSRTLTGYKVGDDGTMTLVGDLATDTGKMSDGGKTWSFTLKDGVKWENGADVTVDDVRHGIERAFASYITEGAFYVQAWLTGSQNYRKSYSGPYKGKHLKSIETSGKTITFHLSEARPDFNYVVAMHSYAPTPVKKDTKEDYDKKPVSNGPYRVKSHVTDKSMVLVRNEHWDADTDPIRNAYPDQFDFTFGIEQLTAVDRLIADAGKDKYAVSWRTIPQERIQKATTEAKDRVFEELGSGVSVYWINTTRVKDKAVREALIKAWPTAQIRQLMGGVHRGDYATGIMSPLVAGYESQDVWGKLKTPAGDPKAAKKILDKAGKTKQKIVYAYQQDDVQPKIAVVIENALKAAGFDVVTKAIDSTTWYDQIGKLDNPFDVYWGGWSSDWPTGYSVFQPLFDSANVVDQGQNYSHLKDPAVDAAIKAATLETDQTKANKMWAALDKQVTEIGAFIPDVYMKRIYLHGSKLGNVKMDPNFDGCMLYKMYVKS

SEQ ID NO: 10689 - protein, 326 aa, Streptomyces avermitilis
MLRFLARRLLGAVITLVVISAITFMLFYAVPRDPARLACGKLCTPETLEVIRHNMGITDSLPVQYWHWLTGIFLGRDYGSYGHCDAPCLGYSFVNRESVLGTIMDRFPTTASLALGSSVVFLIGGIGAGMIAAVKQGKALDKVASGASLVASSMQIYFVGTLALYCFVYQWQILDQPSYTDFTKNPASWANGLLLPWLVLSLIWTANYTRMTRSQLVEQLNEDYVRTARAKGLSRRNVFFRFAWRGAMGPIVTIFGIDLGVLLGGAMITEKTFSLQGIGMLAIKAVTNNDLPMLLGIMVITASFVVIANIVVDAVYALIDPRIRLA

SEQ ID NO: 10690 - protein, 356 aa, Streptomyces avermitilis
VKSTATKPAGERNPQATGPFLSVQDLKVHFSTEDGTVKAVDGLSFDLERGKTLGIVGESGSGKSVTNLTILGLHNPDSTAVEGSITLDGEELNGASEKTLEKLRGNKMAMIFQDALTSLSPYHTIGKQIGETYRKHTGCSKAAARARAIEMLTRVGIPQPDVRVDDYPHQFSGGMRQRAMIAMALVCDPELLIADEPTTALDVTVQAQIMDLLKDLQKEFGTAIIFITHDLGVIADIADDVLVMYGGRCVERGTKKEVLRTPQHPYTWGLLGSMPSLEGPVDVPLTPIPGSPPSLLNPPSGCRFHPRCSFAEKVEDGRCSSERPPLEITDGRGAACHLTADQRRAFFADLAASPAN

SEQ ID NO: 10691 - protein, 348 aa, Streptomyces avermitilis
MSTTTPLLDVSGLTKHFPIKGGFPIRRTVGAVQAVDGLDFQVAEGESLGLVGESGCGKSTTGRLITRLLEPTSGKISYRGQDITHADRKKLAPVRSEIQMIFQDPYASLNPRHTVGKIIAGPMEINGIQPSGGREKRVRELLEIVGLNPEHYNRFPHEFSGGQRQRIGVARALALEPKLIVADEPVSALDVSIQAQVVNLLQDLQKDLGIAFVFIAHDLAIVRHFSQRVAVMYLGKIVEIADRADLYENPRHPYTRALLSAVPEATVEDGEARERIRLTGDVPSPINPPSGCRFRTRCWKATDKCASEAPPLVQVEGNNAGHLTACHYPETKETVPAPRLSKDPKAAV

SEQ ID NO: 10692 - protein, 55 aa, Streptomyces avermitilis
MDTNPFEDDTASYVVLVNNEAQRSLWPSSLPVPAGWTVSFGPNTRRTVVAHIEGD

SEQ ID NO: 10693 - protein, 625 aa, Streptomyces avermitilis
MSPDVDEIAAWNGVSPHVDEIAAWNDTARELPGGGDTLPELFRTQVSRTPDATALVFRDTRLSYTELDERSDRLARLLAGHGAAPDRVVALTVPRSVELVVALLAVLKTGAAYLPVDPDYPADRIGYLLADAAPVLLLTHSDVEATLPPGARPEGLPRLVVDAQEEPLERAPFAPARPPAAQDAAYVIYTSGSTGRPKGVVVPHAGIVNRLHWMQHEYRLTGDDRVLQKTPSGFDVSVWEFFWPLITGATLVVAEPGGHKDPAYLAELIRGERITTVHFVPSMLQVFLDEPAAALCTGLRRVVCSGEALPVELADRFTASLPGVPLHNLYGPTEASVDVTYWEYTPEPGATSVPIGRPVWNTRLYVLDAALRPAAVGETGELYLAGVQLALGYLNRPGLTAERFVADPYGPPGSRMYRTGDLARRRPDGALDYVGRADHQVKIRGLRVELGEIEAALARHPAVSGAAVLVREDRPGDKRLVGYVVPAPGGTVDPAELRTLAATTLPDYMVPSTVVVLESLPLTPNGKLDRKALPAPPDAAAAPARVAPRTPQEALLCDLFAEVLGLSETQVGVEDSFLELGGHSLSAIRLVSRIRAAFDTDLKVRQVFKTPTVAALAACLASAGR

SEQ ID NO: 10694 - protein, 430 aa, Streptomyces avermitilis
VEDTAAAGSAAPRRRGGGLWRNRDFLVFWTGETLSLYGTQVTTLALPLAAVLVFDASAEELGVLRFLQLVPFLGLAMLFGVWVDRVRKRPVMIGANAARMVLIGLVPALSAADVLNLPLLYAVAFGIGVAQVLFDVSWMSYVPVLVKDRRHLVEANTKLSTTSSSADVAGPGVAGVLVNALTAPTAMAVNAVTYLLSIVSLLAIRTPEPRPAKPERRRSIRADLVEGLRFVFGSRLLRAIALVGCACNFFSVMILSLFLLYAVRGQHLSAATIGLVLGVGAVGGLAGSALSGTVIRRVSVGKAYLVSVSGIFVAPLLIPAAGGSKLMVTGVFIASFLVFYASLSVANVVIVSLRQTITPDPLMARMTAAMRTLMHGGGALGGPVGGLLAGALGLHEALWLAAVLSAVMLVPIALSPVSRLHEMPAPAPVP

SEQ ID NO: 10695 - protein, 270 aa, Streptomyces avermitilis
VPLREDGTHPPLYCVHPVSGSGYVYAGLAELLGPQQPSYGFEAPGFDDGGAPLNSIEALAERHLASLRSARPRGPYLLLGWSLGGVVAYHMAQRLVEAGEEVPLLVLIDATVPQPFPLPPEKALLHAFLRDLVTAMGEPPEALDALLTPYPDDVTPEAVWTAVTAAGDEVLPEEFDEEFLQERYDVFRAHAEALYAYEHRGPYAGRVLFLKAADSLDARTRWETLAPRVERHTITGDHDSIWAGEAFATLAGLVRQGLAQARSALAPAEG

SEQ ID NO: 10696 - protein, 1016 aa, Streptomyces avermitilis
VAYRLRGTLDVGALHRALTSLVTRNTALRTTFRSAEGTPYGVVAPAGEVDLEIVDLADADLDATLRARSEAPFDLAAGPLYRFSLLRLSAEDHVLVLVFHHINTDGWSSALINREISGAYNAFVQGTQPALPELEATYEDHVRAQREQHGGDSWEQQLKFWKGKLAGLPVVEMPADRARPATPTQNGETLTFDFPAELLHGARALAQQEGASLFMVLTTALNVVVGRYTGQEDIPLGIPMLGRTEPELEDVVGLFINMLVLRTDLSGDPTFAELIERVADANMDVYDNQDVPFDQIVSHVQPAREAGRNPLFQIGTQLLGSGTGGSDLGLTGLTDEQLDVAVPRSRYDLSLTFLESADRLRFVAEYTTDLFDGIRIEAMARHIQNVLAAAVEDAEQPISKLAMLGEDERRLLLEAGRGPDFDFSHDPVHTTVLQVAERTPHAVAAVCRGVEMTYGELARRSGKLARHLRARGIRPGQVVGIVMDRDLDALVAMLGVMRAGGAYAVMDPSHPAARIDYMLQDTAAPVVITRADVAGGLPTSEDRKVVLIDADWAAIEAESDTEPLEELADRETLAYVLYTSGSTGRPKGVMIEHRSLRVFIEAYRHTFGEFTPEDRLLQQPSLIFDMSQGEIYTALITGATLVLVSPEDASSPEALGTLIREQRVTYVGLSPTLLSLLDGGPYPHLKYIMGGAEVLPAELVNKWNIPGRKFVNLYGPTEAAIACTEYLCEHIEWRSAPPIGRPEYGRLHYVVDRHGNLAPVGVPGELLIGGEDGLARGYLNLPELTDEKFVPNPFEPTGRVYRTGDLVRWTPDYQVDFIGRIDNQVKLRGLRIELGEIESALVAHPQIRMALVLLKADPQGEKQLVGYYTVLGDQAPTLAELRRHLGESMPEYMVPTAWVKLDEFPLTLAKKIDRHALPEPSYGADGTEGRAYVAPATPTEERVAEAFATVLKADQISADASFFELGGNSLQAMRAVSRINKAFGVKINVRMLYGGATVGGVAEAIDELLAAKAGRD

SEQ ID NO: 10697 - protein, 367 aa, Streptomyces avermitilis
MTTATTVSTYPMRRWVFDDAAGRYDIDLGDSNLPCGTLDELTPLGGLELDYGHNRGIPRLRALVADLYGTDDDHVLITHGAQQALYLVYNALLRPGDQVITFRPGWQQSWDMPAELGCRVDILDHRPDLTVDVEAAAAVAGPDLRLIVVNTPCNPTGQRVSDADLAALHTLAARTGAYLLLDEDYALELKDSAATRLERTISVSSLSKVYGFPGLRIGWLYGPPELVVACTERKFLSNIGNSVLCETLACDVLERRDHYTERYRTLTGEGLAVVRAWAARNTDAVRLTEPRGTPFAWFRLLTGEAPLDLCRRVLDTGVLLMPGETLGGPDGFRLCFARDPHLISEGLRRLDPVLRPQAVRNMTSGAV

SEQ ID NO: 10698 - protein, 307 aa, Streptomyces avermitilis
MGEHSTSSTVVTPASTPSASSPPAEFEESAEFFTYHALGNDYVVVDPRGSDFTPGPAAVRLLCDRHFGVGADGVLFGPLGAPEAGEPVRLRMFNSDGTECEKSGNGLRMFALHLAETYGEPWSGDEEFPLRTAAGDVPVRILDLASGTVQVGMGRPEFGATGESLDVGGRRLAVTSVHNGNPHAVVPLAEISAGLARELGPLIAGHTRFPGRTNVQFLAIVDRRTIAIEVYERGAGYTLASGSSACAAAAAAHALGLTGPDVEVRMPGGRIDVSIAADGSVSMTGTAERISSGRFSPVFRNKLETAR

SEQ ID NO: 10699 - protein, 231 aa, Streptomyces avermitilis
MPLNEQKFALIELPEVSQELLDSYEDLPVDEYMGNGTRFKRFSQYRLRPEGTEGWTFELLAHRDYTTFTKFNKVGGGIRRVYQPIKADFVPLISHGIEELGLDRSEDWQINVHQNRTRADGDYAGPLTPEGVHHDGHEFVMIAVLNKNNVAGAQTRLWEPGADAPFWTGTLEPGHAVLLDDRGLAHDVTDVESADGGPANRDIVIIAFSRWAEKWYGEEHDEAALADGAES

SEQ ID NO: 10700 - protein, 325 aa, Streptomyces avermitilis
VSSWLPRNPAELDKAVTGAERDAILDAIRSLNDDARLGDSEAFYAQQRLLARIYGLHTLIPEGPSAEGSVLLHTITRLLEEATIEAEDGYIEPGLIDQAPAEPAAYLSWLKKLAREHRVYKHPYYREFIRDEATSADLRTYVMQESVVDGRFDDLLAMMQVGTSGAAKMEIAQNFWDEMGNGKPEEVHTHLFNKIFEVFEIPADELERSLTANALLSGNLAVLLCRYRQYYPEAVGFLGMTEWLVPDRFVQVVHAWERLGLPDIGIVYHRLHITVDSQHAAGWFHNVVIPAAESEHMRRAIARGTLWRLNSSARYLDERMPAVAV

SEQ ID NO: 10701 - protein, 80 aa, Streptomyces avermitilis
LRTGKGMLFPSGGKIPDRYGEGTSVHDKISIRSLRALVCGVAAGVLTVTVLGSCHITDGAHSQTNVQADLAWGVVARHAN

SEQ ID NO: 10702 - protein, 346 aa, Streptomyces avermitilis
MTEYDEQDEHHDLGRAARPGDFELPDVSGFDLLQYRESLTQGRRPREETSQALLRLHLLHPVSEASDVCVPVSPSAAVDALVAPLEEERLKLRKKINDIRSAMAAFDAVHSEVRSKEAVPLTLLVGGAAISASVTSSARASEREIITVQPGGSRPPELLAETMELNMSLLARGVRQRTLYQHSIRKHQLTMDYSRQVVAAGAEIRTVTEIFERLIICDDTVAYIPTNDERANEALEIRHPALIRYLRAGFERAWEGAEPISPADPLPKRAREDAILVRIAQLLVDGHTDESISQRLGIGVRTVAKRISTLSGRLGSRSRGQLGYLIARSGMLDEPSPPAPPAPPSG

SEQ ID NO: 10703 - protein, 339 aa, Streptomyces avermitilis
MNRHRVTALLNPPQSPFELACAAEVFGTVRPQLPAHYDFRVCADHPGPLPTTVGYAMLVEDGLDALDEADTVVVPGWQPPGTPAPARVLAALRAAHRRGARIISICTGAFVLAQAGLLDGRAATTHWRRTGQLAAAFPEVRVEADVLYVDHGDVATSAGIGAGIDLCLHLVRSDHGAAYATEVARSMVLPPHREGSQLQYAVRPAPARTDESLAPLLEWATAHLDGRLTLDRLAERAGLSSRTLARRFAEQLGTSPGQWLLGRRIDAARVLLEQTDLPVETVATRVGLASAVNLRRRFRTAVGTTPGAYRQIFGGAQPEGGAGGAGGEGSSSIPERAIR

SEQ ID NO: 10704 - protein, 109 aa, Streptomyces avermitilis
MSNITDTGKYAVQVAEVPPEEVTPGIVRRPLPKTDNARGWLIDFAPGTEWPEVDVHASEERYYVLNGEVIEGEERHGPGSYVVFAPGSSHRPRSDIGATILGWTDLPGA

SEQ ID NO: 10705 - protein, 173 aa, Streptomyces avermitilis
MATPPGSPDPHGPGGSSHRLRLEKVTPDNIDAAIALKVGPGQERFVSPVVKSLAEAYVHPATAWPRLVYDGDELVGFVMAFFDIRFNPDDPDDRPRSGLWRLNIGHGRQGRGYGRFAVDAVRAEIRRRGGSRVTVTWAEGEGGPEPFYLRLGFRRTGEISGDQVVGELDLAGA

SEQ ID NO: 10706 - protein, 135 aa, Streptomyces avermitilis
MGETSRLTPVIHNITFDCTGDPYDVGLFWSALLGRPLDDDDKPGDPAALIRDPDGGPSLLFLRVPEGKSVKNRIHFDLRPRGCTRDEEVERALGLGARKVADHTRPDGTGWVLLADPEGNEFCVERGDAERAEKD

SEQ ID NO: 10707 - protein, 167 aa, Streptomyces avermitilis
MTRTDTPPAWDERTQLATFLDYVRATARAKCEGVSPEDAVKAPLPGSPLMTLSGVVNHLRWVEYWWFQVVFLGEEDEGPWTDEDPDREMRIAVDMPPADVLAEYEEQCARYRELVAEHDLDATAKRPIRDGRHVDLRWVILHLIEETARHNGHLDIIRELVDGETGA

SEQ ID NO: 10708 - protein, 246 aa, Streptomyces avermitilis
MADRSFSDTTLAGLYDALNPWGPSEDFYLGLVMSAQSVLDVGCGTGALLGRARGAGHPGRLCGLDPAAAMLVQARRRRPDVEWVLGDLRSQRWQGAFDLVVMTGHAFQVLVGDTELRTCLAGVREALADGGRFVFETRNPAARAWESWTPDRVREVPRVDGGAVRVRHEVEPPVTGDRVTFTETFTSPAWEHPRVSRSTLRFLAPDALTRFLAEAGLTVAEQYGDWGRAPLTPTSAEIITVAEIAP

SEQ ID NO: 10709 - protein, 404 aa, Streptomyces avermitilis
VKGGATKGDAAKGAAAKGDAVKADAVKADAVQGDLTLPAPREGAADDPGEPLLVVEGLVKHFPVKGGFPIRRTVGAVQAVDGIDLTVNVGESFGLVGESGCGKSTTGRLITRLLEPTSGRITYRGQDISHASRKQLAPIRSEIQMIFQDPYSSLNPRQTVGKIIAGPMEINGIRPSGGREKRVRELLEIVGLNPEHYNRFPHEFSGGQRQRIGVARALALEPKLIVADEPVSALDVSIQAQVVNLLQQVQKDLGIAFLFIAHDLAVVRHFSQRVAVMYLGKVIEVGDRDSIYARPRHPYTHALLSAVPEVDLDGGGETRRERIRLAGDVPSPISPPSGCRFRTRCWKAQDKCAAEEPPLVRISGNRDGHLTACHFPEDPTTGAREEDIVLDPALVALEEGGAEG

SEQ ID NO: 10710 - protein, 353 aa, Streptomyces avermitilis
VTTVTKESGVPSPSDAGAFLSVRDLHVRFKTEDGVVKAVDGLSFDLERGQTLGIVGESGSGKSVTNLTILGLHNPMFTEIDGEIVLEGQELITARESELEKLRGNKVAMIFQDPLTALSPYYTVGRQIAEPFMKHTGASRKTAWDRAVEMLGKVGIPRPKDRAKDYPHQFSGGMRQRAMIAMALVCDPDLLIADEPTTALDVTVQAQILDLLKDLQQEFGSAIIFITHDLGVIADMADDIMVMYAGGAVERGTVEEVLRSPQHPYTWGLLNSMPRIDSDLAAPLAPIPGAPPSLLNPPSGCRFHPRCTFRGEVGGTRCVDELPLLPPGRGGACHLTAEQKRTIFIEQIKPRLR

SEQ ID NO: 10711 - protein, 326 aa, Streptomyces avermitilis
MLRFLIRRTLGAGVILFLLSIVAFLLFFGMPRDPGLLMCGKTCTPANLANIHHVLGLDKSIPEQYWIFLHNLVLGSEEFTQGPCPAPCFGYSYHTNEEVWGTLMDRLPTTVSLTLGACVFFLLIGLGTGLLAAWKRGTLIDKTVTAGSMVLSSMQIYFLGPLALAALVYQTHLFDKPAYHEFTANPVTWFTGLIIPWVVLSTIFAAQYTRMARSSMIEQLQEEHVRTARAKGMSRKYVFFRYAWRGSLIPIVTIFGIDLGSLLGGAIITEYTFGLPGLGQLAVQSVFFSDLPLLLGVMLFSAAMILLFNIIVDACYAFIDPRVRLS

SEQ ID NO: 10712 - protein, 603 aa, Streptomyces avermitilis
VMSRGGRHAYAAISVLAAGALVLTGCSKGGSDSGNNDKKDKENAQRQQASIKFGDAKDSTGPAAAVPGAKTGGTMEVLQRDSYAHLDPAQIYVSDEGSVATLLHRGLTGYKATSNDGSKHEVVGDLATDSGTTTDGGKTWKYTLKDGIKFQDGTAITSKDVRHSVERLFAPFINQGPPYLQQWLADTPGADYRKLLKDGPYKGKHLPDSVLETPDAKTVVFHFKTAHPDLPYALAMAGYAVVSQKGDTKEKYDRAPVAAGPYKIQSFKSGKSMVLVKNTSWDPKTDPIRHQYVDRFNFTFNQQYETSTKTLLADSGADQAGVSFNNQVDAGNLSKVLSDPKMKSRTVGGFQPYVGQMNINMSHPALKDKKIREAIAYALPITPFVRAYGGTDAMQVAGGLISPTVSGYDASFDPFGKIKKPAGDPVKAKALLKEAGKVGMKLTFGYINTPEGQQYSTAMAAGLKKAGFNVQRQEIPAETYYDQVSKLDNNYDIFHTAWGADWPSASTVIPPVFDGRAIADGAQNYSQVNDPHVNSEIDRVNKITDPVKSAAGWEKIDQYLVKEVVNVVPTAYYKQIQIAGSKVGGLAYDDVIGGIDPRRLFVK

SEQ ID NO: 10713 - protein, 344 aa, Streptomyces avermitilis
MTSPLEVEGGGPSVVADDEKDPKKGSGAAQLVGRSPGRLMWIRYKRDRAGVISAYVVGFFFLLGLLSPLISKLYGKNPYTVYADERPELFDSAGVPVQPNGGISGEFWFGLEPGNGYDVFTKLIYGIRTSLMISIAVTITVVLTGILLGVAAGYLGGKADFFISRVIDFLLAFPSQLFFIASMPVVVSLFVSPRDETPTYVRVVALIAVQWFLGWMSLARILRGTSLSLREREFIEAARVSGASPWRIIRKEILPNVVTPLLVQSTYLLPNFVTIEAGLSFLGVGIVEPTPDWGQMFAKASTELVLQNDITYMFFPGVSMIIFVVAFNLLGDSVRDAFDPKTAR

SEQ ID NO: 10714 - protein, 635 aa, Streptomyces avermitilis
MATRHDIRNVAIVAHVDHGKTTLVDAMLKQAGAFAAHAAESLDDRMMDSNDLEREKGITILAKNTAVKYHPKDGGDVITINIIDTPGHADFGGEVERGLSMVDAVVLLVDASEGPLPQTRFVLRKALQARLPVILCINKTDRPDSRIDEVVNEAYDLFLDLDADEDQIEFPIVYACARDGVASLTKPQDGTVPADSDSLEPFFSTILQHVPAPTYDEAAPLQAHVTNLDADNFLGRIALLRVEQGELRKGQTVAWIKRDGTVSNVRITELMMTEALTRKPAEMAGPGDICAVAGIPDIMIGETLADPENPIALPLITVDEPAISMVIGTNTSPLVGRGGTGKGASAKAAVKDRKVTARQVKDRLDRELVGNVSLRVLDTERPDAWEVQGRGELALAILVEQMRREGFELTIGKPQVVTKEVDGKVHEPVERLTVDVPEEHMGAVTQLMGVRKGRMDNMSNHGSGWVRMEFVVPSRGLIGFRTEFLTGTRGTGIAHSIHEGHEPWFGTLTTRNNGSLVADRAGAVTAFAMTNLQERGVLFTDPGTEVYEGMIVGENSRADDMDVNITKEKKLTNMRSSSADSFEAIVPPRKLSLEQSLEFCRDDECVEVTPEAVRIRKVVLDQKERGRTASRAKHG

SEQ ID NO: 10715 - protein, 745 aa, Streptomyces avermitilis
MSHDGVGPRAVMRSVVFLTAGVLVVPALTGCGADDEVSKPVAGQDIAPAERALVADGGTLRWAMDAVPETLNTFQADADATTTRIAGAVLPSMFRLDASGRPQRNPDFLESAKVVETEPKQVVLYRLHQQAVWSDGREIGAADFAAQWRALSGKDSAYWTARNAGYDRIEKIERGKGNLEVKVTFSRPYADWKSLFSPLYPKDVMGTPDSFNDGARTKLKVTAGPFGLTKVDRKAGEVALARNPRWWGRPAKLSEIVLRAVPRDQRAAALAADKVDLAEVDPAEAERITLAARDKGGKPLAGPRAATTPAGALRSWAVAHGSDEKAADREISARKKRTKAIAKYADQQSALGGFVVRKSLEPTYTQLALNGSGGPLADERVRRAVARALDRTELAKLVLQPLGLPVVPVGSHLALSGQEAYADNSGALGGQDTTEAQALLTDAGWVLGGPVKEQKKTAGSEGKKARPTNGSGDGSGDDGTYVVGEDNKPSETDKEKKDPKDHTKQHGNEQPGKHADDQVGKHIDGRQYVHEQVGRGGAPGAYAPKGTAAPGGTSAGVLAKDGKPLTLRFVLPSGPGSESLRAVGARISRMLDRVGIRTEISKVSDDSYFKDHIASGEYDLALYSWPASAFPATDARPIYAKPVPAADGSLSVEQNYTRVGTDQVDQLFDQAIATLDEDEARDLVRKADARIWAAAGSIPLYQRPQLTAARPTLANAGSFGFQTPLFEDMGFLKKGAKPSAGPSQG

SEQ ID NO: 10716 - protein, 95 aa, Streptomyces avermitilis
MSVHEDLTSVQRCLDDLARSVGRLEQQLGAGLEMRRVRADADHLRESLALLREAAAEPAAPRRPDLLAIPDTPYDKSLWTDSDDEGLGARDRHAP

SEQ ID NO: 10717 - protein, 273 aa, Streptomyces avermitilis
LATGTEPHPNSGGVRTGTRAAIAAPHLRTDRWWLAPAVTAAGLLAFIVYSTWRAFADTDYYAAPYVSPFYSPCLAERCQTMHAGPNADLFGSWWGISPAVIILIFPLGFRLTCYYYRKAYYRGFWASPPACAVPEPHKKYTGETRFPLILQNVHRYFFYAAIVVAGILTYDTVLSFRDEHYRWGHMGLGTLVFLLNITLIWAYTVSCHSCRHIVGGKLKHFSKHPVRYRMWQWVGRLNARHMLLAWASLVSVALADFYVFLVASGAFDDPRFF

SEQ ID NO: 10718 - protein, 667 aa, Streptomyces avermitilis
MPVVDRQEWDVVVVGAGGAGLRAAIEARERGARTAVICKSLFGKAHTVMAEGGIAAAMGNVNSGDNWQVHFRDTLRGGKFLNQWRMAELHAQEAPDRVWELETWGALFDRTKDGRISQRNFGGHEYPRLAHVGDRTGLELIRTLQQKIVSLQQEDERETGDYESRLKVYQECTVTRVLKDGAAVSGSAGGRVAGVFCYERESGRFFVLEAPSVVIATGGIGKSFKVTSNSWEYTGDGHALALLAGAPLLNMEFVQFHPTGMVWPPSVKGILVTESVRGDGGVLRNSDGKRFMFDYIPDVFKEKYAQSEEEGDRWYEDPDHNRRPPELLPRDEVARAINSEVKAGRGSPHGGVFLDVSTRMPAEVIRRRLPSMYHQFKELADVDITAEAMEVGPTCHYVMGGIAVDSDTAAARGVPGLYAAGEVAGGMHGSNRLGGNSLSDLLVFGRRAGLHAAQYAAGLPAGDRTGVDDIQVDTAAAEALRPFSAEGPEPGADSAGLGDVPRPPGGRPPENPYTLHQELQQTMNDLVGIIRREGEMEQALEKLADLRVRAGRAGVEGHRQFNPGWHLALDLRNMLLVSECVARAALERTESRGGHTREDHPAMDRAWRRINLLCRLADPTGGLAAMDPARGQIDLTRDTTEPVRPDLLALFEKEELVKYLAEEELYE

SEQ ID NO: 10719 - protein, 258 aa, Streptomyces avermitilis
VTSYEARFKVWRGDVKGGGLEDFEVEVNDGEVVLDIIHRLQATQAPDLAVRWNCKAGKCGSCSAEVNGRPRLMCMTRMSVFTREETITVTPLRAFPVVRDLVTDVGFNYAKAREVPAFVPPAGLGPGEYRMQQEDVERPQEFRKCIECFLCQDTCHVVRDHEENKPAFAGPRFLMRVAELDMHPLDAAADTGLDRKRTAQDDHGLGYCNITKCCTEVCPEGIKITDNALIPLKERAVDRKYDPLVWLGSKIGRRPRPS

SEQ ID NO: 10720 - protein, 412 aa, Streptomyces avermitilis
VRGRPREAQGCGRGSSTGVREGARRMGTRHTDSEGESRVGPPGAEPGPGSGPEPRETSEESSSRTPAWARRTARAWRHPRLRLPKRIALALALVLLLPLLAAGVALRVNYAGDPAAGTQTRNRDALWMGHAWVDGRKRDADVKALAKRLRGTGIRDLYVHAGPLEHDGTLPGSAHPRARWLVGAVHRELPGVRVQAWLGDKLASEGPVGLRLERAATRTAVVGSTRQILAAGFDGVHFDLEPLHSGDRDYLSLLDDLRGVTRSAHVQLSVAAHQIDPLPAANAIRGALSGHPKWWSQSYFGQVARRVDQIAVMSYDTAMPLESLYGGYVAQQTSLALEVTPESTDLLMGLPFYYEDNLSHHGSAETVAAAVRGTRLGLSRTDRDRENFGVALYVDFAARESDWTAYRKGWLP

SEQ ID NO: 10721 - protein, 747 aa, Streptomyces avermitilis
MALGWLVLPMEMAGVDHSVPLIPAEQFVAASTSAPGGAAPDGGGTSTGDLVLPVVAVGAAGLLAVYAQVRRRRRMRTRTTPGGTSVGAASVEEIEARARRSLVETDDSVRTSAEELRAAAAQLGDTAVRPFRAALEYAESELAAAFRLRHRLDDSVAGGGADTRGMLEEIVARCAEAGRRLDAEAAAFDQTRSLERQAPAVLERTEARFRELTVRASAADTTLAELHERYAPSAVVPVAGHVEQAKDRLVFATSSLNRARQALDRGETERAVVLLRAAEGAVDQAAAFVDGVARLAAELAAAAERLPAAVAGTETGLVAARGRTDGGAGARADLPGRIARGEAVVAEVRREMSTGVYDPVGALRRIEQAHAGVDVARHHEPDDDEALVRLDHSRLTARSATAATSDYVTTHRGAVGYEARTLLAEAIRRLHRPETGWRASDGNDVRPEPEGGGHGGDAEETPRQAEAGRAPDGSETEADEAGAGPGLGEAGAERQPGEVEASREPGTAEAERVPGTAEAAPEPGTAETARKPGAAEAAREASDAGAARGPGDGKAARHPGEGGAGPEADTIKASPGPGKTAAAQQSAGAAAARQPREGGAGPEVGEVEAGWGLVPVVGLGEVREADALARRARQVAERDVRAYGNPYGAGAPAGDGTGGAVLGGILLGGSARHDDAHHARHGPAHSGGPTSADGPAAYSGGPAAYSDRPTVYSDSPAAYSGGPASFGGPRTRGRRGGGELFRPPAAD

SEQ ID NO: 10722 - protein, 980 aa, Streptomyces avermitilis
MCRPVQKASGPCCDREHRVVRCRSAGYCGQPPPVTGAGRGELEGTVRVSEIPAKATESEDPSDGARAKAVADSAMPTAADDAAHPRRAVAADGTADGSVDDAESGSAGEAESGSPAATADALAGGRADDRSGGRADYGADEPIGTRTGEPVGDMMWQSSPPGSMYDYIKVASFSIGPDGLVEQWSLRAEQIFGISAERAVGMDPIAAFVAPDRREFGQRKMAEILDGREWTGVVPFRMPTPEATEGLAEVYVMPTTTEDGERAAVCIVVDVRTLRRIETDLAASQAIFGQSPFGFLLIDTDLRVRRANQRFASTFGGKVDDHRGRSVHDYLPSPEAERVSATLRRVLETGNSITDMHVTGFVPGSDERRDWSINLYRVHSGSGRPIGVAWLGTDNTARRAAAREAAAARRNLALLNEAGARIGNSLDLETTARELLDVVVPGFCDLATVDLYQGLLAGDETPPGRADGSAELRRVAFSSAVSDAPFAGGPDPVTVGAVHHYPFNSPGADALRTGRPQHVPPEDGGLIQSTLAVPMVAHDTVVGLAQFSRTKGSEPFGERDRALAVELAARAAVCIDNARLYRREHERALILQRSLLPPGDPEASGLDIACRYLPGNAATEVGGDWFDVIELPGHRTALVVGDVMGRGLRAAVAMGELRTAVRTLALLDLEPAEVLSALDEIARGLGTPGGVQQATRTARQPRDADLSEVYLATCVYAVYDSVTRRCTFANAGHLPPVLVEPGETALMLDVPPGMPLGVGGEPFEEVEVELPEGALLALYTDGLVESRDHPLDEGLQAFVGALTDPTSPLEDVCDHVLNTLDTHHGEDDIALLMARVQGLPAESVGDWTLPREPRSVGRAREYARGQLVSWGLEPLVDTAELLVSELVTNALRYGEGEIRLRLLLDRTLVCEVWDAGLVQPRRRRARDTDEGGRGLQLVGLLSAGWGSRRTPRGKTVWFELPLPDGETGLTDPAEALLSLF

SEQ ID NO: 10723 - protein, 152 aa, Streptomyces avermitilis
VPLNPTKPDIGGLLAWEVIGVLDTEGECAEWTFPAEPGAVRTARAVVRDQLRTWGLDELSDITALLVSELVTNSLRHATGPIGVRLVSPAQTMPTLLVEVSDPLPDPPRERAADSDEESGRGLQLVACSSRRWGTRPGDTGKTVWFELAVPG

SEQ ID NO: 10724 - protein, 130 aa, Streptomyces avermitilis
MTERIVVGAALLSGGRLLAARRSAPPELAGRWELPGGKVEPGETPEHALVRELREELGVTAEPGGRVPGEWSLKPGYVLQVWTARLLAGTPEPLEDHDELRWLTPGQIWDVDWLDQDVAAVKAVLGVWNT

SEQ ID NO: 10725 - protein, 60 aa, Streptomyces avermitilis
MNDGTITLPWLVIRQDDNGNRYRVGRYATRAEAQKIADSLDGRGHKQLYWVERIGQNGIK

SEQ ID NO: 10726 - protein, 250 aa, Streptomyces avermitilis
VTFGEQPAYLRVAGDLRKKIVDGSLPPHTRLPSQARIREEYGVSDTVALEARKVLMAEGLVEGRSGSGTYVRERPVPRRVARSGYRPDSGATPFRQEQADGAVRGTWESHSEQAEASGAIAERLDIRPGERVMCTKYVFRDAGEVMMLSTSWEPLAVTGRTPVMLPEEGPVGGMGVVERMAAIDVIVDNVTEEVGARPGLAEELLTLGGVPGHVVLVIQRTYFASGRPVETADVVVPADRYRVAYHLPVK

SEQ ID NO: 10727 - protein, 389 aa, Streptomyces avermitilis
VPPGSPYPQGPYQQQPYANPYPQPYQQWGQGYSPFNRPASVNGLAITSLVLGVVCCVPALGLILGVIALGQIKRRGERGKGLAIGGIVMSSLGTVLLVLSLATGGAHEFWEGFEDEARDSGGSGVTFSVGKGECFDSPSGSLEGEAYDVDKVPCAGDHQAEVFANFKIQEGGYPGDGKISETADDKCYALQNVYAMDSWAVPDNVDVYYFTPTEDSWSLGDREVTCMFGNTDEKGSLKGTLRCDDTTLGADQLAYLQADGILYDALDTAPDEEYVEDDLPGHKEWATRVAKALGDQTELLRAHQWAAADEQPVTDQAKALDQARKEWGQAAKAADADAFYTHYDNGSRLLEGSRAVTARKALGLATTPPSDGGDGGGGGQGSGDSSSEV

SEQ ID NO: 10728 - protein, 377 aa, Streptomyces avermitilis
MTPLPDYFCPADGTRVPGGSLDWCCPACRGPLDLDFAPTPGPLKSLGGRVNSLWRYAECLPLAAPTTSLGEGRTPLVSLTDGVAAKLDFLMPTLSFKDRGAVLLAELALQLRPRQVVADSSGNAGTAIAAYCARAALPCTVYVPEGTSAKKLEQIEAHGARLRVVEGDREATAHAAREAADEAGVFYASHVFNPYFLHGTKTYVHELWEDLGGRLPDALVVPVGNGTLLLGAALAVAELHAAGLIDRRPALYAVQAAAVAPLAHAWEQGADDLVGVTPAAPTFAEGIAIPRPPRARQILRAVRESGGAFLTVTEDQIRHAQSDLASRGLYVESTGVACWAAVRAGALPQPRPRPGEGMPAAVVPLCGAGLKTGPARA

SEQ ID NO: 10729 - protein, 701 aa, Streptomyces avermitilis
VLADHARALDALRSALTPLKAELVAAELESIPVSRLKDVTEGRLRLGAVEAAGFTSVRGVYEAGRYELRQLPGVGEQTADRALAAARQIARAVAETVSVRLDVDHPEPRTTALVVALHRLVEAGPELRRALDAATRLDERLGALLPAARPAGGRLRLALAGRHRREDALAAAAETRDLVAEATARDVPLLLAQASTDLLRDPASDIEAWVDFELRSAEYYSQLAEVSEHRPDAEAGEGFLPSGVAERVHAQPLDDTHRRVSLRGYQSFGARFALAQRRVVLGDEMGLGKTVQAIAALAHLAAEGHSHFLVVCPASVLINWTREIRARSTLRALPVHGADRRDAYEEWRERGGVAVTTFDVLHSLPVPDTEKPGMLVVDEAHYVKNPDTRRAKAVTGWTAHCDRVLFLTGTPMENRVEEFRALVRHLQPALLPAVQGGGVAAGPHAFRKSVAPAYLRRNQQDVLTELPALVQVDEWEELSAADRDAYRKAVAEGNFMAMRRAAYADAEKSAKLGRLRELVAEAADNGLKVVVFSYFREVLATVQQCLGEPVLGPISGGVPAARRQRLVDAFAAIDGHAVLLAQIEAGGTGLNLQAASVVILCEPQVKPTMEHQAVARAHRMGQIRTVQVHRLLATDSVDDRLLRILKNKDRLFDAYARRSDIAEATPDAVDVSDASLARRIVEEEQQRLAARPADQPARTTS

SEQ ID NO: 10730 - protein, 224 aa, Streptomyces avermitilis
LSSAPAVRRPAAGRPVVRLIDADESSRAAARHAPRLLGPEEWTRAVALRRGPDREVYVTAHVALRILLGPLLKRHPGDLPMGREACHGCGAPHGRPVVRGSRLHFSLSHSGRLILVAFAAEPVGVDIEQIASSQAVEQARDALHPAERQELDTLPEARRPRVFTDIWTRKEAYLKMLGSGLLRDTRLDRVGTGRPGSTGVTGAELTSVPVPSGYAAALCVAVPV

SEQ ID NO: 10731 - protein, 268 aa, Streptomyces avermitilis
VAVAQTVARPGDTVHNATEAAATIARAADAGVRVVQFPELSLTGYEPGWLTSHLPAGALTPDGPELTAVREACRATGVTAVVGAPTSAGTKSAISAIAVGGDGGILADYRKSRLEEHERQLFVPGTQCCTLTVDGWRLALGTCYDASFPEHARAAARSGADAYLCGGAFVRGDSDHRRSVYFPARALENTFYVVFSNFVGPQGPWDFCGRSAVYGPDGRTLAEAGAREAELVVADLDDAALVATRRGLTMLRDLDDAAAPSAMSSCVV

SEQ ID NO: 10732 - protein, 97 aa, Streptomyces avermitilis
MGLCSFLPRYLPLVLLADREMPAVAKSLLSYTPPAVLAALVVPEMLMPGGHGMQLSASNPYLIGGGVTFVAGLYSKKFLLVTAIGIAAFYLSRWLLG

SEQ ID NO: 10733 - protein, 297 aa, Streptomyces avermitilis
VRCHMSNPQAPGEAVRPGPGSTLRAGAMSMLPFLASAIPMGLAGGILGPANGLSGWATLGLAMAVNSGTAQFIGFALIAGHSGALTILLTTLILGLRMLIYSAILVPHVREVPQRWRVLLGFGLIDAVFFVAIERLKKGELTERKHLFFLGASGVMYVTWMLCTLVGMALGSAVPDLADLGLDFPMTAMFVAMLAGSLANWRVGAAIVTAGLTVVLGHGLPYNLGVVLATVVGATVGTVCEYLEKRRTPENSATETSEESSPDEGDPTSEDNTANDGKPPTEDKTAKADKVNEENVA

SEQ ID NO: 10734 - protein, 1768 aa, Streptomyces avermitilis
VQSLETLGRLKVAAAQRPREGAFWRAALAALPERTGFPSDAPGRLAGTGPHTTTVLPLGAELTAGLDTLTRGRPMALHTVLVAAVGTLLQRYTGGEEAVVAIPATSADAAAPALADGLVLRLPFTPESTFRAVLADAKPRLVAALEHQDFPVEILAGEFGAAADHDTHPFADVLVDVVREEHEAPAARPRFAVVFALVRDGEGLRLELRHRAGQHSADTAGRLLAHCAVLLAGAIAAPDDPLAALDLRADADRAVLARANGTDAAFEDTVRLDELFTRQARLTPDATAVVGDGFRLTYAELDARANRLARTLRERGVGRDDLVAVLADRSPQLLVAVYAVLKAGAAYLPVDPGYPVERIRYVLDDSAARLVLSTPRHRDLVHEGREVLDLTDESAYAKDSTAPEVIGDARDLAYVIYTSGSTGNPKGVQIEHRSVVNRINWMQRAYPVTSADVIMQKTPTSFDVSVWELFWWMFEGAAVCLPDPGAERDPEALVTAIERYGVTTMHFVPSMLGAFLDFVVGAGVQAGLVSLRQVFASGEALTPHHVRRFAEVAAATTGPAARLINLYGPTEATVDVTHHACGPDDVDRVPIGRPIDNTRILVLDSGLRPQPVGVPGELCIAGVGLARGYLGRPELTAERFVAAPAAGEERVYRTGDLARWLPDGSIDYLGRIDHQVKVRGYRIELGEIEESLRRHPQVKDAVVLARKAEDGQTHLCGYVQSADALTEEDLKRHLGVTLPDYMVPARLVALDTFPLSPNGKLDRRALPEPGPAESESAAYVAPGTPQEAELARIWGEVLGHERVGVNDNFFALGGNSIHFVTVLAKARAGGLDFTFQQFFQNPTVAQLARSLARSGPGEQPAALSPFELLEPEDRALIPAGVEDAYPMTQLQAGLVFQSELSHGTAEYHDILSYMIQSSFDATCFEEAVRILVRRNPIFRTSYHLTGYSEYLQLVHEDAPLPLYIADLRGMSETEQEEWYRDWAVREKAHQFVWTEPGLVRLHVHVLSDDLFRYSLSQHNSALDGWSITLVHTTLFDLFHRLRDGRELPDATVDNHARTYVALERRSLADDEHRAFWADLLEDSTFTALPRTRQEAEADVLPVVFHEVEFARGLSDRIVALANQLSVPVKNVLMAAHAKVLSLVSGEPDVMVGYEHSGRPEAEDATRAIGLFLNTVPFRVDAAEGTWEELVRQVYRSETDLLPARRYPMAQMKRDLGTQKELFETAFNFTHFYLLKQLEAQDGFSLLDVRANSETEFVLRAEFSRHFVTDEVRLSLHYHAHLFEPWQIARMGACYAAAFEQMTADPGAPHHLANLLAEDELAELERAERADALPTELAAFLPQPGAAVRARVVDEHGLAVPFATVGRVVLLADGRDPVETGLYGRRDRDGLRLLGEERARHTFRAGPADAAETASVPEQPADRRPLDEVDRRIARVWATVLDTPLEEISLDDNFFLLGGASLAAMRVVMELDGLVSLTDLMRNSTLAALGEAARANLAAATEAEQGPQELLLSLSAERGAAECALICFPYAGGNAINFEPLAQALDAAGGAVAVYGVELPGHDAGRPDEAFSSLEDTARRVVEEIRDKAGDRPLMLWGHCVGSALAVETARLLEAEGTTPAEVFVGGKLLHDAATTRQGIEQAAAMADEDIVRWLVDETGFTGFDSLRPEHAAFVAGVFRHDAGSANGYLLAADEHGPKARLSAPLTTVFTADDPLTPGHAERYTAWSLFADQPRLVELTDGGHYFCRTAAPAVADLVLSRWQAASGRG

SEQ ID NO: 10735 - protein, 1263 aa, Streptomyces avermitilis
VSAPVDTPVPGGEPMAWLPTPADPAASGAYAPEEPAEKMAGAEPGAVSVLATRTTPARVLAAWAALLHHHTGRVDLDFGFADAAARPATVRLRVEPTASLGALEEAAARALRSPSPGEPAAATPWMVRHTDAGPSGPGRAGALVAELDESAGGGCLRLRHDPAAHRADAVARHAVHLRGALTALADDPTLPVRELDPLTPAERTRLLVDFNRTTVPYPRDSRVEELFAERARTAPGHPAVVHGDTVLSYAELDHRSELLAARLRAEGLPPGEPVALLLRREPTLVVAALAVLKAGGVYLPVDPDYPADRVAYLLADSGARRVLTVSDLAGQLKAVHDRSADDLTVLALDTWDWRRTPGTPPCAPDAPPRDAGDAAYLMYTSGTTGKPKGVLVPHRGITRLVSGIGYVRLDPTTRMAQVGTTGFDASVWEMWGALLGGGTLCILDRETLLDTEELGRALREQRITTALFTSALFSRLADEDVTLFRPLRDLLVGGDVLSARHAREVLAANPGLRLVNAYGPTENAVISTCQIVGEPVGARVPIGRPVPNATAYVLNQDGLPLPTGVPGELHVGGDGLAVGYHGRPDLTERAFVPHPFAPGQKLYRTGDRVRLLPDGAVDFVGRTDHQVKVRGFRVEPGEIETTLSALPGVRAAVVLARRLPGSSDSYLCGYVVGDPDLDTDRLRSAAAESLPPHMVPAHLIVLPALPLTVNGKVDRAALPEPAVATGTAPGGRPPRDELERALIDLWEDTLGIAGLGVDDLLSAYGAGSLTATRLSARIRRTLHLACPVSLVLTAPTVAALAERLRGAEPSGHGPLSPDAHPDGPQGPAPLSPQQHGIYVEQVKDPTGTEYNLPLVVDLPEVPSAERLRTTLAALVARHDVLRTDITLDADGRPHQRVHAELPVALEEVDLPDDADPDAWTARWVRAFDPHRAPLWRVALLRRPGRARLVMDIHHLITDGCSLTLLATEWARQLGGAEPARPEVGYADYARWAAGPAGREHALAQGEFWRRTYATPVRPLDLPTDLPRPPVRRTEGAHLSFPLAAELSHAIRELARAEGVTPFHVLLAGYTAFLGRMSGSDDVTVGTPVSGRHLPGVERTQGMFVNTLCLRLNPRPELSFRAHLRAVADHAMAAADHQDFPFGELVAAAGERDYSRHPMFDTLFAVQDTGLHQVDFLGGRPRWTPEATGRTLFDLNLQIDDAPEGFTAHWAYSTHLFLPGTVELFRDELLALFDAAVTAPDTALHSMNVVAATTQAVPDFDFDF

SEQ ID NO: 10736 - protein, 978 aa, Streptomyces avermitilis
MPPSPLHAHLIPADCPPSGHTHAWRVRLPEGADTVRLSHLLDTAVAPWWPEATARPTLWSEPVPAAAGSTIADRRLRAELHRPLGTGQAPLRVVLLAYADGRADLILVAHRGFLDAASLRHVADVLLDRAPAERHAPPASARLAPADAELRKAWSVAEFAGRVEWAAGDSSAGDRTGVVRQALRDTAADTSGGALAVATGLVLGRYENQDTPVVGALTGHPGRPADALGPDAGTLLALDLSGARSTAELLREAAHTLTATWCDRQTYADLVAESGGRVLAGVLDPVAHPADGPTETYLPCQTAPFPLTVMVRRRTDGEPELEIHHRLADVDEAAARQFARHLARSLEQLSADAQETAPEDIDLLGDEDRDALVALGRPARPLEWQPQRIDEVFAHRAAERPEAIALSCEDHSLTYAELNNRADRFAGALHNLGVRPGERVGVCLDRSLDLVVTMLAVLKADAVYVPMDPAYPADRLAYTAEDAGLRLVVTALEDFPAGQARTIHPEELAAGTAMAAPAPGRGNEQAAYVIYTSGSTGRPKGVVVPHRNVVALLGATREDFGLCPDDTWTLFHSAAFDFSVWEIWGPLLTGARLVVVPYWVSRSPQDFRALLRDERVTVLNQTPSAFAQLVEADRQHEPDLAVRLVVFGGEPLDARGLRDWFDRYPERRCRLVNMFGITETTVHVTAQTVGRKEALSGSRSVGPALPGWYLYVLDERQRPVPLNVPGEIYVGGEGVALEYLGRPELTAERFVTDPFTGGRMYRSGDKGRLRPDGRLEHLGRLDTQVKLRGFRIELDEIRNVLLDDPTVTAAAVVLGSADAGDAAAARLDAYVVLAGGDTAAVRRRAAKVLPEYMLPATVTALPALPLTANGKLDARRLPAPAAGAPAAVAAPSAQPSPDSTEASGTGLAAALVEVWQDVLGVPVGPDDNFFELGGNSLYAVRLAAAMNERNLPPMPMRELYLNPTVNRLAAVLAPGDQA

SEQ ID NO: 10737 - protein, 276 aa, Streptomyces avermitilis
MTPRLSGKTAVITGAARGLGRATAVAFAREGADLMLLDLAADLPGVPYPLGSESQLAHTAELCREQGVAASTARLDVRDLDAVEAAMATTRERFGRIDVLVNNAGIAAPSGKAAHEIDEREWQLMIDVDLSGAWRTIRAVGGHMAEQRSGSIINIASTAGLVGYRHFAGYVAAKHGLVGLTKAVALDYAPLKVRVNALCPGSVRDDSQVEGRMLSEIARCLDVPVAEHEETFVQAQPMNSLIEPEDIASAAVWLASDESRQVTGSVLAVDGGFTAR

SEQ ID NO: 10738 - protein, 237 aa, Streptomyces avermitilis
MPRTHLICLPFAGSGASLFKEWQSLAPEGLRIVPVQLPGREERFIEAPHTEVARAVEEIHTTVLDQLADAEDIAVFGHSLGAVLAYELTHKLRVSQSVPPSRLFVSGSPGPWSGREHRATGLDDEAFLAQVRAFAGYDHPALAHPEMRALLLPMLRADVQMHENYRPTSDKPLDVAVTALRGSEDELVDAEQIAQWREATTADFRTAELDGGHMYLADGAEALLRLIAGELGPVDAR

SEQ ID NO: 10739 - protein, 277 aa, Streptomyces avermitilis
VPIGSDRLCSDRLCDRTWRVTGFGGSRRVSYEAWLSPLRRPTPRPEARIVVIPHSGAGPNALLPLVKHIPAPFEVVGVTLPGRERRFVEAPEISPDDLLGGIARELAALPSLPTVLFGHSLGGSIAFALSVTDPGSCSALVISAQLPCGSQIERPREWDEDALTRVLQRGGGTPADMLNDPAWRDHTLRLLRADLTLGGQLALRNAQMRVAHPLTVLGGEQDLLVPAERLGAWAERADTAVDSRVLPGGHFYLLDDANREVVAEAVAASARVATAAP

SEQ ID NO: 10740 - protein, 355 aa, Streptomyces avermitilis
VTAIHSDPAIALRDPDPTIVLRDLEKRIYARACEAGLVTTGDVEAGTGAPQSEIRAAIQNLRTLHLVRETEDGDGRFVAVSPESAKLQRLAPLLGELRRLQARTETMRTAYDGFVHVYETAAAERSRRAGIEVLPNRGDVRRTINGLAASSTTEVLTSHPGGPRPQEVLHESVARSRDLLERGVAIRTLYQHSAHFDVGTTAYVEHFTALGTQFRTLADGFPQLMIFDRRYVLVPLRDPSEGATLVSDPSIVDFATAAFERAWVAATPFRIAYDQRKVRETSEDVRHSIMRLLVTGEEDRRIAARLGLSLRSCQRHVAQIMKRIGARNRLHAGYLISQHDLLNRPLPDSPQELAS

SEQ ID NO: 10741 - protein, 131 aa, Streptomyces avermitilis
MYEFHGWFGIAESPEEADTGTLEQGIAELRERVEALDWSTGEAVLRAHNGEWFVRADRLVNRRRDEAEELDALVAFIARRFPGGWGLLYERSDDLPSPPGPGAFRVRVLARGEVTERLDPFLSPVRPLIED

SEQ ID NO: 10742 - protein, 84 aa, Streptomyces avermitilis
VRLVFEDQGWEDYTSWLKNDRKMLARINRLIEDVKRDPFTGIGKPEPLKYHLPGVWSRRIDDEHRLVYLVTDKEVVILAARYHY

SEQ ID NO: 10743 - protein, 93 aa, Streptomyces avermitilis
MSITASEARKALFPLIKKVNDDHEAIEIVSKHGNAVLVSAEDYAALREGSYLLRSPVNARRLLKAYENALGNINVSERELIDPDATDPAEGAA

SEQ ID NO: 10744 - protein, 362 aa, Streptomyces avermitilis
VSLTIGIVGLPNVGKSTMFNALTKNDVLAANYPFATIEPNVGVVGVPDARLAKLAEIFGSQKILPATVDFVDIAGIVRGASEGEGLGNKFLANIRESDAICQVIRAFHDENVVHVDGKVSPKDDIETINTELILADLQTIEKVLPRLQRESRIKKDIGPKVAAVEAAQAILEKGETLFSAGIVQGSGNEELLHDLHLLTTKPFLYVFNVDEDELVDDDFKAEQRALVAPAEAIFLNAKLEADLAELDEEEAMELLESVGVEEPGMATLARVGFNTLGLQTYLTAGPKESRAWTIKKGATAPEAAGVIHTDFQKGFIKAEVISFEDLVETGSVAEARAKGKARMEGKDYVMQDGDVVEFRFNV

SEQ ID NO: 10745 - protein, 237 aa, Streptomyces avermitilis
VEQHRTRPPQHGPRRGTPLPPQAGRGGAGAGRPGRPDERPGGRPDGNGEAADGRPTRGRGPGGGAVAGAGRRPPAPGRSVPPGRSVPPRRSVPPRRSASPLVQAVRRMPNPRLTGLGGGLFCGAVMFALACVDQLLFGASLAVYGVLFLPVCALTAWWVRRGDLLTAPVVVPLAFAFGLLPLADSSGGFGGRLMGLVTALATQAGWLYGGTLVAGVITAVRKIRQMSRRAAQRRRPA

SEQ ID NO: 10746 - protein, 248 aa, Streptomyces avermitilis
MQIFGVDIGGSGTKGAPVDLDRGELTEERFKVLTPHPATPDAVADGVKEVVGHFGWTGPVGITFPGVVTGGATIRTAANVDKSWIDTDARALLSDRLGGRPVTVLNDADAAGVAEMQFGAGRDRQGTVLVLTFGTGIGSALFVDGALVPNTELGHLELHGHDAEKRASTKVKEDNDMSWEHWAHRVQKYLAHVEMLFSPELFIIGGGVSRKSHKFLPLIEGIKAEIVPAALQNNAGIVGAAMTAAKSA

SEQ ID NO: 10747 - protein, 338 aa, Streptomyces avermitilis
MVSMTASSGRRVLLAAPRGYCAGVDRAVIAVEKALEQYGAPIYVRHEIVHNKYVVQTLERKGAIFVERTAEVPEGAIVMFSAHGVAPVVHEEAARGKLATIDATCPLVTKVHKEAVRFANEDFDILLIGHEGHEEVIGTSGEAPEHITLVDGPGDVAKVEVRDPSKVVWLSQTTLSVDETMETVDALKEKFPQLISPPSDDICYATQNRQLAVKQMGEEADLVIVVGSRNSSNSVRLVEVAKLAGARDAYLVDFADEIDEAWLEGVSTVGVTSGASVPEILVEQVLEWLSQRGFEDVEIVKAAEESITFSLPKELRRDLRAEAAALVEQRTGNGPSAE

SEQ ID NO: 10748 - protein, 402 aa, Streptomyces avermitilis
MAANTSAETPLPVGEVSRLIGGWIDRLGAVWVEGQITQLSRRPGAGVVFMTLRDPSYDISVGVTCYRQVFDAVADVVSEGARVVVHAKPEWYAPRGQLSLRAAEIRPIGVGELLARLEQLKKSLAGEGLFVTERKKALPFLPQLIGLVCGRASAAERDVLENARHRWPAVRFEVRNVAVQGVHAVPQVVQAVKELDARDDVDVIIVARGGGSVEDLLPFSDEQLVRAVAACRTPVVSAIGHEPDTPLLDYVADLRASTPTDAAKKVVPDVGEEVERVRALRDRARRCVRSVIEREERGLAHTLARPSIEDPHRMVDERADQVASLLDRGRRTLGHLLDRADSELSHTHARVVALSPAATLKRGYAVLQRADGHAVRAPDEVTADEVLRARVAEGEFTVRVDV

SEQ ID NO: 10749 - protein, 80 aa, Streptomyces avermitilis
MTSRTDETANATALGYEQARDELIEVVRRLEAGGTTLEESLALWERGEELAKVCRTWLEGARKRLDAALAEEENAGDDSE

SEQ ID NO: 10750 - protein, 196 aa, Streptomyces avermitilis
MSLVLDPAAQDLLFREARTANTFSDEPVTDEQVQAIYDLVKYGPTAFNQSPLRITLVRSAEARERLVQHMAEGNQPKTATAPLVAILSADNEFHEELPALFPHFPQAKDVFFAERPAREGAAALNAALQAAYFIIGVRAAGLAAGPMTGLDFAGVQKEFLDDDHTPLMVVNIGKPGEDAWFPRSPRLEFDQVVTTV

SEQ ID NO: 10751 - protein, 173 aa, Streptomyces avermitilis
VAGTNGKQKTVRDMILSLGLIGLMAAVIYIFIPHDDSPHEPPRVDYRVELLTARRAASYPVAAPEGLSGSWKATSVRYAGDAFEAWHLGFHGPDGAYVAIEQSTQKASAFIDSASQGARKTDATQRIGDRTWQRYKGERYDALVLEEKGATTVVTGSASFAELTTMAQALKTA

SEQ ID NO: 10752 - protein, 344 aa, Streptomyces avermitilis
MTENHQLPSELEVPSEAPDRNLALELVRVTEAAAMAAGRWVGRGDKNGADGAAVRAMRTLVSTVSMNGVVVIGEGEKDEAPMLFNGERVGDGTGPECDIAVDPIDGTTLTAKGMTNAIAVLAAADRGTMFDPSAVFYMDKLVTGPEAADFVDINAPVSVNIRRVAKAKRSMPEDVTVVILDRPRHDGIIKEIRETGARIKLISDGDVAGSILALREGTGIDLLLGIGGTPEGIISACAVKCLGGTIQGKLWPKDDEERQRAVDAGHDLDRVLFTDDLVSGENVFFVATGITDGELLRGVRYRAETATTESIVMRSKSGTVRQIRSEHRLSKLRAYSQIDFDRAK

SEQ ID NO: 10753 - protein, 123 aa, Streptomyces avermitilis
VLQPPHQSLQVAAVPAQRAPVRDRDQDAPWHTEAVCRRDEAGLFFAPSKEPTAARLSREEAAKRVCARCPVMVECREHALLQPEPYGVWGGLTAAERRVVLARRRRRDVELKKAARGTIAAAG

SEQ ID NO: 10754 - protein, 234 aa, Streptomyces avermitilis
VDLQKQTELRQQQSELRASDADRDRIADILREALAEGRLTAEEHAERVEEVYRARTVGELEPLVRDLPAAHPLRATPAYAPAPNRPTAGAIPVEPDENVVAVFSAAMRKGRWRAGRRMHAYAIFGSVEIDLSEAIFEYQQVVIKVISVFGNVEIRVPENVSLRGTGGGVLGNFEVSTLDSGDADAPVVYVDGLAILGNVEARPKRGKLVADILDRVSDRVTRKLDHGLRKHLDR

SEQ ID NO: 10755 - protein, 558 aa, Streptomyces avermitilis
MGEMPEFAYTDLLPQGEDTTPYRLVTSEGVSTFEADGRTFLKVEPEALRKLAEEAIHDIQHYLRPAHLAQLRRIIDDPEASGNDKFVALDLLKNANIAAAGVLPMCQDTGTAIVMGKRGQNVLTEGGDESALSRGIYDAYKNLNLRYSQMAPLTMWEEKNTGSNLPAQIELYATDGGAYKFLFMAKGGGSANKSFLYQETKAVLNEGSMMKFLEEKIRSLGTAACPPYHLAIVVGGTSAEYALKTAKYASAHYLDEIPAEGSELGHGFRDKDLEEKVFELTQKIGIGAQFGGKYFCHDVRVVRLPRHGASCPVAIAVSCSADRQAVAKITAEGVFLEQLETDPARFLPETTDDHLDESGDVVRIDLNQPMDDILAELTKYPVKTRLSLSGPLVVARDIAHAKIKERLDAGEEMPQYLKDHPVYYAGPAKTPEGYASGSFGPTTAGRMDSYVEQFQAAGGSKVMLAKGNRSAQVTNACEAHGGFYLGSIGGPAARLAQDCIKKVEVVEYEELGMEAVWKIEVEDFPAFVVVDDKGNDFFKDPAPAPTFTSIPVRGPGLA

SEQ ID NO: 10756 - protein, 145 aa, Streptomyces avermitilis
MGERDMVFNQSGWNVGKVYNIAGDLRLTDRSSPQEFAEALNELRSRIRALEDVPGADLAAMDAELAQAALAADTHAGEHATDAATDDAASGEDATGDGPSPGDDIVAGRLTRVANRLRALGTATAAASELGTSLDTMAQWVGHHL

SEQ ID NO: 10757 - protein, 1063 aa, Streptomyces avermitilis
MSGFDITGPEDPAGAPDGAPGEREARVNLPGAVDAAVTHQPDWAVDSVYMAKEISFVDRRVMVNETPAPAPDPSGSPAPADGPAFRKALARVLLGKLTSTLDETHWLDHKLVELTAIVEDVDGYPAAGHRSLWRRRGRYATRPLTQVLARPETDLILLQGAPGAGKSVAMWQHAVEGLRQIVSGRNPDLPLPIYVNLRELRAKPDEINTDVLRKYIAQQTGPRGSIEIASYFAHCFTEDLRRRRVTLLLDSFDEIPAVLGSATVDKAVSPYVQTVIELVGGGGRCVVASREYKGPRAAGWTRLHILGLSSEQQESFLRGLGLGREDIGLVQPLLTDPRHGFVTELQNPLSLKLLASYVEARHTLPERPSAVFEEYVSQRLHAAVETARDTGELRRVEDFLARFAFRLTSTDGGLSVSEREYGEEIVREAGDDAAVRELLLRVVPASRLLVSAPEGRHAGRRVFFGHRRVQQYFASRHVASRPSAVAPFELVTNGRWRETAVTVLQDGSPEITGPLMAELAGVLTAEWGRYRAMEEASRREYVPIAEEFTWSSYGELVGEEGANPPPLLTPFAWSPMAVHCLELLTAAYHGQSQWPRAEIEGLVQALVDAAWRRGSVSDRKFAVDCLPLLPEPVRERYIDRAFAGGSGWIRTTALRDCATLPALTPGIRRSIRRLLITMLSERSLATESHAVDVDLRRLHGDDDLVRVRRIISWSPKAVAVICVLHALVAMAAPGAYWWRLRDQLLWWYAVPLFFFWWFQSTQPLSYGVGKSRTRLFFERVVNRTVGVEMDVLETDVLLGSLVMIAGLQAALQVALGFYEITEGHTTWGLLEITLYAPLSVCALLWGPSLLYAVRQGRSSRELSAIRLVLVVPDTMRLPDHPARALSRQTWARFAWDSLWGLLKMAVFTSPVWGTFALLYYAGGHTGHILALVLLGLLTGYFPLVVVIGLVREFRAHRRVQRAVLRGSRGGAAFVEAMFSLRDTGEAAEYVRRIRGIPGMDAEKLDRQAVRASIAYLQNRPGAKPSDPAPAGFAVTAPRRPAAWRADDALLDELGRLDEHLRAR

SEQ ID NO: 10758 - protein, 467 aa, Streptomyces avermitilis
MTDEDDKQNYRVEHDSMGEVRVPADAKWRAQTQRAVENFPISGQRLERAHIEALARIKGAAAKVNAELGVLDKDVAEAIQEAAAEVAEGRWDEHFPVDVFQTGSGTSSNMNANEVIATLATERLGRDVHPNDHVNASQSSNDVFPSSIHIAATAAVTRDLVPALEHLAAALGRKSEEFADVVKAGRTHLMDATPVTLGQEFGGYAAQVRYGVERLAASLPRLAELPLGGTAVGTGINTPPGFSAAVIAEVARVTGLPLTEARDHFEAQGARDGIVETSGQLRTIAVGLTKIANDLRWMASGPRTGLSEISLPDLQPGSSIMPGKVNPVIPEAVLMVAAQVTGNDATVAAAGAAGNFELNVMLPVIAKNVLESVRLLAHVSRLLADRTVDGIVAHRDRAREYAESSPSVVTPLNKYIGYEEAAKVAKKALAERQTIRQVVLESGYVDRGDLTLEQLDEALDVLRMTHP

SEQ ID NO: 10759 - protein, 230 aa, Streptomyces avermitilis
MADGGAVRRVKADGSTAHWAPGSHILWRYRENAGEHFHIARPVTVVRDDDELLAVWLAPGTECMRPVLADGTPVHVEPLESRYTKPRTVQLDRWFGTGVLKLARPGEPWSVWLFWEPGWLFKNWYVNLEEPLTRWAGGVDSEDHFLDISVHPDRTWGWRDEDEFAQAQRDGLMDAELAARVRKAGHSAVEVIRAWGPPFSDGWQHWRPDPSWAVPPLPEDWDRTPAQMAT

SEQ ID NO: 10760 - protein, 716 aa, Streptomyces avermitilis
MDSTRVTEHPTSHERRQPSAGRPSAPADPRGALLRTPEPLQTPSSSAALPAQARTGDAPTGQGTTTPCGKGPSGGQGTPTPPGAGGAKPSTPGAEHSQPSDAGPDAHRPRPAPEGIPAQPGGEQDRVAPAAGGGDRRTGQGLPPGGPMPMRRDGDRLRFVGAATRRIARGIDLDEIVMGLCRATVPTFSDAILVYLRDPLPVGDERPIGPMVLRLRRTDRIPEERDTDGGFLTAFQPEPASELSAVTAELSEVRPGGALAEVLRGVRPVFADAPAARAALPELLGDDLPMPSGQRAILAPLRGRRRVIGAALFLRRPERMAFEADDLLVAAQLATHSALGIDKAVLYGREAYIADELQRTMLPETLPRPTGVRLASRYLPAAETARVGGDWYDAIPLPGSRVALVVGDVMGHSMTSAAIMGQLRTTAQTLAGLDLPPQEVLHHLDEQAQRLGTDRMATCLYAVYDPVAHRITIANAGHPPPVLLHLGGRAEVLRVPPGAPIGVGGVDFEAVELDAPAGATLLLYTDGLVESRLRDVWTGIEQLREKLAATAQLTGPDHPPPLEALCDEVLDMLGPGDRDDDIALLAARFDGIAPSDVAYWFLEPEETAPGRARKLARRALSRWGLEELSDSMELLVSEVVTNAVRYSTRPITLRLLRTDVLRCEVGDDVPQLPRLRQARATDEGGRGLYLVNKLARRWGATRLSTGKVVWFELNRS

SEQ ID NO: 10761 - protein, 487 aa, Streptomyces avermitilis
VTQAPQKAPYTTNNVGIPVESDEHSLTVGPDGPILLQDHYLIEKMAQFNRERVPERVVHAKGSGAYGFFEVTNDVSQFTKADLFQPGKRTEMLARFSTVAGEQGSPDTWRDPRGFALKFYTEHGNYDMVGNNTPVFFVRDTIKFQDFIRSQKRHPVTGLRSNDMQWDFWTLSPESAHQVTWLMGDRGIPKTYRHMNGYSSHTYMWINGAGERFWVKYHFKTDQGIDFLTQAEADELAGSDADKHRRDLFESIESGNAPTWTLKVQIMPFEDAADYRFNPFDLTKVWPHGDYPLIDVGRMVLNKNPEDYFIHIEQAAFEPSNLVPGIGPSPDKMLLGRLFSYPDTHRYRIGPNYAQLPPNRPHAPVNSYAKDGPMRYVPSNAARPYAPNSYGGPAADYGQFGDPASWETAGELVREATKPHREDDDWGQPGTMVRQVLDDAARDRLVSNVSGHLKADVSRPVLDRAVQYWRNIDKEIGDRIASNVNGG

SEQ ID NO: 10762 - protein, 777 aa, Streptomyces avermitilis
MGRAEERRARQRGGRRAAPQGSSRTAAKSAGAGKGRIRRLFTWKKILGTLFGLCLLGMGAFIVLYMMISVPKGNADAKLQSNVYEYSDGSPLARTGTRNREIVDLSEVPKGVQRTFVAAENKSFYKDSGVDFRGTARGLINTLSGKGKQGGSTITQQYVKNFYLSQDQTVTRKLKELVISLKVDRQKTKSQILAGYINTSYYGRGAYGIQAAAQAYYRVDAKDLSVRQGAYLAALLQAPNQYDWAIATDTGKKLVKDRWNYVLDNMVEEHWLDSGKREGMTFPTPKPPRAAPGMEGQTGYLVDAANAALMKQLVAQGAASDLGTAEAMVKAGGWTLTLNIDKKKQDQLEAAVKAKLTSKLNAKKRPVDGDVQAGAASVDPKTGKVLALYGGQNYVKHYLNNATRRDYQPASTFKPLIFAAALDEGASTQDGKAINANTIYDGTSRRPVLDNGDKVGFAPPNEDNRSYGKVTVQRAMNASINSVFAQMGVDVGMDDVLKVAGKLGMDTKGLEAVPAQTLGSMGASPLEMAGIYATLDNHGKKVTPAVVRSAEHKDRQVKFPDPIGDRVITREAADTVTSVLTGVVDDGTAQTSVAQAADRRGQQVAGKTGTSDSNKSAWFTGYTPNLVTSVGMFGESAKNQSQVTLKGATGLIPGSGRINGGGYPAQIWAAYTFGAMGKVTKFDLETTQGAAIEPTVTPTLTQSPSDSPSSSPTTKKPTTTPPSTSTTPASPSTSPTTKGPSNTPTGTTTTPTDGLPDDPVNPNDRNGLRNQNDPTSQ

SEQ ID NO: 10763 - protein, 315 aa, Streptomyces avermitilis
MSTHDSTHDSTPAADVPEMPAPRVREFAAHSIGGGLALLLGLVGLLLGAGMIAGATTLAATGAKAALIVGGILIAIAAFLAMCGLNTVAPGEARVVQLFGRYRGTIRQDGLRWVNPFTSRTKISTRVRNHETPVLKVNDAYGNPIELAAVMVWKVEDTAQATFEVDDFREFVATQTEAAVRHIAIEYPYDSHDEDGLSLRGNAEEITEKLAIELHARVAAAGVRIIESRFTHLAYAPEIASAMLQRQQAGAVVAARRQIVEGAVGMVEAALARITERDIVELDSERKAAMVSNLMVVLCGDRAPQPVLNTGTLYQ

SEQ ID NO: 10764 - protein, 87 aa, Streptomyces avermitilis
VTAPSEGTPSPGRRPQQQRKQVLLRLDPLVYEALARWAGDELRSTNAQIEFLLRRALAEAGRLPGEAGPIPRRGRPPGGSTPGPSST

SEQ ID NO: 10765 - protein, 175 aa, Streptomyces avermitilis
MSIGHTLLGLLESGPCHGYDLKRAFDEKFGHDRPLHYGQVYSTMSRLLKNGLVEVDGIEAGGGPERKRYAITDAGITDVQQWLATPEKPEPYLQSTLYTKVVLALLTHRDASEILDTQRSEHLRMMRILTDRKRKGDLADQLICDHALFHLEADLRWLELTAARLDKLAEAVTTR

SEQ ID NO: 10766 - protein, 228 aa, Streptomyces avermitilis
MTPAGSLLAATDLRKTYGATTALDGAEFSIHPGEVVAVMGPSGSGKSTLLHCLAGIVPPDSGSITYNGREMAGMSDTERSALRRSEFGFVFQFGQLVPELTCVENVALPLRLNGTGRKEAERISLSWMERLEVDDLQGKRPGEVSGGQGQRVAVARSLVTSPRVLFADEPTGALDSFNGERVMELFTEAARSTNAAVVLVTHEARVAAYSDREIVVRDGRSRDMERIV

SEQ ID NO: 10767 - protein, 778 aa, Streptomyces avermitilis
MRVRQWSRDLAMGARFAFTGGREGWMRAVLTAVGVGLGVALLLMTTAIPSALQARSDRETARTDITYGNTHIPKASDRTLLVARVDDEYRDKAIRGRELEAEGPRAPLPPGVRKLPKPGEMVVSPALADLLKSGNGKLLRERLPYRVIGTIGEPGLIGSAELSFYSGADDLAPRINGSEVTRIDHFGQPLGPPDKLDPVLLLLILVVFVVLLMPVGVFIAAAVRFGGERRDRRLAALRLVGSDSRMTRRIAAGEALGGAVLGLVFGTVFFLLAREVAGSVEVFGQSVFPSYLNPTPALAALIAVTVPGAAVLVTLFALRGVVIEPLGVVRTAKPARRRLWWRLLLPVGGLAMLYPMIGQGNTSGNFNQYLVIGGVLLLLVGVTALLPWIVETVVGRLGSGGVAWQLAVRRLQLSSGSAARMVNGVAVAVAGAIALQMLFAGVEGDYTKASTNDVMRAQMEVRLPYDVPLDQAREQLARTKGVQRVTAIGSASTGDKKKDADLSTSMTVGDCASLREVAKLPTCHDGDVFAVTDAEYDTDLRKLARPGRTIYIDPSYSGAVANRQVPWTVPRDIKKAGVRKDPTNSERGGFLLTPGAVPAKAVPAIEGSAFLQIDQSVPDVYEHVRNTTAKLHPLAHAWTWASATRDTSYASIRTGLSVGATCVLFLIGASLLVSQLEQLRERKKLLSALVAFGTRRRTLSLSVLWQTAIPIALGLVLASVVGLTLGIVLQRMTDVSVRVDWSSLLTMTGSGAGVVLLVTALSLPPLLRLMRPDGLRAE

SEQ ID NO: 10768 - protein, 336 aa, Streptomyces avermitilis
MAGTRTNGRRQPSLAQLRAFAAVAEHLHFRDAAAAIGMSQPALSGAVSALEETLGVTLLERTTRKVLLSPAGARLAVRAKAVLDEVGALMEEAEAVRAPFTGALRLGVIPTVAPYLLPTVLRLVHDRYPDLDLQVHEEQTANLLEGLAVGRLDLLLLAVPLGVPGIVELPLFDEDFVLVTPLDHWLGGREGIPREALRELNLLLLDEGHCLRDQALDICREAGRADAPVTTTAAGLSTLVQLVAGGLGVTLLPRTAVKVETTRSEELLTGYFADPAPTRRVALAMRAGAARGAEYEELADALREALRPLPVRVLGRDDRAATAGPSPLPGTGLRRF

SEQ ID NO: 10769 - protein, 184 aa, Streptomyces avermitilis
VLTVGDKFPEFDLTACVSLEKGNEFQQINHKTYEGQWKVIFAWPKDFTFVCPTEIAAFGKLNDEFADRDAQVLGFSGDSEFVHHAWRKDHDDLRDLPFPMMADSKHELMRDLGIEGEDGFAKRAVFIVDQNNEIQFSMVTAGSVGRNPKEVLRVLDALQTDELCPCNWTKGETTLDPVALLAGE

SEQ ID NO: 10770 - protein, 177 aa, Streptomyces avermitilis
MALDELKAAVPDYAKDLRLNLGSVIGNSDLPQQQLWGTVLACAIASRSPRVLRELEPQAKANLSPEAYTAAKSAAAIMAMNNVFYRTRHLLSDPEYGTLRAGLRMNVIGNPGVEKVDFELWSLAVSAVNGCGQCLDSHEQVLRKAGVDRDTIQEAFKIAAVIQAVGTTLDAEAVLAE

SEQ ID NO: 10771 - protein, 440 aa, Streptomyces avermitilis
MSKVPRWIGRLGAGLTEMGERLDERRAEVEKETSDAPSDGSPPVPAQTPDHVPPPPEYAPAVSARPDPAVAVPWGMRVAAEAGWRLLVLAGTVWVLMRVISAVQLVVLAFVAALLITALLQPTVARLTRHGVPRGLATALTAILGFVVMGLIGWFVTWQVMENIDNLSNQVQDGIDELRKWLLNSPFHVTPKQINEIAKNLREAVGANTDQITSAGLEGVTVIVEALTGILLTMFSTLFLLYDGRRIWEWTLKLVPSAARPGVAGAGPRAWRTLTAYVRGTVIVAMIDAIFIGLGIYFLDVPMAVPLAVFIFLFAFIPLVGAVVSGALAVVVALVTQGVFTAVLTLAVVLAVQQIEGHILQPFILGRAVRVHPLAVVLSVAAGGMVAGIGGAVVAVPLVAVTNTVVGSLRSYSQDRAVRQATTATPPAQTPTEPSEAPAS

SEQ ID NO: 10772 - protein, 237 aa, Streptomyces avermitilis
MLEGNRVSRISVRGFAVASATAVTAVGAVTGVASGSTGQPSSDAEALASDSTLLADIPAGQQAQVQTASLTQQADAQAIAADASAKKDAEASARKQAAEDAVAKQKAAKKAEADAKARKEAETKASRASVRSTSFPVQGSYTIAQIQAMATQMVPSGQFQCFSNIVDHESSWNYKAVNASSGAYGLFQALPGSKMSSVGSDWQTNPATQIKWGLNYMDSRYGSPCEAWSFWQANHWY

SEQ ID NO: 10773 - protein, 441 aa, Streptomyces avermitilis
VVTSTKRHKPDRRTYVLDTSVLLADPHALNRFDEHEVVLPIVVVTELEAKRHHPELGYFARQALRLLDEFRVRHGRLDAPIPIGELGGTVRVELNHSDPSVLPSGYRLGDNDSRILAVARNLQAEGYDVTVVSKDLPLRIKASSVGLLAEEYRAELAITGSSGWTGMAELTLAGEQVDILFDEGHVYVPEAADLPVHTGLTIQSERGKALGRVTSEGNVRLVRGEREAFGIKGRSAEQRIALDLLLDPDIGIVSMGGRAGTGKSALALCAGLEAVLERRQHQKVMVFRPLYAVGGQELGYLPGSESEKMSPWAQAVFDTLSAVTSREVIEEVTARGMLEVLPLTHIRGRSLHDAFVIVDEAQSLERNVLLTVLSRIGANSRVVLTHDVAQRDNLRVGRYDGVVAVVEKLKGHPLFAHVTLTRSERSQIAALVTEMLEDGQV

SEQ ID NO: 10774 - protein, 257 aa, Streptomyces avermitilis
VNLRDNLRRLLVRFYARRVEGHLDHDQVPKHIGVIMDGNRRWAKAAGSTTAQGHRAGADKIEEFLGWCSETDVGVVTLWLLSTDNFDRPQEELGPLLGIIEGVVRTLAADGRWRVHHVGTPDILPSQMQNALKEAEETTAHVDGILVNVAIGYGGRQEIADAVRSMLLDAHEKGTSIPDLADAVDVDLIGKHLYTGAQPDPDLVIRTSGEQRLSGFMLWQTAHSEYYFCEVFWPAFRKVDFLRALRDYAARHRRYGN

SEQ ID NO: 10775 - protein, 196 aa, Streptomyces avermitilis
VMLRASACHNYSPKLPGDATVAAEAFIPGGIMAESQRIPRESFGIRNNPEDLRTVVDLSATRPGVLRAGDTRRERPLDAGANFAAMATFTTPGTPEPVPLELAKSARARRRGLLRREGIEGALLLSPANSVHTLGMRFAVDVAYLDRELRVLAVRTMRPGRIGRPRPRARHVLEAEAGAMERWGVRRGVRVAVRGG

SEQ ID NO: 10776 - protein, 386 aa, Streptomyces avermitilis
MTLKITWDEASARRMQRQFLADPAPAGSAVAEVVGAMLGAHAQVLSAAELSVGIRAEGVTRADVRAALWEDRTLVKTYGPRGTVHLLPSAELPFWTAALRAIPSRPSPFAPDVRLTDEQAEQVVTAIGDALDGAFLTIDELNDEVVARTGPWAGDLVMPAFQGMWPRWRQVMHRAGQSGALCFGPQRGRKVTYTRPARIGPDAEVTAQQAVAALVRRHLRAYGPATPAHFAKWAATSKGWADGVFGALARAGEIEEVRFEGASAWVDAGDTRFPAEAVRGVRLLPYFDPYGIAAQPRELLFPGASYQRALARGQAGNYPVLLVDGVVAGVWHQRRQGRRTTVTVEALGRLTARQEQELGEQVERMGEVLEAKPELVVGEVTTGPHA

SEQ ID NO: 10777 - protein, 286 aa, Streptomyces avermitilis
MTTSRAGRTSHTSRTGGAGGAGGTGGAGGTGHTGRTFEDLVAEAAAASVDGWDFSWFEGRATEERPPWGYARAMGERLAGASAALDIQTGGGEVLACAPELPPLTVATEGWPPNVAKATALLHPRGAVVVASPEDAPLPFADAAFDLVTSRHPVRTYWDEIARVLRPGGTYFSQQVGPASAYELVEYFLGPQPEENRTARDPERARTAARKAGLTVTDLRPVRLRMEFHDIGAVVHFLRKVIWMVPDFTVEAYEPQLRSLHEKIGSEGPFLAHSTRFLIEARKPQA

SEQ ID NO: 10778 - protein, 161 aa, Streptomyces avermitilis
VPYTGGEKESLHASLDRHRDAVLWKLAGLDDEQGRRVMTPSGTSLLGLVKHLASVEYGWFCRTFGREVEPLWFDPFSEEDMRAGPDETTDGIIEFYGRARTAADRAIAELSLDDLGTSWNGTRVSLRWVLIRMVEETARHAGHMDILRELIDGATGDHRPG

SEQ ID NO: 10779 - protein, 168 aa, Streptomyces avermitilis
VPHSPDMSDDNVDNAGDVEDVQLRYVTEADLEVFLAYEHDPEAVRRSRFTPRPREAFMTHWKERVLGDDTGLVLTVTVDGDPAGNIVAWWEGERRFIGYWLGRPYWARGIGSRALGLFLRRERTRPLYADPFHGNTASVRLLEKHGFRRTGTVRHGEDEHIMLVLDDA

SEQ ID NO: 10780 - protein, 290 aa, Streptomyces avermitilis
MTALGAVFRPQLPPERLRAIARLADDCGLEELWLWEDCFLEGGISAASAALAWTERLRVGVGLLPVPLRNVAVTAMETATLDRLFPGRAVVGVGHGVQEWMGQVGARAESPLTLLREYLDALRALLRGERVTTDGRYVTLDRVALDWPPADAVRVLAGATGPRSLRLSGEAADGTILTAATSPEGVRQARRLIDEGRESAGRTGPHEVVVYLHTATGPDAAARLRAEIEANGEDPAVEHGVAGDAAEVAKAVRRLADAGADTVILQPTADESDPEGFIRFAAGEVRPLVP

SEQ ID NO: 10781 - protein, 215 aa, Streptomyces avermitilis
MRKIVLMMSVSLDGYIEGPNREIDWHLVDDEVHQHFNDTLRGMGAFLSGRVTYQLMADFWPTADADPASTGPVADFARIWRDMPKIVFSRTLQHAGWHTTIVRDLVVEDIHALKAQEGGDLALGGADLAAEFMRHDLVDEYRVYVHPVLLGRGKRLFPETDTLTPLRLTESRTFGNGVALLRYERAESTADTAGTNPAAGTADAAGTDRPNGTGS

SEQ ID NO: 10782 - protein, 226 aa, Streptomyces avermitilis
MTLTPRRATATATATATTLTALAVLATLTLTVPSAVADDGDPSAPPGSVTTSPPPDVDANSPGLKLADGATLAPAKVLDIKSVVEDLGGEERREDTNADVTFALQAEVLFPKDSPKLNPEARSRINAIADEIKKQNATNVRVFGFTDNLGSYAHGLTLSKKRAEAVHDQLASALGSQDVTFEVRGYSEDYPIADNTSEQGRRKNRRVEVTFPRDTASSESQKSGAS

SEQ ID NO: 10783 - protein, 197 aa, Streptomyces avermitilis
MDYRHTMKGRRALSAVAITAGLLLTVAGCGGGDDGKSDKGTPSSTAPAKSGDDGSKAQSKAPESDTVLAEVKGEGGVTLTVKSAKRDGGGFVTVEGTVANGTGRAWSVGSWRGDERELAKNGGSMAGASLVDETGKKKYLVLRDTEGRCLCTRFTGGLLQGQSTDWFAQFPAPPEGTTKVSFQVGGMPPASIEISEG

SEQ ID NO: 10784 - protein, 184 aa, Streptomyces avermitilis
VILLFAAFACFAFAQAASARNGAQSAADAAALAAAQDARDELLVRLGDAVGTDDNWLDWLDLPEDTVLPADGADAAAQVLAAANDSTVQGGAQPVVRNGYPGFQVDIQTNYTVGDSIIPGTEGMRARAHAVAVVQPRCDFDLNADPKKPVELGCDGQTVNIDPEDFDPADLPDASVLFSVHLAE

SEQ ID NO: 10785 - protein, 71 aa, Streptomyces avermitilis
MVTNTRRRLSGWRTTVVSRMRGAGRDAGAGFVEYAGLMIIIAGIFTLIDGLGLDGLISDAILRAVTDVIGG

SEQ ID NO: 10786 - protein, 243 aa, Streptomyces avermitilis
MPDQALSGPPLRVLVADDNPVVRAGLSALLSAHPDIEVVAEASNGEEAKALAGEHRPDVVLLDVRMPGTDGLTALPELVRLTTVMMLTYSREPKVVAEALRRGASGYLVHGEFTVPELITAVRDVRRGRLTVSSSLSVSYEPNGNPSHLQSVVAQSSKAWPTRVTGLPRRTVNRLDFGLSSREVEVMDLIAAGMNNRQIAATCFISEKTVKNHINRIFAKLHSATRSEAIAHWLGTAREGWSR

SEQ ID NO: 10787 - protein, 472 aa, Streptomyces avermitilis
MGDGRLAGLWAQRAQWAQWAQRHPARAARRTPAPAGPDAGYLADDAPPPTSVRLQLSALQALCRQTIAVRLTMIAFGAPFAMANAAAGAPRYAVLAAAVLGVMASYAMLRDWDRFGPRLLAHPTLMALDLLFVATLLVTASPASPLAYATVCTPLLSGLLYGWRGSGVFTGLQLVVLLTVFRAWEHRPGAGANTLLVAGFCVAAGIIGVTLRNLMFRFGAASQALSEATSRLAVAEAVESERARLAREMHDSVAKTLHGLALAADALAASTDHSDPAALKRQATVVAGAARRAAAESRDLLSDLRRHTDFTAAHVDLTAELGCRVRDFGTRTGLAAELRLPRTDEDALRALRQLPCATAHHVLAVVSEALENTHRHARATSVLVELDVAEDRLAVRAGDDGAGLPPSATPDSPAKTGHFGLLGMAERAASLGGRVRLGRSPLGGAEVHLTVPLSTPATPSTPHTPQEEAAHA

SEQ ID NO: 10788 - protein, 301 aa, Streptomyces avermitilis
VSSSTSLGLLLAALMAVAVAGVLLGIRMIRADAKLPSDLVLALEVGATRVSTADSAVDRLGMRFAPLVLRLMGPRRVAAKRRRIDMAGNPGGLTLNRYAARRAVYGIFGVVLGLIFLTNGHPLFALGTLAFGLLAADALIWQAVRERKDVIDRTLPDFLDVLAVVVSAGLGFRQALDRVAEKYEGPWADELRITLRQMDMGVSRRQAFDELRKRNSSEQVAQFVSALQQGEELGSPIAETLIQLATDMRRTDAQNARRRAAKTIPKATMVTLVFMLPATMILIATGMFLGSGTNFGSILGR

SEQ ID NO: 10789 - protein, 313 aa, Streptomyces avermitilis
VNHPALLALGATVLCGTLAVAGVHVYAAGRAQRQALVDRLAGGGPIRTVAGRVRRFAGIDRRLRRTRLGRAIHLRLTTTGLDLTAGEFTTYVAAVVVALWLIAATTLAPFFGPIAALVGIWGAAVFLNWQRQKRIEAFIGQLPDVARLLANATAAGLALRTALAMAAEELEAPAGEELARVADQLTLGRSVDDALDELAERLPSRELIVLVTTLVLANKAGGSVVSSLRNLTQTLEDRKETRREVRTMLSEVNATAFTVPLLGLGSLLLINSSNEGALARVTGSSLGQGLILLSLGLYTVGFFVIRRLGKIEV

SEQ ID NO: 10790 - protein, 446 aa, Streptomyces avermitilis
MSLRSRIAAPDEGGPAREDGHLVAVYRAKLLEEIDLAEMSSLAAAERRIRLERVLGHIISREGPVLSSAERSQLIRRVVDEALGLGVLEPLLADASITEIMVNGPDSIFVERAGRVEQLPLRFASTEQLMQTIERIVSTVNRRVDESNPMVDARLPTGERVNVIIPPLALTGPTLTIRRFPRAYTLPELIGLGSLDEQMLLLLAAFVRARFNIIVSGGTGTGKTTLLNALSGLIPSYERIITVEDSAELQLQQEHVIRLESRPPNVEGKGQITIRDLVRNSLRMRPDRIIVGEVRGGETLDMLQAMSTGHDGSLATVHANSAEDALMRLQTLGSMSEVLIPFEALKDQINSAVDVVVQLTRHADGSRKITEIALVVSHGREQFRIVPVARFVPRPVGADRVVHGRFEHLPLPRQVAEKLYVANEPLPAAFRVADAIDVLDTRQAIG

SEQ ID NO: 10791 - protein, 50 aa, Streptomyces avermitilis
VSSWLDPDVPAPAKGADTTTATVTVHVPSVIPFFGAGWDVTRRATMPTDD

SEQ ID NO: 10792 - protein, 535 aa, Streptomyces avermitilis
MTVRILPAVGDIDSARALATLLSQLTDAEPAPPVADTTALLDTLARLAAESLDELPEVVLVHERIGPVPALDVIRDLVLRFPAVGVVLITADTGSGVLTAAMDAGARGIIGLPLGYDALAERVQAAAAWSTGMRRHLGSGTPELYTGPGGTVVTVTGAKGGVGATVTAVQLALAARASGRTVALLDLDLQSGDVASYLDVQFRRSVADLAGITDINPRVLQDAVYIHDSGIGLLLAPAEGERGEEVTDRVARQVVGTLRSRHDVVIVDCGSQMNSATAAAVEMADQALLLVTPDVVAIRAAKRMVRMWDRLQIRKAEETLTVVNRHSRGTEIQPSLVERVTGTKVARSAVPAAFKELQSVVDAGRLQDLDARSTVKQALWALAGELGLVAVQESGGRRRKSSDRGALSLRRRGGDRGAVTLEFAGMFPLLLVVMAILWECVLYGYTYSLAGNAADEAARAATAAYAIKGDVGGACQSAGAEHLPDSWSGADISCGQDGSVMKATVQVDVPLFFPGVNPGWSVDGSAGAALEGDGG

SEQ ID NO: 10793 - protein, 209 aa, Streptomyces avermitilis
VIRDVNSKVGPEVAAYRLRNDIAPYKELSADQFEKVSMPRRWLSKTAVTDLAQIRGKIAVTQLEKGSLLQTDMIVDRPALAAGQQEIAIMIDASTGVAGKINPGSRVNIYATFKAPSDKGKDQSKVIVENARVLDVGKLTALDPGQSSDQRRRTASEAVPITFALDTADAQRVAYAESFAEHVRLALVAGGSGTTVPPGDRSYTLDEDK

SEQ ID NO: 10794 - protein, 295 aa, Streptomyces avermitilis
VPTAIAVTSADLVLPPLDRGTPPAAVQPLDTLEQSLNGMHALIEQHGYVVVLYPAPATGPAAAEQPDVRRLRTVRSVLESDRIALLGIDLPPLGLALLAQQLRQLSMCDFSPGVLASAARLLAHYIYAGALLGSVAGLDRVPVSMKSHAKSWVPGAQFAVLANPRPQLVRVGEEELPGPEFGTRLLVAAGQPPSDWVTASLAPAWRVQGVATVPLPAQSTRWWGTGRLAEFAAGLFDVSVLYQLVSSVRREECHWCGLELIGDRCGFCAAPLPPPPELGQARAPAAVRALPRGRT

SEQ ID NO: 10795 - protein, 579 aa, Streptomyces avermitilis
VDRAPGTPPRRRTPLRTPRRTRTWAGLLAAVLGASVLSLTGAGPASAADVNNAKNGGYESGLGNWTCSASSGTTVSSPVHGGSAALKATPAGQDNAKCTQTVAVKPNSTYTLSAWVQGGYAYLGASGTGTTDVSTWTPDSTSWKQLTTTFTTGAATTSVTVYTHGWYGQAAYYADDLSVFGPDGGGGSDPAPTVPAAPAGLAVSSTTSSSVSLSWNSVSGATGYNVYRAGTKVQSVTGTSATVSSLAASTSYSFQVTATNAAGESAKSAAVTGTTSASSGGGGGSVPKHAVTGYWQNFNNGAQVQKISDVQSQYDIIAVAFADATSTPGAVSFSLDSAGLGGYTVDQFKADIKAKQTAGKKVIISIGGQNGTVSVNDSASAANFANSVYSLMQTYGFDGVDIDLENGLNATYMSQALRSLSAKAGSSLVITMAPQTIDMQSTSNGYFQTALNIKDILTVVNMQYYNSGSMLGCDGKVYSQGSVDFLTALACIQLEGGLAPSQVGLGLPASTSGAGSGYVSPTVVNNALDCLTKATNCGSFKPSKTYPDLRGAMTWSTNWDASAGNAWSNGVGAHVHALP

SEQ ID NO: 10796 - protein, 117 aa, Streptomyces avermitilis
MHREFTVPDDHEILDTLGEWPETDEDGSARLLKLSGGEDGDVLLSYDSLSQSVRVRWINPAGEKILDLFREGAIKMSVTATANNTSITLDFSLGECSGEINIQISPRLVITDRILLV

SEQ ID NO: 10797 - protein, 153 aa, Streptomyces avermitilis
MSFGPPPNTFDPPATLTDSRNSRSSRGRRERLRRALEGFGNVVWMRSPMERHPIYGYRQVSFASWRFEEPSDFLKTKFESLVQDTPTNLEWRFKAARNWMIAPARLVDQAGQGGEFFNEAVVSITEHDQEFCASAEEDLMQILITLEEGGGKS

SEQ ID NO: 10798 - protein, 417 aa, Streptomyces avermitilis
MSFGPPPDVSQAPFPPGWTPPTAVEKALFEARARGDWAAFHDALARTVLYFEVGRDETDADPDGIFPRFHRNLRTGARWWKVFTMGMLPAPQPDLVFARRSLRWFARAWQPTDPPTLLVNPDSPCEVALPLGPAHSTEWSRVAEHVGEPSIAMQLRSLHAGGPLHGPVAHGLACGALLCVNNGSLWNAMAWHGTGYGSERRRLREWWGITSREEWQYYLRSLLACDASSSVWEFALGLRRTIARDFGGHVDIGYWRQAVANVLRAEAGGSTVLSADGVTKSEPRPESETEAKIEGVQRLIGRITRYEARMRADGVLDEGRYVTSVEAWDLGRASKMARWGLGARFGTLQEAEAAVVQAGRSAALSYRSWQDFSAAYILGRCLHFDEEEFGDWYQDMVSAHRILMSEPGSPWLNIPFK

SEQ ID NO: 10799 - protein, 174 aa, Streptomyces avermitilis
MPETRSAARCPLATAYPADPTPPRPETLAYSLTLPAALSSPAVARAATRAFLEAHALPDIMDAALQAVGELTATAAQFTQAPDYYLSLRYRAATLRVIVYDSHPRHTQPRLAAACDTRRRAALRVLACVCRACEGDWGFGESREPGGGTRMWATLPRASAAAYGSAAVPSATAT

SEQ ID NO: 10800 - protein, 283 aa, Streptomyces avermitilis
MPTRSTPTERQKRLGAELRKMRLAAGAPTEYAAGLLGIDRTRLSNMESGIRPFSPDRVRTLACNYSCTDDGYIEALVAMTSTKERGWWERHRGILPSGLLDIAELEWHATRVRTAQVMHAPGLLQTEDYARGVFTAVLPPLTRLEVELRVAHRMERQQVLERPSPLPYIAYVHEAVLRMPYGGTEATQQQLKHLCSQSERENIEVRVIPTSTGGFPGAGHALLYADGAVPQLDTVQLDSAHGPEFTHADAQLTKYRSHLNWMDGAAMTSAASRDLIRKIARDL

SEQ ID NO: 10801 - protein, 64 aa, Streptomyces avermitilis
VNDRIAWEEPFCGEGNNCFRLGTDNEGNAYIAVAGAEDSYLSDSREALRTLIRDIKAGKADHLL

SEQ ID NO: 10802 - protein, 176 aa, Streptomyces avermitilis
MRAHGILTAAHGRCRPRRTGEKRMNQPPYGTPPPPPVPPTAPPGYGPPVPHPGYSQPVPPPAPTGFGPPPPSYAPYPAPAAAPEFLAVDRHNSVVVDETGVTFECNGVTAEFPWPEIRSVHHQPSGNGKSLMMAVIHADGMLYECVVDAKRRERLHEWLNQVALVIGHYRYYRPGG

SEQ ID NO: 10803 - protein, 450 aa, Streptomyces avermitilis
MRLRIRGRGPRSGRRTAALATLLALALAAPVGGAVTDATATGARASDPSADDVRQYEIHQSTTPVTRTAIQQTGVTVDEADEETVVVSGRAAQIKKLRGLGYDLSPLGSAPDRSSGSDVRLFDFPSADSKYHNYAETNTEIDQRLAAYPGIMSKRVIGTSYQGRNIVAIKVSDNVATDENEPEVILTFHQHAREHLTVEMALYLLRELGAGYGSDSRVTNMVNNREIWIVPDLNPDGGEYDIATGSYRSWRKNRQPNSGSSYVGTDLNRNWNYKWGCCGGSSGSTSSETYRGTSAESAPEVKVVSDFVRSRVVGGKQQIKAGIDFHTYSELVLWPFGYTYSDTATGMTADDAAAFKAVGQKMAASNGYTPEQSSDLYITDGSIDDYLWGSQKIFDYTFEMYPSSSSGGGFYPPDEVIERETSRNRDAVLQLLENADCMYRSIGKEAQYCT

SEQ ID NO: 10804 - protein, 201 aa, Streptomyces avermitilis
VEQRIGSNSQPLDVAAVDPAFIPGLTPTVSAEPKSTAEPEGAAEPEKAAEAADEASPEDKTSEEAPAGKAAQKPSLGKASGKVSDEADDEPADEAEEEPAEEADDEADTEGPAFEASDRRASIVADGRGVRLRLDDQEAEFRWDEIGAVETESPRFGKRFTITVHTPDRRWYPIEIEASSRSRFKEWETKLDEVLDAYFQE

SEQ ID NO: 10805 - protein, 521 aa, Streptomyces avermitilis
MSNYTESLQYLDSYISARVPVIGMRTIEQQRALRLLREAATQPRRSSMPFWIYTRATGLRDLRTNAPVQDDRSLTGAMDFAAAQFTSRANATVVFVDPDDLGGDTPITRHIAELARLADSNMGSIVLITDTPIWSGLQRLGMSLHLDLPDADEMYGILSGFLGDHHGHIPIEWDEADGRRAAEFLLGVTEAECINLMATIAAKGSIQKADVLGLAQAKDRIFSDLTGLERVQLKEADYTVGGLSSLREWLQRKHWQLHEDLRDSALRPPRGVLLVGVPGCGKSLSAKAIAHEWQLPLYRLDMGAIHGKYLGESEGRFREALAMADRVAPCVLWIDEIEKGLAGRDDGSGVPQRIIGQFLFWLQESQSRAFVVATANDIRSLPPELLRKGRFDELFFVDLPDAQDRKEIIELYYQRYLQGEPDRDQVDQLVDLSEGFAGSDIESALHDVGLEARRIGGADGLKASFLRDTFANTVPMSRVNPEQIEEIRAWGRERALPAGRSTVSAAPGGAKPSRRIVFMDD

SEQ ID NO: 10806 - protein, 206 aa, Streptomyces avermitilis
MSGLWGDGGPYAAWVGFLRRWAALEPVDPGTLPAIVPEDFQGDTLARLTQHLTDALDARLNDWAERLLRAMAHSTDEFSVGRELAQARAGLNTVRALAGHPGLPPKVREELTGLVDRQIPELQAQLERNLDAEARRGADPRLLERRRRTLRENALTSVLTAPPPPLAPPSAPPSAGRRSPVSGPAAGGDAWAYDPAARPRRRIVPD

SEQ ID NO: 10807 - protein, 590 aa, Streptomyces avermitilis
MSEVDHVLRRQVQEVSNLVFRLSEQVGSVSGQVSAVEAEQQQARTELQQLRADFLAFVKQAEFTANVQRAETRIGVIQDQVDHEFGHHKTVRRTAVGMLQAFDVGLVSEDNVRMVSDQLMIQTPRYWLAPALVALASWSADDPQLCERAVEEAFRRSPDRTALFFALVLRRQDRKESAVRWLRHYLLAQDPTALGREFAVILESIAQGAFGLVGRDLLDRTLAGWRAQLMDSAETQAKQVQRWRDEIDTLRAPSAQAEFPRLSQVSPQWPQLDAALGAARGHQALLNKYRALLNREFEPSERIEDAVDDILDRLVKEYDNEELPLRRDLAFNQAVVEHDGDVLAARGAADADAASYEQTLDYLTVQTTAALNPQAIGTSPATQRLAVVACQEWFQHAQAGATRDYRLAVPQDVQAHFDTTHSVGAQTFRLPPWTGSFTQPLAALEQSLGAHWDRHMQPFIDALAYPTLKKAAPLIAVVAGILLIFGQVSIGFAFTAAAITAAVWGLILLNRKQSADRLQDQARQALDRAKTDSLHQLRGSAAELTDWNERFRAADLVDAECRALITSLSTADGGASPFEGRTVRREEPTA

SEQ ID NO: 10808 - protein, 182 aa, Streptomyces avermitilis
MPTGSPPMTLGGHMGPIEHPRRIVPGGTPAAPGTQAGTGRRLIAAANETRQRTASTPGARTIRRELYQPRSRRLLDAVAQLDAGLDEAACRQLADRIRDEYTTTYDDVPLGFVARCYLGPPYVDHQLNLFQVIVKHFAPSQRMPDPFDGARMLARSGAYAYIEVYAGGLILPVLEDGTVVRP

SEQ ID NO: 10809 - protein, 676 aa, Streptomyces avermitilis
MGTIHALLVGIDDYPSQTATPLRGAVTDVEEAARLVTELVGERADLLFLRDGEATVAAVEDAVVRQLGAAGPGDTALLWFSGHGTQQRATGADLLIEATGQNQALVCVDGPLLDKRLGALLERVAEGGAHVVAVLDCCYAGGGTRAGVLTPRFAPPSPDWDWGEGEGGGGDGGEGWDFGADERARGVVAAAGSGTPAPTRHVLLAASRLDQQSFEGHFGGRRMGAFTYALLGAVREAGPGLGYRELLAAADARLRRSGGRQQPVLYPVTPGGPADQPFLGGAARRPSPHLLRFGADGWEVDCGSGHGLRDGAGAEGTEFTVVDGELVGPVVRARDVRTERTLVDPVEWMPAREQVYPVTLSALALPAAGVALLGPARSEEVRALERAIASAGPGGGPSPLLRLVGSPQEAADLHFRVEVRAGLAHVLGRDGTPFVDPLPLTDPAAHARRIADCLVHLTRWHQLRDLTPRPSLLDGLVRMEIVPWHAAPGQALTPDGSGQITVSYPPGAAGPKAPWLSIRLHNRSPDRKLWCLLLDLTDSYAADSALYRGHFIGPGHTGYALDGDPVQLSLPPNRAVVPGAAARDWLKLIVAERELNTVPFQLPAWDPYAVVARDRVPGDGVLRFTGPGHAADGSRDLGPAYGAAAGRWTTVTVPLRTVVPGGAALPGPGAFTGPGG

SEQ ID NO: 10810 - protein, 1481 aa, Streptomyces avermitilis
MPAQPVDPVDPLDPVDSPDSADAPDSTDPADPADSSDHLDLLDPLDLLAEREEVLEELSGLPADDPEVPRLCAYAGELSIRLHMLRQEPEDLELAAEAFGHAFARPGTDAEWHSWRIMYGHVRACQFDAEPSPELLDECLALVAEGLAGLPTGDELGGAHELGGTGGTGVTGEPGVTDEAGEPDESHDTYEAVRGLGLRLLAAGTKVRCLDCPEDAPAEERTRLFEEALRRHEEAYEHLAPGDPDDAADLNEALGYLRFERGVLLGSAEDGAASAAHYRAALDAPRPASDLPFVRHSLGLALLLHGLVTSDRDVLEEARDAFGTALLDAGRAGGDRPEWAWEAEIRSAYIRAVLWAKWQDQGHGAAAEVELAALLAEPDALDRLSPVYLDIFGRLLYERAAHRDDPQGRDRGIMLLRRAVAEWRPEHDGNVTAAALLLATFQQIRHQDDPDPSRLQDIVRGASLAMADEELDPESVQLARMMLAWARHGLEEMGLHAETEGLPEQPGFEELRDMFTAMFVTEEDRNLVDLGERSDFPGIYRDMGGDRRRMAILDEGFARLDALSPDNEFRPRLAAMLLSQLVVLDPNNTDVGADRKQRLLDIVLEHGRVDPDWDRHAQAVVGAARLRDEMAGSGARMDEVLAHFDRAAATGAGDTAIPEVAFARLLARTHRGQTVGAADDLEAAAEAWRQLRDMPHISDYMRRMMDAQLAGMDAQNAAQRGDLAAVDRHIATVLEAHASLDPEDTSRIQLWTSLENALMNRDELARSLGAPLAPPPPGRPTVDTLRREAARLPRSHRAWVLGDNGISRFGRAMRNRDADALADAVTLLREAHDLAEEDSDSRLRYGHCLASAHCVLSEMLPTPHLRRSHLAKGIALFEKAFEQVKGPEHRLYAPVGLSLGRAYRTRDDLGRGDRAEGRRIGLEALRGHAWAALLQSGTAHAAQAAAQATSTALEVAGWCLRDNVPEEAVQALDACRGLVLHAATTSTTVPERLVAAGHIDLAEQWRAAGAGDPLSAAGGGPTLPSELRRRVLAALTAGDVSQERLLDPPTPREIADALRALRKDALVYLVPASEDGGGTAVVVTNGGDVHAVPLPNLTEVAAPLKEYAPAGTYARDAGPRPGGETAAPGGRDGGREGGRDGGPERDLGPVPGFATGEYGSQGARVDTPTLRKQLERLCGWAWYAAMRPLFAEFPEPRAGRVPRLVLVPMGALGLVPWHAAWEQGDDGRRRYALQAAEISYAASARLLCEVAARPAVAHSGAALVVGNPTGDLHYAGEEADAVQRAFYPRGQFLGRRGSGPADGAGSPQEVLSWLRKGGEDEGGVLHLACHAVVAENAPRSAYLALHQGELSAEELTEAVSDGSRGHLGLVLLAACRSHVSGRGHNEAYTLATAFLVSGARSVIGSLWPVPDDATSVLMYLTHHYLRTGGEPPAKALRRAQLWMLDPDRDRSAELPAELADRVRHIDPDDLSAWAGFTHLGQ

SEQ ID NO: 10811 - protein, 217 aa, Streptomyces avermitilis
VPNHRPPAALTGTPGKATLARGTLLHRVHSVHRDAAAFNPRPTHCLYGGGRFDGTSCHPYGYLYAGSTPAAAVCETLLRSVPFDPSGGPRLLPRVSVERRGLSALRLTTDLDVVSLMTGQDLAAVHQDSWLVQTEAADYAYTRDWAHWIREHTDPWAQGFVWASKREPGDRAVVLFGDRCPPGALAAVDGHTVDFGTDGGRRWLNSVLQPYHAQLAP

SEQ ID NO: 10812 - protein, 222 aa, Streptomyces avermitilis
LNPYAVLAAAAAAWDRIAARLDRAAREGLTELLRVVRDRDTAERERLAAAARAAALLGEALPDEFGAAQQARLAPDVLDEGAPTGPVVQGFHAEDLAVLLMDGHRMVGPVLGPVRERLLAAPALDADTVLREGGDPYAPDLIRLAGAGGRPRLPRFQFSEGTLPWLVVLEVNALLAADRDPWGAADWWLSGNAWLGARPVVLLGTGRDGHLADVARFLMEEE

SEQ ID NO: 10813 - protein, 397 aa, Streptomyces avermitilis
MDVENSQGSTERACDGGGGGAILAAMALPPHLPDHGSVLAEVRKVRRAGVVRLRGLDTPELIRIARELPGQQGELASRSVEVLLRTAVAGLGGGTLQTAAEYSLGLAQGTRDWPAADRRRRAAEVYGVSVERFRKHHELMVLGQLTEQVLGIAGAPAAPAREVPATGRPVALPAAHRVLKPYVHGRPVSVTVHVHSVDLLRDVDVVVSPSNTYFALPAAYKSSVAATLRRAGAHKDPTGGLVEDSVHDELRGWAVRHGAPGRAALPGTVAATSAGALAAQGVRRIYHMAVAVPRFGTNDYDVQPADITRGVTRVFALLAEESRRFDPPLNSVCLPLSGAGRGGLSPLESFGALWAAVEAELARGAPWDVHFVVRRHARADLIERLLSDRADHDTGSR

SEQ ID NO: 10814 - protein, 495 aa, Streptomyces avermitilis
LISYPLAATAPATPETPPHTGGLLLLMDGTAGLLTVAALGIALLLILIIKVRLQPFVALLAVSIAVGLAAGLSVTELFGTVQRSTAVSVVESGMGGILGHVAIIIGLGTMLGAILEVSGGAEVLATRLLNLFGERRAPLAMGLTGLIFGIPVFFDVGIFVLAPIVYAAAKRSGKSILLYCLPLLAGLSMTHAFLPPHPGPVAAAGLLHVQLGWVILMGVVCGIPAVLAAWVYSAWIGRRIFVAVPQDMVEAAAEAKLAVIEEQRAQGVEPREEPVPLGTVLGIIGTPLVLILAATFSSIALDPSTLRSVIEFFGSPFVALTIALLLAYYLLGIRRGWSRKSLETVSTSSLKPVGNILLVVGAGGIFGAVLKASGVAQALSDTFNDVGLPVIVLSYLISVVLRVAQGSATVAIVTTAGIVAPLLAAGDHSQAFVALVIMAISAGSIFASHVNDGGFWMVSKYFGISERDTLRTWTVLESVLSVAGFAVAAVVSTFV

SEQ ID NO: 10815 - protein, 139 aa, Streptomyces avermitilis
MTEKTEKTALTPKTHTTPPAKFSHGVRKGNILQVAGQVGFLPAEEGKPPTPAGPTLREQTLQTLANVRAILEEGGATWDDAMMIRVYLTDVDHFAEMNQIYNTYFEEQGLTAPPAARTTVYVGLPAGLLIEIDALAVLS

SEQ ID NO: 10816 - protein, 264 aa, Streptomyces avermitilis
MSQTVDRALSILPLLAEGPADLGQVADRLGVHKSTALRLLRTLHEHGLVHRQSDQRYRLGARLFALAQEAVENLDVREIAHPHLVRLNEQCGHTVHLAVYEEHEVLYIDKVESRYPVRMYSRIGKPVAITVAAVAKLLLADLPEPERRALAEKLDYPMYTARSIPNAPAFLRELEKVREQGWATDLGGHEESINCVAAPVRGADGRAVAAMSVSAPNVVVTADELLTLLPLVRRTADAISRDYSGKPPKDQLKDHPRDHPKDPG

SEQ ID NO: 10817 - protein, 361 aa, Streptomyces avermitilis
VTTDGRTGAVPRDAHDVVALGESMVTFLPTRPGRLADVPSFERGIGGAESNVACVLAAAGHSVRWAGRVGADGFGDHLVEAIAAYGVDTSAVRRDPARPTGVYFRTAGDRATDAHEVAYYRAGSAASAMTAENMDLDAVRAGRVLHLSGITAALSDGCLGLLRELTARRPARPLVSFDVNHRPGLWRDTDGPRVLLELARGADLVFVGDDEARAAWGLHGPRAIRDALPEPEVLVVKQGGGGATAFERRPGGPGTGDTSTDTVTFVRALQVDVVAAVGAGDAFAAGFLSATLRGLPVRDRLRHGHLMAAAALTVPGDLAVPPARDHADRLAALDDTAWETLRLGPGWTQAVDRAQEEVRTP

SEQ ID NO: 10818 - protein, 423 aa, Streptomyces avermitilis
MSAEALARLATDRVDHRFKGLPPDAEGLTVGELAAQRRDLFTGGFTTPVLALSAERLTHNLELMETYAARHGLAFAPHGKTSMAPQLFQRQLEHGAWGITLAVPHQVRVAREFGIQRVFLANELVDAAALRHIAADLAADPGYRFICYVDSVRGVELMDAALRGTPRPVDVVVELAAGEGARTGVRTEEECAAVADAVAATPTLRLVGVAGYEGEVPRADSERVHAWLRRLVALAVDLDRAGRFKDAGEIVVSAGGSAWFDAVADVFAGIPGLSLPVLKLLRSGAYVSHDDGHYRRLTPFTRVPEEGALHPAFRLWTQIVSRPSPGQAFANAGKRDAAYDLDLPLAQVVRDAGSGEIRDAAGIEVTALSDQHAWLRTAPEAELEVGDWVGLGLSHPCTSFDKWQLIPLVEADGTVVDYIRTFF

SEQ ID NO: 10819 - protein, 530 aa, Streptomyces avermitilis
VDLVIRDVRVVDGTGGASCRADVGITGGRIAEIRRDGPALGGRRVLDAGGLALAPGFIDMHAHSDLALLRDPDHSAKAAQGVTLEVVGQDGLSYAPVDDRTLAEVRRAITGWNGHGDDIDFTWRSVGGYLDRLDQGIAVNAAYLIPQGTVRMLAVGWEDRAATPGELDRMRRLVADGMREGAVGMSSGLTYTPGMYAEDAELTELCRVVAEYGGYYCPHHRSYGAGALQAYEEMVALTREARCPLHLAHATMNFGVNKGRAPDLLALLDGALAEGADITLDTYPYTPGCTTLVAMLPSWAGEGGPEAVLARLRDDTVAERIRHAMEVVGADGCHGVPIEWDTIEISGVSDPALAPYVGSTVQASADLRGEAPWTTARRLLLDDRLGCTILQHVGHEENVRAIMRHRVHTGGSDGILQGTKPHPRAYGTFPHYLGHYVRELGVLSLEECVAHLTGRPAARLRLPDRGLVREGYRADLVLFDPSTVAAGSTFEDPRRLPAGLPHVLIDGRFVVEDGRRTDVLAGRAVRRTPR

SEQ ID NO: 10820 - protein, 213 aa, Streptomyces avermitilis
VLSNGHCLETGFPEPGEVIVNQASSRTFGLLNSAATRVATLRANKVVYSTMTDTDVSIYQLTTTYAAIKSAYGISALTVQDTHPTAGTAITVASGYWKRLYSCNVDGFAYRLKEGDWTWKDSLRYTSACQTIGGTSGSPVIDNATGKVVAVNNTGNEDGETCTENNPCEVDASGNVTVREGINYAQETYQIPACFTTANVLNLSASGCTLPKP

SEQ ID NO: 10821 - protein, 267 aa, Streptomyces avermitilis
VRHGVSSGGHPRVHVTPFLSLHFPAMSWHLQPADRAPGTNGANGPGGPSGADAAHGAPSVYHPRADAAPAYEEYADPAAAHGWENAYDSTRELPVTVPDADEPAGPGGPVLDGGPRRRARPKGRGRPTSRVLVAVGAVCALGAAVAIAGFSGSGSPAGPRVEGDGVRPKAERSEQPSVDASASAGAATTGPSDGGAPPVTARPSDDASSSAGASVSPSPSGEETGAPTTSAPSTEAAVTATASAGVSASASRPGNSGHGKGASKRPK

SEQ ID NO: 10822 - protein, 403 aa, Streptomyces avermitilis
MQVIQSTKLANVCYEIRGPVLEEAMRLEAAGHRILKLNTGNPAAFGFECPPEILEDILRNVSSAHGYGDAKGLLAARRAVVMHNQTLGIETDVEHVFVGNGVSELIVMAMQGLLDDGDEVLVPAPDYPLWTASVSLSGGTAVHYHCDEQSDWMPDLADVERKVTDRTKAIVIINPNNPTGAVYDEAMLRGLTDIARRHNLLVCSDEIYDKILYDGATHTPTAAVAPDLLTLTFNGMSKAYRVAGYRVGWMAISGPRAHADSYIEGLTILANMRLCANMPGQHGVVAALSGRQTINELVLPGGRLKEQRDVAHELLTQIPGVSCVKPKGALYLFPRLDPKVFKIKDDRQMVLDLLRREKIMVVQGTGFNWPDPDHFRVVTLPTVGDLTSAITRIGNFLDGYSQP

SEQ ID NO: 10823 - protein, 139 aa, Streptomyces avermitilis
MYEPIRTKSVHTMAGTAPDFPHRSREEELDIQLAGHLAALLAVTDELRALTPSAELDTAAERLAEQVARLRGGLPPARTSVAAALHEPHLAALHRRAHALAGRALVVAASRADTAAAILAAERMDAHAAAADPRELAPR

SEQ ID NO: 10824 - protein, 607 aa, Streptomyces avermitilis
VARDIAAPSSVPTQHKELISWVNEIAELTQPDSVVWCDGSEAEYERLSEELVRKGTFRKLDPIKRPNSYYAASDPTDVARVEDRTFICSEKEEDAGPTNHWKDPAEMREIFAGEQGVFRGSMRGRTMYVVPFCMGPLGSDLSAIGVEITDSAYVAVSMRTMTRMGQPVLDELGTDGFFVRAVHTLGAPLEAGEADVPWPCNSTKYISHFPESREIWSYGSGYGGNALLGKKCYALRIASVMARDEGWLAEHMLILKLTPPQGESKYVAAAFPSACGKTNLAMLEPTVGGWTVETIGDDIAWMRFGEDGRLYAINPEAGFFGVAPGTGEHTNANAMKTLWGNSVFTNVALTDDNDIWWEGMTEETPAHLTDWKGNDWTPESGTPAAHPNARFTVPASQCPIIAPEWEDPKGVPISAILFGGRRATAVPLVTESFDWNHGVFLGANVASEKTAAAEGKVGELRRDPFAMLPFCGYNMGDYMGHWVDVAKDKDQAKLPKIYYVNWFRKNDEGKFVWPGFGENSRVLKWIVERLEGRAEGVETPIGILPTREALDTAGLDLSASDLDFLLTVDKEVWREEAALVPEHLNTFGEHTPKELWDEYRALVQRLG

SEQ ID NO: 10825 - protein, 237 aa, Streptomyces avermitilis
MTAPVPDAPTDTPAAGHGPAALSLSDEIKPKLRGWLHLGMFPAALVSGLALTAFASSPRARLACGIFALTACLLFGVSALYHRGTWSPRMDGILRRLDHANIFLIIAGTYTPLTMLLLPGAKGQWLLWSIWGAAAAGIAFRVFWVGAPRWLYTPCYIAMGWAAVFFLPDFMRTGGIAVLVLVVVGGLLYSAGGVIYGIKRPNPSPQWFGFHEVFHSLTLAAFVVHYVGISLVAYQHG

SEQ ID NO: 10826 - protein, 524 aa, Streptomyces avermitilis
MVTVTQQHDPRHDARRWWALGALVASMLVLGFDMTILNVALPTMARDLGASTGEQQWMADAYVVVFAALMLPAGLLGDRFGRRRMLITGLGVFLAGSLAGALVDDVTPVIVARALMGVGGALVMPLAMAVLPSLFGPEERTRAVGAVSAASALGLPLGPILGGWLLDHFWWGSVFLVNVPMAAIGIAACVFLLPETRDPASPKVDAVSTALTAAGLSILIYAIIEAPGRGWGDPLVLGLFAASVVLIALLVVRERRSARPMLDLSLLAQRGFLLNTLAATLVMFVLSGLMFVLPPYLQAVLGNDTFATGVRMLPMMGGLLIASRGAQPLLAKFGARAVISAGLVTLAFAAILGSRTSVDDGYGFTALWLSIAGLGFGFAVVPAMSAALGALPRDRAGSGSGLLMTVRQVGGAIGIALLGSLLAGAYGDRLDTSGLPHGAADAASDSVVGAHVIAAQLGDRALTASANAAYLHGMDLVLMISGIAALVTALLAAALLPKPETSPAPAPTPEEDTAVAPTPADAGQ

SEQ ID NO: 10827 - protein, 220 aa, Streptomyces avermitilis
MAATAHSSTPADGPQLGLRERKKLKTRIAIRDATYGLIQEQGYDATTIEQIAERAEVSPSTVFRYFPTKEDIVLTDEYDPVMEKELTARPADEPWTESLRYAVHQAIGFGFTEEPHVSRLRTQLMVDVPAVRSRMMESMSVTGRMLCRVIAARTGRDPDSLEVRVFAMSLIGGLMETSLYWAETGHQEDLGDLVDRALDVLENGLPPKNPEATDASGVTS

SEQ ID NO: 10828 - protein, 241 aa, Streptomyces avermitilis
VNGPEIHVAFAPELRLFVPHERRSGTTAVGTDGASTLGHVVESLGVPLPEVGALVVNGRETPVSYIPAAGDSVEVRPVERPQRVPGAPLRFLLDVHLGTLARRLRLLGVDTAYESTDLGDPALAALSAAEKRVLLSRDRGLLRRRELWAGAYIYSTRPDDQLRDVLDRFAPGLAPWTRCTACNGVLEKATKEQVADQLEGGTQRSYDVFAQCEECGRAYWKGAHHDRLEAIVERALAEFGA

SEQ ID NO: 10829 - protein, 757 aa, Streptomyces avermitilis
MPYCWEKSGWGDNDFTFTTTSDAHTGTKAMKVALTRRVDGDRKALITESAACAPVVTAGKQYDLGLWYRTTTPDAAITLFRHDATAGWQYWTDLKTLDMQSGWTRATVRTPEVPAGTDRITWGVSVYGTGSATTDDYTMEQVADPLPPATCTGTAEECANGRWTVLPTQNPVRSMHSVVLNNGKVLLIAGSGNSEEQFNAGTFTSAVYDPVKGTYRQIPTPKDMFCAGHVQLSDGRVLVMSGNKAFPVVGGHGYEGYKDSYLFDPVTETYSKTNDLNDGHWYPSATELGNGDIVSFGGLREDSTGSVTAERWSAAQQRWLPLWQVNQTWSYWGLYPSMILMQDGRLFYSGSHVFGNGTPGTGSAVYDYDANTTTAIPGLQSKDERDQSASVLLPPAQDQKVLTIGGGNIDSNPAANRLTDIIDLKSANPAYTAGPPLPQGTVDLGNGKVAETGTQGKMYVSAVLLPDGKVLETGGALHNRADPVYESSIFDPASSTFDPVAADPEARGYHSSAFLLPDGRVMATGDNPGNGTWNHNVSLYTPPYLLKGTRPTITSVIDNEWVYGDTQRITVDRPIAKAELIRPAAVTHSSDPNQRFVDLPLSVGGNNVDLNVTSNPNLAPPGWYMLFAVDANGVPSVAKWVHLQGPSALAAASEDTASAHVHPFADSLDGKVTGPGRKRASQKVGAAVSGCDRHYGTVNVCVPTAFPREVRKTTAARCAWLEKNDYGRLKVNGEDDPLGLDPSKDKLACGTKDLKRR

SEQ ID NO: 10830 - protein, 400 aa, Streptomyces avermitilis
MSHESTVPEELGDPVVRAAEVPEPGAVTIVVPTFNESANIRELLHRITESVPARLPCEVVFVDDSTDDTPDVIFQAAQDCPFPVTVLHREEPEGGLGGAVVEGIKAAGSDWIVVMDGDLQHPPSLVPELVGTGERANAGLVVASRYIKGGSRAGLAGGYRIAVSRGATWLTKSLFPRRLRGISDPMSGFFAIRRSAVTAEILQPLGYKILLELAVRSRPREVTEVPFVFQDRFAGESKSTAQEGFRFLRHLVGLRTASPIARMVVFGLIGATGFVPNLLGLYALTALGMHYVPAEILANQLGVAWNFLLIEHLLFRERRRHRTWWDRVGRFALLANADLVLRIPLIALLVGRFGMESLPATAVALVMTFVLRFVGTEALVYLPRRGRGAPDGSRTARRAM

SEQ ID NO: 10831 - protein, 546 aa, Streptomyces avermitilis
VTSTLPAATTPKVPAQRSRAPKFVPSPPRILRFRSSRSDLLLCGALLVAILVVQGWNIADYPTLSDDEGTYLSQAWAVQEGKGLAHYTYWYDHPPLGWIQIALLTWIPAHFSPSSMTVGSMRAAMLVVSAVSTVLVYVLARRLSLPRWAAGLAMVLFGLSPLSVVLQREIFLDNIAVMWTLLAFCLAASPSRHLWHHFGAGIAAAAAVLTKETMLVILPALLVTMWRHGHRDTRKFALTGAITACTLLGLSYPLFALLKGELFPGAGHVSLWDGITYQMSRPGSGFVLDPGSGSYGVLQSWLYYDRVLPLGGLAGALLLLVTWRWSVTARALAGPALTVAILALVALRPSGYLPAMYVIQALPFLALVLAGGTASVAHAVLRRWRGGAEKPYVTGARYVVAALLAAVAGAYVVPHWYDGDRTALTADANAPYRAASAWLKTEVKDPEDTRVLVDDALWLDLVHDGYRPGLGVIWFYKADLDPAVTKTMPRGWRDLDYVVASPTVRRDAVDLPHVKAAMEHSEPVATFGTGADRIEIRRIQTVGGSR

SEQ ID NO: 10832 - protein, 436 aa, Streptomyces avermitilis
VAHRRDRGLLGIWGDLVLTSVFIAAVSLALFWMAAFTLWWQMHAWRTPEVLASTRFSRPDGGEGLSFSLLLPARHEQAVLDHTIQRLLESSHTDFEIIVIVGHDDPETTEVARKAAARDERVRVVVDTHEKKNKPKAMNTALPHCRGDVVGVFDAEDQVHPELLAHVDHAFRSTGADVVQGGVQLINFNSSWYSLRNCLEYFFWFRSRLHLHAQKGFIPLGGNTVFVRTDVLKEADGWDPDCLAEDCDLGVRLSSVGKKVVVAYDSDMVTREETPGSLMSLLKQRTRWNQGFLQVYRKKDWKQLPGFGQRLLARYTLMTPFLQAISGVIIPLNAAVALFLDVPVGIAFITFLPAVTAFVTFVFEVVGLHDFGKQYGLRVRSVHYLKLIVGGPFYQVLLAGAAIRAVWREQRGRNDWELTSHVGAHLTEVIREDVPA

SEQ ID NO: 10833 - protein, 675 aa, Streptomyces avermitilis
VNRLAHETSPYLLQHADNPVDWWPWSPEAFEEARKRGVPLLLSVGYSSCHWCHVMAHESFEDETTAAYLNEHFVNVKVDREERPDVDAVYMEAVQAATGQGGWPMTVFLTPDAEPFYFGTYFPPEPRHGMPSFRQVLEGVRSAWTDRRDEVAEVAGKIVRDLAGREISYGDSSTPGEEELAQALLGLTRDYDARRGGFGGAPKFPPSMVVEFLLRHHARTGSEGALQMAQDTCERMARGGIYDQLGGGFARYSVDRDWVVPHFEKMLYDNALLCRVYAHLWRATGSELARRVALETADFMVRELRTGEGGFASALDADSDDGSGRHVEGAYYVWTPEQLEQALGREDAELAARCFGVTRDGTFEEGASVLQLPQQDVVFDAERIASVRARLLGRRAERPAPGRDDKVVAAWNGLAIAALAETGAYFDRPDLVEAAIGAADLLVRLHLDEHARLARTSKDGRAGAHAGVLEDYGDVAEGFLALASVTGEGVWLEFAGFLLDHVLAQFTDPESGALYDTAADAEKLIRRPQDPTDNATPSGWSAAAGALLSYAAHTGAEPHRTAAERALGVVKALGPRAPRFVGWGLAVAEALLDGPREVSVVGPADDPATGTLHRTALLGTAPGAVVAVGTPGSDEFPLLADRPLVGGGPAAYVCRNFTCDAPITDADRLRTALSG

SEQ ID NO: 10834 - protein, 1078 aa, Streptomyces avermitilis
VGGGVAAGGGRDMRDGHRADAERLLARAVEEEVRRSGGRTDGALLLSRARGALDGMARAAAEEYEAYTRALDETEAGRLTFGQRYAREGAGTPLLVAAVAAVAACVADLSLGTGAGTAFGAGAAVGVVGAAATVAKVTASHLPAASRRAGALGQPGGPEQLRLQWLTALEVRGIRPFLDQQRVITAATGAKKGAPQLRRTDKSAAARRRSVLEQSFGQLPEPDGPFAGRRAELSRIAQWVQAARASTETKPTVVVLHGAPGAGRTSLAVRAAHALKDQFRGACVVDLRGDSPEEPPLSTRDALLHLLNRLGAPREQLLFRDRSSPDQQVRRLSELYHQHLTGLAVTIVLDDASDAEQVRTLVPERSESLVVVTARKPLDLPADLPAWVHQLPVEALDAAGAEELLNAAAQDSSGPYDAESADRIRELCGGLPLALRIAGSSLGPRTPRQLAADLGAYGPVEPVERCLWLRYTDQSDVSRRLLRRLALAGRASLGTAAAASLLATDEHEAARHLDALARAGLIDHVRGSRYRLHDVVRAFAQARLLDEEEPADRTAAQERLIVNYAELADSVIRLVDGKTSTRADQFGPHGFTSLDTALRWLDDESSFITAALRHAEGVNQAAVLNLLGALCDYCLLRGDLYRLGEISELTQAVDQGLLVRSVQWRTGIAARHLGELDKARSTLSSVVDLYFEAHHDAGAARALGSLGITLHHQGNLTEAAAKLREAMDLQAAPELAADRAWTMHALAAVERDRARLAEALDLLTQALVLHREGESVHGEAWAHFQLGQLALRMGDVPRADTELREALDRYGRTRDARGEAWALTQLARGRLVAGDASAAVDGLRQAVSRHRDNEDARGEAWTVYYLGQALEETGNLDQAVRELERSRTMFSRMRDVYGLACARHHSARVTRDQRAAQTGSLRNSGFARQLLVDARSDFQRIGVAHGEGWTCLELAVVDAGNGRTQQALTLCDEALDLFTSYGDRRGEDWARFLRCTLLPYAAPGGVEVGTAVAQEDLRRLSRTSHPLRDTKLVDYVEAYQLLLERGVNLDSGWQAWRLRMVPDRHAREVMGVPVTASR

SEQ ID NO: 10835 - protein, 104 aa, Streptomyces avermitilis
MPDMSASASLAMTHLVPLAKEVDQNKVTPGVLGFIVFAVMALAVWGLMKSMNKHMRKVDFEEKSQDGTPSSDASSSGTPSSGPVAAGTAASAKAPGGKASPAKG

SEQ ID NO: 10836 - protein, 290 aa, Streptomyces avermitilis
LTDQLRLMAVHAHPDDESSKGAATMAKYVSEGVDVLVVTCTGGERGSILNPKLQGDKYIEEHIHEVRKKEMDEAREILGVKQEWLGFVDSGLPEGDPLPPLPEGCFALEDIDKAAGELVKQIRSFRPQVITTYDENGGYPHPDHIMTHQISMVAFDGAADTEKYPESEYGPAFQPQKLYYNQGFNRPRTEALHHAMLDRGLESPYGEWLKRWDEFQRAERTLTTHVPCAEFYEIRDKALIAHATQIDPDGGWFKVPMEIQKKVWPTEEYELAKSLVDTSLPEDDLFAGIR

SEQ ID NO: 10837 - protein, 132 aa, Streptomyces avermitilis
MSTASTQLPEGRYGRSADERADHKLKIVGGILAVALLALFGYFAYHYVVQNKISGEVITFKASDDVVKVHLEVRKDADATGYCTVRSQAADGSEVGRADFRFTGHDTRIDKVVTLRTTALGTTAELLGCHAD

SEQ ID NO: 10838 - protein, 165 aa, Streptomyces avermitilis
VTQTSENVTWLTQEAYNQLKAELEYLSGPARTEIAAKIAAAREEGDLRENGGYHAAKEEQGKQELRVRQLTQLLENAKVGEAPAADGAVAPGMVVTIAFDGDEDDTLDFLLASREYASADIETYSPQSPLGSGVNGKKVGEDAQYELPNGKLASVKILKAEPYQG

SEQ ID NO: 10839 - protein, 409 aa, Streptomyces avermitilis
MSYSTADSLPAVTLDDVRGAQKMLAGVARMTGMEGSRHLSQLVGAPVHFKCENLQRTGSFKLRGAYVRIAGLLPEERAAGVVAASAGNHAQGVALASSLLGVRSTVFMPKAAPLPKISATREYGAEVRLHGTVVDETLAAAQEYAAETGAVFIHPFDHPDIIAGQGTVGLEILEQCPEVRTIVVGIGGGGLAAGIATAVKALRPDVRIVGVQAAGAAAYPPSLAAGRPVSVENPATMADGIKVGRPGDVPFRIIGDLVDEVRTVSEGNLSSALLLCLERAKLVVEPAGASPVAALLREPGAFEGPVVAVLSGGNVDPLLMQRILRHGMAAAGRYLAVRLRLTDRPGALATLLGVLPTVDANVLDVSHVRTDPRLGLTEVEVELHLETKGPEHCAEVEQALREAGYTVID

SEQ ID NO: 10840 - protein, 166 aa, Streptomyces avermitilis
MDMTTVGEPGLLDTLQHEVAVFARRAEQTRLGGVGQVRNSMDRAAYLLLNRLDKEGPMGVKALAASMGIDSSTVTRQVAPLVDTGLVKRTSHPEDGRAVVLQLSPRGMSRLEEVRSSRRQLMSELTHDWAPQEREAFTALLTRFNTALSDRMSTPGMPTGDSQPAS

SEQ ID NO: 10841 - protein, 166 aa, Streptomyces avermitilis
VRERHASQGARRAREFEAFVAGAAGRLLHAATLLTAEPPGANPRARRLLTLALSHTYASWDRLRGEDPYDRTRQYLAVRFARGAWHQYGGLGRSRPSPDSVLARLTPQERLILVLRMYEGVAEEQTAALLGLPAERVGAICARATATLLHPPRGPAPADVMEVAPS

SEQ ID NO: 10842 - protein, 384 aa, Streptomyces avermitilis
MSDRHISQHFETLAIHAGNTADPLTGAVVPPIYQVSTYKQDGVGGLRGGYEYSRSANPTRTALEENLAALEGGRRGLAFASGLAAEDCLLRTLLSPGDHVVIPNDAYGGTFRLFAKVVSRWGVEWSVADTSDPEAVRAAITPKTKAIWVETPSNPLLGITDIPAIAQIAREAGAKLVVDNTFATPYLQQPLALGADVVVHSLTKYMGGHSDVVGGALVVSDQELGEELAYHQNAMGAVAGPFDSWLVLRGTKTLSVRMDRHSENATKVTEMLTRHARVTRVLYPGLPEHPGHEIAAKQMRAFGGMVSFQVEGGEEAAVEVCNRAKVFTLGESLGGVESLIEHPGRMTHASAAGSALEVPADLVRLSVGIENVDDLLQDLQQALG

SEQ ID NO: 10843 - protein, 372 aa, Streptomyces avermitilis
MEILWVLMALAMMSMVLLPVLMRRRAGIQQVAPGDPDAADPANYGFLRQEELDIRMPGPDEDLLDVLDVVQRTQDHRAASQLLAGTETADETRWQRVQAFAGAASLELQQHPGGVSETPGGQWLRVWRAEAPKDAGGAAVHAEFLVQQAWRTSTPGTDEFRIIMEEAKVACGEAALLAPGDPIPYIVELSIARGLAYPQAEFEKLWLKILDRAPEHMGAHLAALHYWCEKWHGSREVAYSFAEAAAARAPRGSLLAAMPLFAVFEHLPEVNLVSSFYQSEVVTKAVHGALYAVHSARPDDPMLAHVRHLLVFFLVRGERWSEAMNQLVHVDGHVGALPWTLTSDPASDYAIYRALAVAGYEANGGSPATLPH

SEQ ID NO: 10844 - protein, 170 aa, Streptomyces avermitilis
MAAQTQRAVLAGGCFWGMEDLIRRLPGVTATRVGYTGGDVPNATYRNHGTHAEAIEILFDPARTDFRAILEFFFQIHDPSTKNRQGNDIGLSYRSAIYYVDDEQKRIAEDTIADVDASGLWPGKVVTEVEPVGPFWEAEPEHQDYLERYPDGYTCHFPRPGWRLPARAEG

SEQ ID NO: 10845 - protein, 197 aa, Streptomyces avermitilis
MEETQRRIRAVHTTSTITVYQAYSPEIGLPAVREGRFPTAWKRDRMTWIKPSFLWMMYRCGWGAKAGQETVLAVEITRDGFEWALRHACLSSYVRGVHPDRATWQRQLKHAPTRIQWDPERDLHLQALPYRSLQLGLAGEAARRYADEWTVSISDVTPLAREIRTLVGNGDLDSAARLLPQELPYLPADELPAHLRP

SEQ ID NO: 10846 - protein, 686 aa, Streptomyces avermitilis
MSRRSTGLVGVWAEVQRQQQRQMEAEARQRRQEAQQARAYQRRAAQSHREYRQAEALRRTEELDAQVASLQGLLAAGCQAPAFRASSLMRPEEVQPFAPGPLAQPVPMPDFHQYQTQSGWTASRRAQAQTEARARFERDWHAAQAAEAHRQQQLASYQREYQQWADAQLAEVRAHNAGVVAVTEGVRRRDPDSVVEYFSAALYASTAWPEGFPRQVAAAYDSAARQLVLDWELPAYGIVPEVKSVRYMSGVDQDKETPRPAGQRRALYREVLAQCLLLVLHELFAADELGALESVALNGFVDGHDPTTGRPGHIFLATVMSPRSSFRDLHLAQVDAGSCLSDALRGQLSARPDQLTPVRPSRRPQDVGNRVVAHGSDEEPDLYDMDPIAFENLVAELFRAMGMQAVTTQRSNDGGVDVDALDPAPIRGGKIVVQVKRYRNTVPPTAVRDLYGTVQDAGANKGVLVTTSGFGPGSHTFANGKPLELVSGSELVDLLHRHGLRGRLGEGGRQAAAQPTPSDPNTRLPDDYNVLGMSWTGSVALDVCALVCRGNRVLSDDHFVFFNNPQTPDGSVRALPAAAPDKAAICVSFDGLPSEADRLVLVAAIDPEVNADADLSGFTDACIRLLDPGMAEVGRLEVSDGRIRERALVLGSFRRRSNGDWDFVLGGKGYPGGLEELVQDFGIVVA

SEQ ID NO: 10847 - protein, 252 aa, Streptomyces avermitilis
LGAFMPEPAGAGSSIRPAGGTGAERSVDHGGVMKWSEKAASSGRGDGETGLTGYQQDLRDRFLAAPVLPAPEPWRPVFKPFAAVGGLLGIGFASHPDNGNDLVMVVSQAGHGLFDAVTGEKIARDRDPDPEDSTPDAVADLSCPGLGPIAGSRVRIAGLFGGGLHTGTEDGWVVEVVSPAWPHDRVLLSRGSGMPHRGPHGEKWWHIFHSNYSELRAAGFSPSGQTLAVATSSDVTLWTRRTAHTPGGPARR

SEQ ID NO: 10848 - protein, 395 aa, Streptomyces avermitilis
VQAVLLGSVLLVCLAAPLVGASQRPRLPSRRCTPERSAHAPFAVAFGCWLVPVPMALLLEDGRADLMHSWWAVAMLMASPVVAFALVRMVAPQRLKRRRLLLAARAAALMAAVVAVEMAALDAGVPSLSVVGPLLTVSFAATATVLGVLRVVDHGYFPLVLLRTAAKQALVAGGTWYWMHRTGATLTPDPADSTTTAQVLALLWWSVVALSSGCALVAVARLVRWLRSGPPARPAPPGVAPWPPAVGDVWMAELTHDDNTYKERPVVVLEHTPGFVRVLGITSVDKSDRRRGYLKLHMSEWKGVLTKDGWLNLEIAQVPYCDFLWRRGECPDPVWDALCTKAAVRERPAGRGPTPGFTFRHRLWSAMNAHAGRDSRNVHAGSDNRRRRVWTRAKV

SEQ ID NO: 10849 - protein, 292 aa, Streptomyces avermitilis
LPSCVPPWDEPGDEQGNDLDLEGTYDMHTYLIGGGWDERGAEAVYGPFLEAAGQRAGRQRAAGDAAVVGCLLVDEGDGAGQFARYEAVLRKVADCAPVPLLVPLGERFDVGALGRVDALLVCGGLTPAYQDALAEVLGRLPRVLAERGIPYAGFSAGAAVAARRAVVGGWLAGGVPVCPEDTGEDLDEIEVREGLGLVPFGVDVHAAQWGTLPRLIAAVADGRVPHGVAIDENTLLTVDGRTARVSGLGRVHTVRPGTDSGTGTRADGGNGDGTGGDVLVRSYAAGESFAAD

SEQ ID NO: 10850 - protein, 278 aa, Streptomyces avermitilis
VAHTIVLGALVGAALGLSGALVQSVTRNPLASPDVIGVGHGAAAATVLALATGTVASPGALPAVSVAGGLGAAALVYVLAWRHGMQPTRFVLTGVGIGVALSAVVQLYLTESELTAAEQVKLWLTGSLNGRGWTQATPLAWVLLLSLPALVRASRALRPLGLDADTASALGVRVQRTRLGLTVLGVVLAATATGAAGPIGFVALTAPQLARRLSRTPQLPLAGSASTGAIIVVAADLVARTALPPLEIPVGALTSLVGGPYLLWLLGREPGRGARASR

SEQ ID NO: 10851 - protein, 347 aa, Streptomyces avermitilis
MTTTVAAYAAPAAKAPLERTTIERREVGEFDVLIDIKFAGICHSDIHQARDGWGEGIFPMVPGHEIAGIVAEVGSGVTKFQVGDRVGVGCMVDSCRECENCKAGLEQYCVGGNVGTYNALDKNGEPTYGGYSEKVVVDENYTVRIPDGLALDVAAPLLCAGITTYSPLKHWNAGPGKKVAVLGMGGLGHMGVKIAHALGAEVTVLSQSLRKKDDGLKLGADHYYATSDPKTFEELAGTFDIILSTVSAPLDFGAFLSLLRTDGALVNVGAPEEPISINLFSVIAGRKTLAGSGIGGIQETQEMLDFCAEHGLGAEIELISASEINDAYERVLNSDVRYRFVIDTATI

SEQ ID NO: 10852 - protein, 303 aa, Streptomyces avermitilis
MDEQPEPVQGAGQPLDRRAELSEFLRTRRARLKPEDVGLPDFGRHRRVPGLRREELAQLAGVSVAYYTRLEQGNGRNVSAEVLDAIARALRLTNAEHAHLTHLAKPKAHKKKQTARPQQVRGALRQLLDTLDGVPAYISGQRSDVLAWNRMAAALFGDWAELPPQERNWARMVFLKPEYRDLFVDWEQKAIDIVCLLRMDAGCHPDDPRLSALVGELSVKSEDFRRLWATHDVKEKTHGVKLLRHPLVGDLALQFESFRLPDDGEQALITYHAEPGSASAEALRLLASWGTDATRAGTTAPQP

SEQ ID NO: 10853 - protein, 260 aa, Streptomyces avermitilis
LCGDMTVHTVEYIRYRIPEQQSAEFLAAYTRAAAQLAAAPQCVDYELARCEEDFEHFVLRITWTSTEDHIEGFRKSELFPDFLAEIRPYISSIEEMRHYKPTTVRGTGAAVPTLYAWAGGAEAFARLTEVFYEKVLKDDVLAPVFEGMAPEHAAHVALWLGEVFGGPAAYSETQGGHGHMVAKHLGKNITEVQRRRWVNLLQDAADDAGLPTDAEFRSAFLAYAEWGTRLAVYFSGPDAVPPAEQPVPQWSWGAMPPYQP

SEQ ID NO: 10854 - protein, 89 aa, Streptomyces avermitilis
MLYTTAYKGGRDAAAWQRYAEFDNAAGVDEVVENLDTTLSTCGFKPVGKAADTHFAGASEDGRRVRVTVEHGKRWIYVSEVEDGRPGGD

SEQ ID NO: 10855 - protein, 192 aa, Streptomyces avermitilis
VTTKTNEDERRRTRNGKRGQMSAQSEDFDAFYTATHKRMVATVYAMTGDLVEAEDAVQEAYVRAWQRWDRLTRDDGDPLPWVRTVAMRLAISTWRRTRGRLLAHFRHGPDADVPELSADRVALLNALRELNPDQRQVVILHHLLDLPVEQVARETGASSGAVRTRLSRARKALGERLAEPTVFTTEGVVRHG

SEQ ID NO: 10856 - protein, 1139 aa, Streptomyces avermitilis
LLTPGGDVHVCAISLGRVNGDSPDTSSPGGDLRRQVKRACAATVATAAAVVLAAGMTTPASAKPEVASSGTTTSAGFSAKHRVTLITGDRVVVDAKGRVVGLERAKGREHIPVSVRKADGHTLVVPADAARMIATGKLDQRLFDVTELNRSATRKAQKQGLKVIVGYKGTASAAKSDVRDAGTLRRSLKSLNADAVQTPRTDTAELWDAVTNGDATASGVAHVWLDGTRKASLDKSVPQIGAPTAWAAGYDGKGVKIAVLDTGVDATHPDLKDQVAESKNFSAAADAADHFGHGTHVASIAAGTGAKSNGKYKGVAPGATILNGKVLDDTGSGDDSGILAGMEWAAEQGADVVNLSLGGGDTPEIDPLEAEVNKLSEEKGILFAIAAGNEGEFGEQTIGSPGSAADALTVGAVNDSDKLASFSSRGPGLDGAIKPDVTAPGVDITAAAAPGSVIDQEVGQKPDGYLTISGTSMATPHVAGAAAILKQQHPNWSFAELKGALTGSAKGGKYTPFQQGSGRIAVDKAIKQSVIANPNSVSFGIQQWPHTDDKPVTQQLTYRNLGTSDVTLNLASTATNPKGVAAPSGFFKLGATKVTVPAGGKASVDFTVNTKLGGTTDGAYSAYVTATGGGQTVRTAAAVQREVESYDVTLKHIDRDGKPAVNYSTDLTGVSGLAADKWFAPYDASGTVKVRVPKGNFILNASLFADPEDFTKGADWIAQPKLSVTKNTTVTVDARKAKPVDITVPDKGAKSAFASPDYTVEAGNNSYSYGWWLDTYDNFRTAHLGPKVTDGSLSQQWEGHWTKGDDEEYDTTARAKVTQLATGYSKHYKASELATVKAGLGSSVTGKKGAITAWGWLPGSSGASAIGIQQTLPGTRTLHLSTSGGVRWTFEFEQTGGLDADGFPIAEAYYSTGDSQKLTGGKTYAKTFNTAVFGPRTGGDFSLYRDGNQIYGYVPLFADGKTHTGSSTFSSVTTTLYRNGTKVGSNDDPLFGEKYFKVPAGSASYKLTTSVKRAATVATASSRIDASWTFKSKKASFTKLPTSSARFAATTGLDSRVTADKKVSVPVTVQGAAAGKNLKSLAVYVSYDGGKNWTKTTVKNGKISVKNPAKDKSISFRAKIADKKGNTSTISIYDAYYGK

SEQ ID NO: 10857 - protein, 227 aa, Streptomyces avermitilis
MYELRGVSKRYTRGKDTINALDGIDLTIGDGDRLVIQGPTGGGKSTLLQMLGGLDKPTAGSIELDGTDLARLSEAKLTKVRSENIGFVFQSFNLIPTLTAQENVETALVPLGVKVKDRRERAAEALKSVGLGERLGHLPAEMSGGQQQRVAIARALVKQPKVLLADEPTGNLDESMRDEIMEVLETMWKEYGLTFIMVTHDSSLAKKAPRVATIRKGKITVKENAGA

SEQ ID NO: 10858 - protein, 490 aa, Streptomyces avermitilis
MFFTYLRRELRRRRKAALVVASGLALGIALVIVVNSVSSGMGKAQDKVLQSLYGLGTDMTVTKAASASAASSQRPRFNFDARGDDSDAEQSSDRVMVQGFQTLATTTVGKVGAQHGVSDAVGGLSLQVVKVSGQFKQGQFQQDQNAGGNQQGGRPNAQASPQGRVEGGGANFGVNSYSVYGTDVTEPALGPLTSSKITSGRTFTSSETNAKVVVADKSYAKEQKLVLGDTVTIKSVKFKVIGIATPDSGDAAANLYIPLKRAQTLGDAKNKVTTIYVKASDSQQIDVVKSTIQKNISGTTVTTSADLAKTVSGSLSTASGLAKNVGKWLSIAVLVAAFLVAGLLTSSAVSRRVREFGTLKALGWKSGRVTRQVVGEAMVNGLVGGALGIALGLGGAYVVTAISPTLQADIGSTGGNAGGPGGGGPGGGGFGGPGRQTASKALEVALTAPVSLSTIVIAVALAVTGGLVAGAFGGWRASRLRPADALRRVE

SEQ ID NO: 10859 - protein, 416 aa, Streptomyces avermitilis
MTDSNRRKGLRAASVLLGGVLVLSACSGGDSEASSGGGDSTSQAKVDEAAAKKASEAQIKITPKDGSDNASINNAAKVTVSKGTLTDVTMKTAAGTAVAGRISADKKSWSPTGQLERSTSYKITATADDSAGRTAHENASFTTVSPANSFIGNFTPEDGSTVGVGMPVSINFDKAITDKAAVQKGITVSSSSGQEVVGHWFSANRLDFRPEDYWKGGSTVTLKLNLDGVEGANGVYGVQQKTVTFKVGRNQVSVVDARTKTMKVTRDGKTVKTIPISAGGPDNKTYQGQMVISEKFKETRMDGSTVGFTKKDGKGEYDIKDVPHAMRLSNSGTFIHGNYWGAKSIFGAVNTSHGCVGLSDTKGAGDPNTPAAWFYNNTLIGDVVVVKNTGDKTVAPDNGLNGWNLGWAAWKAGSAA

SEQ ID NO: 10860 - protein, 97 aa, Streptomyces avermitilis
VEIGDADAVTKAALERIADDPDMPDDERGHSESAVTEDTAEALAYLVDPFDLVSEVPGVELAQASWSSEQISYDPDSPEWDLGEDDGAEDDEEDVLG

SEQ ID NO: 10861 - protein, 114 aa, Streptomyces avermitilis
VSAAHRWSSTARRSTLTATAAGTLLCALWFVPSANATQDTSGQQQTSTTVTQTSTNTDSDSDSGAGTDSTSLDAQLADTGSIDTTPYLVGGTLFLGLGAGFVAYSVRRERMTAY

SEQ ID NO: 10862 - protein, 514 aa, Streptomyces avermitilis
MDMHTVVVGTSGVTASDVLAVARGGARIELSGEAVTALAAARGIVDALAAKPEPVYGVSTGFGALATRHISQELRAQLQRNIVRSHAAGMGPRVEREVVRALMFLRLKTVCSGHTGVRPEVAQTMADILNAGITPVVHEYGSLGCSGDLAPLSHCALTLMGEGDAEGPDGTVRPAGDLLAEHGITPVELREKEGLALLNGTDGMLGMLVMALADLDALYKSADITAALSLEALLGTDKVLAPELHAIRPHPGQGASAANMLAVLAGSELTGHHQDDAPRVQDAYSVRCAPQVAGAGRDTLAHARLVAERELASAVDNPVVLPDGRVESNGNFHGAPVAYVLDFLAIAAADLGSIAERRTDRLLDKNRSHGLPPFLADDAGVDSGLMIAQYTQAALVSEMKRLAVPASADSIPSSAMQEDHVSMGWSAARKLRTAIDNLTRIVAIELYAATRAIELREGLTPAPASQAVITAVRKAGVEGPGPDRFLAPDLAAADAFVRDGSLVTAAETVTGPLA

SEQ ID NO: 10863 - protein, 363 aa, Streptomyces avermitilis
MAAAHTPRESWRAAALGACRALAGNFAALSVWERERGRLRVLANVGDRAFDEEEFPDDEAYPVHQFPEITEFLHERWARGGEPNAWVETAEGSTAGRAGYCHQRVAALRRRGRGCCVVAPIVLHGRAWGELYVARPAGEPVFDRADADFATVLASVVAAGLAQTERLEEARRLAYTDALTGLANRRAVDVRLDEAIEQHRRDGVVVSLVVCDLNGLKRVNDTRGHAVGDQLLERFGSVLSLCGAMLPGALAARLGGDEFCLLAVGPAADEVVRAAGELCRRAADLELGEGVACGIASTQDPIGPVRSGRRLFRLADAAQYRAKAVRATKPVVAGREGPDDPVVRLADEPAPAKAERRRFRGRR

SEQ ID NO: 10864 - protein, 270 aa, Streptomyces avermitilis
MAERADERRFGDHVVVRRHTRGQVAELVLDRPKAMNAVSTDMARAIAGACEALAHDTDVRVAVLTSTHERAFCVGADLKERNSFSDADLLRQRPVARAAYTGVLELPMPTVAAVHGFALGGGFELALSCDLIVADGTAVVGLPEVSVGVIPGGGGTQLLPRRVGAARAAELIFSARRLTGAEARELGLVDELVEEGQDRTEALALAFRIAANSPVGLRAAKRALRLGHGLDLRAGLEVEDAAWRSVAFSGDRAEGVAAFNEKRKPEWPGE

SEQ ID NO: 10865 - protein, 176 aa, Streptomyces avermitilis
VLFAVGGLALAAGALSFVRLAPESVGGGPGTAEAAPPVEATGDPAASAAAVVGATPSGRSGSPGGRGATAATGGASATPTSPVGSGHAATSPSGVALLPAAPGSVSTAPGQRGAPAARTPRSNPAPTDATTEPPPTATTAAAPGPAPSASTHTPHPPGLCVPLVGLCVNRAAAAVR

SEQ ID NO: 10866 - protein, 405 aa, Streptomyces avermitilis
VTVDDTGSGTGVHPAPDGEPGPTARPVSDASPARVDAHGGRTDAHDRVDGHEEPEENPLALRLEQLILGAERRYTPFQAARSAGVSMELASRFWRAMGFADIGQAKALTEADVLALRRLAGLVEAGLLSEAMAVQVARSTGQTTARLAEWQIDSFLEGLTEPPEPGMTRTEVTYPLVELLLPELEEFLVYVWRRQLAAATGRVVQAGDDEEMVDRRLAVGFADLVGFTRLTRRMEEEELGELVEAFETTAADLVAAHGGRLIKTLGDEVLYAADDAGVAAEIALRLIETMANDETMPELRVGIAFGTVTTRMGDVFGTTVNLASRLTSIAPRDAVLVDGAFAEELTRTREAPASEAEAAEAAAAAEKEGEEPPTYRFALQPMWQRPVRGLGVVEPWLLTRRSGES

SEQ ID NO: 10867 - protein, 291 aa, Streptomyces avermitilis
MTPKDASDAHDGRWSDLDRPPLNAASLRRALVREGSLWSSLDVVPVTGSTNTDLAARAGTLDEGAVLVAEEQTAGRGRLDRQWTAPARSGLFFSVLLKPSEVPVHRWGWIPLLTGVAVATGLSRAAGADTALKWPNDLLVSVGGQERKAGGILAERTGEDGVVVGVGVNVTLHEDELPVPAAGSLTLAGAVSTDRDPLLRAVLRSLERWYGTWREADGDPAVSGLQEAYAAGCATLGRTVRAELPGGRSLTGEAVAVDGDGRLVLATAEGVQQPVGAGDIVHLRPAGAGEM

SEQ ID NO: 10868 - protein, 532 aa, Streptomyces avermitilis
MSEPEELHHPDIHTTAGKLADLQRRIQEATHAGSERAVEKQHAKGKLTARERIALLLDEDSFVELDEFAQHRSTDFGMENNRPYGDGVVTGYGTVDGRPVAVFSQDFTVFGGALGEVFGQKIMKAMDFALKTGCPVIGINDSGGARIQEGVSALGMYGEIFRRNTHASGVIPQISLVVGPCAGGAVYSPAITDFTVMVDQTSHMFITGPDVIKTVTGEDVGFEELGGARTHNAVSGVAHHMAGEEKDAIEYVKQLLSYLPSNNLSEPPAFPEEADLALTDEDRELDTLVPDSANQPYDMHTVIEHILDDAEFLETQPLFAPNILTGFGRVEGHPVGIVANQPMQFAGCLDIDASEKAARFVRTCDAFNVPVITFVDVPGFLPGVGQEHDGIIRRGAKLIYAYAEATVPLITVITRKAFGGAYDVMGSKHLGADLNLAWPTAQIAVMGAQGAVNILHRRTIAATPEEEREEVRRRLIQEYEDTLLNPYTAAERGYIDGVIMPSDTRAHVVRGLRQLRTKRESLPPKKHGNIPL

SEQ ID NO: 10869 - protein, 69 aa, Streptomyces avermitilis
VTIKVIRGNPTPEELAAALAVVRARAAAAASVPSGAPGPRDSWADPARIAADRLPQPGPTTWSRTYWPG

SEQ ID NO: 10870 - protein, 415 aa, Streptomyces avermitilis
LLPSRHQLKGLQFPLGRKGLFEKACSERPVRKGLWKEVCAVFTTAWTAPPQLPSEGFTPNWSREGFWRQSLRQVVRLTAGGGRVRIRLSHAYGTSPLKIAGATVARTAAGAAVEPGSVRRLTFGGSGAVEIPARGQVRSDAVELASAAGEAVTVTLHLDAVTGPATFHAQAFTSSYRGAGDRLEDVRGDGFGESTESWYFLTAVEVDAGRTDAVALLGDSVTDGFGSTPGADRRWSDALAGRTGRPVLNAGIGGNLLLNDSAWYGEKGVHRLRRDVLGHEGVDTLVVLLGLNDIGFSETDEQPTYKPAPVVEADELIAGHRELIRRSRGRLRVVGATLLPFGGSDHWGEHAAKVSHEVNEWIRRSGEYDAVVDLNRALADPADPGRLHPAYDFGDHLHPNDAGYEVMAEAVAGVL

SEQ ID NO: 10871 - protein, 48 aa, Streptomyces avermitilis
MLWSDPENEPPEELRKTQDMLRRLGFLMALAMLLAMIVLGFGCGAPIP

SEQ ID NO: 10872 - protein, 206 aa, Streptomyces avermitilis
MTDQPRRRLVLASQSPARLNLLRQAGLDPEVIVSGFDEDRLSAPTPAELALALAEAKASVVAAKPEVQGALVIGCDSVLDLDGEALGKPADAEEATARWKAMRGRAGTLQTGHCIYDTASKRYASATASTVVRFGEPTDEEIAAYVASGEPLHVAGAFTLDGRSAPFIEGIDGDHGNVIGISLPTVRRLLGELGVGITQLWTPREK

SEQ ID NO: 10873 - protein, 174 aa, Streptomyces avermitilis
VGPVVRRPVAWVVAVVLFVEALGIALLNWFLGVIVDRQHMSLAGLDPNAMSVSSKAGGVVFGLYFGLCGLVALLVGVRDRSPAGLGRILLISVAVVHGLLGAFAWGLVGRSAFLFMMGVLGLIVLLLMTYDRREGPADAVDADGDPKGNGDPKGDGDSVSPGPAPVTPPAPSTP

SEQ ID NO: 10874 - protein, 590 aa, Streptomyces avermitilis
VRKVLIANRGEIAVRVARACRDAGIASVAVYAEPDRDALHVRAADEAFALGGDTPATSYLDIAKVLQAAKDSGADAIHPGYGFLSENAEFAQAVLDAGLVWIGPPPQAIRDLGDKVAARHIAQRAGAPLVAGTPDPVSGADEVVAFAREHGLPIAIKAAFGGGGRGLKVARTLEEVPELYDSAVREAVAAFGRGECFVERYLDKPRHVETQCLADTHGNVVVVSTRDCSLQRRHQKLVEEAPAPFLSDAQVEELYSSSKAILKEAGYVGAGTVEFLVGVDGTISFLEVNTRLQVEHPVTEEVAGIDLVREMFRIADGEELGYGDPELRGHSFEFRINGEDPGRNFLPAPGTVTTFAPPSGPGVRLDAGVESGSVIGPAWDSLLAKLIVTGATREQALQRAARALAEFNVEGMATAIPFHRAVVRDPAFAPELTGSAEPFTVHTRWIETEFVNEIKPFTVPTDADAEEEPGRETVVVEVGGKRLEVSLPSSLGMSLARTGLAAGAKPKRRAAKKSGPVASGDTLASPMQGTIVKVAVEEGQEVQEGDLVVVLEAMKMEQPLNAHKSGTIKGLGAEVGASITSGAAICEIKD

SEQ ID NO: 10875 - protein, 357 aa, Streptomyces avermitilis
VRAGAVLSSQDIEEHLRTSHGESSAGRVCMEISGADAQRVLTLVRGIEEADSVEEFQEQALPGLMELIPADAAQSYRIAVDGVGLSTLSLPTDSFHEDPMVIYDHPLDHPLTEVMLQTPTPEAWRVSDVAGDRQWERTHCYNLDFRPFGLRRHLVASAGSDMSVVEGYALVRSGQDFTERERDLLGFAQLQLRAVHRALRERARLRLLAAAALELVGGHDRGVAALDDGRPYPLNAAAAHLLPAVRHDPRLGRTEPFTARDVEVRYVAPAAPGLPALLLLRDLGRGRAVARLFGVTDQEHRTLRHLDSGLTATETARRMGLSPTTVRGYIAALHRKLEAGHTAALLRRGRDLGLLAD

SEQ ID NO: 10876 - protein, 308 aa, Streptomyces avermitilis
MVRANGAVSLRELARVVQTSEVTVRRDVRALEAEGLLDRRHGGAVLPGGFTRESGFPQKSHLATAEKTAIADLAASLVEEGEAIVVGAGTTTQELARRLARVPGLTVVTNSLLVAQALAHANRVEVVMTGGTLRGSNYALVGSGAEQSLQGLRVSRAFLSGSGLTAERGLSTSNMLSASVDRALVQAAAEVVVLADHTKLGTDTMFQTVPTDVITRLVTDEPPAHDDRAATELQALADQGVQIAVAGSAAGAGGGDTVPAGRQSRRDMPLPGPRRGQVPGAGPQLRSTTALGEQQPGERARVADLRRR

SEQ ID NO: 10877 - protein, 475 aa, Streptomyces avermitilis
VIIGGGPGGYEAALVAAQLGAEVTVVDCDGLGGASVLTDCVPSKTLIATAEVMTTFDSSYEELGIIVADDTPPMEQAARVVGVDLGKVNRRVKRLALAQSHDITASVTRAGARVMRGRGRLDGMQSIDGSRKVVVRAADGAEETLVADAVLIATGGHPRELPDAQPDGERILNWTQVYDLDELPDELIVVGSGVTGAEFAGAYQALGSKVTLVSSRDRVLPGEDPDAAAVLEDVFRRRGMNVMARSRAESAKRIGDRVEVTLSDGRVISGSHCLMAVGAIPNSSGMGLEEAGVKLRDSGHIWTDKVSRTTAPGVYAAGDVTGVFALASVAAMQGRIAMYHFLGDAVAPLNLKTVSSNVFTDPEIATVGYSQADVDAGKIDARVVKLPLLRNPRAKMQGIRDGFVKIFCRPGTGIVVGGVVVAPRASELIHPISIAVDNNLTVEQIANAFTVYPSLSGSIAEVARQLHTRKTAGDA

SEQ ID NO: 10878 - protein, 145 aa, Streptomyces avermitilis
MSLYAAYAGNLDPRLMTRRAPHSPLRATGWLNDWRLTFGGEHMGWEGALATIVEAPRSQVFVALYDIAPMDEDSMDRWEGVGLDIYRRMRVRVHTLEGEEAAWVYVLNGYEGGLPSARYLGELADAAESAGAPHDYVMELRKRPC

SEQ ID NO: 10879 - protein, 274 aa, Streptomyces avermitilis
VNASLLPDDIQGDPHAAADAAAARLRELTGAETHDVALVMGSGWAPAVDALGAPEAEFQVTELPGFPPPAVEGHGGKVRSYKIGDKRALVFLGRTHFYEGRGVAAVAHGVRTAVAAGCKTIVLTNGCGGLREGMRPGQPVLISDHINLTATSPIIGANFVDLTDLYSPRLRALCKEVDPSLEEGVYAQFPGPHYETPAEIRMARVIGADLVGMSTVLEAIAAREAGAEVLGLSLVTNLAAGMTGEPLNHEEVLQAGRDSATRMGALLTQVLNRL

SEQ ID NO: 10880 - protein, 543 aa, Streptomyces avermitilis
VHDELIARAKAWLAEDPDAETREELAKLIDAEDVTELAARFSGTLQFGTAGLRGELGAGPMRMNRAVVIRAAAGLAAYLKAKGEQGGLVVIGYDARHKSADFARDTAAVMTGAGLRAAVLPRPLPTPVLAYAIRHLGAVAGVEVTASHNPPRDNGYKVYLGDGSQIVPPADAEIAAEIDAVRALADVPRPDSGWETLDDSVLNAYLARTDAVLAEGSPRTARTVYTAMHGVGKDVLLAAFARAGFPEPVLVAEQAEPDPDFPTVAFPNPEEPGAMDLAFAKARETDPDLIIANDPDADRCAVAVKGGTDWRMLRGDEVGALLAQHLVSRGARGTFAESIVSSSLLGRIAEKAGVPYEETLTGFKWIARVEGLRYGYEEALGYCVDPEGVRDKDGITAALLITELASELKERGRTLVDFLDDIAVEHGLHATDQLSVRVEDLSVIANAMRRLREQPPTRLAGLAITRSEDLTKGTDRLPPTDGLRYTLDGARVIVRPSGTEPKLKCYLEVVVPVGTRQDLPAARTKATNLLETIKRDLSEAAGI

SEQ ID NO: 10881 - protein, 559 aa, Streptomyces avermitilis
MNNPVQQPVLRLPESAVPDGCRPWDGAQAARWAGALPPGWTLAHLRMRLVFGGTCLGVIGAFWLTTLADLKPFVAALLPLQILWLLRRPEVARVSAPVLVVVLLLQRPGLPWVWSGPAVLLLIATWVAAAVRLHARGRQRERALAAAGGVTAGVPGADRRLERGAFLIGLGGVLTVLGAVLVVTSGLWQSGDDRLGSATVGCFVAGLGVTALASGVLGRRRAAALGRAPAPVLRVLVRDDAAADTEVFAADDVGALRPLFTVSLLDMDDDEDEDEDDVDGDGVVDEEELAALLKGLDTDVPGPLREAVLYGAPYDGAEVVVVSAAQEAGDPPLVERSTGPVRPLPEGAARRRIAAGKAKAGREARRQAVYEERRAVAVLAAVRDGGGPARRWSAGWLDRITVVAVVLWGCYALAGESGVWRYVIGAGLGLLGVCLLPGHLAWRITADAAGLWFRRLGRSRHIAWDHIRVVECKGTELRADSYRAGFEEWSVSGPRWPWLERKFGLIHPYERVAAEINAMWQDPALRPTAESGGPERGRGLWPVAVAIGVAWAAALVLLP

SEQ ID NO: 10882 - protein, 218 aa, Streptomyces avermitilis
VTMTTPDHQSPVPDSSEPSGSQSRDRIYRSPSGIVGGVLLLALVGWLGVDALVSGHGRTPWLALATLILLVPLVVAFTLRPAVFANEDRLRIRNPFRVITLPWGSVASLRSGYSNEVVVKSGTKYQLWAVPVSLRARKKATRQQNRAAAQARTGAAAALDAGPRRAQTDQVMDDLRELAEAHESAERAQGEPSVRWAYEVMGPAIAGAVVLVILLATG

SEQ ID NO: 10883 - protein, 329 aa, Streptomyces avermitilis
MPTSPKLSASLDQGGAPSHALGDVAASDSTLRRFLHGLPGVDTVGLEARAASLGTRSIKTTAKAYAIDLAISMVDLTTLEGADTPGKVRALGAKAVHPDPTDRTTPSTAAVCVYPDMVATAKEAVAGSGVKVASVATAFPAGRAALDVKLADVRDAIAAGADEIDMVIDRGAFLAGKYMKVYDEITAVKEACGTSARLKVIFETGELSTYDNIRRASWLGMLAGADFIKTSTGKVAVNATPANTLLMLEAVRDFRAQTGIQIGVKPAGGIRTTKDAVKFLVLVNETAGADWLDNHWFRFGASSLLNDLLMQRQKLATGRYSGPDYVTVD

SEQ ID NO: 10884 - protein, 478 aa, Streptomyces avermitilis
MASAFEYAPAPESRSVVDIAPSYGLFIDGEFTEAADGKVFKTVSPSTEEVLSEIAQAGEADVDRAVKAARKAFEKWSALPGSERAKYLFRIARIIQERSRELAVLETLDNGKPIKETRDADLPLVAAHFFYYAGWADKLDHAGFGANPRPLGVAGQVIPWNFPLLMLAWKIAPALATGNTVVLKPAETTPLSALFFADICRQAGLPKGVVNIIPGYGDAGAALVEHPDVNKVAFTGSTAVGKAIARQVAGTEKKVTLELGGKGANIVFDDAPIDQAVEGIVTGIFFNQGQVCCAGSRLLVQESVQDELLDSLKRRLSTLRLGDPLDKNTDIGAINSAEQLSRITSLVDQGEAEGAERWSPACELPSSGYWFAPTLFTNVTQAHTIARDEIFGPVLSVLSFRTPDEAVAKANNSQYGLSAGIWTEKGSRILAVASKLRAGVIWANTFNKFDPTSPFGGYKESGFGREGGRHGLEAYLDV

SEQ ID NO: 10885 - protein, 302 aa, Streptomyces avermitilis
MSEKTDKTEQQRLSVFKTYKLYVGGKFPRSESGRVYEVTDSKGKWLANAPLSSRKDARDAVVAARKAFGGWSGATAYNRGQILYRVAEMLEGRKDQFVREVADAEGLSKSKAAAVVDAAIDRWVWYAGWTDKIAQVVGGGNPVAGPFFNLSTPEPTGVVTVLAPQESSFLGLVSVIAPVIATGNTVIVIASEKSPLPALSLGEVLATSDLPGGVVNVLSGKTAEIAAPLAAHQDVNAIDLAGADDELAKELEIAAADNLKRVLRPQPVDYSRTPGTERLTAFLETKTVWHPTGSLGASGSSY

SEQ ID NO: 10886 - protein, 131 aa, Streptomyces avermitilis
MARHASLPNPTARRALVALATAALGAGAATASAQAAPAVDATHNRPASTGAIDSQAGLRPLTGTVGYVTGPVEGLKPNPLAGTGVDPLDNGVGTQVADFKPLSSKALTGPLAQAPSVGSTPVLGRAAGLLH

SEQ ID NO: 10887 - protein, 234 aa, Streptomyces avermitilis
LRCDVRSNGVPRGRRRPPDASDWCLVSLHPPIPTRVVLLCGPSGSGKSLVAARSGLPVLRLDDFYKEGDDPTLPLVEGSSDIDWDHPLSWDADTAVAAIAELCATSRTTVPVYDIALSARTGAETLHIERTPLFIAEGIFAAEIVDRCRELGLLADALCLTRGPLTTFRRRFLRDLKEGRKSIPFLLRRGWRLMRAERSIVTRQTALGAHPCDRDEALGRMAAAAAGRCAKATA

SEQ ID NO: 10888 - protein, 206 aa, Streptomyces avermitilis
MTVVDALTGGSGTGVQAHGGAAYGEDTGERRSVSEAEFTAYVQERRASLYATAYHLTGDRFEAEDLLQSALFSTYRAWDRISDKAAVGGYLRRTMTNLHISAWRRRKLNEYPTEELPETAGDTDAMRGTELRAVLWQALARLPELQRTMLVLRYYEGRTDPEIAEILDISVGTVKSSIWRSLRRLREDEVLSFGRDEEESFGELVA

SEQ ID NO: 10889 - protein, 225 aa, Streptomyces avermitilis
VPSLLLIEDDDAIRTALELSLTRQGHRVATAATGEDGLKLLREQRPDLIVLDVMLPGIDGFEVCRRIRRTDQLPIILLTARNDDIDVVVGLESGADDYVVKPVQGRVLDARIRAVLRRGEREANDSATFGSLVIDRAAMTVTKNGEDLQLTPTELRLLLELSRRPGQALSRQQLLRLVWEHDYLGDSRLVDACVQRLRAKVEDVPSSPTLIRTVRGVGYRLDSPQ

SEQ ID NO: 10890 - protein, 521 aa, Streptomyces avermitilis
VTKPQDKLRGWAAARKAILSGLRFTSLRLRLVVVFGLVALTAAVSASGIAYWLNREAVLTRTQDAVLRDFQQEMQNRASALPVHPTQDELQHTAGQMGTSSQRFSVLLVAEDANGKTVTGNSDLDTFTLEDVPESLRTAVNKKQSVSGGNKHAYHLYWQRVTEGGKPYLVGGAKVIGGGPTGYMLKSLEPEAKDLNSLAWSLGIATGLALIGSALLAQAAATTVLKPVHRLGIAARRLGEGKLDTRLRVSGTDELADLSRTFNRTAESLEKRVADMSARDEASRRFVADMSHELRTPLTAITAVTEVLEEELDAETGSVDPMIEPAVRLVVSETRRLNDLVENLMEVTRFDAGTARLVLDHVDIADQITACIDARAWLDAVDLDAERGNICRLDPRRLDVILANLIGNALKHGGSPVRVSVRTEAEDLVIEVRDHGPGIPEDVLPHVFDRFYKASASRPRSEGSGLGLSIALENAHIHGGEITAANSLKGGAVFTLRLPRDPSPLIAEDEGQNGHGTEGNA

SEQ ID NO: 10891 - protein, 209 aa, Streptomyces avermitilis
VGSRPRPAARPRPWLALPLLAALLTGCGIRATQVPTDFGPAPSRVPCALSAPDLSTQGSPGIPVQVFLLCASQLVTVDRSVRIPDGTAEAGRRVLVAQGLLDELARTPSSAEKQAGYTSDVNGGIKVSGPRAKDPGNTFRLSTSPRRLTSYALAQLVCTFANSEATAADDGAVILGGPDTGSPRRYECTTEVRSRPGTQEPPSTEVKTG

SEQ ID NO: 10892 - protein, 183 aa, Streptomyces avermitilis
VQRQGSGGGSAVIRVRVAGGVLLAAHLMLVVWITLRPLDVPWVSPANLHPFAGIRADLALGPREAVRRIGEGLGLLAPLGVLLPMVAGRLAVSPLASLTRTVAAGALISLGIELLQTGVPGQVVDVDSLLLNTVGVALAHLAIVPAGRARLRRRAETRRRAALGREELSQGLTPTIPRVGIAP

SEQ ID NO: 10893 - protein, 67 aa, Streptomyces avermitilis
MTAISRPTDGRMIGGVCAALARRFGTSATTMRVIFLLSCLLPGPQFLLYIALWILFPSEHKAGRTAW

SEQ ID NO: 10894 - protein, 110 aa, Streptomyces avermitilis
MKQSAAKTLGVAALGAAFAAAGAGVASAAPAVPDASSALDTVTRTLPADNVTQVLPGSREALSQGQNAVGAGVAAAKPTAAKALNGGPAAPVAGLLGGLPLKGLPTTTLR

SEQ ID NO: 10895 - protein, 404 aa, Streptomyces avermitilis
LDIDASSCPELYARRAYGAEMTSQHQNTPSSEQIRRAPKVLLHDHLDGGLRPGTIVELARDAGYSGLPETDPDKLGIWFREAADSGSLERYLETFAHTCAVMQTRAALVRVAAECAEDLAADGVVYAEVRYAPEQHLEAGLSLEEVVEAVNEGFRAGERRAKEDGNRIRVGALLTAMRHAARALEIAELANRYRDAGVVGFDIAGAEAGFPPTRHLDAFEYLKRENNHFTIHAGEAFGLPSIWQALQWCGADRLGHGVRIIDDIQVREDGSVKLGRLASYVRDKRIPLELCPSSNLQTGAASSYADHPIGLLRRLHFRATVNTDNRLMSGTSMSREFEHLVDAFGYTLDDMAWFSVNAMKSAFIPFDERLAMINDVIKPGYAELKSEWLFKQTASTSSSAASEE

SEQ ID NO: 10896 - protein, 254 aa, Streptomyces avermitilis
MAHQATPVRTARLGRTLGPEPTAVSGVVLLLPGGDEASTRRPSPVLPTASVRALGRHLARAGRDEGLVTHVVHYRYRGWNGSEAHLAHDASWAAGEVVRRYGDVPVCLAGVDMGGRAALRAGGHTAVNSVLALAPWLPEEDVAAPPEPVKQLSGRRVLLVHGTNDQRTDPELSFRLASRAKKTNRDICRFEVHSDGHGLHQHRSEVLALAEDFVMGVLFGHAFSRPVEDALAAPPPLGLRMPLAAGFGRSLKRR

SEQ ID NO: 10897 - protein, 317 aa, Streptomyces avermitilis
MVHQQRSQAHLSPSSDTEDIVALLAPRLAYFAGVARTEHVTRAAQEMQVPQSTLSRSLVRLEQDLGVDLFARRGRTVSLTPAGRTFLASVERALAEIERAADEVRADADPATGKVAFGFLHTMGSETVPGLIRAFRADHPRVRFSLVQNYGEAMIERLRAGELDLCLTSPVPDAPDLVARRLDEQKLRLVVPADHRLAARKRVRLAEAADETFVTLEPGYGLRRITDDVCQEAGFRPRIAFEGEEAETLRGLVAAGLGVALLPPPAVPRPGVVELTVTAPRAVREIGVAWLDGHPDTPPVAAFKKFLLSRRGHLLPD

SEQ ID NO: 10898 - protein, 430 aa, Streptomyces avermitilis
MPSASTEAPATVGAVPSVSATADPAADSRMAPGGPGYRRMSFALFLAGVATFALLYSTQALLPLISSDLGVTASEASWTVSAATGGLALFVLPMSALSERFGRRTLMTASLAVAVSVGLLVPFAPSIGALIALRAVQGAALAGLPASATAYLAEEVRPKALITAIGLFVAGNSVGGMSGRVITGWVAQEWGWRVAVGTIGFLAVACAFAFRLLLPAPKHFTPGSLRPRVLARTVRDHLADPLLCRLYAIGALFMMVFGGVYTVIGYRLTEAPFSLPQGIIGSVFLVYLVGTVSASTAGRLVDRLGRRGSLYLAGGTTTAGLLLSLAGSLVFVLLGLVLITAGFFAGHAVASSAVSHTAKRGRAQASALYQSAYYIGSSAGSTLGAVAFHAGGWAGTVTLGLLAVLGVVTITVFGSHAARAQARRSPVPAH

SEQ ID NO: 10899 - protein, 376 aa, Streptomyces avermitilis
MEFQVERGAFAEAVGWAARALPARSPVPVLGGLLLTADAGRLSVSGFDFEAAARIGTDAETVAEGQVLVLGRRLLDICRVLPDGPVSCVLEGTRFTVEAGGTRFGLSTLPREEYPALPVPPEPYGSVDADAFASAVSQVAVAAGRDDTLPVLTGVQLRLDGDAMTLAASDRYRYAVRTLGWQPEAAADGVVEALLPARRLLDIARSLARSGDVRIGFDRAAGGLIGFEGGRMRTVVRLLEGRLPKYGSLFAVAGAAVAEVECGALAEAVRRVAVVAEANSPVRLDFSAPDGTVLLGAGYGDDVAAQRLPAVLSGAEEVTAAFNPGYLLDALNSFEAPRVRLELLGAGQRTLLTAVADGGEPDTAHRHLLMSVRQLV

SEQ ID NO: 10900 - protein, 334 aa, Streptomyces avermitilis
MSDGTATTDLDVRLEKHRVELTGYCYRMLGSSFEAEDAVQDTMVRAWRSYEKFEGRSSLRSWLYRIATNVCLDMLTAGNKRARPMDLTDSTPLAQAALSPRPDSTWLEPMPDVRVLPTASDPAEAAVAKESVRLAFMAALQRLPPKQRAVLILREVLAWKASEVAELLDTSVASVNSALQRARATLADSEGAAADAAVSDPLDEEQQKLLERYVAAFEGYDMAALTALLHEDAVMTMPPFDLWLCGTPDITGFMTTLGAACAGSRLLPVQVNGLPGFAQYKPDPEAGGFTPWALQVLEISDGRLTGFHFFLDTKRWFPLFGLPLHLEAEADEIE

SEQ ID NO: 10901 - protein, 128 aa, Streptomyces avermitilis
MSSTARPGLPNVDAMTPAVLVLPAAVSQDAVARLCEDVRALLESTGAGVVVCDAAALGPPGLAAVDALARLELAARRTGGRIRVRAPAPALRALLDLVGLRFEVEGEAEEREPALRVEEEVEPGEPAV

SEQ ID NO: 10902 - protein, 427 aa, Streptomyces avermitilis
MAMDAISVIRTKRDRGELSDAQIDWVIDAYTRGEVADYQMAALNMAILLNGMNRREIARWTAAMIASGERMEFSALSRPTADKHSTGGVGDKITLPLAPLVAACGAAVPQLSGRGLGHTGGTLDKLESIPGWRALLSNEEMLHVLDTTGAVICAAGDGLAPADKKLYALRDVTGTVEAIPLIASSIMSKKIAEGTGSLVLDVKVGSGAFMKTIEDARELASTMVGLGTDHGVKTVALLTDMSTPLGLTAGNALEVRESVEVLAGGGPADVVELTVALAREMLDAAGVKDADPAKALADGSAMDVWRRMIAAQGGDPDAQLPTARERHVVTAPSSGVLTRLDAYDIGVAAWRLGAGRARKEDPVQAGAGIEMHAKPGDTVTAGQPLLTLHTDTPERFEYALESVDGSYDIAPTGTDFKATPVVLERIA

SEQ ID NO: 10903 - protein, 138 aa, Streptomyces avermitilis
VTSGAGAGSAAVDWEALRAVARDAMSRAYAPYSGYPVGVAALVDDGRTVSGCNVENASYGLGLCAECGLVSQLQNTGGGRLTHFTCVDGRGEILVPCGRCRQLLYEFGGAELLLETPAGIVPLSEMLPQAFGPGHLTQ

SEQ ID NO: 10904 - protein, 417 aa, Streptomyces avermitilis
VTVAKPQAKKPGKGSRRMSLPVLLLVIAGVLVLTSVVRLITGADGITSTGQMSTALRLAVPIGLAGLGGLWAERAGVVNIGLEGMMILGTWFGAWAGYQWGPWTGVAFGIIGGMLGGVLHAIATVTFNVNHIVSGVAINILALGTTRYLSKFTFENEPGGSSKQSPGIDSLGTFDIPGLSSGLNTLNEKHWFLVSDIAGLIGGLVTDLSPLTVVAVALVPATWWVLWRTAFGLRLRSCGENPVAAESLGVNVYKYKYLAVIISGGFAGLGGAFLSIVASNVYLDGQTAGRGYIGLAAMIFGNWMPGGLALGAGLFGYTDSLNLRGGTTNVHALILLLAILLVFGAAYLLWKKRYTPAVVTAVVSALMFLWYTSTNEVPKQVVSATPYIVTLLVLSLSAQSLRMPKADGMPYRRGQGK

SEQ ID NO: 10905 - protein, 376 aa, Streptomyces avermitilis
MKKFDKERVLLAVAGPAIALVAAIALTSIVLLASGRSPFEPYSLMLEQATFSDVQVLIINQASMYYIAALAVALGFRMNLFNIGVDGQYRLGAVMTAVVGAHIALPSFLQIPLLMLVAMLTGAFWAGIAGVLKVTRGVSEVVATIMLNAIATSLIGYLMLSDNFGVQVGNNNTTGIMKESGWIPGINLGADVGEIYGLVFLAVVLGILYWIVLNRTRFGFDLRASGASESAAAASGVDAKRMVLIAMLISGAVSGLAGLPLLLGDVHTYSLSFPAGLGFTAIGIALLGRNHPGGIALAALLWAFLDKASPALDYATPVAYEKEIATIMQGLIVFAVVISYEAVRVWGLRRQQKRVGAELAAAAAHNNSEKKEVAAR

SEQ ID NO: 10906 - protein, 527 aa, Streptomyces avermitilis
VVANHDIHLTVRKGTVHALVGENGAGKSTLMKILYGMQKPDEGTIAVDGEQVAFHSPADAIARGIGMVHQHFMLADNLTVLENVVLGSEKLYGIGGGARKKIREISDRYGLNVRPDVLVEDLGVADRQRVEILKVLFRGARILILDEPTAVLVPQEVDALFDNLRELKSEGLAVIFISHKLGEVLSVADDITVIRRGTTVGTAVPSETTPRQLAELMVGSELPTPETAESTVTDKPVIQVKGLTVFAGGAASLGEFDEPSATGLLTEDTAETAGGVRRVLDDVTFTIHAGEVMGIAGVEGNGQTELIDALIGLKHADSGSIGFLGEDITSWPTRKRREQGVGYIPEDRHRHGLLLESPLWENRILGHVTERPNAKGFWLDIKGAQDDTRRIVEEYDVRTPGIDVTAASLSGGNQQKLIVGREMSHNPRFLIAAHPTRGVDVGAQAAIWDQIREARREGLAVLLISADLDELIGLSDTLRVIYNGRLVADADPATITPEELGSAMTGAASGHLEHAESAADLGEDETR

SEQ ID NO: 10907 - protein, 797 aa, Streptomyces avermitilis
VRLISRRTRFSRAAVTVAVVALAAAGCGKSSNEADSGSDKSSSGYTGKGIGLAYDIGGKGDQSFNDAAYAGFEKAEKEFKIGGRDIEPQDGESNADKVQRLEQLAKAGYNPVIGVGFAYAPAVKEAAAKYPKTTFGIIDDEQVKADNVADLVFHEEEASYLAGVTAAKTTKSNVVGFIGGVDVPLIHKFEAGFAQGVKDTKKGVTVKSQYLTETAAEGGFSSPDKGEAAAEGQIGAKADVVYAAAGLSGQGVIQAAAEHKVWAIGVDSDQYKQDALAKYKNSILTSAMKDVAGAVYNLSKSVHDGKPLTGVVRANLNTGGVGLADSNPTFKDITDLHAALNKAKADIMDGPASMHTRRLPVIIQHQRRAKTLALTQLSALHATSSRPRPCGRSAPSPLPPASGAQRSVICGASVATARRTGQKGFSVSSTRVTLRRNQRLVWALAQRSHVPCAGCPESRLRALRPLPSPSLLPPAATRPASPRPAAAAAARPRALPSPTTSAARATSPSMTLPPPVWRRPARSSRPPPRPSSRRTASPTPTRCSVWSSSPSPATTRSVSASPTPPPSRKPPRSTRRPPSASSTTSRSRRTTSRTSSSTRRRPPTSPASPPPRPPSRTSSASSAAWTSRSTSSRRASRRASRTPRRVSRSSRSTPRPPPRAGSPARTRARPRPRARSAPRPTSSTPPRACPARASSRPPPRTRCRRSVSTPTSTSRTRWRSTRTPSSPRRRTWPARCTTSPSRCTTASRRPVWSAPASAPAVSAWPTPTRPSRTTPPCRPRSRRPRRASRTVRSRSRP

SEQ ID NO: 10908 - protein, 417 aa, Streptomyces avermitilis
MSRESEADFPGDAELPGALPEALRAELVAFRRDVHMHPELGNQEFRTTAALKARLEKADLHPRVLDTGTGLICDIGNTAETGDGAQAADAGPRPMLALRADIDALPIPDAKVDCAYRSTVPDRAHACGHDVHTTVVLGAGLVLAELHSQGRLPYPVRLIFQPAEEVLPGGAVDAIASGALEGVGRIIGVHCDPRVDAGRIGLRHGPITSACDRLEVALNGPGGHTARPHLTTDLVTAAARVATDVPALVARRVDARSGLALTWGRIESGHACNVIPQRAELSGTVRCLDLNAWRAAPDLVHAAIDEIAGLYRAKTEINYVRGVPPVVNDPAVSDLLHDAMTARRGPDSVEDTEQSLGGEDFSWYLEHVPGAMARLGVRKPGERVVRDLHQGDFDVDEHAITVGVELFTAAALLDAAR

SEQ ID NO: 10909 - protein, 357 aa, Streptomyces avermitilis
MSPRAGSAGPHTLAFVESPVQLLNVLEWAYTNALHDPGAGLTLVVLSPTDPMTRGQLRRMAELARDEGYEVRWEEARGGPTAPFHTIGGLAGVLRRADRIVMGDPFSRYVQLLLTITRARELVVVDDGTATMEFVAQLARGERLVRWHRKGGRPGPRDLLFAPVSSSARRRLTPSAHRTVEVFSSMPIDSAPEGVKVTRNDFSWTRVRFGPPRLTKGADLVGTSLVETGVVDGDRYLEAVRALAKAHGATRYFAHRRESTDKLRRLAAETGLEIVRPDLPLELIARRGPIGRTILSFPSTVVHTLPLALAGTEVRVAVCDIDPTWLTENASPRAQGFLSGVTGTARDVHRLSAVRMA

SEQ ID NO: 10910 - protein, 311 aa, Streptomyces avermitilis
MSNSRLRSFGSKTAGPGHPVYVVGEIGINHNGELENAFKLIDAAAEAGCDAVKFQKRTPEICTPRDQWDIERDTPWGRMTYIDYRHRVEFGEDEYRQIDEYAKSKNIDWFASPWDTEAVAFLEKFDIPAHKVASASLTDDELLRALRGTGRTVILSTGMSTPKQIRHAVEVLGSDNILLCHATSTYPAKAEELNLRVINTLQAEYPNVPIGYSGHETGLQTTLAAVALGATFVERHITLDRAMWGSDQAASVEPQGLTRLVRDIRTIEASLGDGVKKVYESELGPMKKLRRVPGVVAEAEIAAAAGEPVAV

SEQ ID NO: 10911 - protein, 432 aa, Streptomyces avermitilis
MSHSEAGQAASVRRVLAVIPARGGSKGVPAKNLLPVGGVPLVARAVRECRATRLVTDVVVSTDDHAIAAAAREAGAEVVLRPAAIAGDTATSEAAVLHAMDTHEALHGAAVDVVLLVQCTSPFIVREDVDGVVHAIVGKGADTALTVAPFHGFVWRDADDAPGALGAERAAVEGGTDTLVTGTATSGGYGINHDKSFRPRRQDRPQDLLETGAVYGMDATGFREARHRFFGRTELVRTDPARVLEIDDPHDLARARALAPLFDANRPGALPTAEDIDAVVLDFDGTQTDDRVLIDSDGREFVSVHRGDGLGIAALRKSGLTMLILSTEQNPVVAARARKLKIPVLHGIDRKDLALKQWCEEQGIAPERVLYVGNDVNDLPCFALVGWPVAVASAHDVVRGAARAVTTVPGGDGAIREIASWILGPSLDSLDK

SEQ ID NO: 10912 - protein, 451 aa, Streptomyces avermitilis
VPASTTKSLRVAVLADSDTRWKWGALTANRVSPNESDIRLDGFLLRGRATPTPRQLEEVGVRADSLREVTAVEFLRHMKGETYDIVVLALVGGAVQAVLHGLGHARQGHEKRPVVVTGYVGVVYEKLADGLLLRHGADLVLANSRQDAERFRAVFEGVGADASAVTEVALPFLGGRPYAGNDPSAQRGSRPYTVVFAAQPSVPERRGDRTYLLNRLVQHARLHPDREVLLKLRSKPGEHTTHIEELPYQKLAQRLPDGLPANFRLVYGNMGEVLDRSDLLVTVSSTAALESLHRGIPTVVLTDLGVREALGNHHFVGSGCLASWDQLDAGHRPLPDPTWVARQGVAAGGTPSGGGSYETAFDAARERIAGLLAAGELPPLAPYYTPVTAPGYLPGILARHHLAPDGSPLPGAPAADKEPSPVRQMVRRAARGAYRHGVQRVAPVIRRMGEL

SEQ ID NO: 10913 - protein, 326 aa, Streptomyces avermitilis
VVKLSVIVPFYNVQQYAPDTLKSLRANAGDDFEFILVDDCSRDETPDILARAERELPGAVHVRHEKNGGLATARNTGIDTARGEYLTFLDGDDWLAPGYFPQLLSAIEELGCDFVRTDHVQCTARARTVNRVPHGRRGVVMNPRDAILPADRSTSVDYAYAWAGIYHRRLVDRGLLHFTDGLRTAEDRPWIWKLHREAESFATVGLLGVFYRRGVASSLTQIGDVRQLDFIRAFDQVVAETAKDRDADKLLPKAVRTYCAIISHHLGSIERFEPPVARKLKSMSAVALRRMPQDVLEEALDSMDIQRASRLRRLRRRPATAAGVPA

SEQ ID NO: 10914 - protein, 444 aa, Streptomyces avermitilis
VTTQIFLASTLYGAATLAAALDTECFAPADRRILLVSNNAATPETTPALDEMPGFDHLRGRFDDVISWNETISPFHPGGWAPRLDDVPLWERHLRLAWRLGDDDVALAVESIQVNPALGIAQIFTGAPVTVYADGLMSYGPTRNKIDPLVGTRVTRLLHLDLVPGLEPLLLTEFGVEPEIVPTDAFSKVLGELVDTGDTLPAIDEPALLLGQYLSALGILTAEEEENLHVRMLKGAIELGHTRVVFKPHPTAPARWSRLLEKEAEKLGADLTVLDTPVLAEVLYQRMRPALVVGCFSTALLTASALYGLPVARIGTESLLDRLTPYENSNRVPVTIVDALLPLLTDRAAVTEQRQGLDVEDLTSLVRAVGYAMQPKICPGLRPAAERYLTRQLTPHTWRYFKRRRLTSLALPGAVPAQLAFIPRNATVRRVARRARSLKRATLG

SEQ ID NO: 10915 - protein, 382 aa, Streptomyces avermitilis
VPTPLEKPAATAPEAGQGAAGVPPRIVPKAHAPRLRALDGLRLVAALMVAAYHYGGRDGDVTAAWGGSPRHQFPTLHSWFAYGCLGVQIFFVISGFVICMSGWGRPLRSFFASRASRLLPSYWAAVIIVTAVFALPTVAYKAVSPSDALVNLTMLQQPLGVDRVLGVCWTLWAEIRFYALFALCIVLPGATRQRVILFCASWTMAAAIAQAADEPLLNLVLMPEYAPFFVGGIGLYLVHRDRRDAYAWGIVGVSWLIGQHYAVRGLWHAPNPDFFSYRPAYGIVLIVTLGYLAVAAIALGWLNRVNWRWLTVAGALTYPFYLVHEHLGWVAIKVYHRDLGIPSYGTFLLTVATMLLLAWLLNRYVEERLAPKLRGALSRPRP

SEQ ID NO: 10916 - protein, 216 aa, Streptomyces avermitilis
VVTQRSPKLDKKQVVETALRLLNEAGLDGLTLRAIAKELNVQAPALYWHFKNKQALLDEMATEMYRRMTEGAHLAPGASWQERLLHGNRALRTALLGYRDGAKVFSGSRFTGTEHAVQLEASLRSLVEAGFDLPQAVRATSTAYFFTLGFVTEEQGVEPLPGERREGYDVDERAARMADFPLAAAAGAEIFQNYEEGFEEGLRLVIAGIEARYGIR

SEQ ID NO: 10917 - protein, 478 aa, Streptomyces avermitilis
MRLNGVKETVVNTDVLIVGAGPTGLALGVDLARRGVRALVVERAEGLFPGSRGKGIQPRTMEVFDDLGVLDAIRAAGGSYPVGMIWQDGERVGEHQLFDPAEASDDSPYAEPWMVPQWRTQEILFARLEELGGRVGFGREVVGLRQDEDGVTAEFASGTAVRARYAVAADGGRSAVRRALGIGMTGETVDPNPMLVADVRITGLDRDNWHIFPPREDDGFLAIWPLAGAEDFQVVAQFPEGTDADLSLDGIRKVVATRSHLAPAEVTEVRWASDFRPRAAMADRFRAGRVFLAGDAAHVHSPAGGQGLNTSVQDAYNLGWKLGAVLRGGAPVSLLDSYEEERLPVAADMLGLSTQVHRGEVRRGEATRQLGLGYRGSSLAVETRAGLARDALHAGDRAPDGIRGDVRLFDAFRGPHWTLLAVGTEAELPTLAGARTVRIPAYEEYGAGVFLVRPDGYVGWAGRTAAGLTEYAARVAVA

SEQ ID NO: 10918 - protein, 217 aa, Streptomyces avermitilis
MFGVTDLPTYLAGLVLIVLLPGPNSLYVLSVAARKGVRAGYTAAAGVWCGDTVLMTLSAAGVASLLQANALLFGIVKYAGAGYLTWLAFGMLRAAWEMWRTRRDRADAARAPVAPVAGERPFRRAFVVSLFNPKAILFFVAFFVQFVDPGYAYPALSFVVLGAFAQLASFLYLTALIFSGTKLAAAFRRRKRLSAGATTAAGALFLGFAVKLTLAGA

SEQ ID NO: 10919 - protein, 526 aa, Streptomyces avermitilis
MARESESGLPIEPVYGPEALEGWDPAQKLGTPGAYPFTRGVYPSMYTGRPWTMRQYAGFGTAVESNARYKQLIANGTMGLSVAFDLPTQMGHDSDAPIAHGEVGKVGVAIDSVEDMRVLLGGIPLDKVSTSMTINAPAALLLLMYQLVGEEQGVPADRLTGTIQNDVLKEYIARGTYIFPPKPSLRLIADIFKYCKTEIPKWNTISISGYHMAEAGASPAQEIAFTLADGIEYVRTAVAAGMDVDDFAPRLSFFFVSRTTILEEVAKFRAARRIWARVMRDEFGAKNPKSLMLRFHTQTAGVQLTAQQPEVNLVRVAVQGLAAVLGGTQSLHTNSFDEAIALPTDKSARLALRTQQVLAYETDVTATVDPFAGSYVVEKMTDEVEAATVELMAKVEELGGAVNAIERGFQKGEIERSAYRIAQETDSGERVVVGVNRFQLEAEEPYEPLRVDPAIEAQQAERLAKLRAERDRSAVDAALADLKKAAEGTDNVLYPMKDALRARATVGEVCNALREVWGTYVPSDAF

SEQ ID NO: 10920 - protein, 285 aa, Streptomyces avermitilis
MRTKGMAGRSMAALVALVAVCGCTAQGVDADGKHRSPVHIDLPRTPTASHPPTASRTPAGDKPSGTSTPVPAPAPAKVLWSAGDKGTAVRELQARLRQVAWLFDGPTGTYDDLTVTAVRGFQGKRGLPRTGETDAVTWQRLVRMTHEPTKWELYALGGQPAAAPDPRCMTGRALCISKTSRTLRWMIDGKTVSTMAVRFGAQYTPTREGVFSVYWKSRHHVSTLYDSPMPYAMFFSGGQAVHYSYDFAARGYAGGSHGCVNVRDEVKIAALFAQVRTGDKVVVYW

SEQ ID NO: 10921 - protein, 365 aa, Streptomyces avermitilis
VMADEQYRWLDRDAAERLLRGESLEAVDADTRKQAEQLAEALGALAADPLPNSAELPGEAAALAAFRTARQGRNGEEKVLGGRGRPHAVARAAHSADAGLVRLGRPERAARRGRLGRPVRLGVAAALAAGMIGGVAAAAGTGVLPTPFGGDEPGPTASVSAAVTPERPLGSSSPGAIGDGGGSEAPTPDGTSGAPVQGGSSHDEADKGSAASGRPGADSSRNPARSREWWSAVLSSCRDVRGGKDVGTERMRSLEEAAGGGLRVHKYCKGVLAYAEGHSGSGSGAIDPGDDEGSGRDSGSGRGDRDGKGDGDGTGDGDNGGRGGDGDGHHILPGGSAPGGNGLIVTPSPSPSPSRHALTSLVPRS

SEQ ID NO: 10922 - protein, 237 aa, Streptomyces avermitilis
VLGDDAELTAAVLAAQDGDETAFRTVYRAVHPRLLGYVRTLVGDPDAEDVTSEAWLQIARDLERFSGDADRFRGWAARIARNRALDHIRMRGRRPAIGGDETELTGKPGEADTAGEAIESLATDRTLSLIAQLPQDQAEAVVLRVVVGLDAKSAADTLGKRPGAVRTAAHRGLKRLAELLGADDPESPGGLDGLPPQRDPQRDPQRAPQRPPRREPRTRAVTSAGVTHLRSRTQKDM

SEQ ID NO: 10923 - protein, 227 aa, Streptomyces avermitilis
VGADMGERPDGGARLDAFLAAAMRPKALDAEAEARAVAAFRVAREQGTRAARIRRRDDWRPKGERRAGRSLRTTFAVVAAALTLGGVAVAAVGGVPGDAPEGRPRPSSAAPAASSAAPGADTGVRPTGARRADEKSDQLNQGDRGNRGDLGHKGKKSKKVKDDKSSPKPVKSVKSTKSNKPEKADKADKVEKVAKAAKADKADKADKAEKAVKAEASAKAEKATKSK

SEQ ID NO: 10924 - protein, 229 aa, Streptomyces avermitilis
LGAWTRPSCRTACTRYESVRARTVLGQGGEPRRVRANDGELGAAVARAQRGDEAAFAVAYRMVQPGMLGYLRGLVGNDAEDVASDAWLEIARDLGRFRGDGAGFRGWTATIARHRALDHLRRQRVRPQATALENDVLELPGTHDTPDQALESLSTEYAIELVVRLPRDQAEAVLLRVVVGLDGPAAARVLGKRPGAVRTAAHRGLKRLAQQLAAEGVTDEGSRTLGESG

SEQ ID NO: 10925 - protein, 904 aa, Streptomyces avermitilis
VGYLSRRKTHAYKPLSLKRRTWLTLGAVVAGGAGVVTYAVASPSGDAADDVARGKRPVEVHDLALKAGTSGSRELARTTTEAFSIVGVSWTGAARELDGTAQVRTRGTDTGEWSGWRNLAPGLPVDRTEPGAKNARGASDPLWVGPSDGVQARVLAADGSARAGLPEGLEVNLVDPGVTTTEARNKGLDTSGTGTGTDLSNAAFVAKDPSQTPTGTPSGSATETGSEPAPAPGDSDSASATATATSTATTTAPTAPASTVARPSIVSRTRWGADESAVAGSPQYIDRISAVFVHHTAGSNDYSCAQSASLVRGIMAYDIQVAQRGDLGYNFLVDKCGRIFEGRAGGADLPVRGDHTYGFNGDSTGIAVLGDFEGSAASAAAKPSRSAVESVARLAAWKLGQYGGNPSGTVTLTADADTGVYAKDAQATLNVISGGKDAATTTSPGKNLYGKLGEVRRYASSPGRSSAIPTADYNGDGVSDLVAATPKQGSGWLTLVPGGISGPVSASKLKLNQGSTGVPGAAESGDQWGAATAWGDINGDGYADLAVGAPGEDDTTHADRGAVTILYGPKFDTGADTMALGDDYNPNSAHFGATVAVGDFNADGKADVFTAATGTGGNWVARFANGQETAGDITTVSGALAYADAASGDFNRDGYADVALTYRDASGVGRVTWFKGSKALGLSKVSTLTVKGGRSLAAGDVNGNGYDDIVIGQPSASESGGSSGGQVTLVPGASTGFTTTGMTTVHQGTTGVEGASESGDAFGTSVSVGDVNADGYADVLTGAPSEDITRDAKNRSNAGSVWLLKGASSGLTGTGSLALSQDTANIPGSTETDDKLGSALSLSDVTGDGYADLTIGAEGEDTGTGTLLYVPVTGGTVTTAKAVYYGIAQLGTSTGGRLGQVLTP

SEQ ID NO: 10926 - protein, 152 aa, Streptomyces avermitilis
VGRSCAGVGNPSGTRDESWPERAFPGVNVTEVTRPQAAAKPVRWAADAVATMREGARLRLDYSAQSLWRVDRMIEGIRREGAPYAAVEAVLRGFGAYTGEVVVRHTGGEWWTTGGDHWVRTPDGRLWDPIDEARRCYLGDGSLRLLCRDAAD

SEQ ID NO: 10927 - protein, 186 aa, Streptomyces avermitilis
MSLVELIAEADERGLAASGLACLDRCVPLLGGDDEVLRPLWASLVEGREWEERLTKARAELGAADAEPTEAEDEACGLARRMLDAVPAQPAAGALREWADACSVAALQIHRLLDAADDGPGPVSARREGRTEGMSPLVAAELRRQVTVLELVAGHGAGGLRRALDVSTEGRRVLRAVVSRRARGRA

SEQ ID NO: 10928 - protein, 175 aa, Streptomyces avermitilis
MAYWGYFVVGRSERPLAELGALTAASGMTLLQTAPGGWQVWEYPSGDGDVGSMNALARETGAPALFGYVMNSVCVAVEAAAPQSGAWTTCLARRAMAGYLAGGPGDGEQEGLGVEDYFLTPGEAAERAVAWAAEAGHTVAPGPLAQVLGVDPDPSEPLAENLFFRFLDRLGVVPL

SEQ ID NO: 10929 - protein, 353 aa, Streptomyces avermitilis
VDRMFRVPCVRFWGEPRVAFTDHTPGGRSTMLCTRCRHRAASTPEGLCTNCANGTTTESTVPATPDAAAGAPQPAAPASPKPDAPGFAQSDGPGFAPPGGPGSAPPGALPTAPPLGAAPLYAPGGQPSWLRSPVGLGRATAALLGVVIAADVFAVVADFNMYDVSGALADGEFGAGMQDKADRADALYAAAGVAQVAALIATMIVFLVWFYRVRVNAEVFAPDRQSKSRGWAIGGWFVPVVNLWFPRRIALDIWDASGPDALWDGDLAAAPRPSRARINAWWAVWVVSLLADRLASTAYRKAETAPEIHKAAGQMLFSDVVDMVAAVLAILFVLRLTRMQDEKARRGPVSVEV

SEQ ID NO: 10930 - protein, 545 aa, Streptomyces avermitilis
VSGRRRRVPEGRTPVRRNRLLLGGGLIVAGTLGVTAVLWPSGGSEPAGARASTASSAAAATRTPSPSPTRAYPLSKAPRTIPAVREHTAARGPGWRPAKGGRVVVGDAALADEGKLTAGELGLAYAGRTGARAGDVELALDKGTGGPESYTLTVRGGRVRIAAPAEAGVFYGTRTLKQAVHGGGTAPEGVVRDRPAKPRRGLMLDIARKHFTAGWIEDRIRELGDLKYNELGLHFSDDQGFRIESASHPEIVSRQHLTKAEVRGIVDLAASRHIAVVPEIDSPGHLGAVIAAHPDLQLRNASGVPARGAVDISKPAAATIVDDLLNEYADLFPGAYWHLGGDEYQALMVSDPSASYPQLAAAARNKYGANATVADLTTGWLNGRADNMRAHHRTMRAWNDGFYRSAGTVRPAKDIQVAYWTGKEIGARQPAEYLSAGRKLINYNDEYLYYVLGQPQTFVYPTGQRIYQQWTPRVVRGSTAVPARYDAQILGGVFAVWCDLAASQTQDQVAAGIRMPLRAMTQKLWDPRTPTLSWTEFRALARQLG

SEQ ID NO: 10931 - protein, 162 aa, Streptomyces avermitilis
MGLERFNGVRVDDAERALLTCCRSLRWARRVADHRPYPDLDALLAAADEAAYDLAPADLAEALAGESLTLLPDDAYSVAHTALSAAHAAYESRFGHVFVICLDNAPPGEALDQVLAGIRSRLTNDREEERVLAAEELRRLARGRLARLVRDFSPRPALQRTP

SEQ ID NO: 10932 - protein, 126 aa, Streptomyces avermitilis
VPAGTLYRGREGMWSWVAHRVTGVLIFFFLFVHVLDTALVRVSPEDYDKVVSTYKTPIVAVLEYGLVAAILFHALNGLRVIAVDFWSKGPRYQKQMLWSVVVLWLVLMIGAIYPVLGHAARELFGS

SEQ ID NO: 10933 - protein, 160 aa, Streptomyces avermitilis
MSTTDTAASGIGPVEGASLYGVDNPAPVIESPRKRTKKTPKSTRGNFEMYGWLFMRLSGIVLVVLVLGHLLIQLVLDGGVSKIGFAFVAGRWASPWWQVWDLAMLWLAMLHGANGLRTIINDYAERANTRLWLKGLLYTATVFTILLGTLVIFTFDPNIR

SEQ ID NO: 10934 - protein, 584 aa, Streptomyces avermitilis
MKIHKYDTVIVGAGGAGMRAAIEATKRSRTAVLTKLYPTRSHTGAAQGGMAAALANVEEDNWEWHTFDTVKGGDYLVDQDAAEILAKEAIDAVLDLEKMGLPFNRTPEGRIDQRRFGGHSRNHGEAPVRRSCYAADRTGHMILQTLYQNCVKEGVEFFNEFYVLDQLIVEEDGVKKSAGVVAYELATGEIHVFQAKAVIYASGGTGKFFKVTSNAHTLTGDGQAAVYRRGLPLEDMEFFQFHPTGIWRMGILLTEGARGEGGILRNKDGERFMEKYAPVMKDLASRDVVSRSIYTEIREGRGCGPEGDHVYLDLTHLPPEQLDAKLPDITEFARTYLGIEPYTDPIPIQPTAHYAMGGIPTNVEGEVLSDNTTVVPGLYAAGEVACVSVHGANRLGTNSLLDINVFGRRAGIAAAEYSAKAGYLELPEDPAAQVVSQVERLRASTGTERVATLRLELQETMDANVMVFRTEQTIKTAVEKIAELRERYLNVSIQDKGKRFNTDLLEAIELGNLLDLAEVMAVSALARKESRGGHYREDYPNRDDVNFMRHTMAYREVGDDGTESIRLDYKPVVQTRYQPMERKY

SEQ ID NO: 10935 - protein, 257 aa, Streptomyces avermitilis
MATPTLDKADSKPEAGFADSPYITVTLRIRRFNPEISAEAAWEDFQLEIDPKERVLDALHKIKWDQDGSLTFRRSCAHGICGSDAMRINGKNRLACKTLIKDINPEKPITVEAIKGLTVLKDLVVDMEPFFQAYRDVMPFLITKDTNEPTRERLQSAEDRERFDDTTKCILCAACTSSCPVFWNDGQYFGPAAIVNAHRFIFDSRDEAGEQRLEILNDKDGVWRCRTTFNCTDACPRGIEVTKAIQEVKRALITRRF

SEQ ID NO: 10936 - protein, 87 aa, Streptomyces avermitilis
MTVPTPEAPFGVDPQGRPYSDKSKVVAGVLQLFLGTFGAGRFYVGSTGVALGQLFTCGGLGLWALIDAILFFTSNDRTDKQGRVLRG

SEQ ID NO: 10937 - protein, 136 aa, Streptomyces avermitilis
VAEPARAPLSFLRHPAAAPLAVLAAGAAGACYLYTTDPHEPGHVLPRCPLRLVTGLLCPACGGTRMVYDLMHGHFTAAWLDNRLLLLASPFALGLLARWFLEGVRGRRWRPEPSARTQAVVLLVAVAWVVVRNLVR

SEQ ID NO: 10938 - protein, 166 aa, Streptomyces avermitilis
VFGVLCTTTPESTALSEQPPQSPPPNQPPGYGYPNAGATPPGGPNPYAAGQPGSYQQPGGQYGYGYQQPGYPPGAVPPGTYTGDPNAPYGYDPYGRPYSDKSKIVAGLLQLFLGSFGVGRFYMGSVGIGIAQLFTCGGLGIWALIDGVMLLAGNEAKDQHGRILRG

SEQ ID NO: 10939 - protein, 823 aa, Streptomyces avermitilis
MAHHTPTSHLERARNQIAAGDMGRLAHVVLKAAEHNRGHWGGGWAEILEILRELPRQERLRLAGALAQRCQEFDEGSAGRRHALTLAAVVSRDLPDELFSVERLKQLDQLARQHSFWYGSRLEVLAEAELAAGRPLAPAVVAVLRRSALVAYRADHLTELAGKLTEPVLNVGEEWAERALQDAAGPDWQALLAHALTATASKPTAKWDKRAHEIIGALGPDRVRAAVLSWLTLVGRPRTFPLESGTAYEPDHNHAYDPYNANALRGLAWLVSLLPPHPGTPRTLGALVETSLRKVAGLGPRNPKVANAGVIALSRIDSEAALAELARLATRVTYKNTAKLLDTALQTRATALGLSREEIEELAVPGYGLTGVGHAEHRFGEVTALLDVHGTKTVLSWRNAAGKEVRSVPAAVRRDHAEELKELKTAAKDIDRMLSAQSERLDRQFLARRTWAYDVWRERYLDHPLVGTLARRLLWSVDGTSVGFADGEPRTLGGTPVKAGSEVTLWHPVGREPAEVVAWRDWLERHAITQPFKQAHREVYLLTDAERTTGTYSNRFAAHVVRQHQFNSLAAIRGWRNKLRLCVDDEAPPATRELPQWGLRAEYWIEGDGEEYGEDTTESGSYLRLRTDQVRFYPIDAPANSAHCYGGEYRMWLRDGADPVEPVPLTDIPPLVLSEVLRDVDLFVGVASVGNDPTWQDGGPGGRFQEYWTSYGFGELNQSAETRRALLERLIPRLAIADRCSIEGRFLHVKGERHTYKIHLGSGNILMTPNDQYLCIVPKASAAAPGTGYLPFEGDRTLAVVLSKATMLAKDTEITDPTILSQL

SEQ ID NO: 10940 - protein, 164 aa, Streptomyces avermitilis
VGVTRWGEAVGIPPGPPVLIDPGALSVVPRTVGGMGLVTFVDETTSGNRGGGWGLEIAEERLALRELIRRRVFQEVAEYNARTPQVFQGLVQPEDTERVLNGYAVRPGRRIDPEAQTRLALKAFAGNGFLVLVGDRQITGLDEEIELTLGTEVTFLKLVALVGG

SEQ ID NO: 10941 - protein, 137 aa, Streptomyces avermitilis
MSDDQSYELLGFDNVLLPVGDLDEAVAFYELAGFPLAFRLDEAGIALLKVGGETPGVLLRQEDELTRRPPLWASPRVWLEVRDARIAARTLAGAGVTPLDAPFPVATGWTVEVADPWGNVIGFTDYSKRPELGRRSA

SEQ ID NO: 10942 - protein, 135 aa, Streptomyces avermitilis
MDLTVVAYVIYLLVSISLTIWVARTLSHNGRIFLADVLHGNEKLADAVNHLLVVGFYLVNLGFVALYLNSDDEIADARGIFEALSTKLGVVLLVLGVMHLGNVYVLNKIRRRGVMEREQLPPVAPQGWVAPTTGA

SEQ ID NO: 10943 - protein, 172 aa, Streptomyces avermitilis
VSGMTSPATAGPDRDAARVPVRGLTVLYDAQCSLCTFLRDWLVKQRQLVPLELLPAGSDRARARFPALDHRATLDEITVVGDSGQVYRGSAAWVVCLWALREQRPLAHRLSTPRGAVFARGAMLAAAKWRETRQGGQWGGGSYHVGDGWTYHPASGWTYSPPGCDSGTCSTG

SEQ ID NO: 10944 - protein, 265 aa, Streptomyces avermitilis
VPAKNDSPETGPPAEEGAALTKSEQTRALILETAMRLFQERGYDKTTMRAIAKEAGVSVGNAYYYFAGKEHLIQGFYDRIAAEHQEAVREVLDRETDLEARIGGVLKAWLDIATPYHEFAVQFFKNAADPDSPLSPFSAESEHARVEAISVHREVLAGTRTKVPDELRDVLPELMWLSQMGLVLYWVFDRTEGRERSYRLAERGARLTARGVSLARFRVLRPLVREVHELFTDFLPGMTNALPDPAKAKKRQGNPPGAPASADAP

SEQ ID NO: 10945 - protein, 809 aa, Streptomyces avermitilis
LSVTALARWCYRHRLVVLLLWVGALFGLGFAASTAGTDYANVFSLPNTDSKRAYDLMEKAFPDSAGDTDTVVWKVDGGTVEDPSVRSRIQPALDEIGRMKGVGGVTSPYAGTQGAAQVSGNGRIAYAQITFTEQANAVPKELVQNVVDTAQKAERGGLQVELGGQAIQRVQEPPTGIAEIVGILAAAVVLFLAFGSLFAMLLPIGIAVFGVGTGLFSTQLLSHATDIPDLAPLLATLIGLGVGIDYALFIVTRHRRGILRGMAPEESVVTALNTSGRAVLFAGGTVCIALAGMLVTNLRFLDGVVIGTSLTVVLSVLAAVTLLPALLGFLGTRVLSRRQRRRLAAEGPEPERASGLAARWSTNVQRRPRSIAVMALVVMAILAIPVLSLRLGATDQGNDQASTTTRKAYDLLAEGFGPGFNGPLQVVSDGGDANALVRGIEATDGVARVAALPPARGVTVIQVVPTTSPQSERTDRLIDTLREKVIPDAGANAHVGGVTAISKDFSSVTGERLPYFIATIIGLGFLLLMLAFRSLVVPLTAALMNLIAAAASFGVLVAIFQWGWGLELLGLGKEGPVNAFLPVIMLSLLFGLSMDYQVFLVSRMHEEWVHTKDNARAVRVGLAETSRVINSAALIMVCVFLAFVLSGDSGAAMAGVGLAAAVALDAFILRTALVPAAMHLLGNANWWLPAGLEKRLPHLAVEPQEDAVAEPAAEGGATVVHGFVRDAEGGPVDSAILTLLTPGGRQADRVTSLADGSYILSAPASGTYLLAVTATAYAARARHLSVGTEPLVYDVELTADEVDEVDAVN

SEQ ID NO: 10946 - protein, 243 aa, Streptomyces avermitilis
MTAHEGATVLVVEDEPSIADVLTIALRYHRFEVLTAGTVRQALTLAERTRPRAPGSARAGGTPIDLALLDVMLPDGDGRALGRELRLRQPDLAVVFLTARDAPAEIVGALGFGDDYITKPFNIDEVVARITAVLRRTRPADALPRRPPLRYGDLELDETTYSARRAGHTVELTPTEYALLRFLVRNGGRIVTKEQLLRHVWQYEHTPAESTVVETYISYLRRKLEPLGPPVIQTRRGVGYGLA

SEQ ID NO: 10947 - protein, 481 aa, Streptomyces avermitilis
VSVRRPRRHHGIHSLRGQLTLTNVGLLALGIVVATAVSIMGMRHYLLDQIDAELSQTRDSLGGSQLTLRQIDSLSTLAFARDLFVPHTDETPKPDSVFAAVDGHGKAVAIGGLEPTATQRALAEAVDDPRGLADDTDPHDVTVRGAPYRATAVRLADGTFVLLATSTDALHKGNAKALKLDMAIGTLLLALLACLTMFSVRRRMRPLEDMVETSSAIAEGDLTRRVPSSHHPTQEVEQLRLALNSMLHQVESAYRTRERSASQLRRFVGDASHELRTPLSAIRGYLQLYEKGMLSDPDERRRAWDRMNGEVDRMGRLVDELLTLARLDQRPELRVRNVDVTRLVRDAAQDLRAQQPGRPVTVGADGALLVQADESGLRQVLGNLVGNVRTHTAADVPVRLGVERADGVVRLCVADEGPGLAEDDAARIFDRFFRAGGGAGSGLGMAIVQGVVTAHGGDVTVRTAPGEGLAVTVTLPTRGEE

SEQ ID NO: 10948 - protein, 429 aa, Streptomyces avermitilis
VVVVFVLVGLAVLVAFGALHWYAWRRLVRDTTRGPGLARRTGTVVIVTGPVLMFGALIAERTGAPFWLQRVLAWPGFLWMAFSLYLLLALVAAEFVRPLVRRLVEREAPAEVAVPQPERVPAGTAGTAATEPEPEVESAPEPKRPEPAGPPRAAAPSRRLFVSRVVGGAAAAAAVGTVGYGTYGVLRGPRVKRVTVPLAKLPRSAHGFRIAVVSDIHLSPVLGRGFAQRVVDTINSTQPDLIAVVGDLVDGSVQDLGPAAAPLSQLKARHGSYFVTGNHEYFSGAGQWVEEVRRLGLNPLENARTELPAFDLAGVNDVAGESEGQGPDFDRALGDRDTTRAVVLLAHQPVQIHEAVRHDVDLQLSGHTHGGQLWPGSLVAAAANPTVAGLERYGDTQLYVSRGAGAWGPPTRVGAPSDITVVELASKQA

SEQ ID NO: 10949 - protein, 80 aa, Streptomyces avermitilis
MKLSRPVSWFLLAFGVWSWVIWITFVKNLWKDGSGLAFDDAGDPTAYFWVHLTLAVVSFVLGTVVGVIGLRGLRALRHRS

SEQ ID NO: 10950 - protein, 447 aa, Streptomyces avermitilis
VPASNRTARRRLPVTSAALLSLLTLSLTAPATAFADGSPAATPTATPTGTPTTTPTGTPTATLSATPPSGMSTIGGDQLGSPGTQVNLGSGAPVIPKDITARSWIVADAESGDVLAAHNAHWRLPPASTLKMLFADTLLPKFPKNTEHKVVPSDLAGMGAGSSVVGIKENETYTVHDLWLGVFLRSGNDAVHVLSAMNKGVGQTVEDMQEHARELQALDTHVVSPDGYDAPRQVSSAYDLTLFARSGLQKKDFREYCATVRAQFPGETTKKKGKTTRGSFEIQNTNRLLAGDSDITPYQGIAGVKNGNTSNAGATFTGVAERNGKVLLVTVMNPEKNEHNEVYKETAKLLDWGFGAADKVTPVGELVAPQGADTSAQPGANAPVSPGAGADKESAKPVAADLKDGGSSGVGIALAVTGGVLVLLVAGGFLVNRRWPLPDLVRRRTRR

SEQ ID NO: 10951 - protein, 344 aa, Streptomyces avermitilis
VRRNRPGARHCPAFSGYPDPGFPRGSRRSGSSRRGKSRIMDWLKSLPGIGPLIARLMTTHAWRSYERLDRVKWTQLAAAMTFISFVALFPLLTVAAAIGAAALSEEQQKTLQDKLAEQVPGISDQLDIHALVQNAGTVGVIAGAVLLFTGIGWVGAMRDCLRAVWELDDDEENPFLRKLKDGGVLLGLGGAVLVTLATSTVASAMVGWTADRLGIERDGWGSVLLHITAFLVAVLADFLLLLYVLTLLPGVEPTRRRLVVAALIGAVGFELLKLLLSGYIQGVASKSMYGAFGVPVALLLWINFTSKLLLFCAAWTATPSDGPAEEEVSGASDDVPDRAAASGG

SEQ ID NO: 10952 - protein, 254 aa, Streptomyces avermitilis
VVFMKDAFGAPQSLLILGGTSEIGLATARRMIARRARTVWLAGRPSPALEQAAEALRSLGADARTVAFDALDPESHETVLGKVFAEGDIDMVLFAFGVLGDQADDERDPVAAVRVAQTNYTGAVSAGLVCARALQTQGHGSLVVLSSIAGERACRSDFIYGSSKAGLDTFTQGLGDALHGTGVHVMVVRPGFVRTRMTAGLAEAPLATTPEAVATAIELGLRRRSETVWVPGALRAVMSALRHVPRPVFRRLPV

SEQ ID NO: 10953 - protein, 193 aa, Streptomyces avermitilis
VGTVTIGVSIAVPEPHGSLLQERRAGFGDAAAHGIPTHVTLLPPTEVDAAALPAIEAHLLEVAGAGRPFPMKLSGTGTFRPLSPVVFVQVAEGAEACTWLQKQVRDASGPVARELQFPYHPHVTVAHGIEDEAMDRAYEELADYRAEWPCTGFALYEQGPDGVWRKLREFTFGGPVVPPQAGAPAERNSTPAC

SEQ ID NO: 10954 - protein, 337 aa, Streptomyces avermitilis
MASDRPRVLSGIQPTAGSFHLGNYLGAVRQWVALQESHDAFYMVVDLHAITVPQDPADLRANTRLAAAQLLAAGLDPERCTLFVQSHVPEHAQLAWIMNCLTGFGEASRMTQFKDKSAKQGADRASVGLFTYPVLQVADILLYQANEVPVGEDQRQHIELTRDLAERFNGRFGETFTVPKPYILKETAKIFDLQDPSIKMSKSASTPKGLINLLDEPKATAKKVKSAVTDTDTVIRYDAEHKPGISNLLTIYSTLTGTGIPELEEKYTGKGYGALKTDLAEVMVDFVTPFRERTQQYLDDPETLDSILAKGAEKARAVAAETLSQAYDRVGFLPAKH

SEQ ID NO: 10955 - protein, 207 aa, Streptomyces avermitilis
VLGAPQAGALGRDDGHGRDIPDLALVIAGGSGRTVVLRSGQRDFARIWQLLGPMNVGTEKVPDAWARGRYPKVRATVVWGLTGIGGWPYTDRAPGGDVGIERQDQVFLAEDGTPWVRTDPAPDVADDDVRWHRATRSVFAEVNRSGLFGAAPAPPADEGPSAVRWGVWGLGTGLALGVGGTLLVRRTAARREGAGPPREPRQELIDL

SEQ ID NO: 10956 - protein, 482 aa, Streptomyces avermitilis
MPEQPLSTESTAFRSALDVIRAVEPRVADAIGQEIADQREMLKLIASENYASPATLLAMGNWFSDKYAEGTVGRRFYAGCRNVDTVEALAAEHARELFGAQHAYAQPHSGIDANLVAFWAVLADRVEAPALAKAGVRNVNDLSDADWAELRRAFGNQRMLGMSLDAGGHLTHGFRPNISGKMFDQRSYGTDPATGLIDYEALRTSAREFKPLIIVAGYSAYPRLVNFRIMREIADEVGATLMVDMAHFAGLVAGKVLTGDFDPVPHAQIVTTTTHKSLRGPRGGMVLCDDSLKDQVDRGCPMVLGGPLPHVMAAKAVALAEARRPEFRDYAQAVVDNSRALAEGLVRRGATLVTGGTDNHLNLIDVASSYGLTGRQAETALLDSGIVTNRNAIPADPNGAWYTSGIRIGTPALTTRGLGTAEMDEIAGLIDRVLTTTEPGTTAKGAPSKAQHVLDPKIADEIAHRAGDLLTGFPLYPEIDLG

SEQ ID NO: 10957 - protein, 417 aa, Streptomyces avermitilis
MGRGVTRRRAVGNGVLVSTTETLIASADAHSAHTYHPLPVVVATADGAWMTDVEGRRYLDLLAGYSALNFGHGHRRLIDAARAQLERVTLTSRAFHHDRFAAFCTQLAELCGMEMVLPMNTGAEAVETAVKTARKWGYRVKGVPAEMAKIVVAGNNFHGRTTTIISFSTDPEARADFGPYTPGFEIVPYGDLTAMRSALTENTVAVLLEPIQGEAGVLVPPAGYLAGVRELTRDRNVLFVADEIQSGLGRTGRTFACEHEGVVPDVYVLGKALGGGIVPVSAVVASSEVLGVFRPGEHGATFGGNPLACAVALEVIAMLRSGEYQARAAELGEHLHRELGVLAGTGRVTAVRGRGLWAGVDVDPAYGTGREISEKLMDRGVLVKDTHGSTIRIAPPLVISKEDLDWGLAQLRGVLGV

SEQ ID NO: 10958 - protein, 395 aa, Streptomyces avermitilis
MERRTIDPRPGWQQTVEAQGLIYPLTRYPDDSLRPYWDESAYYVFSLPEVEALEETVEELHRMCLAAAAHIVEQNRFADLGIADPRLAALVAEAWHRRAELPSVYGRFDLRYDGTGPAKLLEYNADTPTSLVEAAGPQWFWMEDRFPGADQWNSLHERLVDAWKKQAALLPPGSPLYFAHSAADELGEDLMTVAYLKETAEQAGLDTDWISMEEIGWDPLSGRFVDNQLHFIRSCFKLYPWEWLTGDRFAGHVLDTLDNGGGTGSTLWIEPAWKMLLSNKALLAILWELYPGHPNLLPAYLDGPRDLATANGYVAKPLLGREGAGVTVHAPGAAPVVREEEPCCYQELAPLPAFDGNHVVLGAWVVEDESAGLGIRESSGLITDEYARFLPHVIL

SEQ ID NO: 10959 - protein, 120 aa, Streptomyces avermitilis
MANSRRQLRSGTVVLGGMGLLAAALTACSSDEPDKRCVDRDSYNLGKGGYKVVADKNCKTGSSGSGKVSSGYTWYYGGDRSKSRIDSGSFTKPSKGSGGSSGGGGVDRGGFGSGKGGSGG

SEQ ID NO: 10960 - protein, 274 aa, Streptomyces avermitilis
MMCALGAAVCFGTATVLQAIATREAATTGPGGDAALLLRALRQWRYLAGLALDGLGFLLQIAALRSIPIYAVGAALAASLAVTAVVAARLLHVRLSGVEWAAVGVVCAGLGMLGLASGAEGDRAGSTALKYATLATAVAVLLLGLVGGRMSGRGRALVLGLGAGFGFGVVAVSVRLIDDLAPATLLTNPATYALLIGGGAAFILLTSALQRGSVTTATAGLVIGETVGPALVGVIWLGDRTREGLSWLAVLGFVVAVAGALALTRFGEAPVEEG

SEQ ID NO: 10961 - protein, 139 aa, Streptomyces avermitilis
MPETDSAADSWEYSLYIPQDLRAVTVCRRTLRLVLTLHHLTHLADTAELLASELVSNAVLHTKGPACLRVRYRDGLLQIGAWDADPEPPEPPGRLEELTDAESGRGFALVRACSDVWGWQPLSRLGHRGKLVWCELGAA

SEQ ID NO: 10962 - protein, 283 aa, Streptomyces avermitilis
MATRRHPTARQARLGSELRKLRDAAGLKATAAATLLGVSSVQMSQIESGIAGVSEERIRRLAANYACSDSALIDALVVMATDRTRGWWEEYRGVLPAAYLDLSELDHHATFRHDVAVIHVPGLFQTEDYARALFSYMNPEFPESEVEHRVHHRMKRRVVIEGPTPIPYEAVIHEAALRIKVAGRPASCAQLTRVAELSEEEHISVRVIPFGLDDFAGAGSAMVYVGGAVPRLDTVVRDAPHGTAFVDSEAQLDHFRTLFRRVKGESLDPGQSRDLIHKLIKEL

SEQ ID NO: 10963 - protein, 66 aa, Streptomyces avermitilis
MATRLKWQKSSFSGGGEGNDCLELASTPTTLHLRESDTPTTVLTTTPTTLAHLLAGIRAHAVPGQA

SEQ ID NO: 10964 - protein, 478 aa, Streptomyces avermitilis
MAKSWATFGVDLHVEPTGPGIRRGLTEALREAVRGGRLAPGTRLPSSRSLAADLGIARNTVAEAYADLVAEGWLTARQGSGTSVARRPVPTPTAASAPGRPTRARPVYDLVPGTPDLSSFPRAAWLKASRRALTVAPHEALHYGDPRGRVELRTALAGYLARARGVRTDPEHIVICSGFLHGLMLLGQVLRGRGLTSLAVESYGLDAHWRLLEAAGLRTVPLGFDELGTRTEELAAGAQGGGALGGVRAVLMTPAHQFPMGVPLHPDRRARVVDWARRDDGLILEDDYDGEFRYDRQPVGALQGLDPDHVVHMGTASKSLAPGLRLGWLVLPPALAPEVVAAKGGVDWSCGVLDQLTLAEFIASGAYDRHIRASRLRYRRRRDALVARLAEQAPGGRATGIAAGLHVVLRLPPGTEQSTLRAAAWQGLAVHGLDRYRHPESTAERSDALVVGYGTPPDHGWSGALDALCAALPFDSTG

SEQ ID NO: 10965 - protein, 173 aa, Streptomyces avermitilis
MTTNDTTTATTTPTAEYAPEHSPRLNWAKLAPDVYKAMIRLDTAAQRGLDPKLRELVKIRASQLNHCAFCLDMHTKDALAAGESVERVVQLSAWDESRHFYTEKELAALELTEAVTVLTDGFVPDEVYERAAKHFEEAELAQLIAAITVINAWNRFGVTCRLVPGHYQAGQHK

SEQ ID NO: 10966 - protein, 238 aa, Streptomyces avermitilis
MVSGVDLFRALHRGRVPGDPLVLPGPWDAASARVFAEAGFPALATPSAGVAASLGYEDGATPADEMFAAVARIARAVDVPVSADIEDGYGLAPRELVERLLEAGVVGCNLEDSHRGVLQDPARHADRLAEVRAAAGDRLFVNARVDTFVRGVTDPARAIQRAASYVAAGADCVYPIGAPTDVLPLLRSGIQGPVNLLARPGGPSLTALGELGATRITFGPGLQLRATEALREIAAELA

SEQ ID NO: 10967 - protein, 324 aa, Streptomyces avermitilis
MTRHMTRRTRMTTMTAGLAVLLLATGCGAADMTKQASPFAGAQGAKTVTLSVQSWVGAQSNVAVAQYLLQHKLGYRVDTVQVDEVPAWDALSQGRVDALLEDWGHPEQEKRYVQDKKTIAPAGGLGVTGHIGWYVPTYFAEQHPDVTDWRNLNKYASQLRTAESGGKGQLLDGSPSYVTNDKALVNNLKLNYQVVFAGSEAAQITQMRQFAKEKKPFLTYWYAPQWLFKKVPMTEVKLPAYKEGCDADAKKVACAYPHTPLQKYLNADFAKSGGKAARFLKKFKWTTEDQNEVALMIADQKLTPEEAAKKWVDGHASTWKAWLS

SEQ ID NO: 10968 - protein, 647 aa, Streptomyces avermitilis
MATATAAASHVGVPAFLRRRAVRKLALLALAAAVLVPLADARWASGTWPHALTVDLTEPLGRASDWIIDNRDSHPLFLYFFGYVSNAVVLAVRGVYLVLLAAGWAGVTAAAALVAWRVAGVRLAAGTAVAFLVCGLLGMWVPTMQTLALMVVAVLASVVLGALLGLAAGLSDRTHRALRPILDTMQVLPAFAYLLPVVLVFGIGVPAAVLATVVYAAPPMARLTALGLRDADGGVLEAVESLGATARQRLLTARLPLARKELLLGLNQTIMMALSMAVIASVIGAGGLGDRVYQALASVDVGAALAAGIPIVLLAVVLDRVTGAAGEGPGADGSRRAGWAYAAAAAVAVALAGRFTHRLDWPDAWTVHIAAPVNRVVDWMTDHLYSGVPYLGGTADWAGHFTTWVLDPLRDGLQWLPWWSVLLIVAALAWLIGTWRTALTAVLAMAAIGVLGVWKPSLDTLAQVLAAVAVTLVLGFATGVAAARSDRVERLLRPVLDVFQTMPQFVYLIPVVALFGVGRAPAVAAAVVYALPAVVRITTQGLRAVDPAALESARSLGATGGQQLRQVQLPLARPALLLAVNQGVVLVLAVVIIGGLVGGGALGYDVVFGLAQGDLATGLVAGAAIVCLGLMLDRVTQPTGRRAKKGA

SEQ ID NO: 10969 - protein, 389 aa, Streptomyces avermitilis
VMSTPPQNTRPVFSVDGLWKVFGPKAERVPADPELAALSAAELSERTGCTAAVRDVSFDVHKGEVFVVMGLSGSGKSTLVRCLTRLIEPTAGTIAIDGEDVRAMDRTRLRELRRHRASMVFQHFGLLPHRTVLDNVAYGLEIQGLGKAERRERAAEVVAKVGLEGMEQRKPGQLSGGQQQRVGLARALAVDPEVLLFDEPFSALDPLIRRDMQEEVVRLHREEGRTMVFITHDLNEALRLGDRIALMRDGRVVQLGTPEEIVGSPADDYVREFVRDVPREQVMTVRTAMRAASAEEAGSGPAVAPDATVSEAIEAVARAGSPARVVDSGRCVGVVDSEALLDVVAGVGASGPAPAVTAVPPFEPSRDFGNAGAGAAEAAPGDVTGEEVA

SEQ ID NO: 10970 - protein, 516 aa, Streptomyces avermitilis
MHENSYENSHENSREYDYVVIGGGTAGSVIASRLTEDPDVTVAVIEGGPSDVGRDDVLTLRRWMGLLGGELDYDYPTTEQPRGNSHIRHSRARVLGGCSSHNTLIAFKPLPSDWDEWEAAGAEGWGAVPMEAYYARLRNNIVPVDEKDRNAIARDFVDAAQAALGVPRVEGFNKKPFTDGTGFFDLAYHPENNKRSSASVAYLHPFLDRPNLHLLLETWAYRLELAGTRATGVHVRTKDGEEILVRARTEVLLCAGAVDSPRLLMHSGIGPKEDLEKLGIPVAHDLPGVGENLLDHPESVIVWETDGPIPENSAMDSDAGLFVRRDPEHAGPDLMFHFYQIPFTDNPERLGYERPEHGVSMTPNIPKPKSRGRVYLTSADPSVKPALDFRYFTDEDDYDGRTLVDGIKIAREIAKTEPLARWLKREVCPGPEITDDEELSAYARQVAHTVYHPAGTCRMGATSDEHAVVDPKLRIRGLDGIRIADASVFPTMPAVNPMIGVLMVGEKCADLLRGDA

SEQ ID NO: 10971 - protein, 509 aa, Streptomyces avermitilis
MAGQQARQAGQTQRTIHVGGEWREADSRATREILDPADAKPFAVVAEGDERDADAAVAAARRAFDSGEWPHTPVAERAALLRRVADLLVRDRESLGLLESRDAGKTLEEGRVDIDCVADAFRYFADLVVGEGGGRVVDAGSPDIHSVVVHEPVGVCAMITPWNYPLLQASWKIAPALAAGNTFVIKPSEITPLTTAALVDLLVEAGAPAGVANIVTGPGHTVGARLAEHPDVDLISFTGGLASGTKVAQAAAVSVKKVALELGGKNPNVVFADACATDEDFDTAVDQALNAAFIHSGQVCSAGGRLIVEESVRERFVAELVRRAGRIRLGRGTEDGVECGPLVSEQQRDKVEGYVASALSEGAVLRTGGRRPEPSDVRPAAGYFFEPTVLDQCHRGMKVVREEVFGPVLTVETFRTEDEAVALANDTEYGLAGAVWTSDAGRARRVAGRLRHGTVWINDFHPYLPQAEWGGFGKSGVGRELGPAGLAEYRETKHVYQNLAPKPVRWFAG

SEQ ID NO: 10972 - protein, 412 aa, Streptomyces avermitilis
VWVGQGDEMQQRRDPDRQQWSGDGHDDGHGGGHDGGNDGGNDGGERAEPSRDTPLWQRPPVPPSDEAPDTPWWAGAETQAAGVRPPAPPSPPTEEPWAAPPTPEEPWSSPPSPSAEEPWSSPAPAPPEEPWAAPPPAEEPWSPPPSASTPWSSPPPPPPPDSWSSPVPVVGGGTPPGSGGSRRTLVLVAVLAVLAGAGVGVRAWVLTRDDSTEHTGAAGAGPSVTVTATATAGEDAAGQGGSTLSDGDSVGTDAQPSSAAAQPSPGYSRAVDPVGYTVDVPQGWVREEKRGVSAEVVTYASPDDGRTLKLFQVVENTPAESLDLAENGPGGFDGLADFHVLDRSSGADWARLDYRYDDPKSGTTQVIDHRFTAADGTLYAIRSSGPSGLDVAEPFTVALNSFCPTGASCTSP

SEQ ID NO: 10973 - protein, 329 aa, Streptomyces avermitilis
MTRTPVNVTVTGAAGQIGYALLFRIASGQLLGADVPVKLRLLEITPALKAAEGTAMELDDCAFPLLQGIDITDDPNVAFDGTNVGLLVGARPRTKGMERGDLLSANGGIFKPQGKAINDNAADDVKILVVGNPANTNALIAQAAAPDVPAERFTAMTRLDHNRALTQLAKKTGSTVADIKRLTIWGNHSATQYPDIFHASVAGKNAAEVVNDEKWLAEDFIPTVAKRGAAIIEARGASSAASAANAAIDHVYTWVNGTADGDWTSMGIPSDGSYGVPEGLISSFPVTTKDGRYEIVQGLEINEFSRARIDASVKELEEEREAVRALGLI

SEQ ID NO: 10974 - protein, 420 aa, Streptomyces avermitilis
MPRWKALPDELDPQVREFASQLRRLVDRSGLSIAAVADRTGYSKTSWERYLNGRLLAPKGAIVALAEVTGTNPIHLTTMWELAERAWSRSEMRHDMTMEAIRISQARAALGESGAPPAAGRNGKAARGATVLPGVAGPAGVSPTIPPQPTAPDVQDSSGEARRGALRGGSSGGSSGASAASSGGNSWGLAGYAGPAQADGRAPAAPTGRSGSPEKGGPRSPGGPGRTPEAAAHGAPGGQPPRDSGPPAVGSPDGARRKRRLTMFLAGVVGALVVIAAAVFLTNNGGDKDNETAPKSPAASASADPDLPAGVKCSGKSCTGKDPENMGCGGELAKTSNSVTVGTTLVEVRYSKTCGAAWARITRAVPGDEVTVASGASAKQTGTVEAAADTDAYTPMVAVKDAGEAKACVTLKAGQKGCTT

SEQ ID NO: 10975 - protein, 170 aa, Streptomyces avermitilis
MMGAWQPLPDDLPPEVRHFVEQLRLLKDRTGLSLVALGARTAYSKSSWQRYLNATQPPPRQAVAALCRVAGLAESEAERFGVRWELAVHAWPRPPAPAPAHAGGPTGGPTGEPMGGPAPGAYEDDPTLPWWDARDNVPEPRWSPTRLLAVAGVIAVALLLCVLIGAFALT

SEQ ID NO: 10976 - protein, 178 aa, Streptomyces avermitilis
MRKHIRTAAVAAVLAAGTALGSIAAVGTALASEDTGFVDGKAGTHDDWNDEGTLAKDDTSNAVALWQTVLWADGAKWKAKNGTLKSFTQDDITGDFNSRTVSATKFWQAGNGLKQTGKADGASFSLADNNLGSANKKGLVIYDGVIDETVQFKRLTVAGVTQQVYFVKVDDEWVAAAY

SEQ ID NO: 10977 - protein, 205 aa, Streptomyces avermitilis
VAERGMGEWAPLPADLGREARALAESCRLLKERTGLSLAALAERTHYSKSSWQRCLNGRQIPPRSALRFLAEAAGADPARLLGLREAVLRSGRGPLAPPGPRQPSDGRGPSHGRGEPAEAVPQEAMPQDASPASPAESGRTAREERRAGKSVPASAAPTAPLAAAVRRWRLIAAVLLALLLAVTGTALAVIGQGRTDCEPVTTNP

SEQ ID NO: 10978 - protein, 209 aa, Streptomyces avermitilis
VRDASVEGVGGGPAAEDANGGPAVRDASGAPATEGGPAADGESGAPAVAEASGSPVERDANGGPVVLDAVSAPDADGKPRRTTRRFPSFTRDTARPEGGGRAASSDAPAPARQWPILTVLTAVGLGLLLTALDVVRFGTVLIGVALLAGAAMRWVLPDVGMLAVRSRFTDMVTYGVLGVAIVLLAMMAQPNPLLEIPFLDDTLHFTIRT

SEQ ID NO: 10979 - protein, 284 aa, Streptomyces avermitilis
MTAQILDGKATAAAIKSDLTARVAALKEKGVTPGLGTILVGDDPGSQKYVAGKHRDCAQVGIASIQRELPATATQEEIEAAVRELNEDPACTGYIVQLPLPKGIDENRILELMDPDKDADGLHPMNLGRLVLNEPAPLPCTPNGVLTLLRRYGVEIKGAEVVVVGRGVTIGRPMPLLLTRRSENATVTQCHTGTRDLSSHLKRADIIVAAAGSAHLIRPEDVKPGAAVLDVGVSRSAEGKIVGDVHPGVAEVAGWISPNPGGVGPMTRAQLLVNVVEAAERSVG

SEQ ID NO: 10980 - protein, 223 aa, Streptomyces avermitilis
MSFGAPDNPYGQPQNPQQGYGYPQQGQPPYPQAPGGIPQQGYGYPQQGQPGYGYPGGPGGPGPRVASMGRRLGARAIDGVAFFVIYFILGAIGVAGSIGAAQDCDPNAADYNTCINNASSDIAAKIGSMIAVLAIVGLLYEWLMTGLVGATLGKLAVGIRVVKADTGQKPGLGSSFIRWIIPLVGSLACGIGQVLVYLSPFWDKSGRQQGWHDKAAGTMVIQN

SEQ ID NO: 10981 - protein, 527 aa, Streptomyces avermitilis
VTAEGTVTAEGTQRPIRRALISVYDKTGLEDLARGLHEAGVELVSTGSTAAKIAAAGVPVTKVEELTGFPECLDGRVKTLHPKVHAGILADLRLDEHRRQLEELGVEPFQLVVVNLYPFRETVASGASPDECVEQIDIGGPSMVRAAAKNHPSVAVVTSPERYADVLSAVRGGGFDLTARKRLAAEAFRHTAAYDVAVASWFASSYAPVDESVFPDFLGATFERKSTLRYGENPHQPAALYVDGGGTGLAEAEQLHGKEMSYNNYTDTDAARRAAYDHAEPCVAIIKHANPCGIAIGADVAEAHRKAHACDPLSAFGGVIAVNRPVSKELAEQVAEIFTEVIVAPGYEDGALEALAKKKNIRVLRAQDAPANPAELKQIDGGALLQVTDRLQADGDDPANWTLATGEALSPAELDELAFAWRACRAVKSNAILLAKDGASVGVGMGQVNRVDSAKLAVERAGEERARGAFAASDAFFPFPDGLEILTAAGVRAVVQPGGSVRDELVVEAAKKAGVTMYFTGTRHFFH

SEQ ID NO: 10982 - protein, 209 aa, Streptomyces avermitilis
VAAKPVAKRLVVLVSGSGTNLQALLDAIEAQGIEAYGAEIVAVGADRDGIEGLARAERAALPTFVRRVKDYDTRDEWDAALTEAVAAYEPDLVVSAGFMKIVGKEFLARFGGRFVNTHPALLPSFPGAHGVREALAYGVKVTGCTVHFVDDGVDTGPIIAQGVVEIRDEDDESALHERIKEVERRLLVEVVGRLARNGHRIEGRKVVIP

SEQ ID NO: 10983 - protein, 312 aa, Streptomyces avermitilis
MPDRSLRLPQLLLRERRPSPPQPTPPREGEDAPAGERDAAGGRSPETPSSGSGSSGSGASTSGSGGSGSSGSSGSSGSGDSGSSEDNPFAPPPEGTPDRPWQPRRPSGGPEGDEHGGPSGQPGQSPWGSQWSDRQPGRSGEGGFGDRQGRPGGPDGQGGQGGGPEGSGGPGGPGAGLRWDPADPAQRRARYALLCGMWAFFFALFSWPYVALLLGALAVYWGASSLRAKPRTPDPDNPAPEATANARPQRTAAISGLVTASLAIVMVAATFTAQLVYSDYYTCTNDALTQTAKQSCNDLLPKNLRGLLGSQS

SEQ ID NO: 10984 - protein, 131 aa, Streptomyces avermitilis
MPSPAGGPGRGKGGEGDVVVATPAPAPAATPAPVLPVPSAVDETSELYDFLPSDAEGSSWYDDAARESRWSALRKAATSPEPTEAAAPTDAREAPAPPEPREVAATPEPREAPSSPEPPEGATPPEPPQAP

SEQ ID NO: 10985 - protein, 110 aa, Streptomyces avermitilis
VAGVVPFAAGVTVGWFTAGAAVADGKARWSRARTAAVAGVASAAVRGRSLDTGTRWRAGRSGVRTLARFGPVGWQVGGATVGWKALVGVPVAVGAWGWRLSGRGPGDGGR

SEQ ID NO: 10986 - protein, 324 aa, Streptomyces avermitilis
MAGVTQLTDHRTPLSPLLTRLPDRSPGLAASLLGGALAAVLGLGSFAVLVTVLWISSPYPDSGPGGALHIGAALWLLAHGVELVRTDTLAGAARPVGVTPLLLLALPVWLVFRAGRDAVDVDEEGDMPPVAARTALSGVVAGYVVVGVAAGVYASGGALRPSWLWTAGCLPLLAVTAAGAGVWTAYGRPRGPLPPLARRALNALPGGVRRFVTADARGWTRASLRAGLAGVAVLVGGGALLVGVSLVWHGGPAQDSFLRLTEGWSGRFAVLLLALVLVPNAAVLGGRVRAGARVRTGGRAYDRAAGHRDSAGAAAAVSAAGGGA

SEQ ID NO: 10987 - protein, 370 aa, Streptomyces avermitilis
VGVSRETVRSWEAGRTTPRGRKREAYARALAGLTAPQPPAADPVDPKPAAPVPAAPETEPPAVRPPAEAPLRQEQPVRVPVGAALTPVSTADEILADTEDPTATTALTPSQAFDALYAFCAPALVRQTYLLTGRRELAREAVERAFQLAWQRWPEVAVDRDPGGWVRATAYEYALSPWHRLRPRHRHPEPPPADAADRVLLEAFLKLPPAHRRTLLLYDGVGLGLPETAAETEASTPAAANRLLHARGAIAARLPELAAPEELHRRLTALASGERLRAARPPTVRTGSEQRARQWTRAAVAFTVVIISATALTLRDAQDHYEPPVAPGATVQGVPPRVAPGPLSRQELELRAKLRSELLNGPERLTPDDH

SEQ ID NO: 10988 - protein, 294 aa, Streptomyces avermitilis
MAIFLNKDSKVIVQGMTGATGMKHTKLMLADGTNIVGGVNPRKAGTSVDIDGTDIPVFGSVAEAIEKTGANVSVLFVPPAFAKAAVVEAIDAEIPLAVVITEGIAVHDSAAFWAYAKSKGNKTRIIGPNCPGLITPGQSNAGIIPGDITKPGRIGLVSKSGTLTYQMMYELRDIGFSSAVGIGGDPIIGTTHIDALAAFEADPDTDLIVMIGEIGGDAEERAADFIAKNVTKPVVGYVAGFTAPEGKTMGHAGAIVSGSSGTAAAKKEALEAAGVKVGKTPTETAKLARAILGS

SEQ ID NO: 10989 - protein, 392 aa, Streptomyces avermitilis
VDLFEYQARDLFAKHGVPVLAGEVIDTPEAAREATERLGGKSVVKAQVKVGGRGKAGGVKLAATPDEAVARATDILGMDIKGHTVHKVMIAETAPEILEEYYVSYLLDRTNRTFLAMASVQGGMDIEEVAEKTPEALAKVPVDAVEGVSIEKAREIVALAKFPAEVAEKVAEVLVTLWDTFVAEDALLVEVNPLAKVASGDILALDGKVSLDENAEFRQADHAALEDKASANPLEAAAKEKNLNYVKLDGEVGIIGNGAGLVMSTLDVVAYAGENHGGVKPANFLDIGGGASAQVMANGLEIILGDPDVKSVFVNVFGGITACDEVANGIVQALQLLADKGEEVTKPLVVRLDGNNAELGRRILSDANHPLVQRVDTMDGAADKAAELAAAK

SEQ ID NO: 10990 - protein, 628 aa, Streptomyces avermitilis
MNKNIRRSIVIAAGVTGAWALGSAVASADELPAPSVSVPDAADATDASDASVDTTDPLGAVTGTVDGVVSGVQDTATGLTGTNGTTARVTDATTSTVTDAAGQTKTTAARTTSTATTATTAAADQADQARRYVDAEVPVSHLSHAHTANTTHTVHAARGKATAVADGATRAVDAAVSDAGAPRGGIDYLFGPLSAFAPELEQALAAAQTKLQGAQDAAQPKAQGVQGLVQTKAQTTTAGAGRTAAGATSAAHHAVGYAQGRATGTVAAARGTAGEVTTAAHATASAVPGHLTGTVTGVEQQAVGSVFGTVAGVPGTVQGVTATVTPVVDGTAAAVVPPVAVTAVDGVAPLADHAAGNATGLAYGVVADVQPLARDAAGHATTLAYGVTGDVQPLASGVVRDAVHETAASVLPPVAATAVHGVVPVAGQAAGDATGLAYGVVGDVRPFAGGVVGQVPPLAQGVGGSATGLGHGVTDEVQPFTNGVVGSVHPAVDTVVGSVHPAVDTVVGAVRPVVDTVTGAVRPVVDTAVGAVGPVVDGVGGSATGLAYGVVGDVQPFAGGVAGAADPFARGVVGQVGPFAQDLTGTVESAGGPLAGHAVTGVQGVAESVTPGYLPHVQHTGAYGTYSI

SEQ ID NO: 10991 - protein, 394 aa, Streptomyces avermitilis
VSAVFRSVPPRFVTFRRTEAPPVLTLPAALPFSGAALRVMRGAAGRRALHVVVLVGGLFALGLLCGEQVHAADGTPTVSTAAETVSGTAPGAAPPAFVRSVKGTARQAGRTISSAAAQEPKGAPTPAARPVRPEATAVPSAPKGSPGTPSRANAATPSRANAGTPSRANVGPVADVTKTAPAVQRVVRPVAVGLAGGVVRPVGDLADTVADGLADASSQVPVPSFPSPPSPPSPPSLPPLPSLPALPEPPSLPGLPGLSGLPTSPVQTLPAPASPRQPGGTAAHAGSAEQRETQESPAAYGPPAVGASSAGGNVMHRAPHGAGPAQAPAQQAPGDPTGELGPQSAVDNGAPRHGDAHAVTLDHRAPLRLVPGATAVVTADGTRDRYRDIPEFPG

SEQ ID NO: 10992 - protein, 349 aa, Streptomyces avermitilis
MDGALTALYGKGDKPQTGRDRSAGLGASAPSVARWLGDIRTYFPSSVVQVMQRDAIDRLGLSTLLLEPEMLEAVEADVHLVGTLLSLNKAMPDTTKETARAVVRKVVEDLEKRLATRTRATLTGALDRSARITRPRHHDIDWNRTIAANLKHYLPEYRTIVPERLIGYGRASQSVKKEVVLCIDQSGSMAASVVYASVFGAVLASMRSIATRLVVFDTAVVDLTDQLDDPVDVLFGTQLGGGTDINRALAYCQSQITRPADTVVVLISDLYEGGIRDEMLKRVAAMKASGVQFVTLLALSDEGAPAYDREHAAALAALGAPAFACTPDLFPEVMAAAIEKRPLPIPDTA

SEQ ID NO: 10993 - protein, 808 aa, Streptomyces avermitilis
VAGDEEAQSVGVGVGVDVAVGGGGDGGERPLLLGVRHHGPGSARAVRAALEAARPRAVLIEGPPEADALIPLAGDEEMRPPVALLAHAVEEPGRSAFWPLAEFSPEWVAIRWSLEHGVPARFIDLPATHTLAWDKEEPAAEKEPLPQPVDEAVRVDPLAVLAEAAGYDDPERWWEDVVEHRGTGGDVFAPFTVLEEAMGALREAYGTGGHERDLVREAYMRLQVRAAQREFGDDVAVVCGAWHVPALRRKATVAADRALLKGLPKVKTDMTWVPWTHRRLARASGYGAGIDSPGWYGHLFGVPDRPVERWLTKVAGLLREEDRIVSSAHVIEAVRLAETLAVMRGRPLPGLTETTDAVRAVMCEGSDVPLALVHDRLVVGDVLGEVPESAPAVPLQRDLTRLQRRLRLKPEPLEREVELDLRKETDAERSRLLHRLRLLRVAWGEPAASRGSTGTFRETWRLRWEPELSVRVAEAGVWGTTVLAAATAKAEADAVAAQALAEVTALAERCLPAGLPGALPVVMRVLADRAALDTDVGHLAQALPALVRSLRYGDVRGTDTKALAGVATGLAERVFVGLPPACAALGTEAAEEMRRHVDAVHGAVGLLGEGTAARQGDEGSGQGGTGIRERWHSVLRVLSGRDTVPGVIRGRAVRLLLDDGALAQDEAARLMGLVLSPGTAPGDAAAWIEGFVGGGSGGGMLLVHDERLLGLVDAWLTGVPAEAFTDVLPLLRRTFSAYEPGVRRTLGELVRRGPGARGSAAAVGSGTPGYATDLDTERADAVLPVLRLLLGLDDLADGDTNDLVGVTR

SEQ ID NO: 10994 - protein, 402 aa, Streptomyces avermitilis
VSVEPTSVDPSPDKSAPANASGRADASARPSTGESARPSGGETPEVLRPHAEVTFAAELAALAAQDDRPRPVRWRLSPWAVATYLLGGTLPDGTVITPKYVGPRRIVEVAVTTLATDRALLLLGVPGTAKTWVSEHLAAAVSGDSTLLVQGTAGTPEEAIRYGWNYAQLLAHGPSRDALVPSPVMRAMADGMTARVEELTRVPADVQDTLITILSEKTLPIPELGQEVQAVRGFNLIATANDRDRGVNELSSALRRRFNTVVLPLPESADAEVDIVSRRVDQIGRSLDLPAVPDGVDEIRRVVTVFRELRDGVTTDGRTKLKSPSGTLSTAEAISVVTNGLALAAHFGDGVLRASDVAAGILGAVVRDPAADRVIWQEYLEAVVRERDGWMDFYRACREVSA

SEQ ID NO: 10995 - protein, 404 aa, Streptomyces avermitilis
VWGLCKGSGSKPYQTVVDIADATGPAYKCSCPSRKFPCKHALGLLLLWAGEDGAVPLGQAPDWAEQWTRGRKQRAEEKRTASTAGSASGDPEAARRRAERRAERITAGAAELEQRLADLLRGGLAAAEREGYGLWEETAARMVDAQAPGLAARVRELGAIPSSGPGWPVRLLEECALLHLLDQGWLRREDLPDGLAATVRSRIGLPGSPDGPPVRDRWLVLAQYDTSDSRLTTRRIWLHGEASGRTPLLLSYGAAGRAPELTLPVGLAVEAEVSAYPGAGQLRAALGEQFTPPAPASTRPPGISPAEAAARYGRALRDDPWLDSFPVTLGRVVPTPADDTWQLADAYGDLALPLTPAARSRPGLWRLIALSGGAPVTVFGECGHRGFTPLTAWPEETGEAVALC

SEQ ID NO: 10996 - protein, 546 aa, Streptomyces avermitilis
MSTSPAPAPTPGSPAAPSVAPWEELVTVALLGTDRRTPPGPASGREAPAALLDIAAVETVRRRAGLRPARAAARPEPAAADPRPQLPPAAARRLSMLLADRPGTGGGGRRGAAPDLMELLPQWLSLANARGFAAPPQTLPTLLDAARGRTDLRPAVLAFAGPRALWLARLNPDWRFALRAAPGGGAELPLPQESDRIRQLWQEGLFAERVALLTTLRAQSPETARELLATTWATERAEDRLMFLDSLRAGLAAADEPFLEQSLSDRSRNVRATAAELLSALPESALAGRMADRAGSCVAVDRTRRVPTLVVEAPHECDAGMERDGVVAKAPAGRGERSWWLGQLVEAAPLGTWQNRLGGRTPEEVVALPVADDWRSELHAAWCRAAVRQRDPRWSRALLGSPSAPEAGGPGAVSLAERAKLLATLGAAERADWVAGFVATHGLSEAFQLLGVCAVPWAAPLGRAVVDALNIARDAGSYPWSFSGVMGLAERCLDPAEAGRLDALTAVPDEPEDASPGAGGYWAEAFQRLTTTLRLRAAMREELEGP

SEQ ID NO: 10997 - protein, 138 aa, Streptomyces avermitilis
MGVAAGPIRVVVAKPGLDGHDRGAKVIARALRDAGMEVIYTGLHQTPEQIVGTAIQEDADAIGLSILSGAHNTLFAAVIDLLKERDAEDIKVFGGGIIPEADIAPLKEKGVAEIFTPGATTASIVEWVRANVRQPAGA

SEQ ID NO: 10998 - protein, 286 aa, Streptomyces avermitilis
MKVTGAVQPFLPLCRCLFPSKLAGLSVALLKATALEIAILAGHLILYPSGIAQERRAGPPPLPAETAPLPTEAKPPVVLLHGFIDNRSVFVLLRRSLTQHGRQQIESLNYSPLTCDIRTAAELLGRHIEVICERTGHARVDIVGHSLGGLIARYYVQCLGGDIRVRTLVTLGTPHSGTRVAPLANAHPIVRQMRPGSEVIEELQRPAPGCRTHFVSFWSDLDHLMDPLETACVEHPDLMVQNVRVSGIGHLALPVHPAVATGIRQALDSEGTGAEAAPRTDGLTVA

SEQ ID NO: 10999 - protein, 532 aa, Streptomyces avermitilis
VNDRHPSGTVTPPAPASDAASAHYAAYGGQGGQYGEFTTYADGSANGFATGGHQMASFATDPLFGDMPGDGTTGSYDATQWSTGSHETLGTGTHQTLNYDAYAAQHQAAYDTGAYDATAWATGYQQLADIPSQHPGPDASGQWDAGSWHHGDQTAPADRTQQWEWGTQAFDTGAYDATQWNSDGTAAHETQDQSAPEPFDQQATATFEQVTQEPFDQQATATFEQVTPEPFDQQATATFEQISPEHEELGEHGEHGVEAPGDIPLLDDQEEVTPVPGSRAASRTASRSRRRIPARRSALLTVAVPSACVMGVAGIAAASVGVGSSDSKDAHTTASAADAIAVKPSAANNKLDTQIESLSAGADDFADRASRTQERIDLKAQQAAEKQKAAAEAARKERLRPKFALPVAQKGLSAYYGQAGINWMSVHTGIDFPVSYGTTVLAATDGTVRTQWNSAYGNMAIVTAKDGTETWYCHLSTYKVASGTTVKAGDPIAFSGNSGNSTGPHLHFEVRPAGGSAIDPLPWLRSHGLDPT

SEQ ID NO: 11000 - protein, 861 aa, Streptomyces avermitilis
MSSLFDDSFLADLKPSRAHEEEPPPPPEDDHVPESVPDDLFGGKFDVPPDRDTYYRDGAPRPAVDPATLLHGLNENQRAAVVHAGSPLLIVAGAGSGKTRVLTHRIAHLLGERHVHPGQILAITFTNKAAGEMKERVEQLVGPRANAMWVMTFHSACVRILRRESKRLGFTSSFSIYDAADSKRLMALVCRDLDLDPKRFPPKSFSAKISNLKNELIDEEDFAAQAADGFEKTLAQAYAMYQSRLREANALDFDDLIMTTVNLLRAFPDVAEHYRRRFRHVLVDEYQDTNHAQYALVRELVGVPGPGGGARPEDEPPREDDLEPAELCVVGDADQSIYAFRGATIRNILQFEEDYPDATTILLEQNYRSTQTILSAANAVIERNESRRPKNLWTNAGAGAQITGYVADTEHDEAQFVADEIDRLTDAGEAKAGDVAVFYRTNAQSRVFEEIFIRVGLPYKVVGGVRFYERKEVRDVLAYLRVLSNPEDSVPLRRILNVPKRGIGDRAEAMIDALSQREKISFAQALRRVDEAYGMAARSTNAVKRFNTLMEDLRTIAESGAGPATVLEAVLERTGYLAELQASTDPQDETRIENLQELAAVALEFEQESGAGEEAATGDAAGDAAGDAAGDAPGGAPGAASGDLSAFLERVALVADSDQIPDEEDGNGVITLMTLHTAKGLEFPVVFLTGMEDGVFPHMRSLGQTKELEEERRLAYVGITRARERLYLTRSSLRSAWGQPSYNPPSRFLEEIPDAHLEWKRKGASAAPLSSGPASGVAASLSSSRSRSAVSGASGFATRRGGASEKPVASLAVGDRVTHDQFGLGTVVGVKGTGGNAEATIDFGDTKPKRLLLRYAPVEKL

SEQ ID NO: 11001 - protein, 398 aa, Streptomyces avermitilis
MAPHRKPRPAGTRMAGIRTPGLATAALTSVALLSQTANAAPPADDKPSLEEVEKKVDDLYRQAESATEKYNAAKEKTTKQRTRVGTLLDEVAQRTQKLNDARERLGSFAAAQYRTGASAPDTTTFLLADSPQDYFDQTQLMSRLTDHQKDAVDAYVTEQAATTTKRQEASQSLETLTESQSALKTAKATVQHKLATARELLSKLTAEEKARLAAIEKEKRAAADRKAEELARQQAAAAQQTAQQDPASGTGSTSGATGATGSTGSTGSTGSTGSAGSSYSTKAGKALAFARAQIGKPYVWGATGPGSYDCSGFTQAVWKAAGVTLPRTTYDQVNAGTTVSLSNIQPGDLVFFYDDISHVGLYIGNGMMIHAPKPGAYVREESIFYDGESAIHSVVRPA

SEQ ID NO: 11002 - protein, 341 aa, Streptomyces avermitilis
VRHARVPRTAMRAYVPSIGPMPGTPQPRTWWAPLPPADGAAVMATGVVSVGLHLTGHEVLSRIALVAAGAAWLALAADFTVRLLRERERWAAEAGTPAALTAVAATAVLGTRLSALGWQGLAEALLALAAALWPGLLFLVVRRWERHMPGVVLLACVATQGLALLGATLAADLGVAWLAHTALVFFWLGLVLYAVALWRFDLRQVAEGAGDHWIAGGALALSALAGAQLVAARRSGGPYLWNDDDNGVLRTVTAALLVLALGWYCVLWAAELRWPRPAYDVRRWATVFPMAMTAVAVLSVAIVLGVPWLWGPGQVLLWIAVAVWPAVCAAAVVDIRSRAPR

SEQ ID NO: 11003 - protein, 117 aa, Streptomyces avermitilis
MDVLIHLFVGLHIIGIAALLGGFLTQMKAMGRGTARFVPGMLHGALTMLVTGVALVGLNQADDHSVNTIKIGVKLALLIVILGLVYVKRDEEQVDKGLFGLVGLLTTANIFIAVLWT

SEQ ID NO: 11004 - protein, 358 aa, Streptomyces avermitilis
MWALVAAHRKPRQRSLGGHTARTAVTVALAGAATATAFDGTGHAEPQLSPAQVKAEADKLYEQAEAATEKYNGTKEKADKAERRLNALRDEAARRTERLNSARDALGSVAAAQYRSGGLDPAVQLMLSSDPKQYLDGAAVAERAGSRQATAVERVRKQLREIEQLRGAAQVELASLKSRQTELKRQRKTVTTKLTEARRLLSRLTDAQRAQLDTAGGAGHASRSAARDLGPASLSAATAEAPNSRSAAAVSYAYAKLGSPYVWGATGPDAFDCSGLAQAAYRSAGISLPRTTYAQIDTGRRVSRSELLPGDLVFFYSGISHVGIYVGHGQMIHAPNPTAPVRLAPIDEMPFAGATRVV

SEQ ID NO: 11005 - protein, 260 aa, Streptomyces avermitilis
VLRPLPPRPRPPRCPPGKAPMPRSTLPPPPPPAHLRTWPDRSALLADRWRALEELRRRSLGVHRVLLLWLLAVTAIIGWALLVLPLQQIEQEDPTSLVLGPLFAILGLAALTPSLVTVSLAVRRDGRIHQLLDDWLRLDSHPPTDARLRAPGLSLFWLLSSLCVCAIGLWSSFAATADAKPGGGTYGDVALGMGIGLILWLTGLIGVGKAVRHYRWAVRALRPRPGVRSGAEPAPGLGAAPGPGAAPGAGPASGEASNGR

SEQ ID NO: 11006 - protein, 57 aa, Streptomyces avermitilis
MRAGEWRGRDRAGASAVLAPQAAGPPGLPPGCVASPDTAGAPAEGVTAIGEALREVG

SEQ ID NO: 11007 - protein, 243 aa, Streptomyces avermitilis
MSDAKEPSGSAEPNGGVTGADAPGRHVRVVLVDDHRMFRTGVQAEIGQTERTGVEVVGEAADVDQAITVITATRPEVVLLDVHLPGGGGVEVLRRCAPLMADAEQPVRFLALSVSDAAEDVIGVIRGGARGYVTKTITGTDLVNSVFRVQEGDAVFSPRLAGFVLDAFASTDAPPVDEDLDRLTQREREVLRLIARGYAYKEIAKQLFISVKTVESHVSAVLRKLQLSNRHELTRWATARRLV

SEQ ID NO: 11008 - protein, 429 aa, Streptomyces avermitilis
MPDAAAVPLADPRLPRKLYRSSDGRWLGGVARGLAGHLGLPVIWVRLVFVGLFMADGLGALLYAAFWFFVPLGVGGVDAQRPPALTTETAADGRRRLVARKPDKGQIAALLLMVVVAMVFVGKVNLGGGAKAYLWPTVLVGAGVALVWRQADNARRARWVEVGRRRRTLTLLRSAAGVLLVTAGVSGIFVLQGSAAHLGSVLQAALAVLVGIALLAGPYLVRMTQDLSEERLMRIRAQERAEVAAHVHDSVLHTLTLIQRNAESANEVRRLARAQERDLRAWLYKPEGTGKDEADEPDTLAEAVRRNAAEVEDKHGVPIEVVIVGDCPLDEGLTAQMQAAREAMVNAAKYGGDGGAVQVYAEVEGRTVFVSVRDRGPGFDLDAIPGDRMGVRESIIGRMERNGGTARLRAVPDGGTEVELEMERAEKTS

SEQ ID NO: 11009 - protein, 478 aa, Streptomyces avermitilis
MTDQQHAAPEPGPGPGPGTGRGPEPGADHGARPPAAEPRDAAPSAGPSGDAAASEATAPTAPPRFRRDRRHRMLGGVCAGLGRQCDMDPVIFRIVLAVLSATGGLGLIFYGFVWLFVPYDDEEENEVRKLLTGRVDGPALAAVLFALVGCGVFLSMLNNGGVLTFAAVLSLLLAGAGYWSQRRGAPDPDPLAAQAVADAPPEAKAPPVPASYPSWWRDPIVKDGTHVGGTGYLWGPMDARDRDVSAAVNIARGTSFRQDIRTAREPKPRGPRWIGGWVFLFALLAGALGTGLTWDDHALGTSLQTGLACALAVFGTGIAISAFLGRTGAGSLFLAVITAGLLAASAALPKDISTHWVRTNWTPASASAVQPRYELGTGEGTLDLTRLRLAKDQTVTTGAQVGAGRLRVVLPADVTAEVDIRAGIGDIQLPGDGKQDVDVEPGKQQQVTLTPSGTKNGGTLNLDLEVGVGQVEVTRAAS

SEQ ID NO: 11010 - protein, 86 aa, Streptomyces avermitilis
VLRHEFQPGKLIAGLFLTVAGVAFAGDAGGSWETPWFAIIPMVTGGLCLAGAAAFLTHAIRQRRAGHDHASPEPEGAWPSDRPSGG

SEQ ID NO: 11011 - protein, 172 aa, Streptomyces avermitilis
MRTDTQSPYLEGDRDWRDTATRYALLPLRVFLGVTFIYAGLDKLTNSAFMSESGAGSIGDMMRTVRDSSAIPALVDLALKNPVGFGYAIALGELAVGIGTLIGLLTRLAALGGALISLSLWLTVSWASDPYYYGNDLAYLMAWLPLVLAGASVFSLDAALRARRRQRGAGYR

SEQ ID NO: 11012 - protein, 429 aa, Streptomyces avermitilis
VAVQEARQGAGRGTGPGAHEGGCTCGDCPHGAREGHRRAVAAFLSRRDEFASGQGLPAAVAYSASASRQWVSDELTQSADLVAERGRVEGEAWLGRLWRHTAFVVWGVVGALLLAQALTAIGAGWTVARTAGLLAAVVVGGSLTGAGYLHRARGGALAPVIGEDNRLSTSRAVAASWVLFVVYAVLVLVGQLAAASGPGERDALIAGLELARGVGVVTVVAVACGIAVLVRRVVGLRVLGQRLQKVRADRPRGADLLTDDSGRGSFADIQYVVVGAVALAFAAVRLARRPDQLPDLPWGLALLVLVSAATYLAGKYAEGGRPVVLSVVRAREAGDLDAPIRTGDDIEIRGAGFVPPGAQTADRLSRMVVRIGAVHVHVPLVPVAGGFSNPTDAVLTVPVPADVEPGRVEVQVITAAGVETNRVTIDVTD

SEQ ID NO: 11013 - protein, 292 aa, Streptomyces avermitilis
MAEIIQRDGSWAFDGSTVRITPGLHRSVPLFRQTYGEVTVPLEAISGIVYEPERKRGRLRLRLREGADPLLQATGGRLPDAADPYRLAVDIDRSGVAEYVAEEIRHSLLLEQIPQEPTKAYLLSGPPVPVSVRSSDGTVSFDGAEVRIDWSDTSERIKRATGPRIIAVGDLVQVEWLPNSGYEDGFLRFVTRETVFSKLPPEKDPYALDLWGSARRDLLTALVAAAVTARLPHPSTRLADFVERPRLATAVPPAADHDVLLRRLRDLGELHREGVLTDEEFAAAKAAVLRGF

SEQ ID NO: 11014 - protein, 273 aa, Streptomyces avermitilis
VTELRPGGPMYGPTPPLPLPTDRLQFAMPPMYESLDDERTHRKERLAGALRLFGRLGFEDGVSGHITARDPEYSDCFWVNPFGMPFKHVTVSDLVMVNASGQVIEGRYHVNQAAFTVHAQVHAARPDVVAVAHCHSVHGRALSALGDLLDPITQESCAFYEDHALYDAYTGVAVDAEEGRRIASALDTRKALVLRNHGLLTVGDSVDAAAWWFVSMERSCQVQLTARAAGRPVLIDHKQAVATREQLGGDLVAWINYQPLWQDISRSEPDLLS

SEQ ID NO: 11015 - protein, 158 aa, Streptomyces avermitilis
MTQTNWAAFTTAEPGLANIAEERFGGFAHHVLATLRKDGSPRTTGLEVRFLHGELWLGMMPDSLKALDLRRDPRFALQANPGEGAGTGGGDVRISGRAIEVEDPATKAAYGKEVEPPEPFHLFRTELTEVVRTYVEDDMYLVVEIWRPGAPVRTLRRT

SEQ ID NO: 11016 - protein, 525 aa, Streptomyces avermitilis
VPSAPSAAAPDTVLVVDFGAQYAQLIARRVREARVYSEIVPSTMPVAEMLAKNPAAIILSGGPSSVYAEGAPRLDREIFEAGVPVFGMCYGFQLMATTLGGTVDNTGAREYGRTPLHVSKSGSTLFEGTPDEQPVWMSHGDACSAAPEGFTVTASTDVVPVAAFENDEKRLYGVQYHPEVMHSTHGQQVLEHFLYRGAGLTPSWTTGNVIDEQVELIREQVGTRRAICGLSGGVDSAVAAALVQKAIGSQLTCVYVDHGLMRQGETEQVEKDFVAATGVQLKVVDAEERFLTALKGVSDPEEKRKIIGREFIRVFEQAQAEIIADEGPEVAFLVQGTLYPDVVESGGGTGTANIKSHHNVGGLPEDLEFELIEPLRKLFKDEVRMVGQELGLPDEIVQRQPFPGPGLGIRIVGEVTKERLDLLREADAIAREELTAAGLDREIWQCPVVLLADVRSVGVQGDGRTYGHPIVLRPVSSEDAMTADWSRLPYDTLAKISTRITNEVADVNRVVLDVTSKPPGTIEWE

SEQ ID NO: 11017 - protein, 426 aa, Streptomyces avermitilis
MRRRLIQSTLAVVLVVIAVFGLSLVIVETRTISNSAQERVDSEALRLASIVDSRILGSESVSADILKDQVGAGGYAEITMPGQAPIAIGTKPVGDVIHATEKGEEGETVRVEEPRSAVTREVGRTLLIIAAVALLAVIAAVLLAVRQANRLASPLTDLAETAERLGSGDPRPRHKRYGVPELDRVADVLDSSAERIARMLTAERRLAADASHQLRTPLTALSMRLEEITLTDDPDTVKEEATIALTQVERLTDVVERLLTNARDPRTGSAVSFDLDEVIQQQLAEWRPAYRSEGRAVVSSGKRHLRAVGTPGAVAQVLAALIENSLMHGGGTVALRTRVTGNQAVVEVTDEGPGVPADLGARIFERTISGRNSTGIGLAVARDLAEADGGRLEMLQAQPPVFGLFLSRTPLKKAPQGEEEQGPTVR

SEQ ID NO: 11018 - protein, 225 aa, Streptomyces avermitilis
MTRVLLAEDDASISEPLARALRREGYEVEVREDGPTALDAGMQGGVDLVVLDLGLPGMDGLEVARRLRAEGHTIPILILTARADEVDTVVGLDAGADDYVTKPFRLAELLARVRALLRRGAAEPQQPPATHGVRIDVESHRAWMGDEELQLTAKEFDLLRVLVRDAGRVVTRDQLMREVWDTTWWSSTKTLDMHISWLRKKLGDDAANPRYIATVRGVGFRFEKS

SEQ ID NO: 11019 - protein, 498 aa, Streptomyces avermitilis
MASSLTKDSVTPGTPGSEKTFFGHPRGLATLFMTEMWERFSYYGMRALLPLYLVAPGGLHLSAATATAIYSVYVSLVYLLALPGGWFADRVLGPRKTVAVAGLIIMLGHLTLALPTSGTFFAGLGLVAIGSGLLKANISTMVGHLYDGPDDPRRDGGFTLFYIGINLGAFAAPLIIGTVGENVNWHLGFALAALGMALGLAQYLLGSRHLSARSSDVPTPLSAEEKAATLRKSAMWAAVAVVFYAIVGFSGHYTLNWLLVPITVAGLIIPVMVIARIKRDKALDRVEQSKMSAYIWFFVAAAVFWMIYDQGGSTLSIFADSSAENTIFDWHFPVSWYQSVNPVLIMALAPVFAWLWLALNRRGKEPSTATKFASGLLLIGASFFLFLAPLAIADGGHKAAAMWLVAIYFVQTVGELTVSPVGLSVTTKMAPAKYASQMMGVWFLAVTAGDATTGLLSIAGVDLNKTGIVALQATLAAVAGVAVWMYRKKVKELMGDVH

SEQ ID NO: 11020 - protein, 209 aa, Streptomyces avermitilis
MNATATRFLYLARHGEATADEDAGELTANGRRQAELLGDRLRDVPLAAIHHGPLPRAAQTARLIGDRLKEVPVRAAEAAGDYVPYVPGRAELPADAADRLLAFLAPVTPDERERGAALARAAQERFTGPVAGDEVRHELVVTHAFLIGWLVRAALDAPPWRWLGLNHGNAALTVLRYTPGRPSAVLFFNDMAHLPAELRWTGFPPELRG

SEQ ID NO: 11021 - protein, 410 aa, Streptomyces avermitilis
MLGGAGLLLGVTAGPAQAAEVSYATKCVPPAASGLDPVEGTTKVEITAPATAKVGDTVEVVWKFVQAASKNPDIIDLPKDSVQPSGTLKAAGAQAAGIAMQGARQNPAIPKGGAMVLSDMKGTLKLTTPGEVTLTPDAYAINAFSTDTKCAPTETVKSAATINVTAGGGSSSSATPDPSQSATGGSDTGGSSGGQTDFTGKEVSVPYACKTPIGDKNATSPVQINAKKNGGSFDLTVQFKKSVMDSPADIPKDSVKPSMEVVLGGADKGTVRVEGPANADAIKSGDPIEIPDLTGTYKPGASGTSTLSPGVLTVNALGTTTTCTPTKTEVSLSLDTTEQANGASGGGSSSTSGSGGTSGGTSAGGTSSGGGLAETGAGDHGALKALGLVAGTVILLGGAVFTFLPGRRVR

SEQ ID NO: 11022 - protein, 368 aa, Streptomyces avermitilis
MTALVAVLALALLPWAGATASAADNPSVRLSTSQAGSGGSITVTGSGWRPKALLMVLICGQSVPSRGVIGGTNSCANADGRAVTTDAKGAFSRKLPVAEPPKPCPCVVHVATVTGEKADADAVFQVAGHPVRALPKEDTSGRLSVLTDTRLDGSSGLLTWFGAPPSRTLVLTVGNVGTSPVKNPVFRVGTSHGVFAPQWEEQPWRGTVAPGGKARIKLPVELAAGAHGDYTISLEYGGKVLAEQPWGVGRPWGVTLFWILLCVVVPAAVFRVGMAVVDRVRPRRRAPGRHRVLKLPELTLRLPKPGAPAPETRTTPALPWFTPDGDPGTPAAGPLSAPQEETSPTSSAEETSPTSSASPTTPTTKGNT

SEQ ID NO: 11023 - protein, 350 aa, Streptomyces avermitilis
VSRVLTHRTGPTTAYDPQEPPMPYVSHVLGLAALTLLAAAPSAAAADAWSVAPATGGTAGRPYIYAEGESGTVLEDAVSVLNPGGTPLTVRLRGADGPDGVRSGPVGTGAWIGFARATGGHRRAASAVSVTVPARTRADVPFTVSVPPGTTPGDHPGAIVAEAGGRSSAVRVRLRVGGPTLSALSVEHVSVGGGRISYELVNRGNTVLAPSLAVHVDGLFGPLLDRPAHALSLDLPPGRRVTLSEPWRDTPALDAVQVRLTVTAAGGARASASASARFVPWGAVAGTGGAFAAAGAGFVVRRRGRGPRDGDAAPRQPWQPWRPWRRGRRPPDGDAGEPPCAEAELTGAVK

SEQ ID NO: 11024 - protein, 231 aa, Streptomyces avermitilis
VSYRTYQKRTAALAFAAALAGSAVLMAAPAAVADVVDVNYQCKTPIGDKSAVSPIDIKSVKSGSGYKLTMSFQKGVSSSPVELGKGAMNPSAVIKLGGADSGTVAVSGPANSAAIPADTPIKINDLSGTYTPKKTGKVTFTAGVLTIKALGTTTTCTPGNNPKPSLTLDVTAAGGGGTSGSTQSGTDTGSGLPQTGPEDSAIALGTLGGTVLLAGAAGALWLTRRNQAARR

SEQ ID NO: 11025 - protein, 219 aa, Streptomyces avermitilis
MSTTRPCSPGDRGPEPGAGGASGMSAERAAPEEEAAAMASASSTAATPSATPAASAEDAPSAEDAPPAEGGSVSGGGSTSSAAARRTRKLNFDDQSGVVPLARDFARQALYEWGWLPAATADQRAAAEDVLLVVSELVTNACLHAEGPDDLWISCDNKVLRIEVSDKGAGQPAPRTPHRAGRPGGHGMFIVQRLCLDWGVVRTPGAAGKTVWAELGAPA

SEQ ID NO: 11026 - protein, 122 aa, Streptomyces avermitilis
MDRGTVGSAQSGRLLVEVREEGTSAVVTPAGELDHHTSELLREPLDDCLGKGFARLVVDCSRLEFCDSTGLNVLLGARLKAEAAGGGVHLAGMLPVVARVFEITGADAVFTVHETLEAALAD

SEQ ID NO: 11027 - protein, 306 aa, Streptomyces avermitilis
MSPRLDESHTQRATSTRPPENLEHASLAEHDGFPGERDVLAGLPEIPPYDEVGPVDARALSKTLFARLESLEEGTHEYSYVRNTLVELNLALVKFAASRFRSRSEPMEDIIQVGTIGLIKAIDRFELSRGVEFPTFAMPTIVGEIKRFFRDTSWSVRVPRRLQELRLDLAKAGDELAQRLDRAPTVSELAERLGISNGEVVEGMAASNAYTASSLDAQPEEDDSEGALADRIGYEDHGLEGIEFVESLKPLIAQLPSRDRKILSLRFVANMTQSEIGDELGISQMHVSRLLSRTLVRLRKGLTVEE

SEQ ID NO: 11028 - protein, 549 aa, Streptomyces avermitilis
VRCLRHARRQSQGVRGGRGMARADRGDGDGDAEAEDGRHSTASDARLTQLLRTDTATAYPALRELRTRHRPAVLGYARLCTVDDAAARRLTAQAFALAARDTARGSDPRGPWRHQLLLLAGRVAASWAADERAARLDPDLLAHLGAAGSRAQVPPLLAAFQSLPSRVQGVVWYAVVEGEPDDRTADFVGLTREDVTYGTEPAFQSLRQSCLTTRLAASDDPRCQDFRRLIEESVRPDNPRYSADLHAHMVHCVYCATAYDELSALRDDPRTALAAGLLAWGGAAYVTGGAVTRRAVAGGPGPSGPGPGDPGPGPAPGWWPSRRFVLASTALGVALIPFLAYLLVSGGPEPERAANAVATPSRPPAVTVTATVSATPSPSPSHTAGKSPKPSRSPSASKTTRPPSPKPSPKPPAPHPPNGSFAQVVNADSGLCLDIRDGVMDLGTDVVTAPCTSSRTQRWRVDTARGVLQSSEDPDFCLDSRGSTDRGVGIWECGAVYGRNGRNLRFTVDAQGVIRPAVAPDHAVTPYGDALFLVPAEGRAAQRWRAGAA

SEQ ID NO: 11029 - protein, 191 aa, Streptomyces avermitilis
MTGIVVFFFVAAALFVALGLADQRKLYWRFAARRYRDPEANEPSDSAYAWQRVLIFIAAAVMAFQGFKALDFADDNSWSAGELGQAVEQAASALEEEPHIDDEYSDYSDLIEQEVEDAGEDMGPGYAVNVEPADSRDDYEITAEGTDAAYCMSVSQKESDEGGFTVPGVGDQQGTYVPEYDLSATTAEGAC

SEQ ID NO: 11030 - protein, 414 aa, Streptomyces avermitilis
MSSTVTTAHTAGTGSTVITNIAGLVTNSPSFGRGSPRSSKFESGGASPLGLIQDAAVVIDGDRVAWIGESSKAPATDNRVDAGGRAVIPGFVDSHSHLVFAGDRTQEFNARMSGRSYTAGGIRTTVAATRAASDADLEANLTRYLDEALRQGTTTFETKSGYGLTVEDEARALRIASAHTDEVTYLGAHIVPPDYADDPAAYVALVTGEMLDACAPHARWIDVFCEKGAFDGDQARAILTAGRAKGLHPRVHANQLSYGPGVQLAVELDAASADHCTHLTDADVDALASGRTVATLLPGAEFSTRAEWPNARRLLDAGATVALSTDCNPGSSFTSSVPFCIALAVRDMGMTPDEALWSATAGGAAALRREDIGHLTPGAYADLAFLDAPSHVHLAYRPGVPLVSEVWRRGRRVR

SEQ ID NO: 11031 - protein, 444 aa, Streptomyces avermitilis
VTQTYWLEHAWLDPAVEPGVSVEVAQGRIAAVRTGVGTPPPGAEILRGLTLPGLANAHSHAFHRALRGTVQVGSGTFWTWREVMYAFADRLTPDTYHALARAVYAEMALAGVTAVGEFHYVHHAPGGTPYADPNAMGEALIAAAADAGIRITLLDTAYLSSGFGQPPNAHQLRFSDGTADAWAERCSVLKDRDHARIGAAIHSVRAVPAGQLATVARWAEERRAPLHVHLSEQTAENDACQEAHGRTPTRLLADHGVLGPRTTGVHSTHLTDEDIALLGGSSTGTCMCPTTERDLADGIGPAVALQRAGSPLSLGSDSHAVIDLLEEARAMELNERLRTRTRGHWTAAALLRAASADGHAALGWDDAGTLEPGALADFTTVALDSVRTAGPLPRLGAETAVFAATAADVRHTVVGGRHVVRDGAHALVPDVPSALADAVEALRA

SEQ ID NO: 11032 - protein, 413 aa, Streptomyces avermitilis
VTFHSMWAELLPIGRSSASGGYRRFAWTGADADCRAWFKAQAESRGLTYELDRNGNQWAWLGDPTAGDAVVTGSHLDSVPDGGAFDGPLGVVSSFAALDELRARQVTLAKPLALVNFGDEEGARFGLACVGSRLAAGQLTVEQAHRLTDADGVTLPQAMERAGYDAGTIGPDPERLARIGAFVELHVEQGRALDLSGDRIGIASAIWPHGRWRFDFRGEANHAGTTRLADRRDPMLSYAETVLAARREARLAGAVATFGKIAVEPNGVNAIPSLVRGWLDSRAADQRTLDTVVTGVEKAAREYADAHGIELDVVRESFTPVVEFDHALRDELARILGRDTGTGAGTGADLKVPVLGTGAGHDAGILSGTIPTAMLFVRNPTGVSHSPAEYAAEDDCVAGVTALADVLEGLARR

SEQ ID NO: 11033 - protein, 554 aa, Streptomyces avermitilis
MSGPRPVRAPRGTELSALGWQQEAALRMLQNNLDPEVAEHPDKLVVYGGTGKAARDWRSFDAMVRTLRTLKQDETMLVQSGRPVGVMQTHEWAPRVLIANSNLVGDWANWEEFRRLEALGLTMYGQMTAGSWIYIGTQGILQGTYETFAAVAAKKFNGTLAGTITLTAGLGGMGGAQPLAVTMNDGVAICIDVDPRAIERRIEHRYLDVKADSLEHALQLAVEARDARRPLSIGLLGNAAELLPRMLAEGAPVDIVTDQTSAHDPLAYLPVGVDFDDMAAYAAKDPAGFTTRARESMARHVEAMVGFMDAGAEVFDYGNSIRGEAQLAGYERAFAFPGFVPAYIRPLFCEGKGPFRWAALSGEASDIAKTDKALLELFPENESLHRWIKMAGERVHFQGLPARICWLGYGERDKAGERFNDMVASGELQAPLAIGRDHLDCGSVASPYRETEAMLDGSDAIADWPLLNAMVNVASGASWVSIHHGGGVGMGRSIHAGQVSVADGTELAGEKIRRVLTNDPGMGVIRHVDAGYDIAESVADERGVRVPMREGDDA

SEQ ID NO: 11034 - protein, 485 aa, Streptomyces avermitilis
LPGHMGAERDRTGDAMGATDARDNGAGGSTGNAGETDAARVARRDEAVRAAVGQGLLGADAPIVALLDVAGIRGSAAALRAAFDAVVAPGTPVLHAFAVKATPLVPVLRLLGEAGIGAEVASPGELALAQAAGVAPERTVLDSPAKTPAELREALALGIAVNADNPQELDRIDALVRSAPSGSPVGIRVNPQVGGGSIDALSTATATSKFGVALRDEGAREWILRAYADRPWLTRLHAHSGSQGMPLSLMARGIAETYALAEEINRHVGRRQIDTIDIGGGLPVNFGSDATTPTYARYARLLAESVPGLFDGRYGLVTEFGRSLLAKHGTVVARVEYAKSAGGRAVAVTHAGVQVATRTVYAPASWPLRITAYDAKGHPKAGPEVVQDVAGPACFAGDLLAVGRALPLLEQGDHVAALDTGAYYFAHHYAYNSLARPGIYGFATGGVGGGAGGSGVRFAVVREPQAVEEIVMESGGGHASALSAL

SEQ ID NO: 11035 - protein, 131 aa, Streptomyces avermitilis
VPGIDECLLEAMRLPGARGASVVDWTSGLALGTVGDSPGGDHETTAAEAAELARLAAEHRAFAPEEGSDWSGQVPVEDLIISNRDSYHVLRFVPTTFDSSVFLHLWLARADGNLALARIRLGEMAGRLVLG

SEQ ID NO: 11036 - protein, 374 aa, Streptomyces avermitilis
MTTVRTPPPPPLPVRQRAEAPATGLSPMLSRLAAERATGVLVRERGSLYLSEGQVVHAESPATPGLDVLLTVRGALNAEGWREAVAEAGARRLVGRFLVDRGRISKGALELCHLGALYDAAYFVLGPSSAPSRFRYGAAHWLGPVHPVPVAAVERETLRRRELLHRIWPDPATDDAPLVRIERLDEPTVAPRQAAVLGRVDGTRTAADISRALGRPAFHTLVDLRRLAAAGIVAPAPGAEVPACHEERERFDAAIPAEARAALGATSPAGAPPGPAPVTPAATTPAPDTPAPATSAGTATARTTPPAPPAPPVAPPAPTALPARGTPPLTLAPPDPLAPPDTPTPPDPLAHLALTSTDPDVSLLRRLRDALEAL

SEQ ID NO: 11037 - protein, 173 aa, Streptomyces avermitilis
MAAEAEVLDELHRLRSRVPQLTGALAASVDGLVLAQDTPGVDPDSLAALTAAALGVALRVTDATGQGDFRELLVRGVHGYVATYAAGGTAVLTLLAQDRVNVGRLHLEGRRAGTRIGELIEAAAARAEPAPQTPAAKAPAKAVAKSATPRTRTARAPAKPRTTTNARTTTTES

SEQ ID NO: 11038 - protein, 124 aa, Streptomyces avermitilis
MTNTETALKEALASIEGATGAALVDYTTGMALGTIGGSKSFDLTVAAAGNTDVVRAKLRTMEHLGLKGEIEDILITLTDQYHLIRLITGRGGNGLFLYLVLDAKRANLAMARHQLKRIEADLEV

SEQ ID NO: 11039 - protein, 194 aa, Streptomyces avermitilis
MARGGQGLARVAVVVRAGAAPLWWCGAFAAGVGVLVPGLTGRRIGVMAGAVLFLVAAAVVTYGSRKRYTALAAAAARAGKHDVLQDRAVTVRNWRRGHRWWLLLAFVAALVSSFAVPAAGGMLLAGLGTGLRLKAAWLGRRERAGDALLWVRVDWLGAHGGRPAGKAVKVYRSTGIAAGDAAPGGARRRTDALV

SEQ ID NO: 11040 - protein, 286 aa, Streptomyces avermitilis
MSGDRDTEMTDSPAGRLQALFEGHRLTPTQRRIAHSMVRRAADVPFLSSVELAELAGVSQPSVTRFAVALGFDGYPALRKHLREVAPAEQAPDTSSYNEYQQAVEAEIENLKHLAELLADPRPLARAGRLLAASRPLPVLGLRAAASQAYGFAYFAAKVHPDVRLLHEGGTMVQDRIDAAVRAGASALLCFALPRHPREVVDTLAYAREAGLTVVTVADSAFAPVAKVSDLLLPAAVGTGLAFDTACAPMLLGRVLLEAMCDDLPDAQARLEEFDARAAAKGLFVE

SEQ ID NO: 11041 - protein, 548 aa, Streptomyces avermitilis
LRVMSSRIVDTSTVEVSPASTGIVVLDGCGIGVSDVVCLADGASRPVPGTEAMKRVEESWDAARQIAATGRVYGRSTGVGANRNEDVPTEAAAGHGLRLLRSHAGAIGAELPARQVRAMLAVRVNQLLAGGAGLRPTVVTALCEALENGAYPVVNEFGSVGTGDIAALAQVGLALAGEHPWRRAETSGGLGSETSGGPGAGASGGRYAGGVRALRRGASAREIGAPEPQLLDNNDALALISSNALTLGQSALALHELRGLIGATQVVAALSLLAVDGSHEAYAAPVHTARPHRGSAEVARIMRELIGAADRPTPPLGRIQDPYGFRCLPQIHGPAHEAADALEAVLAVEINAAAENPLISPGDLAAYHHGGFYQAQLALALDHFRLAITQVARLSTSRLSTLNEPAYTRLRPFLADHEPASSGVMILEYAAGAALGDLRAFSAPASLGHAVLSRGVEEQASFASLAARQTLRACDAYRLVVGCELVAAVRALRQRDLRPDPELPVGRALELAESVLDPEPADRPLTDDVTAAAALLDRFTEIWRGSES

SEQ ID NO: 11042 - protein, 356 aa, Streptomyces avermitilis
MTICRPGKGHLMIQFDAVHKRFPNGTTAVHDLSLEMPEGGVTVLVGSSGCGKTTTLRMINRMVDPTSGTIRVGGRDILEQDAAELRRSIGYVIQQSGLFPHRTVLDNIATVPLLLGWGRRKARARAAELLDTVGLAADAGRRYPHQLSGGQQQRVGVARALAADPPVLLMDEPFGAVDPVVRTQLQDELLRLQKELSKTIVFVTHDIDEAVRLGDQIAVFRTGGHLVQCASPAELLARPADDFVADFLGAERGLKLLSLTTLADVPQGPAPEGGAWTLVLDEARRPQHWRSKDGAELPVRPLRDRDSLLAALNESVASPNGLTVRVDADGVLTGVSSRDDIHEHAGRAHSEASVAA

SEQ ID NO: 11043 - protein, 213 aa, Streptomyces avermitilis
VSVDWSWIGDHTDDLTGLTLSHLQAALTAVFFGLLISLPLAVIAHRIRPLRGFLLGLSNVLFTIPSIAIFVLLLPVSGLTRTTTVIGLTVYTLVVLLRNTVEGLDSVPVKTKEAAKAMGTRPLRTLLTVELPLALPVIMAGVRIATVMSISLVSVATYIGDGGLGQLFTDGFQRNFPTPVIVGVVLTILLALVADALLVAVQYALTPWKRRRA

SEQ ID NO: 11044 - protein, 239 aa, Streptomyces avermitilis
VEEAARLMYELFKNLGAWLVSGDQWTGPDGIAHRLAEHLQYSLLATLVAAAIALPVGLLIGHTGRGAFLAINLASFGRALPTVGLVVLVFLASGLSMWPVYIALVALAVPAIVTNTYAGMTAVDPDVKDAARGQGMRWHQVLFQVELPLALPLIMTGLRLALIQVVATATIAAYVSFGGLGRYVFDGLAQRDLVQVLGGAVLVAAVAVVLDLALSALQRFLFLPHSRLRSSGGTPTRTA

SEQ ID NO: 11045 - protein, 312 aa, Streptomyces avermitilis
MNRRTLLGGLFAAASVPALAACSSGITSLDSQGSGGSGGGSSKGGVIIGTANFTENQVLGHLYAAALEAAGVRTTVRPNLGTREILIPALRGGDIDLLPEYQGALLHYLAPKATATEEGAMQNALTVALPSGLQVLPYGMAEDSDAFVVTRATAKKYGLSSLADLKKQNGELVIGAAAEVKKRQVGVVGLKDVYGVEFKEFKSLDSSGPLVKGALRKGDVDVANLFTTDTDIQANDWVVLSDPRNLVPGQHVVPLIADRKADSTVRRALAELGNVLTTAQLTELNRQVDKDKKDPEDVANAYAEQHGLVKKK

SEQ ID NO: 11046 - protein, 141 aa, Streptomyces avermitilis
MTGMDARDAELKKELDATLHARRELGDEYESALVDSFLEKVDQRIDGAVDRRVRRQLAEQQMVVARGARSPQATDSWGERFGFGIVSLVLAIPLSAIGATAHLPGLLITWMGIVGVNVVQAMRVFPSFGRRGDKPEPDWEG

SEQ ID NO: 11047 - protein, 464 aa, Streptomyces avermitilis
VQFHDSMISLVGNTPLVRLNSVTAGIQATVLAKVEYFNPGGSVKDRIALRMIEAAEESGALQPGGTIVEPTSGNTGVGLAIVAQQKGYKCIFVCPDKVSTDKINVLRAYGAEVVVCPTAVDPEHPDSYYNVSDRLVRETPGAWKPDQYSNPNNPLSHYHSTGPELWEQTEGKITHFVAGVGTGGTISGTGRYLKDASEGRVQVVGADPEGSVYSGGSGRPYLVEGVGEDFWPTAYDRTVADEIVAVSDKDSFQMTRRLAKEEGLLVGGSCGMAVVAALRVAERLGPDDVVVVLLPDSGRGYLSKIFNDEWMADYGFLEDSGPSARVADVLSDKAGGSIPSLVHMHPDETVGEAIEVLREYGVSQMPIVKPGAGHPDVMAAEVVGSVVERELLDALFTQRASLQDPLEKHMSAPLPQVGSGEPVGDLMSVLGTADAAIVLVEGKPTGVVSRQDLLSFLAKGGGKQ

SEQ ID NO: 11048 - protein, 346 aa, Streptomyces avermitilis
MTSLSRARVARRIAAGAAYGGGGIGLVGAATIGVVLAEVQLAKRHVGNGSAPHPPSAEGRYGYAYTVPGEPPLRLTMLGDSTAAGQGVRRSGQTPGALLASGLAAVAERPVVLRNVALPGAQSDDLDRQVGLVLGASEQVPDVCVIMVGANDVTHRMPATRSVRHLAAAVRRLRTAGAEVVVGTCPDLGTIEPVQQPLRWLARRASRQLAAAQTIGAVEQGGRTVSLGDLLGPEFAANPRELFGPDHYHPSAEGYATAAMAILPTVCAALGLWPAEEERPDVSRREGFLPVARAAAEAASEPGTEVTAAMPTGPRGPWALLKRRRRRRLPAADATAPATPARETSA

SEQ ID NO: 11049 - protein, 407 aa, Streptomyces avermitilis
VMPEAVIVSTARSPIGRAFKGSLKDLRPDDLTATIIQAALAKVPELDPKDIDDLMLGCGLPGGEQGHNLGRIVAVQMGMDHLPGCTITRYCSSSLQTSRMALHAIKAGEGDVFISAGVEAVSRSVKGNSDSLPDTHNPLFAEAEARTAAVAESAGASWHDPREDGLIPDAYISMGQTAENLARIKGVTRQDMDEFGVRSQNLAEEAIKNGFWEREITPVTTPDGTVVSKDDGPRAGVTLEGVQGLKPVFRPDGLVTAGNCCPLNDGAAALVIMSDTKARELGLTPLARIVSTGVTGLSPEIMGLGPVEASKQALRRAGLTIDDIDLVEINEAFAAQVIPSYRDLGIDLDKLNVNGGAIAVGHPFGMTGARITGTLINSLQFHDKQFGLETMCVGGGQGMAMVIERLS

SEQ ID NO: 11050 - protein, 265 aa, Streptomyces avermitilis
VSAMPIALLLTTAATAVVGVAVLRTLQSLRRQIAALHTELTESRAASARGLVPAARSTADAEEIRAAVAEALAEERERELAEARAFWAAQEARDISDAPSLLGLPDSDLFLPRQSDFMGLEHDSLEPVAEPGLEADELSGESPELAAARRRHPSHPDFVPVQSPVVGDHERTVTCLEELAESRTELADIRPGPLGTLDVYVFADGTTLCMTPGHRDTAERLSAALRAGDTPVLLGGSGISGAYALTFACGEETVYVLADRVIASL

SEQ ID NO: 11051 - protein, 103 aa, Streptomyces avermitilis
VVDTTPLTRAVDHFADLLRAAPQSRLQRSAAAEALGLARELALRAQRLEDPAAEPREMPDAGMFAAADQITVAGRDLALVLSNEEELAEAVTLVVEAQKRAGV

SEQ ID NO: 11052 - protein, 76 aa, Streptomyces avermitilis
MSQVFSAETHRNLLARIPHCTGREVSDWLRTVDEGPALFRFEEKVSWLRAEHNLAYGHAKAIIHEYDLRRAARKLL

SEQ ID NO: 11053 - protein, 293 aa, Streptomyces avermitilis
MRSSNPVFSRRGFSRDNGYAGFNTAPPAGGPAVGTQANPYAQQGGNPYAQNPYAQQGQQYGAPPQAPVSTGRMTMDDVVMRSAMTLGTVAVGAILAWAVLPVTSTSYALAIGAALIAFVLAMVQSFKRTASPALILAYAAFEGVFLGVISEMFNSQWSGAPFQAVLGTMAVAGATLLVYKAGWIRVTARYARIGMAIAIAFILVMAVNLLLVVFGVAPDGGLRSMGPLGAVVGIIAILLGAFFLTLDFKQIEDGIAYGAPREEAWLAAFGLTMTLVWIYVEMLRLVAIFSSND

SEQ ID NO: 11054 - protein, 463 aa, Streptomyces avermitilis
MRTTVGIIGAGPAGLLLARLLRNAGIDSVVLESRDRAYVERRQRAGILEQGTVDVLRAAGAGERMDREGLRHDGIELRFDRRRHRVDFPALAGGRAVMVYAQTEVCKDLIALQLEEGGPLLFGAEALAVEGAGTERPRVPFTHEGREDVLECDYVVGCDGFRGVARQAVPAEVSRVFERTYPFGWLGVLADVAPSHDELVYARHERGFALLSMRSPAVSRLYLQVPEGTDAEAWADDEIWAELERRFETDDAWRLERGPITQKSVTPMRGYVHEPMRHGRLFLAGDAAHIVPPTGAKGLNLAVGDVVTFARALTHLKETGSGERLDAYSATCLRRVWQAERFSYDMTTLLHRPPAATPFEERVQLARLERITSSRAAEADLAEGYTGSPWSDPNGRSAAGRSPAGRRRMTDRAPNGHRTTTGRAPCYGFVPVLAGHGTHAYRGSTGERSFLSSRVNPLPTYYS

SEQ ID NO: 11055 - protein, 285 aa, Streptomyces avermitilis
VAGSYPPLPSVLFAFLWAYGVTGLFAAVQPQSPPWRPGTGTFTAAVTLTVTLLLMRAVDDIRDLAYDRAFHPKRPLAAGTVRMKDLLVLCAAGAVLVLALNAGSPTALAVLAAQLGYCGLFLTVDRLLGWPPGDRLFLSLLFSFPAQLLLHVYLYARYLHDTSSGPGREGVLAIVITVLVTVHMEFAKKITRRTRPGERSYVDALGLGGTVAVALIAPVLSVLLLMTQARPVALLTPLALLPLLLPARAGWRFWRTRTPRWPAASPAYYVLSTFACYLALSLTYG

SEQ ID NO: 11056 - protein, 470 aa, Streptomyces avermitilis
MSGASARCPFSGAGGGTDVLPLPADPGTAAGAPAPGPPDAPAAPAPRTADRSAPHAADPHAPSTADLPRFPFPGLSGIPLDPVLLDRYRGEPLVPVGLANGREALLVTRYADVRTVLSDDRFSREAWANGTLFARRSGALALVTSDAPTHTRRRSRVQSRFTHRRAEEDRPRIARIAAELLDSLQAADTGRPVDLIAEFTTPFPYRVICEMLGVPVADLDRLLPSVTVMMSAGRFSADEAARAHEVMYGYFFGQLAARREAIAAGCPGDDLLTSLLSAPRETRLSDEEIVVFGFGLMMAGGETTASHLAMCVLQVLGTPGLADRLRRDASAVPAVVEELLRWVWFAGTGGQPHVALEDVELAGRVLPAGQVVIPLTDAANRDPGVFPDADEFRPDRAPNPHIGFGHGRHMCLGAAHARVELQEGLTAVLERLDHLELAVEPAELRWRDQMFMRGVWELPVRWHTKEDGRC

SEQ ID NO: 11057 - protein, 131 aa, Streptomyces avermitilis
MTVARWIGSLEAGWRARDAEAIAALFTDDAVYHQGPYGAPHTGRAAVAEHWRGTLSRQKDAKMWFGEPLVSGRRAAVEWWCVLYDPATGTPRNAAGCLALRFAPDGRCESLHEYWHGAPDQALEPAEGWLR

SEQ ID NO: 11058 - protein, 361 aa, Streptomyces avermitilis
VRVDNLHIAGLGCYLPRPYPAERAVAEGRYEAAEHRNGGWTGAAVAGNISPPEMAVKAARTALERSGHPAADIALVLHASLHEQGPELWTPHQYVLRHAVGTQVPAMEVRQGCNAALGALELAHGYLSADPARAAALVTAAENFGTERVDRWRYQAGARMKRPSILGDAATAVVLSSRGGFARVRSIVSASLPELEEMNRPRGPLFPPNRTRTGRIDLVARVLDYAHDNPGAATLARKSLDAGRTEIALRAIEDAGLRPSDITRVTHVLSGGPEYIRAVLEPLGIDPARGVLDFGRHLGHMTTSDQLAALHHLVETRQVVEGDRVLMINNSFGVSLFGAVVEITGNPSWATGSPSAYKEWK

SEQ ID NO: 11059 - protein, 1029 aa, Streptomyces avermitilis
MAHTVHHPPSTGSTGRGTTDAGAPASLDTHLAGPVDTHLAGPAADALADPVQVGHKFSRQHTMRRAGLPVPAFFVLTAEAFAASVPVPAGFPGTGASAGDLMAWARAARDRVRAVRVPAELAGRILAAFDELAGPDGLVAVRGCTAAQADGSGEDGADDPFAGLSDSYLYVRRDAVLDRVVDCWSSAYNPEAVLYRVRRGVDVTAVRVAVGVQRMVPGVRSFVMFTRDPRGGAQQAVVAAAHGIGEGIVQEKADIDHFFVNRADGAVRGELAVKSVMVGLDPARADEGPVVLPVPAPLARKAVLSDADVRRVGALAARAEELFGGPQDIEGTITSDGAIHLVQARPVVQTGSVVQTGSVVQTGPVPGEGAVPGAGAVPGAGAAPGDEAVPPVPWTNHNLTESFPGVTSALTYSQARVFYRTGFADFYRRVGVPKRSLRRNQHHLSRMIGHLDGRVYYRLDAWFALHGQIPGFELIRPMWQRSLGFTQPPDHARPDEGDRRRAWGEVLRASPRLGWAYVTQPRRLRQFLRWWDELMAQWPSFEDCTADELVARYRTMWAEAEHRWGITMVSSYFALVALTCADSLLKRWAPEGSALLPRLLGGGRPNRTLASVRSSIALAERVAADPALRTAVLERPEREVWEEIASSVHGEAVAEEFDRHLRTYGDRALHDLKLEVRTPRQEPWQIVPALRPFITQGLTVAANEADEAAARRAARHALREACPNPLRRAVLSGVLASLRFSVKAREDTRFCRSQLYGVSREVMWRLAERLVEAGMLDRASDIVHLQAEEVLGAFDGTLPETDLRAVARRREARQDARAATPDPPAYFTVPGGLPVPVALASRRDTRPRAGLARDGVLRGIASSSGRARGRALVVRDTRVPPEQCVDRILIAKETDPGWLALMMAARGIVVERGSLVSHTAISGRLLGVPTVVAVTDAMTAVPDGAWVEIDGDAGTVRPLTAAEAAQCEAAEAARRDADDADDADDAAHRKADDATASGRDHSDSAAPGRGDPDGTAPGHDGTTAARGEA

SEQ ID NO: 11060 - protein, 213 aa, Streptomyces avermitilis
MNQRLVVLALRALLPVTCAVFVTAIGLLLTDHASTPQLAGALFAGLYVLWVLAEARITVRHPSQSAAENSTLLPYALARAGTGMSAVLWPLPWQGWSAWLVVPVVVFTAAVALRLVAIRTLGRFYSHHVVRYSDHSVVTHGPYRHVRHPAYTGMLLANAAFVSFFLNPLSVLFLLALCAVVTWRVRVEERVLWEVPGYAGYAGGRARLLPGVW

SEQ ID NO: 11061 - protein, 297 aa, Streptomyces avermitilis
MRMTTHIETTREEERNGSRVGLLPPPAPSPGGDSWLTELTVDRRDPFFFDHPLDHVPGMLLVCGMANAVRDRIDVPPGLRAKWVVNFRVMPELSPELVLYAAPEEKGRRPLRVTQGPAVVSDGWFVLTPDSDPVRPSAAGARREAPAQASLVHRTRPANVMIGEPRATDGLVTAPVLVPASWHTLASRRAGLRSVKSVIEAGRQFATWLSHRVGGWPPEVQMLWLRLTADLPLDLPASVPLSLRWRQVRMSDDKARLTFEVVAGEGEGVTVGSLIYVSKGLSPDGYRAFRADREAAA

SEQ ID NO: 11062 - protein, 280 aa, Streptomyces avermitilis
VILVTGATGVVGRQVAHTLARSGRVRLLVRDPARLTVEGPGVEVATGAYEDHASLLRALKGVEAAFLVTVDPGGQEDGRFLRAAVAADVRHVVKLSSYAAGEDDADDLITRWQRKCEETLRSSGLDWTLLRPRAFMSNTLSWADSIRREGTVRALYPGSENACVDPRDIAEVAVTALTSPGHEGRVYPLTGPEAVSAEQQTRHLAAVLGRPLVCRELTPQQAAARWARRYPPKVVHALVLSAQRQLLGRKTTTDPTFARVTGHPPRSYRQWATDHRNAFA

SEQ ID NO: 11063 - protein, 256 aa, Streptomyces avermitilis
VTSTPLADRTTAVAARATELSKVYGQGETQVVALDRVTADFRQAEFTAIMGPSGSGKSTLMHCVAGLDTFSSGSVRIGDTELGSLKDKQLTKLRRDKIGFIFQAFNLLPTLTALENITLPMDIAGRKPDKQWLDNVIQMVGLSGRLSHRPAQLSGGQQQRVAVARALASKPDIIFGDEPTGNLDSRSGAEVLGFLRNSVRELGQTVVMVTHDPVAAAYADRVVFLADGRIVDEVHGPTADAVLDRMKQFDAKGRTS

SEQ ID NO: 11064 - protein, 842 aa, Streptomyces avermitilis
MFRTALRTVLAHKARLVMTVLAVMLGVAFVSGTLVFTNTISDAYQKSSAKGFDQVDVAIQAESRQDEGDTIAERPKLTQALLDKAAEVPGAGSAIGVVNGFTAIADQDGKLVGNGFQSQGGNYWGTKDPRYPLTVGHAPRGKNEIALDARTAERAGYKVGDTVRLSVDGPVLTPKVTGIFTTDDGNVAAGGSLALFDTATAQQLFHKAGEYDEIDVKAASGTSQIALRNALDEVVPKDVASTTTGKQLADDQATQIASAMSGMKTGLLVFAGIALFVGTFIIANTFTMLVAQRTKELALLRAVGASRRQVTRSVLIEAFVVGAVAAVTGLAAGIGIGAGMRSLMGTLGATVPDGPLVISPGTVATALLVGILITMLAAWLPGRRAAKIPPVAAMSSVHAKATTKSLVLRNTLGALFSAAGIAVVLYATTLDGSDGQAPMGLGAVLLIIGVFILTPLLSRPLIAAAAPVLRIFGVSGKLARQNSVRNPRRTAATASALMIGLTLITGMTVMAGSLQTSIDKMASSAIKADYVVSMANGNYLSTDVDKKLSATDGVTATSPLRNAPSRIDGETEYLTGVNGRSINDLTDLTVQDGAFKVGGTQVVVDDETAASHHWTAGSRFTASFEDGKKQRLTVTGVYQSTEMMRGIMLDNATLTPHLTDPSDMQVMVKTSAGASGPVKDRLEKALGDNPAIKVQDKKDISNDIAQMFTLMLNMLYGLLAMAVIVAVLGVINTLAMSVFERSQEIGMLRAIGLDRKGIKRMVRLESLVISLFGGVLGIGLGVFFGWAAGELLGTKMATYELVLPWGRMALFLLLAAAVGVLAALWPARRAARLNMLTAIKSE

SEQ ID NO: 11065 - protein, 429 aa, Streptomyces avermitilis
MPDAALRLKSLLDQLLGAPLPLRIHAWDGSEAGPPGAPTLVVRNRRALRRLLWKPGELGLARAWVAGDVTVRGDLYAVLDLIAGLLWERRDDARTLTEALRDPDVRAAVSGLVRMAGPPLPPAPPREEVRRRGHLHTKRSDRRAISHHYDVGNDFYEIVLGPSMVYSCAYWATPDGTLEDAQRDKLELVSRKLGLTPGQRLLDVGCGWGSMAIHAAREHGVSVVGITLSQEQAAYARKRVADEGLTDRVEIRVQDYRDVTDGPYDAISSIGMAEHVGAERYLDYARDLYALLKPDGRLLNHQIARRPQLDESTYSVDEFIDAYVFPDGELAPIGSTVTQLERAGFEVRDVESLREHYALTLRRWVANLEAQWVRGVRLTSPGRARVWRLYMAACALAFEHNRIGVNQVLAVRTPESGASGIPLRARTWN

SEQ ID NO: 11066 - protein, 435 aa, Streptomyces avermitilis
MRYGEATVTVVDPRSYMTYQPFLPETAAGSISPRHVVVPLRRVLPKAEVLTGRVTTIDQDRKVATIAPLVGEAYELPFDYLVIAMGAVSRTFPIPGLAEQGIGMKGIEEAIGLRNHVLEQLDKADSTTDEEVRRKALTFVFVGGGFAGAETIGEVEDMARDAAKYYNNVSREDMRFILVDAADKILPEVGPKLGQYGKEHLESRGVEIYLSTSMDSCVDGHVVLKNGLEVDSSTIVWTAGVKPNPVLSRFGLPLGPRGHVDTQTTLQVQGTDYIWAAGDNAQVPDMAARKAGVENAWCPPNAQHALRQARVLGDNVVSGMRGFPQKEYAHSNKGAVAGLGLHKGVAMIVMGKMKIKLKGRLAWYMHRGYHGLAMPTWNRKIRVFADWTLQMFLKREVVALGALESPREEFYEAAKPAPAPAAAVAPKTEEKAKAS

SEQ ID NO: 11067 - protein, 313 aa, Streptomyces avermitilis
MTRVAAIDCGTNSIRLLVADAHPETGELVDLDRRMTIVRLGQGVDRTGRLAPEALERTFAACREYAAIIKEHGAEKIRFVATSASRDAENRDEFVRGVIDILGVEPEVITGDQEAEFSFTGATKELTGRDDLAKPFLVVDIGGGSTEFVVGDDHVRAARSVDIGCVRMTERHLVHDGQVVDPPSPDRIEAIRADIDAALDLVEQTVPLHEAHTLVGLAGSVTTISAIAQNLPEYDSVAIHHSRIPYDRVREITEWLLASTHAERAAVPSMHPGRVDVIGAGALVLLSIMERIGAREVVVSEHDILDGIAWSIA

SEQ ID NO: 11068 - protein, 174 aa, Streptomyces avermitilis
METPPPTTPRTEPTDADVEAFKQQLGRPPRGLRAIAHRCPCGQPDVVETAPRLPDGTPFPTTYYLTCPRAASAIGTLEANGVMKEMTDRLATDPELAAAYRAAHEDYIARRDSIEVLEGFPSAGGMPDRVKCLHVLVAHSLAAGPGVNPLGDEAIAMLPEWWRKGACVVPAADE

SEQ ID NO: 11069 - protein, 164 aa, Streptomyces avermitilis
VKGRREMAVKDRDRFSTATRLRLLGEQTAARVYRSQTKRQARRSRLTSRAALLALVLCSLIVALAYPIRQYVSQRAEVADLQRQQERARQRVEQLRDLKARWQDDAYAEQQIRQRLHYVMPGETGYIVIDPAAAKPARTTQGAADRPWYANVWDGVDKSDASDQ

SEQ ID NO: 11070 - protein, 428 aa, Streptomyces avermitilis
VPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKTKGLSTGLGDEGGFAPNLESNRAALDLIIEAIKQAGYIPGEQIALALDVAASEFYKDGKYEFEGKSRSAAEMTEYYEELVSAYPLVSIEDPLYEDDWAGWKVITDKLGDKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAEYAGRSAFPRFRSAN

SEQ ID NO: 11071 - protein, 227 aa, Streptomyces avermitilis
MLLSSKGKHRRPSKATRAIAIAGVTGAAVAAPLMAAGNASAATASEWDAVAQCEAGGNWSINTGNGYYGGLQFSASTWAAYGGTAYASTADQASKSEQISVGEKVLAAQGKGAWPTCGTGLSGAANNAGSPAPSTPQQSTPKSSTTQSTEQRASRSDERPAAKTVETPTGKKVKKGDGEYKVVKGDTLSSIAEKKHVAGGWQKLFKLNKDIVDDADFIYPGQQLHLS

SEQ ID NO: 11072 - protein, 319 aa, Streptomyces avermitilis
MLSGNGRHRRPRQAPALLVAAGVTGSAIAIPLLGATGASAASGTTWDQVAECESGGSWSADTGNGYYGGLQLSQGNWEKYGGLDYAPSADQASRSQQIAVAEKVLAAKGSSPWSTCGIAVGLSQDSGSADVDTGLLGSGSTADSDSGSGISSGLSDSSSSSGSSSAAKDSKGSAKADATPSGSSTSDSSSADAAKSDDSDKSGQNGDASTPSEAESTSSGRHRGDTADESAADGRADDSTGRHASRGSDGSREAAPDAADDAYVVRPGDSLSAIADSLGLRGGWSALYTENEKTVGADPDVIVPGQSLALAAEPGEKQR

SEQ ID NO: 11073 - protein, 457 aa, Streptomyces avermitilis
VAGSARRRGRHGGGVGTVAGSAAGTRRLQRERGSRYRHPVNAPHSEPELFTWEFATDPYPAYAWLREHAPVHRTTLPSGVEAWLVTRYADAKQALADARLSKNPVHHSEDAPGKSKTGIPGERSANLMTHLLNIDPPDHTRLRRLVSKAFTPRRVAEFAPRVQELTDHLIDQFAQTGSADLIHEFAFPLPIYAICDLLGVPREDQDDFRDWAGMMIRHGGGPRGGVARSVKKMRGYLAELIHRKREALPADPGPGEDLISGLIRASDHGEHLTENEAAAMCFVLLFAGFETTINLIGNGTYALLRNPQQRARLQQSIERGEQDLLDTGIEELLRYDGPVELATWRYATEPLDMGGQRIASGDPVLVVLAAADRDPARFDEPDTLDLSRSDNQHLGYGHGIHYCIGAPLARLEGRTALATLLRRLPDLRLAADPADLRWRGGLIMRGLRNLPVEFTAT

SEQ ID NO: 11074 - protein, 344 aa, Streptomyces avermitilis
VGYVRGVNATSLNGDSNVTGADAPAPGRIVLLTTSHRVAPGLLSWPAWQALHGADRVLCADGAHPQLPYLREAGITVDEASPTAEELVDACAGGRTLVVVATGEGEPRLTDGLARLAGSGRIQMPDLELLPASYDLPGARLLDLVQVMDRIRAECPWSSQQTHKGLAKYGIEEAYELVEAIEEGDRDELREELGDVLLQVVFHARIAEEDEDEPFSIDDVAGGIVAKLIHRHPHVFGDETAATPEEVKEHWLRTKAVEKQRTSVTEGVPLGQPGLALAAKLSSRVRTAGLDVPLPHGEDVGYELLAMAARAEAEGVDPEAALRAAARAYRDAIRGAEETGAAGD

SEQ ID NO: 11075 - protein, 219 aa, Streptomyces avermitilis
LHRRRRTALVLSAAIVAAAPLLTACGGEAHPGAAAVVGGQRITVAQLESRVNEVRTAQRAATTDDAQYEQTIAKTGSLTRDTLHSLVLDRVLDRAAKDAGVSVTRKDAQQMRTALEQQAGGTKALESAWLQQYGVAPGRLDDSLRTEIEAQKLATTLGADMNTVNGKAAFWKAMSEASKKLHVTLNPRYGTWDVQKSSRVDAKTPWLREVTATTTQQTA

SEQ ID NO: 11076 - protein, 242 aa, Streptomyces avermitilis
MAATTWPAQRTFTGRAFDTCAAPSLSAMKAWHTGFYGAAAVYVGGKNRGCGQPNLTASWVKSVSTLGWKLIPLYVGAQPPCQTGSSPEKITASTAASLGATDAADAVAKASALGMKAGSPIYLDMESYDVTDKACNDAVLTYVRAFDKALHAKTYRTGYYGFRSSSAKAVADATDRTDLPGNLWYALWDKQNTTTADWPFGAGQWTNHSRAHQYMVNSKESRGGYTITVDRDAWDAPVAITG

SEQ ID NO: 11077 - protein, 487 aa, Streptomyces avermitilis
MGQVWTAYDKRLDRRVAVKLLRPDKVAGQEADELRRRFVRECRVTAQVDHPGLVTVHDAGSEGEELFLVMQYVDGADLADHLAEHTPYPWQWVVAVAAQLCAVLSAVHAVPIVHRDLKPRNVMVKQDGTVTVLDLGVASVMDTDTTRLTHTGSPIGSPAYMAPEQAMGGAVGPYTDLYALGVLIHELLSGDVPFTGSTALGVLHRHLYEPPLPVRRLRPEVPEALEALVLRLLAKDPQHRPASAQETYEQLLPLLPARGTPTGAPLDPTRPFLRPHAPWPDRARTPAPQPSAAASAPAVEKPDVVGAVDEVKRLLGEGRITQAVDILGAILPAAAAQHGEHSPVVRTLRKQYAATLMDDGQYRRALPELRRLADERATESGQADPQSLRFRYDAAQCLEQLGEPAAALAEYRALLPYYENQYVAGDPELSLEVRRRIGHLLLALGDRVAAHDTLARLLHDVERLRGPGHPLVAEVRRTLQWLGQVRG

SEQ ID NO: 11078 - protein, 196 aa, Streptomyces avermitilis
MYGHGAPPPTRSQGTVITLRVLFVAAGFLSCGLLACLPLFRVAVLRGKWPDWLLAWLSLPLSIAGLAVVGSVPESDHRGDVALASVLILGAVSAAYFVVFDIRHQRTLPSADRPVPPHTTGYMPPQQPQPGYGYPPAQPYAATQISHTPPPYTPTPPPQPPAPAPEPQRPAPARIDQVRAELDELSDYLRKHEDGR

SEQ ID NO: 11079 - protein, 678 aa, Streptomyces avermitilis
VQDNATEVTAAGIARLAGVGRAAVSNWRRRHADFPKPVGGTETSPSFALAEVEDWLRRQGKLAEVPLRERVWQQLVGHPEGPVAALVHAGCALLLIHDRPTVWLELSAASDERLAELLPTALEQVLAPRFGMVRRPAVRTPAPAELLPSAPLLRGAAELAAELGARQTYEFLLGRHLDANPRQYTLTPGDLAALMADLAGPARSFLDPACGTGALLRAVAPGTDQELYGQDSAPELAELTALRLALHTRAAVRTAVGDSLRADAYETLRADAVLCHPPFNERNWGHDELAYDPRWEYGFPARTESELAWVQHALARLRDGGTAVLLMPPAAASRRSGRRIRADLLRRGALRAVIALPVGAAPPYNIPLHLWVLRRPERAPAQPEVLLADTAGVSEAADGRGRLDWPAVRAAVLDAWHPFDRTGTTREEPGVSRSVPVIELLDDDVDLAPARHLPPPAAGGGAAELTAVRERLGETLRLTADLTPPPTGTAGPARWPLTTIGELARGGALLMRTGGSGPHARVLTDHDVIAGTAPSGTLTDNASPEEPVLVEAGDVVVPVLGGGAIARVVDDATAGAALGRNLTLLRPDPAAVDPWFLAGFLRGTANNRQASSYASTATRLDVRRLQLPRLPLDQQLRYGERFRALAAFEEALRLAGRLGEQLVRGMHDGLTDGSVAPE

SEQ ID NO: 11080 - protein, 249 aa, Streptomyces avermitilis
MRRTALAALCLAAAATAGLTGCLPGQDKADSKPKGPFAGLTGGEIADRAVKATNGASSLRMKGDVPDDESGGTIQLDMALNKKGECAGTMSMDGQGKADLIKTDDTVYMKYDEAFLRAQSKGEPKGDTDAVVAMMAGKWTKMSAKGQDAKDIASFCDLGTVLAGAEDVNSDATRGKTTTVEGTPAIVLHEKDGKDRYTLYVATEGKPYLLKVVSTSAKDAGTIAFSDYQKPVPAEAPKGKVLDLDALSD

SEQ ID NO: 11081 - protein, 239 aa, Streptomyces avermitilis
VRLRGGAAAAAAVLIAVGGVGGCKKETNGSSGPQETAAGGAAISAVDSLTVKGRAPKTGYDRGRFGTAWADTDSNRCDTRDDILKRDLKEVKFSDGKCKVTAGVLDPDPYTGQQVTFARGRSQVDIDHLVALSDAWQKGAKYWDAGKRIALANDPLNLLAVDAGPNRSKGDGDTATWLPQNKAYRCTYVAAQVAVKKKYDLWVTSAEKAAMKKVLSTCPGQKLPSGGNPTEAPKRFHAN

SEQ ID NO: 11082 - protein, 308 aa, Streptomyces avermitilis
MSENTSGASGGGGTVRGEERTGVDLGTVRRLWHLLEPLHAVLYYAPEAFDEAAALGYGTQERWESYFPYRAAPLGAVGSERVTSAFYSFSPRMVAAYMDSAWDTASPDAVLKAREAAMDRAYRAIFGDRADSPELAEAAALARRAAEAANTAGRPLAAANAELPWPEAPHQQLWHAATILREHRGDGHLAALLVAGLDPVEALVSFAAIGAASVERFESRGWTSEEWTAARNRLAARGLVGEDGVATEAGRALRRQVEHHTDELAAEPWQSLGADATGRLADLLGEFWVAVLGTGLFPPETTLGIGKV

SEQ ID NO: 11083 - protein, 200 aa, Streptomyces avermitilis
MPSSQTADQRDQPDQRPYHHGDLRRAILGAALDVIATDGPSALSLRDLARRAGVSHAAPAHHFKDRTGLLTAIAAEGYELLATALADADDLRDAGVRYVRFATGHPAHFQVMFTPELLRANDLELTTAKALAGERLRSAVSDAPAGRGPDPRLAGVAAWSLAHGFATLLLSHNLDGPVGDQDPEEVFRTLAGMLFQSKSS

SEQ ID NO: 11084 - protein, 247 aa, Streptomyces avermitilis
MNSTRTVLITGAGTGIGRATARAFAAEGARVVAVGRREAPLAETTEGHPGITPLPADVTAEDAPARIIDTVLDTHGRLDVLVNNAAIVGTESLATYTRTSIEPLLATNLIAPVLLTQAALPALTESRGVIVNVSTSVGQRAWPGNSLYAATKTALELLTRSWAVELAPRGIRVSAVAPGAIATPIGRHSGFTPEQSAAIREWQLAHTPLGRIGRPEEVAWAITRLAAPDASFVTGVVLPVDGGAVLT

SEQ ID NO: 11085 - protein, 128 aa, Streptomyces avermitilis
VRIGELGRATGATPRALRHYERAGLIASRRAANGYRVYDEGTVTRVRNIRHLLAAGLTLDDVRVFLPCLDGDMTAGPASARALGVARERLAVIDERIAAQLAVRERLAAALREAGAVRGGGGGGGGGG

SEQ ID NO: 11086 - protein, 1176 aa, Streptomyces avermitilis
MSLHGLLDAVAKDAALAEAVQAATDGNRMHVDLVGPPAARPFTVAALARDTGRTVLAVTATGREAEDLAAALRSLLPPDRVVEYPSWETLPHERLSPRSDTVGRRLAVLRRLAHPRADDPETGPVSVVVAPIRSVLQPQVKGLGDLEPVALRTGQTADLGTIVEALSAAAYARVELVEKRGEFAVRGGILDVFPPTEEHPLRVEFWGDDVEEIRYFKVADQRSLEVAEHGLWAPPCRELLLTDDVRERAAALAEAHPELGELLGKIAEGIAVEGMESLAPVLVDDMELLIDVLPKGSMAVVCDPERVRTRAADLVATSQEFLQASWAATAGGGEAPIDVDAASLWAIADVRDRARELEMMWWSVSPFAADDELDADTLKLGMHAPESYRGDTAKALADTKGWLADGWRTVYVTEGHGPAARTVEVLGGEGIAARLDPDLAEISPSLVHVACGSIDYGFVDPRLGLAVLTETDLSGQRSVSKDGARMPARRRKTIDPLTLEAGDYIVHEQHGVGRYIEMVQRTVQGATREYLVVEYAPAKRGQPGDRLYIPTDQLEQITKYVGGEAPTLHRLGGADWTKTKARAKKAVKEIAADLIKLYSARMAAPGHAFGSDTPWQRELEDAFPYAETPDQLTTIAEVKEDMEKTVPMDRLICGDVGYGKTEIAVRAAFKAVQDGKQVAVLVPTTLLVQQHFGTFGDRYSQFPVNVRALSRFQTDTEAKATLEGLREGSVDVVIGTHRLFSSETKFKDLGLVIVDEEQRFGVEHKEQLKKLRANVDVLTMSATPIPRTLEMAVTGIREMSTITTPPEERHPVLTFVGPYEERQIGAAIRRELLREGQVFYIHNRVESIDRAAARLREIVPEARIATAHGQMSEQTLEQVVVDFWEKKYDVLVSTTIVESGIDISNANTLIVERGDNFGLSQLHQLRGRVGRGRERGYAYFLYPPEKPLTETAHERLATIAQHTEMGAGMYVAMKDLEIRGAGNLLGGEQSGHIAGVGFDLYVRMVGEAVADYRASLEGGVEEEPPLEVKIELPVDAHVPHDYAPGERLRLQAYRAIASVNTEEDIKSVREELVDRYGKLPEPVENLLLVAGLRMHARACGVGEIVLQGNNIRFAPVELRESQELRLKRLYPGTVIKPAAHQVLVPRPKTAKVGGKPLVGRELLGWTGEFLTTILGS

SEQ ID NO: 11087 - protein, 855 aa, Streptomyces avermitilis
MTVLKTSMRNFFAHKGRMALSAVAVLLSVAFVCGTLVFTDTMNTTFDKLFAATSSDVTVTPKAAKSDEDPQSGRPESMPASALTRAGKAEGVKSAEGAVSSMNVTVVNSDNKNMGSTTGAPTIAGNWTKNDLRSMQITSGHAPRGPTEVMVDADTADKHHLKLGDELRTIAVTGDFRAKIAGIATFKVTNPGAAVVYFDTATSQRELLGATGRFTHINVTAAAGVGDEQLKRNVADALGAGAYTVRTQKETADENRKGINGFMGVIKYAMLGFAGIAFLVGIFLIINTFSMLVAQRTREIGLMRAIGSSRGQVNRSVLVEALLLGVVGSLLGVAAGVGIAVGLMKVMSSMGMDLSTRDLTVKATTPVAGLLLGIVVTVLSAYLPARRAGKVSPMAALRDAGTPADGKAGLVRGLIGLVLTGAGTFALYAAATADKASDGSLVLGLGVVLTLIGFVIIGPLLAGVVVRVISAVLLRAFGSVGRMAERNALRNPRRTGATGAALMIGLALVACLSVVGSSMVASATDELDRTVGADFIVQGNQRIVAQAEKAMQATPGLAHVTRYKDLKAELTTPDGKVDGSGITAADPSYAEDLHRKTTAGELTAAYGKDAMSVGSDYAKKHGVKVGDTVSVAFTGGSTARLKVAAITDDDVAIDQGARYMSIETMKKYVPAGKIPPNQIMFGEAKKGQEKQAYAALKKAMEPYPQYQVRDQTDYKQELKDQVGQLLNMVYGLLALAIIVAVLGVINTLALSVVERTREIGLMRAIGLSRRQLRRMIRLESVVIALFGALLGLGLGMGWGTTAQKLLALEGLNVLEIPWPTIIGVFIGSAFVGLFAALIPAFRAGRMNVLNAIATE

SEQ ID NO: 11088 - protein, 262 aa, Streptomyces avermitilis
VTSAVTIPRHGGTGGRTAVAARARQVVKAYGSGETRVVALDHVDVDIARGQFTAIMGPSGSGKSTLMHCLAGLDTVTSGQIFLDETEITGLKDKKLTRLRRDRIGFIFQAFNLLPTLNALENITLPMDIAGRKPDKGWLSQVVETVGLGERLRHRPTQLSGGQQQRVAVARALAARPEIIFGDEPTGNLDSRAGAEVLGFLRRSVAELGQTIVMVTHDPVAASYADRVLYLADGRIVDEMYEPTADAVLDRMKDFDARGRTS

SEQ ID NO: 11089 - protein, 519 aa, Streptomyces avermitilis
VGGGWMQGERNSVDDTRPALRETARPPGTDRRGPVVAALMLSMALAALDSTIVSTAVPQIVGDLGGFSVFSWLFSGYLLAVTVTLPVYGKLSDTFGRKPVLVVGAALFLAGSLLCATAWNMAALIAFRIVQGLGGGALQGTVQTLAADLYPLKERPRIQARLSTVWAVAAVAGPGIGGVLAAYADWRWIFLVNLPIGAVALWLIVRYLHEPERKPSGTRPRVDWAGALAVFACGGVLITALVQGGVAWPWLSTPSIALSGTGLALAALVVLVERRAAEPIIPGWVWRRRTIAAVNLALGALGLLMVAPSVFLPTYAQSVLGLAPVAAGFVLSVWTLSWPVSAALSQHVYRRIGFRNTALLGIGAAALILLAFPFLPYPGAAWQPALLMLLLGAALGLFQLPLIVGVQSTVGWAERGTTTASVLFCRQTGQTIGASVFGAIANGVLAARLGGASDLDSVTRALDAGTAPESTRRAIADAVHAVYLGAAGAAALAFLVLLVLAPRRFPVLKTQPAEDDTAR

SEQ ID NO: 11090 - protein, 159 aa, Streptomyces avermitilis
MSYDPSPSYPVPPHHTYSTPPHHAHLDPPANSSPSYATYPWQPQPSEPARQRQPRRAALGHHSDLRLLRGAYRWQRRVATLTALGYFMLFLLLSAFAPSFMTRTVSGGLSLGLLLGLLQVPVTGLAIALYEYTAQHTVDPIADRIRKQADLDAQREAAR

SEQ ID NO: 11091 - protein, 548 aa, Streptomyces avermitilis
MSTSSTQHAAPAFTGFSSSAQAMSLVAFTTVATITLLLCVMTGPDRDDLEEFYTGYGSLSPMRNGLAIAGDYISAATVLGTGGVIALTGYDGVVLALSTALSLMLLMFLLAEPLRNAGQFTMGDALARRMPGRAVRVTACVVTIAALLPLMLVQLAGTGDLLSFILGFSNDTLKTGCIIGLGALMISYAAIGGMKGTALIQIMKIVMLLGSGAVVAVLILHRFDWDPGALFSAAAAHSGAGPAFLRSGLEFAGGPNPRLDMITTELTVVLGGGCLPHVTMRMYTANSARQVRRSMSWAVPAVALFVLVITVVGFGATALVGREAIAAADPQGNTAYLLGSRAAFGPDVSSAETLLFTTVTTALFLTLLASVAGMILACANSLAHDVFAARVQEMSPRREMTLARLSALAVGVPTILLATLVHHRSLQPLVTLSFCIGASAIAPALVYGLFWRRYTRTGLLCTLIGGTLSVVLLLPGTNLVTGSPAAAFPDADFNWFPFTTTGLATIPLGFLLGWLGTLLSGRQKAEAQRRQYEAVEGWILAGAVRRSG

SEQ ID NO: 11092 - protein, 299 aa, Streptomyces avermitilis
MGSAPVSPHGFVPVRRGYRPEQVDAYAAALSRDRDAAWERAARLTVLAREMEGEALRLRETVAGLAPQGYESLGERARRIFELGQEEAEAVRESARREARDVVEEAEAEGRRVREAAQAYADEVCEEAEERIRTRLLAARAEADDLRISARREVKEGRGEALAALREVRQRTEALLAEQEKEHAERGQRAEREAAERAAALDAHHAERVVRAEAALAEAERALVEAAESARQAQQDAEERARVLLAEARVHADRVARETERVLRDHGEQWDCVRAHMDHVRSSLTALTGRAPAEWAEGL

SEQ ID NO: 11093 - protein, 903 aa, Streptomyces avermitilis
MGIPDRRNGTSGGASGGTSGGASGGVAGGASGSGVGGTSGGAAAAVSGGASGGVSDARGNADAHGASAAPGAHAASAAPGGGTPWPAAGGADDDVQDAAPQDSVPGPPPGATPWAGTDTNAEAGEDRSVPLPATVFAPPLSGLGDLRDEDTPPPAATPDAKTALMSGGSGLPRTTVAPALDDAVPAAPQGPVTPPPGPGAPRVPSGPSAAQGPGAPEGAAPSAPSYGYPQGPGAAPSAPSYGYPQGPGAVPGTPPPGAPQAPGAPHAPGAPQAPTGSPVPGRPLAPNAGDIADAATSKAAPPRGARAGAPRPPGAPGVPGAPGTPGAPGAMPPASGPGAPGTPAGGYVPTQLVSQLGPDGPEGLAGPNPPSAPGTPNPPGGTPPGGVHHAATMFADPGRPGAGPGAPQPPGPPGAPGRPGVPNPPGPPGAPGQPGAPGAPGAPNTPGGTPPGGVHHAATMLAGPSVGGPGAPLPPPGAPGAPGMPPGAPGAPGAPGGPGGVHHAETMLAGPPVGGPGLPPPGAPGAPGMPAGTPPGVPQGWPPPQPGQAMAPQPMPGQPMPPQPMPGQQPPAYGYPPTGQPTVGPGYQAVLRYRAQDGSEQQLIRRSAPGTPHPEWQILHELRAMNVPPQQVLELHTELESCELPGAYCARMIRESWPQARITSIATYGTDHASRQQGMQELLAHQGELHQVADGPARPGPVRSPLPPVPPAQPIPPEAIAQELAAAFGPGVFHFDQAAVSRQGVPPIVAHTLVVAGLPVDMGPFFWAQAQPGRPVPTLAELAQERGVQPGPDAGSYLVMGSDFGKAICVQYGTANIVAVPVEAGPGGAPVSPQFVNTGLPEFARCLALLGRMWRLRFGLNQEQAGRWTVDFQAQLASLDPAALGSPESWWSVLLEQMWDGLL

SEQ ID NO: 11094 - protein, 328 aa, Streptomyces avermitilis
MTTGRLGQQAAPPNAAYAGQVVQFPDPVRAARHPRGVRVDEHGYPDFSAYARAAAEIAEPPEGFGVDELRLTDYVSANAALAASGHDLWDTIPAVATPHGWTWHHVPGTRRVELVPVEVKALLRHHGGLATAVVDQNKRGTRPLQETRPAHFGLPKSSVAVTEQQVQGVEEDLGYRLPGAYRSFLKAAGGCAPVGAALDAELGLLVDQPFFTVRDEAAVNDLVYVNKCLRDHLTKDYLGVGFVQGGLVAVKVKGDGAGSVWFCAYDDARDQDAWPPAERVQRLLLPCGEDFDQFLSRLAGNPPELETVANLMVDGGFARAVPVSSVGE

SEQ ID NO: 11095 - protein, 166 aa, Streptomyces avermitilis
MNATQTDTSGDPRVGWSSTGTPHAPTLLHRRDGILPTVAAALSVRGATLTGTAARGDQPPPLHPLVQDFLDTLTSSQRDRFSGRCAEVLLISRHIAAVDATRTKRAARKPMTNGEARKALKQAKLTARRIREDGDPLHGSFATPCRACTALSDHFGVRIVDPTAQG

SEQ ID NO: 11096 - protein, 164 aa, Streptomyces avermitilis
MHADRTSTTRFSVPVDAALRTAGWQPGRWDIKQAEFWADTLRSHTSPAGHRHTVFPAAVEAWAEFGGLHLTAQGPGRQLAPATLHLDPLHGLHLARTLGDLGRALDTEVCPLGEESDSRALVAIDTEGRVYALDHTGDWYLGPDIDQGLTTLLTGIEPVRLTAG

SEQ ID NO: 11097 - protein, 439 aa, Streptomyces avermitilis
MTTTGEAETGALTGPWWWTRWRSAVLDIGLALLSAVECVIEGARFARDAALPLPVGMVFGLFAGLVLVLRRKWPIAVVLVSIAIAPAQMGFLMGVVGLYTLAASELPRRIIGSLAGMSFVGMLIVTYVRAHQGVVRGDLTIGDWFVPFLSITTALGMTTPPVLLGLYVGARRRLMESLRERADSLERELMLLAERAEERAEWARNEERTRIAREMHDVVAHRVSLMVVHAAALQAVARKDPEKAVKNAALVGDMGRQALTELREMLGVLRTGDGTVSRVRAVPLVAVGVAAAAAASRAVEDPSDGPCLADLDVLVGQSAAAGMAVDLSVEGDARSYAREVEQTAYRVVQEALTNVHKHAAGAKTRVRLAHRSAEIAMQVENGPPPEPGSAESARLPSGGNGLVGMKERVSALGGVFVSGPTDAGGFRVSAVIPAGAEAA

SEQ ID NO: 11098 - protein, 482 aa, Streptomyces avermitilis
VSAIRPAAVVVLAAGEGTRMKSATPKVLHDICGRSLVGHVLAAARELEPENLVVVVGHAREQVTAHLAEIDPAVRTAVQAEQNGTGHAVRMGLEELGGVVDGTVVVVCGDTPLLSGETLRQLAATHTADGNAVTVLTAEVPDATGYGRIVRDGASGAVTAIVEHKDASESQRAVREINSGVFAFDGRLLADALGKVRTDNSQGEEYLTDVLGILREAGHRVGASVAADHREIAGINNRVQLAEARRILNDRLLTRAMLAGVTVVDPATTWIDVTVTFGQDAIVHPGTQLQGTTQLGEGAEVGPNSRLKDTRVGAGARIDNTVAERADVGAQASVGPFAYLRPGTRLGAKAKVGTYVETKNASIGEGTKVPHLSYVGDATIGEYSNIGAASVFVNYDGQDKHHTTVGSHCRTGSDNMFVAPVTVGDGAYTAAGSVITKDVPPGSLAVARGQQRNIEGWVARKRPGSAAAKAAEVASRKPEGED

SEQ ID NO: 11099 - protein, 324 aa, Streptomyces avermitilis
VTGIKTTGEKKMMFFSGRAHPELAEEVAHKLGVGVVPTKAFDFANGEIYVRYQESARGADCFLIQSHTAPINKWIMEQLIMIDALKRASARSITVIVPFYGYARQDKKHRGREPISARLIADLMKTAGADRILTVDLHTDQIQGFFDGPVDHLFALPILADYVGAKVDRSKLTVVSPDAGRVRVADRWCDRLDAPLAIVHKRRDKDVANQVTVHEVVGDVKGRVCVLVDDMIDTGGTICAAADALFAHGAEDVIVTATHGVLSGPAADRLKNSKVSEFVFTDTLPTPGELELDKITVLSIAPTIANAVREVFEDGSVTSLFDEQ

SEQ ID NO: 11100 - protein, 197 aa, Streptomyces avermitilis
MSEVKLAAEPRTEFGKGAARRIRRESKVPAVVYGHGAEPVHITLPGHELLLALRTPNVLLSLDIEGKAQLAIPKAVQRDAIKGFLEHVDLLLVRSGEKVNVEVYVHTEGDLAPGAYLLEHVLSTLTVEAEATHIPESVTVSIEGLEAGASILAKDIPLPSGTTLAIDEDAVVLQVLAAQAEEAAEEAAGTAEVGSEA

SEQ ID NO: 11101 - protein, 203 aa, Streptomyces avermitilis
MGDTDVTSDANAPWLIVGLGNPGPEYARNRHNVGFMVADLLAERIGGKFKRAGKAQAQVIEGRIGPPGPANRRVILAKPMSYMNLSGGPVNALREFYKVPVANIVAVHDELDIDYGVLRLKLGGGDNGHNGLKSMTKAMGPDYHRVRFGIGRPPGRMQVADFVLKDFASAERKELDYLVDRAADAAECLVIEGLERAQGTYNS

SEQ ID NO: 11102 - protein, 170 aa, Streptomyces avermitilis
LSWPRIAAMPAVSSTQSAYAVLRFGRIAAMGTVAVLILIAGVWGSWGTAQHVMLTKGRERGTMTVARCSGDRCTGPYVPATEGSKARARVVIEQPVAVRRGEVLTVVVKPGSDQVVRTGPAGVLYAWVPLGGALLLASVVVAGGLRMARTAWALAGSGLVLLTAAFAALQ

SEQ ID NO: 11103 - protein, 910 aa, Streptomyces avermitilis
VSSADDQTTTTSSELRADIRRLGDLLGETLVRQEGPELLDLVEKVRRLTREDGEAAAELLRGTELETAAKLVRAFSTYFHLANVTEQVHRGRELRTKRAAEGGLLARTADRLKDADPEHLRATVKNLNVRPVFTAHPTEAARRSVLNKLRRIAALLETPVIEADRRRYDTRLAENIDLVWQTDELRVVRPEPADEARNAIYYLDELHAGAVGDVLEDLTAELERVGVQLPDDTRPLTFGTWIGGDRDGNPNVTPEVTWDVLILQHEHGINDALELIDELRGFLSNSIRYTGATEELLTSLGTDLERLPEISPRYKRLNAEEPYRLKATCIRQKLENTKQRLAKGTAHQPGRDYLGTGELLHDLKLIQTSLREHRGGLFADGRMDRTIRTLAAFGLQLATMDVREHADAHHYALGQLFDRLGEESWRYADMPRDYRGKLLAKELRSRRPLAPSPAPLDAAGAKTLGVFHTVKRALAVFGPEVIESYIISMCQGADDVFAAAVLAREAGLLDLHAGWAKIGIVPLLETTDELKAADTILEDMLSDPSYRRLVALRGDVQEVMLGYSDSSKFGGITTSQWEIHRAQRRLRDVAHRYGVRLRLFHGRGGTVGRGGGPSHDAILAQPWGTLEGEIKVTEQGEVISDKYLVPSLARENLELTVAATLQASALHTAPRQSDEALARWDAAMDVVSDAAHSAYRRLVEDPDLPTYFLASTPVDQLADLHLGSRPSRRPGSGVSLDGLRAIPWVFGWTQSRQIVPGWFGVGSGLKALREAGLDTVLDEMHEQWHFFRNFLSNVEMTLAKTDLRIARHYVDTLVPDHLKHVFATIEAEHELTVREVLRITGGEKLLDTHPVLQQTFAIRDAYLDPISYLQVALLKRQRDAAAADTPPDPLLARALLLTVNGVAAGLRNTG

SEQ ID NO: 11104 - protein, 336 aa, Streptomyces avermitilis
MTPGSDVIDDVPKANNDSMAASATLGGERKRSLEQITLLLFIIVPFLALLAAVPLAWGWGVSWLDMGLMVFFYYLGCHGITIGFHRYFTHGSFKAKRPLRIALAIAGSMAVEGPLVRWVADHRKHHKFSDAEGDPHSPWRFGETVPALMKGLWWAHIGWMFDEEQTSQEKYAPDLIKDGAIRAISRQFVLWTGLSLALPPLIGGLVTMSWWGAFTGFFWGSLVRVALLHHVTWSINSICHAVGKRPFKSRDRSGNVWWLAVLSCGESWHNLHHADPTSARHGVERGQLDSSARIIRWCERLGWAYDVRWPSRSRIDSRRHTGEEGSRRKRESADAA

SEQ ID NO: 11105 - protein, 225 aa, Streptomyces avermitilis
MIDSVATDSSSTPSNEKPRRARRTRMTGAERRQQLLEIGRTLFAAKGFEGTSVEEIAAKAGVSKPVVYEHFGGKEGLYAVVVDREMRRLLDMVTGSLTAGHPRELCEQAAFALLDYIEEYTDGFRILVRDSPIPQSTGSFASLISDIATQVEDILGREFKSRGFDPKLAPLYAQALVGMVALTGQWWLDVRRPKKAEVAAHLVNLAWHGLDGLEPKPRLIGHRKS

SEQ ID NO: 11106 - protein, 122 aa, Streptomyces avermitilis
MLTAVDHVQLAAPPGSENALRAYYVDILGMRELPKPPVLAARGGCWFQAGAVHLHLGIEADFRPARKAHPGLRVTDIESYGGRLAARGATVTWDANLPGHRRFYSEDPVGNRLEFLEPLAPE

SEQ ID NO: 11107 - protein, 269 aa, Streptomyces avermitilis
MPAAVPSWDPSQYLRHADHRARPFADLLARVPELPRDPARIADLGCGPGNVTRLIAERWPTARITGLDNSPEMLAKAAAYAGPTAGGGRLDFAAADARTWTPAQPYDLIVSNATLQWVPGHIDRLPAWTDGLAPGGTLAFQVPGNFDSPSHRLMRELAHSARWKDRLADTLRHDDAVHTPAAYLEALTALGCAADVWETTYLHLLQGEDPVLDWVKGTGLRPVLTELGAADAEAFVAEYREALREAYPATERGTVFPFRRVFAVAHKEA

SEQ ID NO: 11108 - protein, 165 aa, Streptomyces avermitilis
MEDEVDRLVAAWRRERPDLDVEPLEVLSRVSRLARHLDRARRLAFSEHSLEPWEFDVLTSLRRAGAPYQLSPGQLLTQTLVTSGTMTNRIDRLAKKSLVERLPDPSDRRGVLVRLTEEGRDRADQALAGLLDQERAILAELSRAQRAELAALLRQLTAPFDNIPG

SEQ ID NO: 11109 - protein, 259 aa, Streptomyces avermitilis
VGVSVLRIRVLVVDDHRIFAESLAAALAAEPDVDVSAAGSGPAALRALERAVAEGRRFDVLLVDADLGGNVPGTRPAVSVRDGNEEGLVDGISLVAGVRSGQPSVRTVVLAEKDDPRRAALALQAGASGWVAKDCSLSRLLTVIRGVLRDETHLPPALLTGVLRELTAARKHRTESERLVESLTPREREVLRCMVAGLGRKAVAERLFLSPHTVRTHMQNVLGKLGVHSTLAAVALARRAGVGPADLAGDVVERGGQLA

SEQ ID NO: 11110 - protein, 163 aa, Streptomyces avermitilis
LQNWLASAFMVSRMFRMETEVDNERRNLLRRRLLDTNTAASPALRALRGTPDERERPLHVWALSEDGDLAGGLVGHTWTTWLHVTYLWVDERHRGTGLGSRLLADAERTAHDERGCRAARLETWDFQAPDFYRKRGYEVVCVIPDYPPGTTEYTLTKRLDRLS

SEQ ID NO: 11111 - protein, 381 aa, Streptomyces avermitilis
VVGVREGFEELYGAAPEGVWAAPGRVNLIGEYTDFNEGFVMPLALPHTAVAAVSRRTDGVLRLHSADIEGPVVELRVDELEPLTNTSWAAYPAGVVWALRSAGHPVTGADIHLASTVPTGAGLSSSAALEVVTALALNDLYELGLTRPELARLAQRAENDFAGVPCGVMDQTASACCTEGHVLHLDCRDLSIRQVPFDLPAHGLELLVVDSRVKHALGDGAYAERRAGCEEGARQLGVSHLRDVAYEELDGALSRLPDERVRRYVRHVVSDDHRVERVIALLDAGDVRAIGPILTDGHVSLRDDLRISCPELDLVVSTANAAGALGARMTGGGFGGSAVVLVESADVDTVTKAVTEAFAAAGHTAPRVFPAVPSEGARRLS

SEQ ID NO: 11112 - protein, 319 aa, Streptomyces avermitilis
MSGKYLVTGGAGYVGSVVAQHLIEAGHEVVVLDNLSTGFREGVPAGASFVEGDIRDAAKWLDSSFDAVLHFAAFSQVGESVVKPEKYWDNNVGGTLALLAAMREAGVRKLVFSSTAATYGEPEEVPIVETAPTRPTNPYGASKLAVDHMITGEAGAHGLAAVSLRYFNVAGAYGSCGERHDPESHLIPLVLQVAQGRRDAISVYGDDYPTPDGTCVRDYIHVADLAEAHLLALDAATPGEHLVCNLGNGNGFSVREVIETVRQVTGHPIPEIVAPRRAGDPAVLVASAATARERLGWNPARADLAGIVADAWAFAQHKE

SEQ ID NO: 11113 - protein, 361 aa, Streptomyces avermitilis
VKKTSTPLADGRELIYYDLRDDAVRDAVDRRPLDRTVTSSEIRRDPLLGDSVAIASHRQGRTYHPPANECPLCPSEGERLSEIPDSSYDVVVFENRFPSLAGDSGRCEVVCFTSDHDSSFADLTEEQAGLVLDAWTDRTAELSHLPSVQQVFCFENRGAEIGVTLGHPHGQIYGYPFTTPRTALMLRSAAAHKEATGGGNLFDDVLAGELAGERIVLQGEHWVAFVPYAAHWPYEVHLYPRRRVPDLLALDEDARTEFPKVYLELLRRFDRIFDGTGGGKEGVGEPPTPYIAAWHQAPFGPLEEFEGVNRDDFALHLELFTIRRTSGKLKFLAGSESGMSVFINDVPPETAAQRLREVASS

SEQ ID NO: 11114 - protein, 569 aa, Streptomyces avermitilis
MQSPTHLPTHPLEATYLADGLRLPTNGLDYTILAIYFAVVLGIGFAARRSVKTSLDFFLSGRSLPAWVTGLAFIAANLGATEILGMAATGAQYGVAVVHWYWIGAIPAMVFLGLVMMPFYYGSKVRSVPEYLLQRFDKPAHLLSSVLFAFAAILIAGVNLYALAIVVEALLGWPQWVAIVVAGFLVLAYITVGGLSSAIYNEVLQFFVILAALIPISVLGLKKVGGWDGLSDSLTKSHGDNFLSAWGGTGIGDPNPLGANWLTIILGLGFVLSFGYWTTNFAEVQRALSAKNLSAAQRTPLIAAFPKIFIVFLVMIPGLVAAVLVPKIGTSGSDLQYNEAIPYLMQELLPNGVLGIAVTGLLAAFMAGMAANVSSFNTVFTTDIWQRYVVKDREDAYYVRFGRLITAVGVMASIGTAFIASSFSNIMSYLQTLFSFFNVPMFVVFIIGMFWKRASMKSGVWGLLAGTTAAMVNYFWIYKQGVIDIPSDQGANFVSAIVGFVAGAVVMVAVTLFTAPKPEAELAGLVYGTRSPGVPEPPATGDDAWYRKPALLGWSAIVLAALCYIPYSF

SEQ ID NO: 11115 - protein, 95 aa, Streptomyces avermitilis
MSDLQREVTDLESKSATAARLFDIRRIIGGLFVVYGIIVTIAGISPSDADLDKAQGVNINLWTGLGMLALGLFFLGWMWLRPTVPPTPADEEPSQ

SEQ ID NO: 11116 - protein, 265 aa, Streptomyces avermitilis
VEKTLEFSDLLRLIDERSTAFRAAVAAAPSLDVQVPTCPEWTLFDLAQHIGEGRRDWAATVAAGPAPAKSAAEGAPAAPREREALLAWLAESTEQLLDALRKAGPDRGCWTWWGTSQSPPTSGAVARHQLQQLAVHTYDAQITVGAPQPLPDEVALDGVDEFLSTCVATTSAWPHEPAAVDFHASEGRSWRLSLSADGARATRLPAPGTAPAAAAGEDPDAADASFRGTAGELVLALYGRIPVDSLKLDGGRRLFDLLEAWDPDE

SEQ ID NO: 11117 - protein, 161 aa, Streptomyces avermitilis
MFQIKRFGSAVATAAALASLSMAIAPVAVAATVPQPSTSVAQGVKGPKPPTPPTVCAALSGQLSTQLQAAATALAATPPDVPAAQAAIAAAQVTVAQLRANGCLPAAPPTPPTCAALTLQLQAQLQVLAAALAANPQDPAAITAAFNAVVATAAQLAAVCV

SEQ ID NO: 11118 - protein, 241 aa, Streptomyces avermitilis
MGVRLMVVDDHRLLAEALASALKLRGHRVLAAAAPAAGAAELVITRAPEVCLLGTATPDEPGIFDPVVKIKRERPQVAVLVLGPVPNPRGIAAAFAAGASGYVRHDERIEGVERAIMKARSGEAAVAPQLLQGAFSELLNPAAQPDDEGQRLLQMLTPREVEVLVRVADGEDTRLIAAGMGIAPSTARTHVQRVLMKLGVGSRLEAAALAARTGLLDRAGPVAAGPGSAEDSRPAEQPGRG

SEQ ID NO: 11119 - protein, 497 aa, Streptomyces avermitilis
VPMQPQPPQGGRKGPGATTWIIVAAVAAIALIVGGGVYMYSATGGDDSKNNSSGTTGGSGGSGGKDDDATSGGTDTSSGEAKEKAPADPSAKVLFQVPAPTITDKQEIDSVSGSWLTDSVYAKAGVAKIVGYDADSGSSKWTLPLTGQTCAASPEISASGIAAVVTESGKRAGSSDRKPCSEVTAFEVATGKKLWTKNVSVGDAKVAFEEVTLSGGTVGVGGLYGGAAFDLSSGKVLWQPKASGCQDLGYAGGEQLVAVRKCGEYGDEKYEVQLLDPKSGNVKWSYKLPTGIDNAKVISSKPVVFGVDSGDVTASGVTDVFSLDDSGKLRTKITLADGKYEHDCGVGDVHDCHAITVGNDKLYVPTKEHDGTAQGSRTNEIVTFSLATGKTAGDKIDAGDDYEIFPIRMDGGNVIAYKDGPYNKGSQVVSVNGTSLKETKLLETPSTDAVRSAISSMVPKSSELLYTDGRLFMGKDLVSKPYSTDQKEYAALGFGAK

SEQ ID NO: 11120 - protein, 623 aa, Streptomyces avermitilis
MTQPPNQPPQGGFGAPQDQPTVGFGGPQDPRQDPRQEPRQGTPPPPAQPPQTPPPPPQSPPPPQPGYGYPQQPGPYGQPQQPGQPGQPGPYGQPQQPGPYAQQPGPYGAPQPGYGYPQQQPGYGYPQQPPQFPGAPTPPPGGGSKNPFKGRPAVLIAAAVAAALLVGGTVWAVTSEGGSDDKKPVAEKSEKSKGGKTSASDDPVNPGDGSGDGGADPENLNEGRQAGESKVLWYKEAPDAPGSGADAPGMWITGKTAVKAAYKQVFAYNVGNGNPAWDPITFPQKICSVTQQKTADDKIVVAYMSGVSDNAKCNQLQQIDLDTGKKGWKGEIAEGALFDSTFNVSLTITGDTLLVGRSQSGTAYDVATGKKRWDKKKYGTACFPTAFAGGAKMISVASCAAGTGTEHDEVQELDPATGKARWTKKIPKGWTVARTYSVAPVVLYLTNEDKKQWNVSTLKNDGTLRSQVDVDESFAPQCGWAILDRDLQGCTGVAADANTLYLPTEAKTGANEVVAVSLETGKEKWRVKSPADESMLPLKMDGTHLIAYVEPSYDAGGQVVSIPTAGSSHKPAKLLQNPQGTAQIESGFYSKALDWVDGRFYLSTTRLTGSNESKEKLMLAYGK

SEQ ID NO: 11121 - protein, 601 aa, Streptomyces avermitilis
MAVNLVNVEAVSKVYGTRALLDGVSLGVSEGDRIGVVGRNGDGKTTLIRMLAKLEEADTGRVTHSGGLHIGVLTQHDSLDPEATVRHEVIRDMEDHEWAGNAKIRDVLTGLFGGLDLPGFPQGLDTVIGPLSGGERRRIALAKLLIEEQDLIILDEPTNHLDVEGIAWLANHLRERRSALVCVTHDRWFLDQVCTRMWDVQKGDVYEYEGGYSDYVFARAERERIAATEEVKRQNLVRKELAWLRRGAPARTSKPRFRVEAANELIADVPPPRDSSELMKFASSRLGKTVFDLKDVTVQAGPKVLLKHLTWQLGPGDRVGLVGVNGAGKTSLLRAMAEAARSEGEKQPAAGRISTGKTVKLAYLSQEVAELDPALRVLQAVQQVRDRVDLGKGRELTAGQLCETFGFNKEKQWTPVGDLSGGERRRLQLLRLLMDEPNVLFLDEPTNDLDIETLTQLEDLLDGWPGSMVVISHDRFFVERTTDKVYALLGDATLRMLPRGIDEYLERRHRMEEVAAAAVLAAAPAPAKATSAADARAAKKELQKIERQLDKISERETKLHTQIADNATDFEKVAKLDAELRELAGEREELELRWLELAEDA

SEQ ID NO: 11122 - protein, 444 aa, Streptomyces avermitilis
MRPSDLAAATPASRDRYVDLLRVASLGTVVLGHWLMAAVDVGTDGRVRVGNLLAVEPRLQLLTWALQIMPVFFFVGGFSHALSYRSLSRKTPDTSVYSAFLRARLQRLLRPTVVFIGVWGAAALGLQLAGSGGGLLDVSLRLVAQPLWFIGIYLAMVAFTPPLLRLHERYGWGAFGGLVAAAGTVDVLRFALGVPYVEFLNFAFVWLAVHQLGFLRADGKPGRPYVLAGAGLAGAALLVAYGPYPLSMVGMPGEKISNMAPPSFALLCHGLWLVGAVELMRAPATRWLDRPRVWRTVVAANGISMTAFLWHLTAMLGVYGALLAADVRLPAPGTGAWWVQVPFRIMVAALLTAVLVAAFRAFEKPSGVREPSAPRAYAGPAAAFGVTLCLFGVLGLSMVGFGGLLEGRSAVLVAVRVTAPAAVLMTLAGWLLVERSGRRRPRGA

SEQ ID NO: 11123 - protein, 297 aa, Streptomyces avermitilis
VSVTVRVPAKVNVQLAVGGARPDGFHDLANVFLAVGLYDEVTATPADELRITCEGPDAAQVPLDRTNLAARAAIALAARHGLAPDVHLHIAKDIPVAGGMAGGSADAAGALLACDTLWGTNASRGELLDICAELGSDVPFSLVGGAALGTGRGERLRELEVGGTFHWVFAVADGGLSTPAVYGEFDRLSEGVRVPEPVASQELLDALAKGDAVALAAAVSNDLQPAALSLFPSLSDTLEAGRAAGALAALVSGSGPTTAFLTRDADGADAVAQALLASGTCRTARVAPSPAPGATVL

SEQ ID NO: 11124 - protein, 295 aa, Streptomyces avermitilis
VSSPAPDALLGPADIRELAAALGVRPTKQRGQNFVIDANTVRRIVRTAGVRPDDVVVEVGPGLGSLTLALLEAADRVIAVEIDDVLAGALPATIAARMPERAERFALVHSDAMHVRELPGPPPTALVANLPYNVAVPVLLHMLDTFPSIERTLVMVQAEVADRLAADPGSRVYGVPSVKANWHAEVKRAGSIGRNVFWPAPNVDSGLVSLVRRTEPIKTTASKTEVFAVVDAAFAQRRKTLRAALAGWAGSAAAAEAALVAAGVSPQARGESLTVEEFARIAENRGADHADDANN

SEQ ID NO: 11125 - protein, 511 aa, Streptomyces avermitilis
LESDDRSARFWSPDPDALGAVVVSNSQHETYETYGTYGPPYDPYDPYELSYGPAEPPYRMTEPSYGAAEPSYEMTEPSYGTAGPYGPVPEPPGPHTAPTLPYGVYEDTYRPAYESGGSPLPRRTDAAGHPGGRAEARRAARRRKISVRPDPLRRLLPQALVVVFLAGGTTAFVAKDKAIELSVDGKPRTLHTFADDVTELLAEEGVGVGAHDVVAPTRGSALASGDEVAVRYGRPVHLTLDGQRRRVWTTARTVDGALQQLGVRAEGAYVSTSRSRPIGRAGLALDVRTERTVTIMADGRERTIRTNAATVGEAVEQAGITLHGQDTTSVAPGSYPRDGQTVTVMRITGSREVREEVIPFGVERMDDPALFRGTELVERAGQPGARRVTYSLRTVNGVRQTPKRIDSEVVRQPQNRVVKVGTKPPPPSVAGADDLNWGGLAACESGGRPGAVDPSGTYGGLYQFDTRTWHDLGGSGRPQDAPAAEQTYRAKKLYVRRGASPWPHCGSRLHD

SEQ ID NO: 11126 - protein, 295 aa, Streptomyces avermitilis
MPSRASDADKNAAPPLPAPLRVPVADSHTHLDMQSGTVEEGLAKAASVGVTTVVQVGCDIDGSRWAAETAAAYDAVHATVALHPNEAPRIVHGDPDGWSRQGARRPGGDGALDEALAEIDRLAALPQVKGVGETGLDYFRTGPEGKAAQERSFRAHIEIAKRHGKALVIHDRDAHADVLRVLKEEGAPERTVFHCYSGDAEMAEVCAHNGYFMSFAGNMTFKNAQPLRDALAVAPLELVLVETDAPFLTPAPYRGRPNAPYLIPVTVRAMAAVRGIDEDALATALAANTARAFDY

SEQ ID NO: 11127 - protein, 138 aa, Streptomyces avermitilis
MSEIAGQTGQSTGNRTSATAIVHESYSFACMRCGHGWEQSYEIEHHLDAEGSEFVMYVANGKVVPSPLSRPTCVNCDGHVVRIMRPGQVSSVLDLLHRPHRPEPGRRPLAEPEAAPVRETHHWHLSDLLHPFHHRKAG

SEQ ID NO: 11128 - protein, 288 aa, Streptomyces avermitilis
VTTAPGTLVLAGTPIGDITDAPPRLAQELAGADVVAAEDTRRLRRLTQALGVQPAGRVVSYFEGNEAARTPELVEALLDGSRVLLVTDAGMPSVSDPGYRLVAAAVAKDIRVTAVPGPSAVLTALALSGLPVDRFCFEGFLPRKAGERLSRLKEVAEERRTLVYFEAPHRLDDTLAAMAEVFGEDRRAAVCRELTKTYEEIKRGPLEELAAWAAEGVRGEITVVVEGAPVRGADELDADELVRRVQVREEAGERRKEAIAAVAAEAGIPKRDVFDAVVAAKNAARTGA

SEQ ID NO: 11129 - protein, 579 aa, Streptomyces avermitilis
VTSTASSTDIRQGQAADEQWPSWQQRLRRFGYTAPPRTDVRDRLVPPFSEPSPRLWAAIGLRQEVADRVTRWSAWGGPLLVTLLAGLLRFWNLGSPKAVIFDETYYAKDAWALIHNGYEANWAKDANDLILQGNGHVAIPTDPAYVVHPPVGKYVIGLGEWLFGFTPFGWRFMTALLGTLSVLLLCRIGRRLFRSTFLGCLAGALMAVDGLHFVMSRTSLLDGVLMFFVLAAFGCLVVDRDRARARLAAALPADADGVVRPDAHTAETTRLGPRPWRWLAGLMLGLALGTKWNALYVMAAFCVMAVLWDVGSRRVAGARRPYAAVLRRDTGITFLATVPVAVATYLVSWTGWILSPANGSGGYFRNWAATDGKGGHWTWLPDWLRSLWHYEHEVYEFHVGLSSPHQYQSNPWSWLVAGRPVSYFYESPSPGKDGCPADAGEKCAREVLALGTPLLWWAACFAVLYVLWRWLFRRDWRAGAIACGIAAGWLPWMMYQERTIFYFYAVVFVPFLCLAVAMMIGAILGPPGSGERRRVVGAAGAGVLVLLIAWNFIYFWPLYTGTAIPIDDWRSRMWLDTWV

SEQ ID NO: 11130 - protein, 151 aa, Streptomyces avermitilis
MEECLCLAREAATTGNYALGAVVIKGGQVIGKSGSKLVQGNDPTGHPEITAIRQAAERLGSRYLPDAYLVTTLEPCPMCTSAAIWAKMRGIAYGATQIDAVTWSQEHPDQKYTWRQIRMRARDVIRAGTPSLELHEEVRREECAKLFTLSH

SEQ ID NO: 11131 - protein, 259 aa, Streptomyces avermitilis
VRAVRHPRPERRQQFSGLESVKGGGLVQRRRVRKQPSNAFCRNLMRQQVPRVDASVTDPEDREQQADITRLLLYHLNAPVAEYCRLRGVLPAPGAVRIAVRAGDDENGMNFLYEIPHDTVTPYDIPGLLRTVLTGPQIYSSGDVSEVLGMTLVRLRPEEISPDPEPVQGQALTVVRALSGPGDDENPFLIGFLMHGEGLLRLYVQRPDRPGIIGADIRLTETPPTALIASLPSLVREEQYQRPSQDDPHCDLLVDLTNW

SEQ ID NO: 11132 - protein, 236 aa, Streptomyces avermitilis
VKTRPGAIPAPVSFDAAWCATDLGGYRACRYTYEHYPYESLPPLDSDQFTGAFPWLGGVGDSIPEQVAGLDTLAGELAAEGLALPRDFVTFQTSANLRGSLHEVSVTGCWTSISHPLPSPVEPGAFLVRFLRDQQDCVIWYLYLRPSSEAFVVHSHLDYEFEYEARRAGEETGTDLDDGEEQRTAILWCAPTFEEFAHRFWTENRLWHAVNGGDLSRVEPRLRRYLDHYAAPETSP

SEQ ID NO: 11133 - protein, 99 aa, Streptomyces avermitilis
VARVLPPLTLVRTLWWKSSRGDRQMAWPGPLLIANVIRHVGDGTPVRVRVSRREDGGTRIEVTDPDPRANRTVMERSQVPRNDPGSAATGARPVTDHRR

SEQ ID NO: 11134 - protein, 225 aa, Streptomyces avermitilis
MGKVLGDVLGLAAGVAISPLPIIAIILILATPRGRLNGPLFTLGWILGLSALGAVMLAIASPAGASAHNQPATWVGAVKLALGVVLVLFGARQWHRRPKDPSQAQLPKWMGAIDRLTPVKVFGLGLALAALNAKNAPLTIAAAASIGSAGLPVGQQIASLAIFVLIATLGLLAPLGVFLLGGERAKTTLGNWKDWAAQHNVAVMAVLFFVLGLKLLGDGIGILVS

SEQ ID NO: 11135 - protein, 220 aa, Streptomyces avermitilis
VRAMAPHVRALGDPRTDPWQENLTMTATTGAPQSAQPERPGRSDGVCSEFTVFTKIKPGHADALREDLAAFAEAATDAKAREALRQIGTLHDARHVIFDNDTRFMFASVFDGSWDTYIDDFAKTVVGARFDKIFSHTEGFPGVADPGVKDWFVSQQEPAGVFVSSYPDLTVQQIWKDQRVDEAFEALLDTAEFRAALDNPANAELLATPAFQKLMEEAAA

SEQ ID NO: 11136 - protein, 456 aa, Streptomyces avermitilis
MEAQASMNTTASSSAGDVRVEIDDVQSGALRPRPVPYEGKFILLRVDDRHAGRALLRRLLPVTSGGLPSVDRSQDAWVAVAFTYQGLRALGVPQESLDSFPRAFREGMAARAELIGDVGESAAAHWEAPFGTGDVHIALSALSSDTAQLDKELDRARVAYEDTPGVQVIWQQEVHQLPTGRTTFGFRDGISHPNIEGVGLPGSNPQEVPIKAGEFILGYPDETGSLPPMPSPDVLGRNGTYAAVRKIHTNVAAWRQYLRANTSSAQEEALLAAKMVGRWPSGAPLTLTPEHDDPELAADPHRVNNFLYREDDDRGFRCPAGAHIRRTNPRDATIIGDARMHRLIRRGTTYGPPLPEGVLEDDGAERGLVGVFIGAHLERQFEFIKAEWVNDGNFIGYPGEKDPVAGHHGGTGSVTIPEKPVRRRLRNLPSFVVTRGGEYCFVPGLRALRWLAELED

SEQ ID NO: 11137 - protein, 376 aa, Streptomyces avermitilis
MAAQFVPYTPDVEDDDPHFDQNVQTVIAKTEAYITESVKAGGTGRALRDAHAKGYGLVRGEVEILDGLPPEYAQGIYATPGTHDALIRFSNGSPHAGADARLGAATGLALKIFDIPGPTLLEDEPDTGTFDYANINGPIFFCNTVEHYLFIQELFLNAPAYFSQGRPGAHRFFTDFVTGKGTLDQDDWAWDEFLAFLRLSKTPPANLLLSSYWTMGAVRHGDYIAKVRITPDPSFAAAVVRRDIDPTSAQEVFRPALEAELQERPYAFDIQVQLCTDLERMPVEDTTVEWPEQLSPSVTVAKLRLPRQDISGPENLEKMDSLSFTPWRVTAEHAPLGNIMRSRKEVYRQSSMERHKLNQQPRTEPRSVAEVLGPAQ

SEQ ID NO: 11138 - protein, 454 aa, Streptomyces avermitilis
MTKRDVAALFGNRFLTEPAPSQTFPEEGMTATDTMRLLDEDLVMEGDPQRNLATFVTTWMEPEAQRIIAENLHRNFIDHAEYPISAEIEQRCVRMLADLFHAPGKTTGCRTQGSSEAIMLGALSLKWKWRERRQAANLPADRPNLVFGGDVHVVWEKFCRYFDVEPRIVPLAEDKYTIGPEDVEPHIDENTIGVVAVVGTTFTGHKDDVVGIDKLLRDVRKERDLDIPIHVDGASGGFVWPFLYPDSKWDFRLEQVRSINVSGHKYGLVYPGIGWLVFREESDLAKDLVFYENYLGKTDATFTLNFSTGASMVLAQYYNFVRLGRQGYTYVMETMQKNAHALADNLRSSGRFEVIGSDLEQLPLVAFRLAGEHAYDESDIAWQLSAERGWMVPAYTLPPNAERVKILRALVKETLSREQIERLTQDIADACATLDHKGGTTEVERAQIKRGTGY

SEQ ID NO: 11139 - protein, 380 aa, Streptomyces avermitilis
VRGVSGSCPKSDQGDGRKRARSSRPATYMNARRRPASDRRYSLVLGLPGLLGSYWAVFGCSANETGCRAGRRERQQSPNCDHGAFLAGDRRGAPGRGGRCAAAVWRSRQRAVGDVVNWLTSLPAVVLVVGGLLLALLVAAVARVGVRALVPVEERDRVPQIATPLMPTLGAAFAIFAALTLASEAGYLRAAEGLVSDEAAAASRLAWAATSPRVRSEPIHTALLNYLQTTRAGEWEATAAASGDDPATARAIARLERSVRAEAARPEVGTPTGTELVASVDGVTSSRRARVAAASRDVPALYVVTLVVSGLALIVNAGALVFRSSLRTSLLIVGVASVVGLSLALLFALSGPWSGPLIVSGHPLDAVIGNLKSGFFDGGP

SEQ ID NO: 11140 - protein, 543 aa, Streptomyces avermitilis
MRKGAKVAIVGGVFAVMVGGAGYGAFNVVSALSGDGAGGSPETKAARSGPPSGAEVKEASAKFFSSWAKGDAETAASYTNDAVAAGSLLAGYRAEAHITKVHITPGTPSGTTVPFSVKATVAYEGRSKPLAYDSELTVVRGETTGRALVGWKPALVHPDLTAADDTLVTGEAATPPIEAVDRDDVVLTEKKYPSLGPVLDALREKYGEKAGGRPGVELSVHHTGEGAADKTLVTLAKGTPGKLRTTLSASAQAAAEKAVAQYSESSVVAVKPSTGEVLAVANHREDAFNAAFEGRLAPGSTMKIISAATLIDNGIATMNGPAPCPDTATWQSQTFHNLTGMEPNEKATLANSFLRSCNTAFVKYADEVKVDSLTKEAEDRFGLGGDNWKTGIISFDGSVPASGGPNTAANMIGQGEVQMNPLNMASVTATAMTGAFRQPYLVPRSLDDREFAAAKGLASNTVTQLKAMMRLTATQGTAAGVMAGLGGDIGAKTGSAEVDGQAKSNSWFTGYRNDIAAAATTEEGGHGGDAAGPIVAAVLRTGG

SEQ ID NO: 11141 - protein, 557 aa, Streptomyces avermitilis
VGKRRRAAERNRSGRPLVIGGLIAVVAVGGAVGAYSLYGSGAAAEERASQARHRAVKTGPLSATEIRTTATEFLNAWQRGKVTGAAAATDDSAAARTALTGYTKDAHITDVTLTRGKRSGASVPFSVKATVSYKGRSKPLAYESKLTVVRRAKDGVPLVSWRPSVVHPDLGAGDRLVTGEAGTPPIKALDRDGGELTTATYPSLGSVLDGLREKYGKKAGGKAGIELRVVRKAVKGTGKDKTPDKTLVTLSEGTPGTLKTTLSPTLQAKAEQQVTTKERASVVVMRPSTGEILAFANSSHGFNTALQGSLAPGSTMKIVTSTLLFEKNLASADKTHPCPKYVTYGGWKFQNDDKFEIKGGTFKASFARSCNTAFISQAKKLKDGDLTAVAQQIYGLSMNNWSIGVPSFDGAVPVQSAAQMAASLIGQGGVRMNPLNMASVVSTAKTGVFHQPYLVSPSLDDRALAKTTRTMSSSTRAQLKEVLQYTAAAGTAAQAMSGLGPDYGAKTGSAEVDNQKQPNGWFTAWKGDLASAGVVQAGGHGGDSAGPIVAALLRAGS

SEQ ID NO: 11142 - protein, 113 aa, Streptomyces avermitilis
MSVVEQYARAHVVSDAPEAQDTVPVVLRYDPEVDPRSVRIGLPGPHEWAFSRDLLERGLRTPTGTGEVRIWPCGRVQAVMEFHSAQGVAVVEFEAKTLFRFLRRTYLATPVPH

SEQ ID NO: 11143 - protein, 351 aa, Streptomyces avermitilis
VHVPDGFINAPVSAVSGVVAAGAIAVSLRGARRELDERTAPLAGLVAAFIFAVQMLNFPVAAGTSGHLLGGALAAILVGPFTGVLCVSVVLLMQGILFADGGLTALGVNITDMAIVTTVVSYAVFRGLVKVLPRKRRSVTVAAFVSALLSVPAAAVAFTLFYAVGGTTDIAIGKVATAMIGVHVLIGIGEAAITALTVGAVIAVRPDLVHGARGLQQRLKLRVGGDLVDAPAAPAAPATPVAARTSHRKVWITGLVTSLVLAGFVSFYASASPDGLEKVAKDQGIDAKAKKHHTEDSPLAGYGVKDVSDARISGGLAGVIGVGITVVAGTGVFWAVRRRRTVDASPVNTSV

SEQ ID NO: 11144 - protein, 253 aa, Streptomyces avermitilis
MGAGHAHKLYRHGHSAVHALPPHTKLAAAFAFVVVVVSTPREAMWAFALYAALLAVAAHRARVPAPFLLKRLLIEVPFVAFAVLMPFVAEGERVDVLGLSLSVNGLWGAWNVLAKGTLGVAASVLLASTTELRELLLGLQRLRLPPLLVQIASFMIRYGDVITDEMRRMRIARESRGFEARGIRHWGVLAKSAGALFIRSYERGERVHLAMVSRGYAGSMPVIDEVTASRAQWSYALALPFAALVVCLLGWTL

SEQ ID NO: 11145 - protein, 262 aa, Streptomyces avermitilis
VNSPAPVGSPAPVSAPSLDVAGLAFAYPDGHQALFGVDFRVERGERVALLGPNGAGKTTLVLHLNGILTGGAGTVTVAGLPVGKRHMAQIRRKVGIVFQDPDDQLFMPTVREDVAFGPAAAGLTGAELEARVDRALDQVGMAEFKGRPPHHLSFGQRRRVAVATVLAMEPEILVLDEPSSNLDPASRRELADILRSLDVTVLMVTHDLPYALELCPRSLILSEGVIAADGRTGELLADDTLMRAHRLELPFGFDPRSVTMGA

SEQ ID NO: 11146 - protein, 153 aa, Streptomyces avermitilis
VTNQENTGSLLLDDQLCFALYAAQRAVTAAYRPLLDELGLTYPQYLVLLVLWERGETTVKELAAALRLDYGTVSPLLKRLESAGLVSRERSARDERSVLVAVTGRGEELRERAAHVPQALLAATGLRGGEVAALREELWRLAERAESAAAQSR

SEQ ID NO: 11147 - protein, 134 aa, Streptomyces avermitilis
MYVAEATAHGGRDGYVTSQDGRLELKVAMPPALGGNGDGTNPEQLFAAGYSACFHNALVLVGRREGYDLSGSTVAAKVGIGPNKQRGYGLAVALSVSLPVVDQDLATKLVDAAHEVCPYSNATRGNIEVTIVLG

SEQ ID NO: 11148 - protein, 400 aa, Streptomyces avermitilis
VLHPLSLNGGRSTGVDVNGTVAEGFEPVRDAFARNFETLGERGAAVAVYRDGRRVVDLWGGTRDVDGTAGWERGTAQIVRSATKGVAAAVLLMLAERGELDLDAPVGHYWPEFKAQHKERTLVSHVLSHRAGVPVLDRPLTPAEAADPDLGAAAVAAQAPAWEPGTDHGYHAQTYSWLTGELVRRVTGRGIGEWIAAEIAGPLGLDLWVGLPAARAHRVGRGGQTEAPAADGALRTRPKRAVAQAYADPSSLTRRAFAAITPLPDENDPGYRAAVLPASNGIATADALARFYAALTGEVDGVRLWRPETVALARAERSAGPDRVLVVNTRFGLGHMLHGSASPLLSPASFGHPGRGGPLGFADPESGIAFGYVTNGYRTSVTADPRAQALVRAVRAALGN

SEQ ID NO: 11149 - protein, 91 aa, Streptomyces avermitilis
MTHTIVGWHVELEFQEDDQRTRAAALVRLPDGSEVRAHGYASRHRSDENQPRVGEEIAAARALNELAMQLLTKAHDEIDGASGRTSHPLTQ

SEQ ID NO: 11150 - protein, 281 aa, Streptomyces avermitilis
VTPAVTAAVLLAAVTHASWNAIAHRVTDKLVGFTLISGGGMLIGLAAIPFAALPAGGSWPYLLISCAIHIAYYALLMRSFRLGDFGQAYPIARGTAPLVVTVLAAVFAHEVPDGWAAAGVVVSCAGLTGVALWGLRGRRPNWAAIGAALATGLTIAAYTVVDGLGVRASGSSFGYIAWLMAIQGVVIPAYALYRWRGAAVGLLRPVAGLGLVGAALSVAAYALVLWAQTRAELAPIAALRESSIIVGAAIGAVFFKERFGAPRIAAAGLLVVGIGLMLHAG

SEQ ID NO: 11151 - protein, 183 aa, Streptomyces avermitilis
VPGTRTASVPCMTTSTATEGTEDSGAHPRFTEALREMGLGDLQTRIRRFPDGTRTAAEAAAAIGCELDQICKSLIFAADGVPVLVLMDGASRVDVELVRRELCAAKVTRAKADLVRETTGYAIGGVPPFGHRTRTRVLADRSLLEHDTVWAAAGTPYAVFPMEPEALIAHAGAALVDVRERTA

SEQ ID NO: 11152 - protein, 62 aa, Streptomyces avermitilis
MSTSELHWFKSSYSDSSNPSDCVEIATTPATIHIRDSKTPHTPHLTLTPATWTGFLAYVSGK

SEQ ID NO: 11153 - protein, 269 aa, Streptomyces avermitilis
VEVVVAVQLKLNRTLLQLRQLAHLLRIPGLLQTVEGDFLLAVEAQGKKDLDKPHSWAYYLAHLYAKYKLPPVLLVVCQDRNTAAWAALPVDIGPPEWPALTVRPLVLGPDNVPMVSAPAEAARDIPLAVLSAMLHGRDRGIDAILKALAAALKGLEVLDPETATIFVELTSQGLDKTWAAKIWRDLVAVDTSFFTSSLSQEIRAEGEAKGRAADILRILDRRGIPVADTDRERITSCDDLDALTLWFDRAITAASIAEVFAEDLSDQEQ

SEQ ID NO: 11154 - protein, 215 aa, Streptomyces avermitilis
VGLVQILLSLRLDGKEEVALHRLEKARYPKKVRELAQLEERAVELQLYGNHNLHGLLQTPEYARALLGTRRPKLSAGEMERALAARMARQSILEKESGPELSFVQEQVTLERPVGGKMVLSRQLEHLLEVARLPNVELQVMPTARAEHPGTGGRIQVLKFADGTGAGRTDDEFGGRPVSDPRQLRILELRYGIIRAQALSPGESLDFIEQALGEL

SEQ ID NO: 11155 - protein, 741 aa, Streptomyces avermitilis
VATFLYKIGRFAFRRRHFVALIWVALLTLAGVGAASAPTAGSSSFSIPGTEAQKAFDLLESRYPGMSADGATARVVFRAPSGEKMSAAANKAAVKKTVKALGDGSEVTSVTDPFKTHSLSKDGAIAYTQVRYDVSGMELKDASKDALNEAAQEARDTGLTVEVGGDALQAAPETGSTEVIGIAVAAVVLVITFGSLIAAGLPLLTALIGVGIGVSTITALAKALDLGSTTSTLAMMIGLAVGIDYALFIVSRYRAELAEGREREEAAGRAVGTAGSAVVFAGLTVVIALVGLAVVNIPMLTKMGVAAAGTVAIAVLIALTMIPALLGYTGRMVQPAGKKSKLLGGGRAAKKPARPNMGTRWASFVVRRPVAVLLLGVVGLGAAAVPATSLELGLPDDGSQPTSTTQRRAYDLLSDGFGPGFNGPLMVVVDAKSSTHPKAAVTKVTDTVKDLKGVVSVTPATYNKAGDTAMITVVPDSKPSSVKTEDLVHAIRDAGGEIKAGTDAEVLVTGTTAMNIDFSQKLNDALVPYLALVVGLAFLLLIVVFRSVLVPLKAALGFLLSVMAALGAVVAVFQWGWLAGLMGVEETGPIMSMMPIFMVGVVFGLAMDYEVFLVTRMREAYVHGEKPAQAIVTGFKHGARVVTAAAVIMIAVFSGFIGSSESMIKMIGFGLAIAVFFDAFVVRMAIVPAVLALLGKRAWWLPKWLDRALPNVDVEGEGLRAHDTDRPKDGDADEDRKLARV

SEQ ID NO: 11156 - protein, 196 aa, Streptomyces avermitilis
MTETATVRRSRITPEREAELYSAVLDLLREVGYDALTMDAVASRTRSSKATLYRQWGGKAELVVKALRHQKHSHFGEVDTGSLRGDFHALVTRENNCEMEQNSALMRGLAVAVHANPDLLDAFRDLIIDPETNEMQRLLQRAVDRGEIRADNPATQYVLHMLIGAFAARTLIDELPPTQEFLTSYVDAVVLPALGA

SEQ ID NO: 11157 - protein, 1101 aa, Streptomyces avermitilis
VNPESENVPGYLRFPHLHGARLCFAAEDDLWLAPLDGAGRAWRITVDRTKVGHPRFSPDGRHIAYTSWRSLVPEIHLAPVDGGPGRRLTYWGSTDTRVCGWSPPDKEGHSDILAVASHGEPFSYFTWAYCVPTDGDPGGRLPWGPVSDIAVADIDGERKTLLLTGTPPHEPASWKRYRGGATGRLWLHGQRLLADIDGHLDSPLFVGGRIAFLSDHEGIGNLYSCAYDGSDLRRHSDHDAFYARHASSDGTRVVYQCAGDLWIVDDLSPDSVPRRLDVRLGGPRAGRRTYQVPAAQHVDGISVDETGRASAVVVRGSLYWLTHRDGPARTITDTPGVRVRLPEMLGSGGQVAYITDAEGEDAVEIAHLPRVSGEREPRRLASGRLGRVQELAADPRGERLAIASNDGRLLLITVSEAAGEEAGADAVESGEPDGEVTELIRSINGPVRDLAFSPDGAWLTWSHPGIGRSLRQIKMARIKDRLIVDVTNGRFEDENPVFTRDGRYLAFLSWRGFDPVYDVHTGDLSFPLGCRPYLVPLSSATLSPFALNPEGRPVAGGLDPVEDESGDGAVTVELEGLESRVTPFPVTASKYSALYPVAGGGLVWLRWPISGALGETFANPDDTSGRPTLEYFNINKAKKSELVGHLDWFAVSGDGSRLVVVDEGDLRAVPSTESGDGDTTVWIDLRRIMHEVDPGAEWRQAYAEAGRITRAYFWDPGMSGVDWDAVLDQYRPLVERVASPDEFADLLREVLGELCTSHAYVTPARRNEGPRHYQRWQGLLGANFVRREGGWMLKRILPGDSSDSKARSPLAGTGIREGAMLTHVDGRPVNLVTGPYPLLAGAGGTTVELTFAPAEGDGPPRRVAVVPLIDERPLRYQDWVAKRREVVRELSGGHCGYLHIPDMGGSGWAQFNRDLRMEVSRPALIVDVRGNAGGHISELVVEKLTRKILGWDLTRDAQPVSYASNAPRGPVVALADEATASDGDMITAAFKLLKLGPVVGQRTWGGVVGMTGRHRLGDGTVITVPMNAAWFEEYGWSIENHGVAPDLEILRTPLDWAEGRHAQMDDAIQLAQDLLRTHPAATPPDHHDVPVHTRPKLPPRR

SEQ ID NO: 11158 - protein, 57 aa, Streptomyces avermitilis
MGKKDKFQDKANELKDQAQKAKEEAGKRSSEQRDRSRESLEDTQQDMDDRMNQDYDA

SEQ ID NO: 11159 - protein, 81 aa, Streptomyces avermitilis
MGMKDQFQDKANELKDKAKKARSGDRDDMSQRARKDREQGQKPMREPMRDPMREPMRDPMRESMDDPMDDPLDELDEHRGA

SEQ ID NO: 11160 - protein, 294 aa, Streptomyces avermitilis
MSRVSLEGQVAVVTGAARGVGELLARKLSARGAKVALVGLEPDALKQVAERLHTDSGHWYADVTDHEAMVRVAAEVKQRFGKVDIVVANAGVANGGPFAESDPVAWRRVIEVNLIGSAVTARAFLPVLTESRGYLLQIASLAAITPAPMMTAYCASKAGVEAYAHSLRAEVGHKGVRVGVGYLSWTDTDMVRGADQDEVMRELRQRLPWPAGKTYPLGPAVDRIVAGIERRSSHVYAQWWLRGMQGVRGYLPMVIGAVGQREMRRFEPRLKNVGTKLVGAGGAADEEARNTARN

SEQ ID NO: 11161 - protein, 307 aa, Streptomyces avermitilis
VSRLTHTGAASGPYAPPVPVRALTAVSADGARLHVEVHGPENAPAVVLAHGWTCSTAFWAAQIRDLAADHRVIAYDQRGHGRSPASALCGTEALADDLEAVLAATLAPGEKAVLVGHSMGGMALMATAGRARFREHAAAALLCSTASSRLVAEAKVVPLVAGRLRTWLTGRILRSRAPLGPVTPVAMRVLKYGTMGAGSSPVMVEACARIVHACPRQVRYAWSRVLGLLDLDHGVRELTVPTAVLVGAEDRMTPPVHARALVAALPNCVGVTELPGLGHMTPVEAPELVTARMRELVAAYVHIKEGA

SEQ ID NO: 11162 - protein, 520 aa, Streptomyces avermitilis
VRLGGVGMTEGDQVRRERVPHVRVAVIGSGFGGLGAAVRLRREGVTDFVVLERADSVGGTWRDNSYPGCACDVPSHLYSFSFAPHPDWPRTFSGQEHIRAYLEHVTDTFRLRPHLRFNSEVKRMTWDADQLHWTVETATGTLTADLVVSATGPLSDPRIPDVPGIETFPGKVFHSARWDHDYDLRGKRVAMIGTGASAIQIVPEIQPRVAKLTLFQRTPPWVMPRVDRAIGRAERGLHRMLPFTTQVRRGLLWGIRELQVQAFTKHPDELGLVERLARRNIARAIEDPGLRARLTPDYRIGCKRILLSNTYYPALARPNVDVVASGLAKIDGSTLVAADGSSAEVDAIVFGTGFHVTDMPIAERVVGADGTSLAQSWSGGMKALRGASAPGFPNWMSIIGPNTGLGNSSMILMIESQLNYLADFIRQLDVLGGKVALDARPGAVHAWNSKVQERMRRTVWNTGGCTSWYLDANGVNTTVWPGTTTEFRNATRRVDLAEYEVVRAPRPAAAGVRAKAEADA

SEQ ID NO: 11163 - protein, 222 aa, Streptomyces avermitilis
VAEKAGRREYRMEELAKEAGITVRTLRFYRERKLIPPPRREGRIAWYDETHLARLRTISGLLERGHTLSGIAELAEAFDHGRNVGELLGLGAPTEETPVRLSPEELADVFAGQATPENLAAALDLGYLGTDGGEIVHISRRLLDVSAALVREGIPLADVLAAAGRVRVHTEALAALFTDLVLKRDRTPEDLRRLRPLAKSVVEAELSMALDRRLSAARDERP

SEQ ID NO: 11164 - protein, 163 aa, Streptomyces avermitilis
MTIQLLQLRPVAFDHPDAVRLNDEVQLEYAERYGDDGDATPLDPTMFAPPRGLYLIAYDERDQPVATGGWRSQDENGEGYTDGDAELKRMYVIPAARGLGLARRILAALEDDARAAGRLRMVLETGAKQPEAISLYASSGYEQCPKFGYYRFHELSQCFAKAL

SEQ ID NO: 11165 - protein, 287 aa, Streptomyces avermitilis
MRASVHLCARPLSWIKYRAGVLTVTSVNVNGLRAAAKKGFVEWLAETSADVLCLQEVRAEPDQLPAGVRAPDGWHVVHAPAAAKGRAGVSLYTRREPDRVRVGFGSAEFDGGGRYVEADLPGVTVASLYLPSGEVGTERQDEKYRFMGEFLTHLKDLRERAAADGREVLVCGDWNIAHQEADLKNWRGNRKNAGFLPEEREWLGRVLSPEDGGYVDVMRALHPDVEGPYSWWSYRGRAFDNDSGWRIDYEVATPGLAAKAVKGFVERAATHEERWSDHAPVTVVYDL

SEQ ID NO: 11166 - protein, 150 aa, Streptomyces avermitilis
MRRRVAATLATTALALTAALVPVTSASAAPADKATVLSNWTQTSAASYNAFFAARADQGAWSAYGFDWSTDYCTTSPDNPFGFPFANSCVRHDFGYRNYTAAGSFDANKSRLDSAFYADLKRVCTAYSGVKKASCDATAWTYYQAVVNLG

SEQ ID NO: 11167 - protein, 219 aa, Streptomyces avermitilis
LRANRPLRVVLAEDSVLLREGLIGLLTRCGHEVVAAVGDAQALLVAVAEHAPDIVVTDVRMPPGFQDEGLHAAVRLREKQPALPVLVLSQYVQRAYASELLDSGDGSGVGYLLKDRVGQVEEFVDALSEVADGGTVVDPEVVRQLLRRRRDPLARLTPREREVLALIAQGKSNGAIARELVVSEAAVGKHIGSILTKLDLPPADETHRRVLAVLAFLRA

SEQ ID NO: 11168 - protein, 429 aa, Streptomyces avermitilis
MHPRNVWQAMSRPGFLLSSWPWRSVLYLLTGAAAGIAALVGIVTVAVIGGALAVVLVGLPLLVCVALAGIPVASMERRRLALIDLDPATDQHRTPSAPGLWAWLRTRLREQATWRELGYALLFAGLLWPVDALVVTVGLLFPVSMVATPLLMATIGGGDEAKVLKQWTVTTWPGAFGVAVLGLVLLVLCAYALGLAGGARAELTRLLIASREADLDAKVTELASSRVRLVDAFEAERRRIERDLHDGAQQRLVALTMTLGLARLDAPPGPLADQLAKAHEEAGKALEELRELIHGIHPKVLADYGLEAAVADAADRSVVPVDVGLELPGRLPEAVEAAAYFVVCEALANVAKHSGASRAEVSGGHRDGRLVLEVHDDGGGGANAADGSGLTGLADRVSVLDGRLALSSPPGGPTLLRVEIPCERTDPCA

SEQ ID NO: 11169 - protein, 615 aa, Streptomyces avermitilis
VEAREGARRVALSGSKVHTVLAVLLLARGRVVGDSRLSSLLWGWDPPATMNAQIYTYISRLRKHLGSDVELVRRQPGYQLLAEGSHVDMVEFERLDRLGRGALEERRFPEAGELLRRALDLWQGPALSNVTPHLAEAELPRLEESRMSALERRIEADLALARHQRLVPELTGLVGEFPVRERLRAQLMTALYRCGRQAEALRAFHEGRDVLAEELGVDPGTDLTDTYQAVLTGELSRLPQPARLPTSAPYASPYSAPYASPSAPVMLPPDTADFTGRENQFTELCARLAPPPADRRSAFRPRRLLITGMAGVGKTALAVRVAHAVAAEFPDGLLYARLHHEDGTVKDSCAVLAQLLRALGDPSAGLPAPDGSPLQLDELIRRYRTRTAGRRLLILLDDAANELQLDALLPGTSDAAVLVTSRSRLSAVPGSRTVALDPMDRKESLALLAAIAGNARLAVEPEAARTVTEVCAGLPLALRIAGTRLASRPLWPAARLARRLADPATRLGELRVGELDVRRRLDAALRQLPAPELELLRTLVRRGAEPFAATSAALLLGLPETAAEEFLERLVEVSLLEMTGIDSAGEPRYRLHALVRLVVRAGREQRTDRPFTRAS

SEQ ID NO: 11170 - protein, 170 aa, Streptomyces avermitilis
MAWLAERVLAYGSFGILATVLLLPALEAALPLVGALLPGQTAVVMGGLLAWHGRVPVVAALVTAVVGAVLGNVAGYAVGRRFSARLLARVPADGRRRRYTDRALGLIERRGGSAVFVGRFTAVLRTLVPTLCGATRMPLRRYLAWSVVSSVVWAPAFVLIGYVMGPAGPG

SEQ ID NO: 11171 - protein, 248 aa, Streptomyces avermitilis
VGQMSNDAIQLRSVSRRYGAGGGAVTALDQVSLAFPRGTFTAVMGPSGSGKSTLLQCAAGLDRPTSGSVTVGDTELTKLSETKLTLLRRDRIGFVFQAFNLLPSLTAEQNVALPLRLAGRRPRKTEVREVLAQVGLGDRAGHRPTEMSGGQQQRVALARALITRPDVLFGDEPTGALDSQTSREVLTLLRGMVDSEGQTVIMVTHDPVAASYADRVVFLVDGRVNGELIGASAEDIAARMTKLEAAPC

SEQ ID NO: 11172 - protein, 818 aa, Streptomyces avermitilis
VLSVALRTLRARWVTFVGSFVALSLGVGLLAVMGLALASSLDAPDREPERFAAAPVVVKGPDTLRVPTPIGDRVQKLAQPRAVPAALKTELKKLGPVVEDRAFAVRARGGPGELVGHPWSTAAFAPYEISAGSAPRAADQVVVSGDWATVGQRLRTDRGTVRVVGTVAGLGFENAVFFSDARAAELAPVSVQLVVDADAAAVRDAARDSTGVSVLTGDRRRLADADPDRDSEALVAMNAMFGTAGGVTAFVSVFVVASTFAFAVAQRRREFGLLRTAGATPGQIRRMVISEAFLVGVLASAAGCVFGAYGAPRLAQWVVDNELAPSWFTIGDYTWPYYMAFWTGLLVALCGAVAASWRAGRTGPTEALREASVDTRTMTWGRWLSGLALLLTAVGTLVFALATEPGDLLHRKTYVSRPMLLITAVALLAPVLVRPMTRLIAWLPAQLPGATGMLVRENAAAGVRRTAAVAAPVLVTVALAGSLLGATATLNEAKATETRAQTAANFVVSPGSSEGFDAAALTRLREVPGAKVSATSTSAVYVLEDGVALIKSEARAADPAMLATTTRLPLAAGRVTDLDDDSIIVNEEWARHTVGQSVAVWLGDGTKKTLKIAAVMHTGTGNNGVYVTPGNAQGASVDRVDVSVADGADASAVAAGLREAVRSEGGQVLTKDAWVRASYPETNRTTRLGFILVLGIALVYTAIALANTLVMATSDRVRDLAVLRLAGATRWQVLRLVGAEALMVVAVGGVLGLLAAGLNLAGMWGALGLLEVWSSIELPWPVLGAAVAVCAVLAVVSAMAPAGVSLRRRAVELAGMRE

SEQ ID NO: 11173 - protein, 311 aa, Streptomyces avermitilis
MTAIEYTAQPGTPVHDYIAENREKLRRVLGERGALLLRGFEVGGVDGFDGVVQAFSGSRPLSYAERSSPRSTIKGQVYTSTDYPADEEIFLHNENSYQAVWPHTLYFYCIEPAHTRGATPLADIREVYRAIDPAVREEFVRRGGWQVVRNFHADFGVPWQEAFGTGDPAAVEEYCRGKGITAEWRADGGLRTTTVRAAVHTHPGSGEEVWFNHATFWHVTSLAPEVQEGLREIFPDEDLPTNTYFGDGGRIPDETVAHLRAAYRSATTRFDWQRDDVLIVDNMLAAHGREPFTGPRKIAVAMAEPSRPPAA

SEQ ID NO: 11174 - protein, 264 aa, Streptomyces avermitilis
MTAAYENLRDRDAVHIWQGRAPDALAPGDTDLLSEEERHLVERLPDAAAVRYAAAHAALRRVLAEYLDVAPGDIVLGRRPCPRCAHPRHGRPRVDWPPTDLDFNLSRSGPRWLLAVVVGRQVGIDVEDGRSLDVEGASKLVLSASELAHVRSAPDEAARSHAFFRCWTRKEAVVKASGVGIITDLKAVDVRPALDGPVVVTHTEPTGPDTWLVQDLSVADGVFAALAREAGSTGPVVRRGDEERQEQQQEQQQEQAKATGVLVR

SEQ ID NO: 11175 - protein, 311 aa, Streptomyces avermitilis
MTDTQTWTPLEIETECEGGAEELVERVAGMGEEFGKLLVAEKGLVFRGFGVTPEDLDRALDALLPNRLAYVHGNSPRTKVGSNVYTSTEYPREFTISMHNEMSYAHAWPSRLAFYCQVQPGGGGATPVVDAAVWYGSLDAEVREAFAGGVRYVQNLHDGYGLGKSWQDTFETTSREEVEAFLGPTGATWEWKADGGIRVSSVRPATTRHPVTGAEVWFNQSDQWHPAGLGDDTAAALAQILPEDELPQSVTFADGSPIPAEYVAQIRDRGLANAVDVDWRAGDLLLIDNVLLAHGRRPFVGDRRVLVAMSD

SEQ ID NO: 11176 - protein, 249 aa, Streptomyces avermitilis
VRGEPWLRRYPARSGGRPRLRLVCFPHAGGNAQLYHGWPARLPSDLELLAVCYPGRQERLAEPCVTDMATLADAVTDALLPHLDVPLALFGHSMGSTVAYETALRLRARHGVVPRRLMVSARSAPHRARPSGLYLRTDDELVAGVRRLGDLGSQAYDIPELRELLLPALRADYRLIESYRPATPPEPVASPVTAYLGRSDPGCDRDSVLAWSELSSAGDFALRTYPGDHFYLAQREAELVADVSKDLEE

SEQ ID NO: 11177 - protein, 450 aa, Streptomyces avermitilis
VTLVEGAGPRTGAPPEPLRRNREFLLLWSGASMSFLATRVTAVAYPLIVLWHTGSPLAMSVVSTAALLPLLLVQLPAGALVDRWDRRRLMLGCEAGRVLAVGSVALALAAGRVDVAHLAAVAFLESALAVFYRLAERGAVRNLVHPAHLPAALAQNEARGRAAGLLGQPGGVLLHSAARWLPFGFGVLGYLVSLVTLLFVRKDFQAERTAPARPGRLTGEVAEGMRWLWRQRFLRAALGYVAGTNVLFQMLALALILRIKEAGLPSATLAVVVGIGGVGGLGGALAGGRLQRLMSQRTLLIGGAVAWTLLIGAMALTARPVLLGALYAGTGFVGAVFNVAAAVYQVRITPDAFQGRVAATAGLIGSGTNALGSFAGGLLLTAWGALPTVRAIAAAMAVLALLAAVAPGLRGETAATPRTAEPVDPVEPTEKPVEPTEKPVEPTEKGEGDR

SEQ ID NO: 11178 - protein, 307 aa, Streptomyces avermitilis
VAPVRHLISIDDLSDTDLYSLVLRGAAFSAGTAGRPAPLAGDVVGIYFRKTSTRTRTAFSSGALRLGAQIIAYGPDDLQLNTGETSEDTGRVMSGMLDVLVARTAGDPAEMRAWAAQDRMAVVNAMSADEHPTQALTDLTTLQGHFGGIEGLRVLYVGEGNNTASALALALTRYPGVSLELRTPPGYGLAPYYRERAADQAGRHGATFRERHDMDDLPADQDAVYTSRWQTTGTSKPDPDWREIFAPFQVSAALWETSPKAVFLHDLPAHRGDEVTAEVLDGPASIAFAQAENKMHSAMAVLEWCRP

SEQ ID NO: 11179 - protein, 3686 aa, Streptomyces avermitilis
MEKPVLSGTDADALRAELLRRRLAGRRTGATRRPDIPRADRDGPLPLSYGQQQMWFLSRLEPDSPEYLVPLVLRLRGALDTEALDKAWHQLLERHEILRTRYALDGDEPVQIIDAPRPLPLDRSGAADDDAVRALVEADLARPFDLGRDWPVRARLIRLADDEHVLAVVFHHIACDAWSTGVFGQELSALYTGSAPAPLTVQYADYAAWQRAELTGEVVERHLDHWKGRLADLAPLELPTDRPRPAVRDGAGSAVAFDVPAPLGTRLRELAAAHDSTPFMLFLAAYQSLLARHTGRADIAVGTVVSGRGRPELQRLIGYGINTLVMRGDLSGDPAFTDLLARTRATVLDAYDHQDVAFAQVVDALGPERDLSRTPLFQVAFTMHGDRSSAFAFPGVEVAPFEGAGRVAKFDLDLQIRERADGSFGGHLEYATSLFDRATVERFAGHLLRLLTGIAATPGARLSAYEIVGEREKAVLLGAPEAVEPVTRRVHEVFEEQVARTPEGVAVSFEGTDLTYAELNARANRIAHALIAKGVGPETLVGLSLERGIELIPALLGILKSGAAYLPLDPANPADRIAYIVGDAQAPVVVTTAEHAHLFDVELLLLDTDAPDLAARPDSDPGVPGSPENLIYTIYTSGSTGRPKGVALTHTNVVRLLERGNEHYAFTDTDVWPLFHSYAFDVSVWEMWGALLHGGRLIVVPYDVTRSPEEFLDLLVRERVTVLNQTPSAFRSLVAADAELSLRAVVFAGEKLEISELRPWADRFGLDRIALVNMYGITETTVHTTYHRLTERDLDPRAGNAVGHPLADLRVYLLDADRQLVPVGVPGEIHVGGPGVARGYLNRPELTAERFVPDPYGPAGSRLYKSGDLARRLPDGSLEFLGRIDDQVKIRGFRIELGEIETALAAHPQVRDAVVLVREDTPGDKRLVAYTTPAADQAPAPGDLRSHLAARLPEYMVPAAFVALDALPLTTNGKLDKRALPAPGQDALGAAGHVAPRTVAEERIAEVWADVLGLDRVGVEDGFFELGGHSIRAVTLVGRLRAIGYDLAVRDVFEYRTVARVAELVTGRPAPEDADRRTEPFSLLTAEDAARLPDGLADAYPLSQVQLGMVVEMLTDDGKHPYHNVTSFRIRDERPFSLDALRAAAAAVVARHEALRTSVDLTGYSVPLQLVHTTAEMPVGARDLTSLTEEELLSSLREFTAKERSELFDLATPPLLRLHAHMAGDGSWWITNTECHAILDGWSHHSLLMEVLEEYGRVRDGGQPSEAPVPGVRFADFVAAELDVLDSAGTRAYWQSVVDGYARLTVPAPWRGDPDDTGAPYRVPVPFHDLEDRLRALATKAGASLKSVLHAAHLKTLSMLTEEDRFFSGLVCNARPEVLGADRVYGMHLNTLPFAYDRTAATWRDLAAAVFAREIELWPHRTYPMPVIQRELAGGERLIDMRFSYHDFDQVDRAQVDYLASIDDSPTEFPLGVSARVGHLVLTASPKALSRAGTDRLAAMLRGVLEAMAADPEGDAQASFLPAGERERQLVEWNDTAYEAETASVLRRFEEQAARTPDAVAVGHQDGTLSYGELDVRANQLAHHLRGLGVGAESRVLVRLDRGPDLLTALLAVWKAGGAYVPVDPSYPADRVTAMRELSGAPVTLTEIPVRALISLPTGAPARTDDLDRLAYVIFTSGSTGTPKGVEVTHRGLANHVAWAARELASQGDGGAPLFSSVAFDLVVPNLWAPLVTGQAVHTVSQDVDMADLGEHLVASGPYSFIKLTPGHLDVLAQQLAPEQAAALAPVLVVAGEAFTRATLERWRALAPDTRLINEYGPTEASVGTTVHEVPRDAETDVLPIGRPLPNMRVYVLDPALQPVPVGVTGELYVGGTGIARGYAGRPDLTAERFLPDPYGTEPGARVYRTGDLVRQRPDGNVEFLGRVDDQVKIRGYRVELGEIQAVLTAHPGIRDAFVTTVDGELAGYYAPAGAEGVREHLADRLPDYMVPATLTALDALPLNANGKIDRKALPAPDAAAADDDGYVAPRTDTEERIAAVWAQVLGLERVGVEDGFFEIGGHSIRAVALVGALRSAGFDIGVRDVFEHRTVAALGEHLTGRPARTEVDTPVARFALVPAEDRARLPEDAVDAYPLTQVQLGMVLEMLADDTKHAYHNVSSFRITEAAPFSADALRGAAAVVAGRHEMLRTSFHLDGFSQPLQVVRAHAAIPVAVHDLTALDEAGRRRAVEEFIARERADLFDLERAPLLRMTAHVEEDGAWRLGLTVCHAITEGWSHRALLMELLDEYRRLRDGGQPSEAPAPAVRYADFVATEVRSLESEHDRAYWRDVTGGFARFALPAAWAGDRSAPRETFRVAVELRPFEQGLRALAARARVSLKSVLLAAHLKALSVLTEEDRFHSGLVFSARPEAPGADRVYGMYLNTLPFAFDADRDRTWEELVREVFAHEAGMWEYRRYPMPAIQRDAGVERLLDVRFSYQDFDHVDTERVDVGDSSGEGATEFSLAVSAVSGYLLMTTHTHALSRANADRLTALYAGVLTAMTQDPAGDARAVPLPADELRRQLVEWNDTAYEAETASVLRRFEEQAARTPRAPAVTLGERTLTYAELDEHANRLAHALRARGVGAESRVAVQLDRGPVLIAALLAVWKAGGAYVPVDPSYPAERVASIVGTSGAAVAVTSAAYADRFGAVSLLLDDEDVSALPSAAPARADDLDQLAYVIFTSGSTGRPKGVEVPHRGLAGHVGWAARELASRGTGGAPLFSSVAFDLIVPNLWAPLVTGQRVFAVPQDTEPAELGHRLLAGAPYSFVKLTPGHLDLLAEQLTTEQAQELAEVMVVAGEALPGATADRSLDILGPGRLINEYGPTEASVGTTVFPVLAPVGRDVVPIGRPLPNMRVYVLDSALQPVPVGVTGELYVGGTGVARGYAGRPDLTAERFLPDPYAAEPGARLYRTGDLVRHLPDGNVEFLGRVDDQVKIRGYRVELGEVQAVLAEHPAVRDAFVTVHEPVPGDRRLVGYWTPAAGAGARPEELAAHCAVRLPDYMVPSAFVALEALPLNANGKVDRGVLPVPGRGALRSGTAHVPPRTPTEKALGAIWSEVLGVEEIGVHDRFFDLGGHSLLMIKVLAAARAAGLAVSVYRMYQHDTLIDLAAAVDEDTAAGARAGGSQSADAESATSGAAAETQASAGTAPASSAEAGGSPAEAAGSAVGAVSAGGARASGAAGSSGEAVAPAAVAAGSSGEAVVFTAAAAAPGVPTPAPGVDAAAPTVAVSAELLAALLEQAAGGDPGRAGSGVVPEAAALLGAARREAPGVRGEDRDPLAEGLTAAMAERHVPGVALAVIRDGAVAELRGHGTLEAGGSDPVTERTLFQVGSISKHLTAFAVLRLVHEGLIDLDADIDGYLTSWHLADDPAAPGTVTVRTLLGHRAGLARHRSVGFRPGEQLPTLLDLLEGRPPVTTPRVRRELPPGEVFRKSSTHYWVLQQVLEDVTGEPFETLMRRLVLDPLGLADTSFDQEHPRTAGLPVALGHDAHGTPLSGGWRERAHLAAAGLWTTAGDAARFVLAVRDALLGAPGALVPQALARELLAGETGTFYGLGTIVDDTGDDLEFGHGGEPSGYWNMAISRMHGGTGFVALTNADSGKAVVKYLTAELGRRDATFGSGRLAADWRREDPAGALPAVLAPVVTDEERA

SEQ ID NO: 11180 - protein, 1709 aa, Streptomyces avermitilis
VNAELLSERFAEQAFRTPHAAAVVDGARTVTYEELDRASLRMARHLRDLGAGPETLVGVSLPRGVDLIVALLAVWRAGAGYVPLDPAQPPARLSDLAREAGARLVVAGPALAGPVRDAGARRVGPEEIPDRSSDPAGPLPAADPANAAYAVFTSGSTGRPKAVVVTHAGIANRIGWTVQRHALGAADRVLQKTTIGFDAAGWEIFAPLVGGGTVVLAPAGAERDPAALLRAVADHGVTVLQVVPSVLRLLVEEGDWSGCGSLRLLFSAGEALHAELVARLRERTGQDLEVWNTYGPTECSIDITAQLVDPALTAGPVPIGRPLPGMRVLVLGPNGVPVPVGVPGELYAGGVGVARGYAGRPDLTADRFVPDPYATEPGARLYRTGDQVRWRSDRTLEYLGRLDHQVKVNGVRIEPAEVEAALAAHPAVTGAVVTPYEADGGGKRLAAYLTVSGEADPAGLRGFLAERLPDSHVPSFLHTLDAFPLTANGKVDRAALPSPAEIAAAGQPTYTAPRDAAEELVAGVWADLLGLDRVGALDDFFALGGTSLQLTRLAARLRAASGEKVSLRGLFAATTVQAQAQLIGTPTGAADGGTSGAVTGGTTDAGHEGTGGTGGAVHGGTGADVDDGPQIRPVPRTGDLPLSSGQRRLWFLDRMHPGSPEWVAPLFLRLPGSLDAGTVGRALDALAARHEPLRTRYVDQGGEPRQIIDAPGAGTVELRVEDTARDGVAALFGAQFERGFDLAAGPLWRALLARVAGEDHVLLLTMHHITCDGWSTVILERELRELCAADRAGRAPDLPELPLQYADYGSWQGARLTDAVVEGELTHWRAALDGIAPLDLPADHPRPAVRDPRGAVVPFRVAPELAVKLAELGRAHGATPFMTLLTAYATLVARHTGQWDVPVGTPVAGRTRPETENMVGFFLNSLVVRCGLTADLGFTEALRRVRDAARAALVHQELPFERLVEELQPERDLSRTPLYQVAFDLHSEGVTSVVTHDSDLAAFAEAWQVAKTDLSLFMRQTPDGSLDGVLEYATSLFERGTAERMTGHFLTLLEQVAEQPETPLGALELLSADERHRLLVEWNDTAEDTDDRTVFERFEEQARSAPERTALTFGTETVTYGELDAAANRLAQHLRTRCVGAESRVAVLLDRGPELVTALLAVWKAGGAYVPVDPSYPAERIAAMCDTAGVRTAVTTSAYAARFTSSGTRLLLLDTDADDIAGRPAAAPARTRDPRRLAYTIFTSGSTGTPKGVEVTHQGLANHVAWAARELAGQDYGGGALFSSAAFDLVVPNLWAPLVTGQRLFLLPQDTDMSELGKRLAEAQPFSFVKLTPGHLDILALQLTPAQAGALAPVLVVAGEAFTRATLERWRALAPDTRLINEYGPTEASVGTTVYEIPEHADADVLPIGRPLPNMRVYVLDPALQPVPVGVAGELYVGGTGVARGYANRPDLTADRFLPDPYGTGPGARMYRTGDLVRHLPDGNVAFLGRVDDQVKIRGYRVELGEIQAVLTAHPAVRDAVVTVHRPENGEPTLAAHVVPADAAAPLPDLAAHCAARLPEYMIPATFTALDTIPVNANGKVDRSALPAPGRTADDESHVAPSGPVEERVAEIWTELLGVQAGAHDNFFHIGGNSILAIRLISHLQQEFEIDFAVRTVFEGPTVARIAATVEERVTAQIAALSDADLLDDAARTDTTHLTNNPALKEHQA

SEQ ID NO: 11181 - protein, 88 aa, Streptomyces avermitilis
VTAEQTAQQAADQPAQQAAQQSEGPVQRVVFNDEEQYSLWPAGRDLPAGWHAEGTEGSREECLARIAEVWTDMRPLSLRRHMHESSAA

SEQ ID NO: 11182 - protein, 334 aa, Streptomyces avermitilis
MLILRRADVTDVLSGRETEIIDLVAETYRLHDEGQTSLPHSTFLRFPEEHHSRDRIIGLPAYRGGERPVAGMKWISSFPGNVAAGTDRASAAVVLNSLGNGHPVAFVEGAVISAKRTAASAALAARELTADNPPAAALLIGCGVINLEILRFLAAALPDLREAALYDTDPARAEAFAARCAEEVPGVKARPVTDLAAALGEHRLVSLATTAATPHMDLSACGPDTTVLHISLRDLTAEAVLGAVNVVDDADHVCRERTSLDLAQQATGNRDFVAAPIGALLRGTATLRRTADRPVVYSPFGLGVLDLALAEFVREEADRRGLGVRVEDFLPAFA

SEQ ID NO: 11183 - protein, 266 aa, Streptomyces avermitilis
MTGTESAAAGGPVRQQLPEGPTVWCTNGPAAVAMWREMQPPGAYHRAAGRLRAGDTLLDIGANVGLMSVHCARACPGVRVVAAEPAPDLHACLRRNLADHAAPGWQAECAAVSDRPGLLRFTYYPDAPGNSGLYADPRADDEITLAFLRNSGVDAEDAEELVEGLHEGVEFTVPAVTASDLVRRHGIERVDLLKVDVERAELDVLLGLEEAHWSLVRAVVAEVHDEDGRLAAVLRLLHAHGFTVDVRQEPLLKGTALYDVEAERAV

SEQ ID NO: 11184 - protein, 446 aa, Streptomyces avermitilis
MSTGQEGLWLTHQLDPDSPAYNVVLAVRLRDRVRTEVLQEALTALVRRHELLRSRFPGTEQGPVRVTGPAEAVRLDVREVPDADDERLFLLAQRAGEEPFRIADEGAFRAVLLRRAPDDAVLVTATHHIVSDATSQWLLVRDLFAEYGARTGVETPDPLPVGTDWDQQVRAEREFIGSPRGARAAAYWRQVCAGLTAATLPTDRQRPPQRTLNGATVELALPERTAARLRDAAARHALTPFAWLLGTFQTALHRSGAGDGFLIGCPVTTRFTPRSREAVGYYVNALPMAAVFGPTTTLLETAQAAQRRLRTGLAHARHPVELLDTTAGRGPLFRISCTLVAADRLPVPGLYEGPVRLGGLRAELCDVPQQEGQLDLTVEVLQDSQGFKAVLRYNTDLFDAATVERFRDTWHRLIDVSLDAPGTRTADVELVAQDDLLFLLALGGVS

SEQ ID NO: 11185 - protein, 327 aa, Streptomyces avermitilis
VPDKTFPGILSTVGNTPLVELERLLPDFGSRVFGKIERFNPGGSIKDRSALGMLLAGIRSGEVQPGRTVIIESSSGNLAVGLAQICRYFGLRFICVVDGKTTEQNLAILSAFRAEVEVVTERDELTGEFLPVRLRRVRELVAATPDAYWPNQYASLLNPKAHETTMREIEESLDGAVDFLFCSVSTFGTLRGCRDHIRARGLDTTIVAVDALGSAIFGLESTQRLIPGHGASVVPPLMDASAADEVVHISDLECVVACRRLIGREAVLAGGSSGATVAALWKIRHRIPEGSNCVLIFPDGGDRYLDTIYSDAWVNQNFGDVAHLWKD

SEQ ID NO: 11186 - protein, 88 aa, Streptomyces avermitilis
MTETTTAVTSPEAIRSWLTERVASYLERPAADIDAGAQLAELGLDSVYALSLCGDVEDHFGLVVEPTMAWDHPTVDAITAFLAAELAA

SEQ ID NO: 11187 - protein, 609 aa, Streptomyces avermitilis
MTDLLTAGAADAPLDPAGPDPDLARVDRLEALLGDPDDAANPLGLHAVLAADERGELLPEGERALRDFGLGAEFVPAAYGGRFVRADRFALLMRSLFRRDCALGIGHGVTSFIAGLPVWADGSDTQRYRAAGLLLGGGRIVAAYTELDHGSDFSRVSLAARPAPGGGYLLDGGKQLVNNVGRAEAAVVFARTDERPGSRGHSHLLVDLDALPADRVDRTARYATSGVRGCLLGGVDFDACPVPADALLGTEGGAMETVLKVFQVTRSVLPGMVVGVGDTQLRAVLDFAGQRLLYGQPMHELPEVRSALTGAFLDLLICDALSVVGARSLHLLPAEASVRSAAVKYLVPRFLQDSSYRLGVLLGARSYLREGPYAVFQKAARDLPVVALAHASGAVCLSTIVPQLPRLAERAWQPALRGDASFQEAPRTLFRLHEPLPALDFGRLELTARGADSLAGHLPVLARELAEEARSRPELAELADLAGLFARELDELARRSVALPPRDRTPVAGRRAFLLAQRYALLLAAAACLGVWRAATPSDGFVADPLWAASALHRLAERLGLRRGPLPEPAVRQLFAELAERHETGRTLDLFRGRLARRAAPSHGVQGAI

SEQ ID NO: 11188 - protein, 1261 aa, Streptomyces avermitilis
VPHSGGRLPGVPYRCWASAAPRSRRGWVVGVSGFESFVSALRHRVADTPTRSAVRFSAGAAEEDVTYAALDRAVRAAAHALGDRVTPGDRVLVSCGPGTGFLRAFLACLYVGAVPVPVPVPGGFGRQEARTTAIAGDTGARLVLTDEASAGAVRRWLDGERDALPELTVATVESAQEAGDADAWHEWPVGPEALCFLQYTSGSTSEPKGVMVPHGALVHNLRLMRDCHGWHGGMTWCSWLPAYHDMGLIAMMLAPLYLGGTAVLMSSTDFLKRPVSWLRLIERHRAEISCAPNFAYDLCARRLTEEQTAGLDLSSWRYACNGAEPVDAATLTRFAERFAGAGFSARSLLPGYGLAEATLYVSGTRADRPPVVLRADPSALAGGEVAEAEPGSTAQELVSSGIVRGLDVRVVDPGTRAELSEGRVGEIWIRGGSVALGYWNRAEETRRTFGAATADGDTGFLRTGDLGALRAGELYVTGRIKEMIIVHGRNLYPHDIERELRDLAPAFADLPAAVFAVRPGGAHAPEEIVAVQEVRGRGLSGEELAALARTARAGLARRLGVRVGGVALVKAGRIRRTTSGKIQRTLMRGLFEGGELQPLHEELAPELATAFRSGGRTRETPSTSSTPSTPTTPSTRSTPSAEPAAPAGGRSAYELAGSVGGGVGAGGWDPYALSRELEVRLGDPRDGSAEFSFRRSAELDRAEEFPAAICRELDALGVPRWFAPARYGGELRGSEELLQLIRTLGRRDFTVALGHVKTYLGAVSVWVAGRPEQAAALAARVTAGAVVSLAATERAHGSDLLAGELRAGRTPRGWRLDGEKWLINNATRAELVCVLARTDEAGGSRGFSLFLVDKARLAPDSWRPLAGVPTHGVRGADISGIAFTGAELPEDALIGAEGEGLEIILKGFQITRTLCSAMSLGMTDHALRIALDFARTHLLYRRPLAELPHAARTLAESYADLLAMEAVSLVATRSLHTLTEEQSAVSAVVKYLVPTLGDEVVGELRGLLGARAMLTEDFADGAFQKVERDHRIVGIFDGSTAVNLNSLINQFPVLTRGYRKGLADRDAVAAAARLDGPTPELDHGRLTLYARSGSSVVQSLPDAVERARATAPPAVVARAEQLLALADEVHGELAAHRHSARAVPETAFASARRYALVYAGAASLHLWLENAGTARARGPLWADAAWLDAVLARLLRRLTGTADLDDADGPALDRLLPALHAQFEEGALFSLLPCPLGEGRPAAVPPVRIPTVTTATTKEPV

SEQ ID NO: 11189 - protein, 241 aa, Streptomyces avermitilis
VRAGRRRRRPPRFYFSLRSPYSWLAYRDLLDRYPATAAAVEWVPFFEPDELSRKLLAEAGGAFPYTPMSPEKHRYILQDVRRLAGERGLEFTWPVDREPVWEVPHLGYLAAARHGVGAQYIALAARARWELGLDICDRTVIAGFAAELGLDAEELATASDDSGLRAEGVRVLLEIQRDGVFGVPFFVDHFDKYWGVDRLPAFAAALAAKTAADLTGVPDDSGDPLPVPAASVDDGHAGGCG

SEQ ID NO: 11190 - protein, 313 aa, Streptomyces avermitilis
MSEQSRSTPGDKVAPGDKVAPGDQAAPGDKVAPGDKVAPGDKVAPGDKVAPGDKAAPGDKVAPGDQAAPGDKVALVTGGSRGIGRAVVARLASDGYDIGFCYRSDDQAAALVEKEVRELGRRVLSRRVDVTDRTQVREFVTAAEEELGPASAVVTSAGITRDSPLVLMPDEDWDAVLRTNLDGTYNLCRAVAFPMIKRGGGAVVTLSSVAGVAGNAGQTNYSASKSGIIGFTRSLAKEGGRHGIRANSVAPGFIDTDMTSELPPKVAKEMLGRIPLKRFGRPEDVAALVAFLLSSEAAYITGQVFQVDGGIAL

SEQ ID NO: 11191 - protein, 165 aa, Streptomyces avermitilis
VHGIDRIKNTIPHRGEILLVDRVADVVPGTRLTAYKAVSGNEPCYAPLGQDAAPADYAYPTSLVIESWAQSAVLLSVWENPNPDVLAGKVELAGSIGDAVIGERAYPGDVLEHRVRLVKSVDETAILAGETLAGGREVLRIGSFVVALRDVTELLPAPDRALLSV

SEQ ID NO: 11192 - protein, 154 aa, Streptomyces avermitilis
MSAATPLGDLELIRTGPSGAVTAFDAPVDGPVIAGHYPGFPVLPGVFLIEAADRTVRQWAKDNGRAQDDGADPGSGADSGTAGTADSGTELELAAMDRCRFHRPVYPGDRVLADVSVVDNAAGLLFKAAVATNRGKVADIRLRYRAKQEEEETP

SEQ ID NO: 11193 - protein, 87 aa, Streptomyces avermitilis
MPETTTTALDKEQLRELVADVLDLDVAEVTDDADFMEDLDVDSLMALEITVRLEKEYGVRLAEAELTSITSLQGTYELLTSKLGDTR

SEQ ID NO: 11194 - protein, 372 aa, Streptomyces avermitilis
MSVSLATGADPDTLVVSGWSAASPYGLGAEAFAAGVLGDVDAVRGADDATDLGPYERAGRVPDFAAKAVLGRKGTRAMDRATALAVATAGLLLEEAGPGLAQDAPEAVGMVLGTGHGSVQSIMDFTRDSLTGDKPFHVDPALFPNTVMNRAAGQSAIWHTLRGPNTTVAGGAATGLLALNYAARLLRQRHCEAVLCGAVEEFSTARAWLEYRARTGGPHRQPAGPLGEGCALFLLESLGRARAHGRTPLASLLAARFIAFTDQERAKDAVARSVTEALKNAEVRPEEVALLVPSDSGGELGAREDAALADLFGEHRPPRLRLRRLTGDLGAASASMQLAAAVAAGGEGTPVLVTSVDPDGQTGAVVLRTGTP

SEQ ID NO: 11195 - protein, 271 aa, Streptomyces avermitilis
MLKSLEGSWCLVLGASSGIGRAIALGLAREGVHVAGVHFDTAARAEEVEALVEEIRSLGVEARFFNTNAASKATRAELVPQLAELTGANGGIRILVHSLAFGTLVPFTPREGWDRPISVRQLEMTLDVMAHSLVYWTQDLLAAGLLRSGSKVYAMTSAGTSQHLPSYGAVSAAKSALESHVRQLAAELATSGIAVNALRAGTTVTPALQRIPEHAGYIERAAENNPHGRLTRPDDVADAVALLSRTESSWLTGNTIGIDGGELHAAAGAWG

SEQ ID NO: 11196 - protein, 370 aa, Streptomyces avermitilis
VTGVRGRLSLGGHGRGRRGGGRGGDARRREVVRPPGAAGARADTKYLPAAAQYALAAARAALADGGRPDAVPADRRGLLLATGAGLASLFDAMDATVAEDGGAAHLSPATAPYFAVNVLGNRLAAELELKGFALTVATARTAAADALSTGALALAAGRCDTLVLAAAEEPLPAVRGGGGEQGAAAFTLEPLAAARARGARVHGTLRARSLFVPPGALRDSAGRERAAAYLSEALADLLLGPAGGPPVPVSRDLDLDPDPDLDLVLVLDESAVGEAVALAVAGAAPGAGLPATGPRLPMPSGAPEIAHPPGTPRVGCLGPAFALAHAVTSPDGPDRLVVCATGAGHVALVRVSPARPSRLTTQEPSHAEVA

SEQ ID NO: 11197 - protein, 439 aa, Streptomyces avermitilis
VVTGIGAVTCHGAGADTLWRAMTAAGTRLPDRPADPLARMDLPLISLVPDPDLRAERATRFASLAAAEALSDAGLDGPSLAAARTAVVFGSCMGEPGGNERGRGADDGWQPPFRLASALAGELGLFATVHDIGNACAAGGYALGIAADLVRAGEADVVIAGGSDAYSRVALGCFNRLGAVDPERCRPFERDRAGTVFGEGAGVFVVESAAHARARGVLSSPDGAPRLTGVAWSCDADHPTAPQADAEQVVRAMREALGAAPDTVGCVVPHGTGTRLNDVLESRALHRALGPRAARVPLYSLKALLGHTGGASAALGAVAAALILRHGEVPPNVPLKEQDPECEVLLPQGDAVPLADGARRVLVNAYGFGGNNASLVLESGTPTGPSGGSAAGERAGAASGGGVGSVSGGSGSAGGGAVVGPGGGSGGVVRRTVEGGGVS

SEQ ID NO: 11198 - protein, 327 aa, Streptomyces avermitilis
VTTNTADTADIEAAVLALKEPSSLEIRPRYEGSNICTWIGFKHVNYLVEEAVLNHLRQAGIAPGTVYETYGLCTDIVDIDTRILHAFHIDDTAIAEVKPHRKAKDGELVLAVTLHVRRETLLKAVTSTVRVQLRLDPRGGGELPVPAALAPFAVDRLGAVPGWTPEPVEVDLAADDLVKELTAGRNAYAWKFRIPYWYCHFTERQQMSGYLRLMEEAKDRLVADRGVSIKTLLDEQNWIPVVPHSRITVLDEARMEEDLYVVLTVESVFKGFTYDSRMDTYVVRDGQLVQTATGRITHGYAVIENRRDWSLVSFDDRMNAALEGRSA

SEQ ID NO: 11199 - protein, 241 aa, Streptomyces avermitilis
VLPWSADGDPDWSLRDDPADHVEHALDSVPGGADVIVVHSFTAGPALEALARRGAGRGPRAAVVVAPFHRRTPGEFTWDDATYYLSGFHRILDEGLRISAGDRLAPQLRAAMALRVRDRIGPYGWQQFFGAYLRSPFLDVGALRLPVLVVAGTQDFAAPPDDARALAAALPDGRFRLFDGCGHFAMAEQPDRFADAVHGLLHEVFAGTSPHPSDHPSDQLSDELSEHLSVHPYAPYAPELT

SEQ ID NO: 11200 - protein, 361 aa, Streptomyces avermitilis
VSTARTADVVITGIGTAVRGLDGPAALFGPLPAGHRSAADPVSRLTGRGLRYKDRATKLAMAAAKDALRAAELVDAAGELTVSGEATGVVASTNYGNADTVCETVRTIAESTYLATSPMLLPATSSNVVASWLAITHGLRGANLTLCNGPTSGLDAVNWARLLIAAGRVERVLVAGVEPDNPAVRHVTDAAEASDHEAYGEFGAPVLFDGAVALVVESPSSAHARGVRPLAAIGPYARRGDHAEAVAEVRALRPGPVGLWCVPEHPEGVRAPAPALGAAAGSAPVHDLSALFGPSSGALGVLQCAAAAVWLDTGPGDGEVALVSAGTGDAGGDDAGAALILTAPGAVAAVAAAPRPAGGVR

SEQ ID NO: 11201 - protein, 387 aa, Streptomyces avermitilis
MGAVASIGDSVEEIFGSLVEGRSGLAPLRGYDRDNFRAQVAYEIDDRPAPGVDEPLRATRWLERAVAAAAADAGLGDDLSRVPVLVGTTLRELRSVELSWRDGIPFDAADLHFGTMLRRRFGAVDTHTVANACSASLYALALGADLLDLGAADTVVVAGVDTITESTYGLLDRCYPEAPDRVRPFDRARRGMLQGEGAVAVVLRREADGPGPGARVHTRVRGVAVNCDAHHPSAPDAKNIAAAVQEAHLRAGVRPADIDLVMLHGTGTPLNDEAESTALGTVFGGLDPSPYMTAIKSMTGHTAGASGLHSLVAAVDVLRTGTIPPTVYLDDPVEAVAGFRLVRGTAERASAPLRIAQIDSFGFGGLNAVAVVERVDGPPASEEGAGQ

SEQ ID NO: 11202 - protein, 428 aa, Streptomyces avermitilis
MNASINTDARGHGGPEDPRPEAAGRRVVITGLGVVTSIGIGVEAFTAGLRAGRSGVKPITAFDTTGFAHANGCEVTDFEPERWLDRQHPEELGRASQFAVAAARMAVADAGLHEEDVRARRSLVSVGTTDGESRDLDQLVAAGLENGPEEYEPAVARRIPAGRLSAGIVRELELEDVEAVTIPTACAAGNYAVGYGYDALRSGDVDIALCGGADAACRKTFTGFYRLGTIAPEVCRPFDKDREGILTGEGAGILLMESLDSALARGARIYAEVLGYGLACDALHPVAPDRDSIARTIRIAHRNAGITPDQVDFVSAHGTGTKANDITEAGAIRQVFGEDAMPRTVSIKSMIGHSMGAASAVSAAACALAITEGFIPPTVNHRETDPECGVDCVPNQAVETELSVVQNNALAFGGNNAVLILGAYRSAA

SEQ ID NO: 11203 - protein, 84 aa, Streptomyces avermitilis
VTTGLDAARKQEIKEIVCDILEIDEDEVTETSLFKEQHDADSLRAIEILAALERTQKVTIDQAELSRMVNLEGVYVVVSEAAQN

SEQ ID NO: 11204 - protein, 337 aa, Streptomyces avermitilis
MLEPLGLGAHAAEVYRAMLKRPDFGVEDLVTSLGWEQDLVRSALDECVRLSLIKPSWDAPGGLRAVSPEIGLQALLARQESEFLERQQRIAESRIEVARFVDEYTAAQQKLRSTVVERLVGIDDIRSRIEEFTQECGTELLTFATGGPQSEASRQASRPLCEDLAKRGVVMRSIYLDSVHNDPATVEHLRWLHLHGDQVRTTASLPSRMLLFDRTHAVLPIDPDASAAGALVLRGAGVIATLGDLFDRVWESAIPFSGGRPQPRDRGEEELTGQEQAVLRLLGEGLTDEVVARKLGVSVRTGRRITAELMGRLGARSRFQAGLRAAQLGWLTGSDTV

SEQ ID NO: 11205 - protein, 449 aa, Streptomyces avermitilis
VSSSGLIYAVIVGAWAAYLVPMWLRRQDELNEARPTERFSTAIRLLSGRAGMERRYAKDLQARSAEEGEPSADPDAVTDSVDVRAFAMPPTRPRVQTRVDPAAPAEPPSAGASVPAPASGHRPASKSVPSPQAHAQAQAHAQEQAQAHAQAQARSGAGAGAQSPSVPPSQAVPQQTARSASAARRAASAEAAARARRSKVLARRRRTTMMLFLAFTLGAIVAAVGGLAFLWAPGVPAVLLSGYIAYLRAQERKRFTYTMDRRRAELAAQRLRERQPRRRASVEADGDEPEDGPEPQSDPGLSALAADRRALVEQTDHAEWVDQQRERQRRPGHGDSWDPVPVPLPTYVTAPVAPRATPSVDLGAPDAWSSARSSSAVEPGAAAREREPGPGTDAGSAPGDPGAEEQADAADDGRSDARRAASARRARERGRTPLFDQYEDGERPRAANE

SEQ ID NO: 11206 - protein, 156 aa, Streptomyces avermitilis
MVRHLRAEAAAGRMLPFVIEYQGRLVGQLTVAGITWGSMCSGHVGYWVDEAVAGRGVMPTAVGLVVDHCFRTVGLHRIEVCIRPENGPSRRVVEKLGFRSEGLRPRYLHIDGAWRDHLVFALTAEEVPEGLLARWRRAREQQARRQDPSKPGNASK

SEQ ID NO: 11207 - protein, 179 aa, Streptomyces avermitilis
MTRPAEPSIGGALTASYSALVVTASNRAAAGVYEDKGGPLIAEGLATFGFAVDGPWVVPDGDPVEETLRSGVAAGYDVIVTTGGTGISPTDRTPEATRAVLDHEVPGIPEAIRAFGREKVPTAALSRGLAGVAGGTLIVNLPGSTGGVKDGLAVLEPLLVHAVDQIRGGDHPRPSGGAS

SEQ ID NO: 11208 - protein, 170 aa, Streptomyces avermitilis
MTVPSRGETPGPPAQDRLTHIDEAGAARMVDVSGKDVTARTARASGRVLVSPRVVELLRGEGVPKGDALATARIAGIMGAKRTPDLIPLCHPLSVSGVKLDLSVADDAVEILATVKTTDRTGVEMEALTAVSVAALTVIDMVKAVDKGAVITDVRVEEKTGGKSGDWSRS

SEQ ID NO: 11209 - protein, 424 aa, Streptomyces avermitilis
VTEHLEDILATVRPLEPIELQLLDAQGCVLVEDVTVPVSLPPFDNSSMDGYAVRVADVAGASEGFPAVLTVVGDVAAGQADLLHVGPGQAARIMTGAPLPPGAEAVVPVEWTDGGLGEGPVSGMRAHSAAPEGASGQVSVHRPAEARAHVRALGSDVRAGDRALAAGTVLGPPQIALLAAIGRGTVRVRPRPRVVVLSTGSELVQPDEKLGSGQIYDSNSFALTAAARDAGAIAYRVGAVADDAETLRSTIEDQLVRADLMVTTGGVSVGAYDVVKEALSTVGDEDEAGSGVEFRTLAMQPGKPQGFGSVGPDHTPLLALPGNPVSSYVSFELFVRPAIRTLMGLEDVHRPTTRAVLRTDKALTSPAGRRQFLRGTYADGEVTPVGGAGSHLIAALAQADALIVVPEDDTSVEPGTEVEVVLLG

SEQ ID NO: 11210 - protein, 300 aa, Streptomyces avermitilis
MTESHPRITKAVIPAAGLGTRFLPATKATPKEMLPVVDKPAIQYVVEEAVSAGLDDVLMITGRNKRPLEDHFDRNYELESALQKKGDASRLAKVQESSDLATMHYVRQGDPKGLGHAVLCAAPHVGREPFAVLLGDDLIDPRDPLLARMVEVQEQRGGSVIALMEVAPEQIHLYGCAAVEATDEGDLVKVTDLVEKPDPADAPSNYAIIGRYVLDPHIFDILRKTEPGRGGEIQITDALQQLAADEKVGGPVHGVVFKGRRYDTGDRGDYLRAIVRLACEREDLGPEFRTWLRSYVAEEM

SEQ ID NO: 11211 - protein, 207 aa, Streptomyces avermitilis
VSHLRPGSDPDKRMLRREFLVVRSRLTADDVRETASALAARALELPELAHARTVAAYVSVGSEPGTLALLDALHARGVRVLLPVLLADNDLDWGAYAGQGSLARVRHGGKMALLEPAGTRLGPSAVLGADAVLLPGLAVDSRGMRLGRGGGSYDRVLARLERAGVDPALVVLLYDTEVVDRVPEEPHDRPVHAAVTPSGVRRFRAAS

SEQ ID NO: 11212 - protein, 936 aa, Streptomyces avermitilis
MPPNTTASSGEQPGKSGRKKGRKARLLVIVLVLAIIGGIGFGAYWSISTVRASFPQTKGSITLDGLAGPVDVKRDGYGIPQIYASSDADLFMAQGYVQAQDRFYEMDVRRHMTSGRLSEMFGKGQVKKDEFLRTLGWDRVAKKEYDTKLSAATKKYLRAYAKGVNAYLEGKDGKDISLEYAALGFTNDYQPQKWTPVDSVSWLKAMAWDLRGNMQEEIDRSLMTSRLGPKQIADLYPDYPYSRNKTIVQEGQYNELTKAFEQGGSTGTQSTTGGTSTGTSGTSGTSGTTGSTSASGTSTSASDPSALESQLTGLYKLLDDVPTAVGVNGNGIGSNSWVVSGDHTITGKPLLANDPHLSASLPSVWYQMGLHCRSVSSKCQYDVSGYTFAGMPGVVIGHNQAIAWGMTNSGVDVTDLYLEKLSGDGYLYDDKVLPFTSHDETIKVAGGRSKTIVVRETNNGPLLSDRNDELVKVGKKATVDTAAPDRGDGYGIALKWTALAPGNSMDAVFELDKAANWSEFRKAAASFDVPSQNLVYADKDNIGYQLPGKIPTRAKGDDGSLPVPGWDSKYQWTGYIEQDELPYEYNPDRGYIVTANQAVVDKDKYPYTLTTDWGYGSRSQRIADLIESKIKGGGKISTDDMRQMQLDNSSEIAKLLVPKLLKLDVADKHVREAQKLLEGWDYTQDADSAAAAYFNAVWRNVLKLAFGNKLPKELRVQGQCLYVDPAESTGPADQDQKVRECGQRDADQAQPDGGDRWFEVVRSLMDDENNDWWTSPKSRTDEATDTRDELFARAMKDARWELTAKLGKNMDTWSWGRLHRLFLKNQTLGTEGPDVVKYVLNRGPWKLSGGEATVNASGWNAAGGYGVVWVPSMRMVVNLGDLDKSKWINLSGASGHAFSAHYTDQTDKWAKGELLPWAFSEKAVDGSTSDSLVLKP

SEQ ID NO: 11213 - protein, 523 aa, Streptomyces avermitilis
MLGSKRSHRSARLARREQPLTVHHLNQLLLVCSLVLLIAVAAVRISSRSGLPSLLVYLGIGIAMGQDGVGDIHFNNAELTQVIGYAALVVILTEGGLGTKWKEIRPALPAASSMALAGVAVSVGVTAAGAHWLIGLEWRQALIIGAVVSSTDAAAVFSVLRKIPLPARVTGVLEAESGFNDAPVVILVVAFSTAGPVEHWYALLGEIALELAIGAAIGIAVGWLGSWGLRHVALPASGLYPIAVMAIAVTAYAAGALAHGSGFLAVYLASMVLGNAKLPHWPATRGFADGLGWIAQIGMFVLLGLLVTPHDLGDDIWPALLIGLVLTMVARPLSVVISLAPFRVPWQEQVLMSWAGLRGAVPIILATIPMVNGVEDSRRIFNIVFVLVIAYTLVQGPTLPWLARKLHLDTSAGQAADLGIESAPLERLRGHLLSVAIPEGSKMHGVETNELRLPAGAAVTLVVREGKSFVPLPTTVLRRGDELLVVTTDPVRDAAEARLRAVGQGGKLAGWLGTGAPDDRPGR

SEQ ID NO: 11214 - protein, 432 aa, Streptomyces avermitilis
VASTVTSGTSKTSPPPDSSRPGYGRLLRTRGAWTFLLPGFAARQPFAMLTISIVLLVQHTTGSYGAAGAVAAATGVSMALFAPYSGRLADRHGQRAILLPGVLVHTLAGLSLTALALTGAPLWALFAAAVPTGASVPQVGPMVRARWGVKLQDSPLMTTAAAFESVTDELTFVLGPLLATALCTAVNPAAGLLTEATLTLVGGLLFAAQKSTQPAVAPDRHARVEHASALRVPGVRVLIVTFLGIGSVFGGMQVSLAAFSESIGEPGLNGVLYGTFAAGNMLSGIVCGAIAWKIAPQRRLVIGYAALALAASGLWTAHSVVVLAGIGLLVGMCIAPALITGYTLVEDLVPATARTEAFTWLTGAVALGQAAAVTVAGQLEDRLWDGAGFLVPMAGTVLALATLVCLRSRLAHRPAGRTVARGVGHRVPVTVD

SEQ ID NO: 11215 - protein, 113 aa, Streptomyces avermitilis
VPTYQYQCTACGEGLEAVQKFTDDALTECPSCAGRLKKVFSAVGIVFKGSGFYRNDSRGSSSSSSPASSAKSSGSSSSSDSKASSDSKSSSSTSSSDSKASSTGSSSAGSTAA

SEQ ID NO: 11216 - protein, 277 aa, Streptomyces avermitilis
MANAEIGVIGGSGFYSFLDDVTEVQIDTPYGPPSDSLFLGEIAGRRVAFLPRHGRGHHLPPHRINYRANLWALRSVGARQVLGPCAVGGLRAQYGPGTLLVPDQMVDRTKARAQTYFDGLPLPDGSVPNVVHVSLADPYCPVGRKAALAAARGRDWEPVDGGTLVVVEGPRFSTRAESLWHQAQGWSVVGMTGHPEAALARELELCYTSLTLVTDLDAGAETGQGVSHEDVLKVFASNVDRLRDVLFDAVAALPANDARDCLCTTALGGMDPGFELP

SEQ ID NO: 11217 - protein, 164 aa, Streptomyces avermitilis
VPHFAPLRVRGGRYRLRRLARHRQRAVAAGLAVTAAALVAAGPQDPGRSRGHPDPGPPAHAASEADPVRRGRTVRTVTAPVRIADAATVRLLRPGDRIDVVAADSGGETRVVATAARVTEVPDTGEGMAESGALVVLSVPRATAARLAGASTTSRLAVTLCRTC

SEQ ID NO: 11218 - protein, 158 aa, Streptomyces avermitilis
VSEKKETGVLAGFKAFLMRGNVVDLAVAVVIGAAFTNIVNSVVKGIINPLVGAFGTKDLDKYSSCFRAPCQVAKDGTVTKGIPIMWGTVLSSTLSFVITAAVVYFLMVLPMSKYLARMEARRKAKAGMQEVIEVTELQVLKEIRDALVAQRGPGHSQD

SEQ ID NO: 11219 - protein, 58 aa, Streptomyces avermitilis
MTTAPEPSVPKAALIFDDPLSQQSSDDTDRGWGERPGVDSDSAADLKRFLDEKPPHHI

SEQ ID NO: 11220 - protein, 418 aa, Streptomyces avermitilis
VLGPMTSSPPPPSAAEPTPPARPTPLSPLRPMTARGRGEAHRVASPLELFFDLCFVVAIAQAGVQLVHAVAAGHSGQGILNYAMIFFAIWWAWMNFSWFASAYDNDDALYRIVTLVQIAGVLVLAAGVSKAFEEHDFLVVWLGYAIMRFAMIAQWLRAARAGRGAERTMALRYAGGVFLCQVGWLGLLVLPEHARPWVFLVMALLELSVPVYAEKDFTTSWHPHHIAERFGLFTIIVLGETIAAATVAVKSAVDEHNALGELLPIAIGGLLIVFAAWWIYFVVPIHGHLRSNRESFLWGYGHYLIFGSAAAIGAGLEVAVEEAVGKAHVSTLTASAAVTLPTALYLLTVWVLHSRYFKVGIAQQLVLPTAALLVIVCTFLGEWAVLGAGIVSAGAVASGVMLTVRMAARQKGRAATTA

SEQ ID NO: 11221 - protein, 342 aa, Streptomyces avermitilis
MTVDALTDVAGLRVGHATRTGGGWLTGTTVVLAPEGGAVAAVDVRGGGPGTKETDALDPRNLVQRVEAVVLTGGSAYGLDSASGVMAWLEEQRRGVRVGPDPAHVVPVVPAACVFDLGRGGDFRARPDAATGRAAVEAAAASEPGAPVPEGCVGAGTGAVVGQVKGGVGTASTVLGSGITVAALVVANAAGSTVDPETGVLYGELFQGRVVYPADGVHEAARRRLAETAAKNAPPPLNTTLAVVATDAELTKAQAQKLAGTAHDGIARAVRPVHLLSDGDTVFTLATGAHPLPSDSPLALNEVLAAGADVVTRAIVRAVRAAESADGPGGTWPSYGELYGSR

SEQ ID NO: 11222 - protein, 408 aa, Streptomyces avermitilis
VATPNIAARRAVVACAALVVGALSLTACGGSADANVGKGDGKSGSGSGNTSTAKITISAKDGSTGASINATGVKVSDGKLTDVKMTVAGAGTAVSGAISADGKSWKPAKQLDRGVKYQISATAKDASNRTAAANSIFTTVNSANSFIGTYTPDNGSTVGVGMPVSFNFDKVIGDKKAVQSHITVSSSSGQRVVGHWFGAQRLDFRPEAYWKAGSKVTMKIDLDGVEGANGVFGVQKKTVTFTVGRSQVSTVDVSTQTMTVVRDGKTVKSVPISAGSPQHTTYNGQMVISERFAQTRMNGSTVGYGGEYDIPDVPHAMRLTSSGTFIHGNYWYNRGNPPFGRQGTSHGCVGLADVQGAQGDTVAKWFYDNSLVGDVVTVKNSPDKTVAPDNGLNGWNMSWSAWTAGSAV

SEQ ID NO: 11223 - protein, 249 aa, Streptomyces avermitilis
LSVPYETAAYEPPESPESPEEHLARLLGRALNSFELPDETIWRLDCALAHDSSLHSAHHSAGLHRETYRHTWLLADGSAVTLWELVHNTAPGSHPQHEVYVDEEELLAATARLPLPPDAPDFELPVLVQLSPIPEPRHAYLPENSADHARRLLRRAENPDPPDADLASLLLGSAFAHQITQAFGRPCRAGQMRLCFSLYEHAFLLRDGRELSLWEVEHTATPDGRHMCEVYASEEAAREAMERRAATLG

SEQ ID NO: 11224 - protein, 96 aa, Streptomyces avermitilis
MPEHASILQLTGVTVLALAMGVWIAGLIRLLRAPRAPRAPRGGHGVRHRGAHRRRDVLRALPRQRQAGPALESVDLTPAERDAFAGLVRQFSDGRS

SEQ ID NO: 11225 - protein, 704 aa, Streptomyces avermitilis
MSEMITADLVDLDLSAQTKEAAARALAERMVAKGRVTDLDGFLADVAAREAQMPTGLDGGIGIPHCRSEHVTEPTLAFGRSAAGIDFGAPDGPADLIFLIAAPAGADDAHLTILSSLARQLMNAEFTSALRAVDDAAAAAALIRGDETPAAGTSENSVAEPIAAASAGTATEGTAPVPGATVDDGSAPAPGAAATDGAPSDNDARPFRVVAVTSCPTGIAHTYMAAESLENAGREAGIDIVVETQGSAGFTRLDPAVIAAADGVIFAHDVPVRDKDRFAGKPTVDVGVKAGINRPAALLTEVRGKAERGEVTSGSAAATPVERGGESGEGYGTKLRKWLMSGVSYMVPFVAAGGLLIALGFAIGGYKINKAPSVMDHFLWTQADSWGALFFQIGVVSFGFLVPVLAGYIAYGMADRPGLVPGFVGGAISLTINAGFLGGLAAGLIAGGVVIGIQKVKIPAALRGVMPVVVIPLISAAIVGFLMFVVIGKPIASAQKGMTDWLNGLTGTNAVLLGALLGLMMCFDLGGPVNKVAYTFATAGIAVAGPSDSAMKIMAAVMAAGMVPPLAMALATTVRGKLFTQTERENGKAAWVLGASFITEGAIPFAAADPLRVIPSAMAGGAVTGALSMTFGATLRAPHGGIFVVPLIGNPLLYLVAIAAGVCVSTALVVALKGMRKQSPDDVTKEAAQAPIPAKTDSKQPVAA

SEQ ID NO: 11226 - protein, 317 aa, Streptomyces avermitilis
MILTVTPNPSLDRTYEVPSLDRGEVIRATGERMDPGGKGVNVSRAVAAAGQRTVAVLPLGGAPGAFVAALLDAQGIDVAPVPVAGATRSNISVAEPDGTLTKINAPGPELTPAEAELLLETVREQYRAGDTTWITCCGSLPRGLAPSWYADLVARAHAAGARIALDTSGPALLEALRERPDVVKPNAEELAEAVGRPLATVGDAVKAAEELRGLGAGAVLASLGADGQLLVDASGTWFGSARVDAVRSDVGAGDSSLAGFLIAGGSGADALASAVAHGAAAVQLPGSVMPKPADLDPSAVTVTAEVPVDRVLTEPVS

SEQ ID NO: 11227 - protein, 253 aa, Streptomyces avermitilis
MYAPERQQEILRLARDGGRVDVVSLAEEFQVTAETIRRDLKTLDRAGLLRRVHGGAIPAGRLDFEPDLAERESTAADEKDRIAEAALAELPADGTMILDAGSTVARLAGALPLDATLTVVTHSLPIAARLADHPGIQLHLVGGRVRHRTRAAVDAWALRAYSEIRADVLFVAANGFSAEHGLTTPDLAEAAVKRAAVRAARRVVLLADSSKHGQEHFARFGDLGDVDLLITDSGLSPEDATAMERGGTEVVRA

SEQ ID NO: 11228 - protein, 504 aa, Streptomyces avermitilis
MTSTETPLNSPAAAADRRRWFALAIVMTAAFMDLVDVTIVNIAIPSIQRDAGASWGQIQWITAGYALAFAAGLITGGRLGDIHGRKRLFLIGIGGFTLASALCGFAANPEMLVASRILQGGMAAMMVPQVLSIVHATFPAHERGKVFGLFGAIVGLGAVSGPLLGALLTEWNLFGLEWRPIFLINLPVGVAGLILGRRFITESKAPRALKLDLVGVALVTLGLLMLLYPLTRGRELGWPLWGHVSMAGALVVFAALVAYERRKTARDGSPLVELSLFKVKSFAAGIAVQTVFGIALGIFFLVWTLYMQMGLGWSALRAGLTGVPFSIAVSAAAGMSVQLLVPRFGRKVLQAGALLMALGVLLYIWESDRYGMAIASWQMALPLVVMGAGMGFIVAPLTDAVLSEVPREHSGSASGLINTVQQMGNALGLGLVSVVFFGEIGDRLTRAQVGPAFAHAFQHALGWVAVVLAVIFLLMFALPKRPAQHVEGAGAADTLGEKEPVLVP

SEQ ID NO: 11229 - protein, 330 aa, Streptomyces avermitilis
MTTDTPARLLQLLSLLQTPREWPGGELSDRLGVSRRTVRRDIDRLRELGYPVQATKGSDGGYRLVAGKAMPPLVLDDEEAVAIAVGLRAGAGHAVEGVDEASVRALAKLEQVLPSRLRHRVSTLQAATTPLTSGDGASIAPETLTVMASSIAGRERLRFAYRSGDGTPSRRQTEPYRLVSTGRRWYLVAYDLDREDWRTFRVDRVSEPFATGARFTPRELPTGNAAEFLRQSMFRRQETYEFEVTFAAPAEFVAARLPNWLGAPEPIDEHSCRLRASAGDSVEWLAVRIAMVDCEFTVQEPPELVGCVRELGGRLTRAVGADDGWATDSR

SEQ ID NO: 11230 - protein, 235 aa, Streptomyces avermitilis
VPQRHNLPSVTGTNRATGPSAGRTSKASAGASLIERRKAATRMEIARAAAGLFMADGLRATRAEDIARAAGVAPRTFYRYFATKEESLAPLFSAGAHKWAEAVREAPAALSVPDALHHAVVRTLTPGVGVSHTSLEWVRSLLRLTGTNPALAKVWAEICQAADGELAEVLAARPGVVAAPDSPAVRFAAAVAGAAVRVAVESWAADDAPAVGPQGPADLAVRNLETLRNFPWDEL

SEQ ID NO: 11231 - protein, 331 aa, Streptomyces avermitilis
MATRAVARRKSAAGGTDAASSVRAVGGEIADRDLVGMYLDEIARTPLLDAAKEVELSQIIEAGVFARQILDGEEEPRAEATREELESLVADSERAKDVFIKSNLRLVVAVARRYPRSGLPLLDLIQEGNAGLVRAVEKFDYRKGFKFSTYATWWIRQAITRSIADQSRTIRLPVHLVEELGRIRRVQREFNREHGREPEPAEIAAELDSNPARVTDVLDWARDPVSLNMHVDDEGETQFGDLLEDTSAVSPEQSVLTLLRSEELDDLIGRLDQRTASIIKMRYGIDDGRERTLTEVGKEHGLTRERIRQIEKHALLELKKLARSTGFDAAA

SEQ ID NO: 11232 - protein, 172 aa, Streptomyces avermitilis
MPSERTEVQVRSGVEADLKALTDIYNHYVRETPITFDTAAFTPEERRPWLLSHPEDGPHRLMVATGADSQEILGYATSSPFRAKPAYTTSVEVTVYVAPDAAGRGIGTLLYGALFEALAGEDLHRAYAGIAQPNEASTRLHERFGFRHVGTYREVGRKFGRYWDVAWYEREL

SEQ ID NO: 11233 - protein, 253 aa, Streptomyces avermitilis
MPALYLSHGAPPLADDPIWPGELAAWSADLPRPRAILVVSAHWEEAPLALAATERVPLVHDFWGFPEHYYQVRYDAPGAPALAESVRKLLRAPGTPVQDVPDRGLDHGAYVPLVEMFPDADIPVLQISMPTLDPVKLMEIGRKLAPLRDEGVLIVGSGFFTHNLAALRQGGIPSWSVEFDDWGHRALDTRDWDALLDFTRKSPAGLLAHPRTEHFAPLFVTMGAADATGELDDQKSVIDGFWLGLAKRSVQFG

SEQ ID NO: 11234 - protein, 184 aa, Streptomyces avermitilis
VGYMNTASAPAPASTSTSATASAEEPRWLTEDEQHTWRSYMHAVTLLEDHLDRQLQRDAGMPHIYYGLLVQLAEAPRRRLRMTELAISAKITRSRLSHAIARLEKSGWVRREDCPSDKRGQFAVLTDEGYEVLRKTAPGHVAAVRQALFDRLSPEQQKSLGEIMQIISEGLQPKEAGADLPWLR

SEQ ID NO: 11235 - protein, 516 aa, Streptomyces avermitilis
MSETATAKAAQASEAEAHSNRWKALVFIALAQLMVVLDATIVNIALPSAQQDLGISDGNRQWVITAYALAFGGLLLFGGRIADLWGRKRTFVTGLIGFAAASALGGAAQGEATMLGARALQGAFGALLAPAALSLLAVMFTDAKERAKAFGIYGAIAGGGGAVGLILGGFLTEYLNWRWTFFVNIPFAIIAAAGAYFVIREPAGGRNRSPLDIPGVVLSTLGLVSLVYGFTRAESNGWSDSTTIGMFVASAVLLAAFVFVESKVKAPLLPLRVITDRNRGGVYLSLGLAIIAMFGLFLFLTYYLQIVKGYSPVKTGFAFLPMIVGMITGSTQIGARLMTRVPARLLMGPGFLAAAVGMLLLTQLEIGSSYAGLLLPAQLLLGLGMGTAFMPAMSLATLGVEPRDAGVASAMVNTSQQVGGAIGTALLNTIAASATTSYIKDHIAGAAAKPQQQLVQLEGMVHGYTSAIWFAVGILVAAATIAATFVNAGRPDTSSVSGSGEGDGVEDEFKVPVIAH

SEQ ID NO: 11236 - protein, 214 aa, Streptomyces avermitilis
VETAAPVQRRVPRPRADAVRNRERIVTAAREMFVEFGPDVPLDEIARRAGVGNATVYRNFPDRDALVREVVCSVMDRTSEEAERALAETGDAFEALSRFVHAAADERISALCPMVSSTFDQHHPDLEAAGERIEQLVASLMERARTAGQLRPDVAVGDLMIGVAQLSRPPAGTGCMSLDRFVHRHLQLFLDGLRAPARSTLPGTAATMEDLRQA

SEQ ID NO: 11237 - protein, 439 aa, Streptomyces avermitilis
VQSETGGCRGAKGPRMQSSRRRIRPRRVAALASVTVLTLAVSTSAGTGHLTAGSTTAGPIAPARSTALGSCMIRGGMGVQMAEGIPTPAGYSRSTGTVRALTLMVDFSDAPGQGSALERLAEFFPQTQNWFKVSSYGRLDYRPEAPVTHWLRMPKPFGAYGIERGAPFDPGYRGLVQDIVAEADPEVDFRQYDLLNVLITPNAGPSALDTVLSVTFAGNTEAPVADGVPVANASFVYSRQDDGSGSYAETGYRVLPHENGHTFGLPDLYTQDGGGAVGHWDIMSEDWGADNDLLAWHKWKLGWLDDSQVRCASAPGTAEYTLTPLARPGGVKLVVVPLSTTTAYALELRTPEGNDADVCRPGILIYKVDADIDTGNGPINVFDSTRDSGGCTRSPNVHAELSDAPFIADESFKDPARGITITVIAADPSGDYRVQVSRR

SEQ ID NO: 11238 - protein, 572 aa, Streptomyces avermitilis
MSPNVTAAPDSTAVPAEAVAPLTRGITVLRRLTEADGRASLSGLERASGLARSTVDRITATLARMGYVRLDGRDAVLAPRLMELGNAYLAALRLPKLLHAQADALADELDESVSLAVGDRDGIRFIHQATRRRAMSLSFRIGDLLPAERTAPGPLFATEWDAAEWQRWRERRAADPEDRGFPAVPARSRPLEDDDRGERSSGRRRGGTLGDDFEERTAAARKQGWALDDQLIEPGLVALAVPVRDPDGRIACVVSVVSHTSRHTAAGLRDALLPRLRTSVDAMERELREAPPAEPAAPADPSGLAAWTGASKQELGREFVESLARGLTVITSFGEGRSALTLTEVARATGLARATARRALITLEHLGYVTAQSGVFRLTPRVLGLGFPALSRTTLPDVAAPHLAALSRRVHESASLAVLAGDEIRYTARFTTSRVMSVNITVGTRLPAYATSLGRVMLADLPEPHLPDPSDLVAPTPRTVTDPEELRAVLDRVRRDGYALVDGELEEGLRSIAVPVRERGGRVVAAVNVALHSSRRTPEECVEEVLPELLATASRIEADLHIAGRFREVPGA

SEQ ID NO: 11239 - protein, 218 aa, Streptomyces avermitilis
VTKQERAARTRHALIRSAAHAFERQGYTQARLADISACAGVSPGALHFHFESKAEVARAVEAAAGVSLRRAAWLAQPPGTNALQRLTNTSHALAERLRGDVVARAGFRLNCESAGGGALNLLREWQTCVEQLLAEAAEEGLLARRLVRADTVSAVVAATTGFELLGRRDPEWLSGQSLAAFWRVLLPRAATAAALTAVDPDGTCPSRAETRTPATTAG

SEQ ID NO: 11240 - protein, 287 aa, Streptomyces avermitilis
MVKQVRQERAIRTRNALIESAAALFARHGYEVVSLSTISARAGVSNGALHFHFPSKAALAEAVGVAAAQRFGRIIAGEALPAQRGGVPERGGVPERGGFAERGGFARHEGASAYGGSSRYEGAPERGASLRRIEAPRRWDVPRRDEAASKQGAASRQNSALQTLIDTSHALLRGLGHDAVLRAGFALGDGAEAVGRGEDLYRRWQEWVTEVLARAEREGLLARDLAVRDAVTAVVGATIGFAVLGGHEGQWLSRTTLTRFWTLLLPRLATPTALEGLMASGRPPETR

SEQ ID NO: 11241 - protein, 474 aa, Streptomyces avermitilis
MAETAEAPGTAEAPGTAEAPGTAEAPETAEVSGTAEAPRTAETAEAPETNGTNRVAEGVGAAGVTGMNQCPYALDVTGRDLAGETAQLRTRGPAVEVELPGGVAAWAVVRQKYVKQLLMDARVSKDARQHWPAFVSGQIDEAWPLYPWVANENMLFAHGDRHARLRRLNAAAFTARRTEALRPRVEEITAALLDGLADRPAGEQVDLRAEFAKLLPMRVICELFGIAEANREPLCTALELVFGTAVPADEMAAAQVKVFGMLAELVAEKRERPGGDLTSALIEARDGDDSRLTEQELLGTLYLMIAAGQETTCTLITNAVAALCAHPDQLSHVREGRADWADVVGETLRTHGPAAYSPMRFAIDDIELDGVHIKKGDPILVSFAAAAADPEPYGADAAVFDVLRPGRRDDLAFGYGVHRCLGAPLARLEATTALSALFTRFPDLTSVQPTEELEPVRSFIVNGYGSLPVVLRPH

SEQ ID NO: 11242 - protein, 234 aa, Streptomyces avermitilis
VARQERAIRTRQTILVAAAEVFDEVGYEAATISDVLKRSGVTKGALYFHFTSKQELAQAVLAEQVASLPRVPEQELKLQQSLDEALLLAHLLREGTGDPIVQGSVRLTVDQGSPRDHLNRRVPMQAWTEHTQSLFEEARAKGEILPHADVEALAKLFVGAFTGVQVLSRIMTGRADLAERVADLYRHLMPSFAMPGILVRLDFSPERGSRVYEAAMKQRESAAASTTDAARTLE

SEQ ID NO: 11243 - protein, 673 aa, Streptomyces avermitilis
MIATTFEAGPVATGHPVADHLAHLLFEGTGRERTHGTWRRLISGREFSYRPGLAPAERTALSYDRLRLLNDTVDDPVRLAADPHRLAALHEWIGPVDGGLTTLASIHYNLFLGSLVDHDDNGRDLSAFTTLQQVGTFLCTELEHGNDVAAMETVAVFDRASGGFHLHTPTPGAQKFMPNTSTTGGPKSAVVAARLVVDGRDEGVFLFLTPLGDRSGLLPGVRVRPLPERTGTPVDHALTAFDHKWLPREALLEAAHGRLAPDGTLTSTLGNRRKRLLRSINRVTMGKLCMSAGTLGMARAALTIAVRYAHSRLVTGPRAGERIPVAAHRSHHGRLLDALATAYAMTFLHRTVVDRFAARTEEDREEVERLTAVAKGWITWQARAITTECRERCGAQGLFPANGISDLASNIEGGITAEGDNLVIWVKAAAEMVFGHDTTARTRAGAPAAPNSSAALSAPNRPAAPATPSAPGAPATPGAPGAPGAPGAPGAPGAPGAPGAPGATLADPAFLRGLLAEAEAIWQARARADLRDGPAGDPVGRWNGTSTAALEMVSAHARLQAADALIAAAERATDPTARFLLRSLCRLFLLRRLRDHTGDLLAEGHLTADHVRALPRALDSVYDDLAPHLMTLVDAFDFPAEMLSAIPIASGGTIVRTLEQSAEEWPLVSPASP

SEQ ID NO: 11244 - protein, 344 aa, Streptomyces avermitilis
MRATLIYGAGDVRVEDVPDPKIQQPTDAVVRVLRSCICGSDLWPYKSRPATEQGERIGHEFLGVVEDVGSDVSGLKNGDLVVAPFVWSDNTCDFCAEGLHTSCRHGGWWAADGVDGGQGEAVRVPQAQGTLVKLPVAEDSALLPSLLTLSDVFCTGHHSAVTAGVDPRTTVTVVGDGAVGLSAVLAARRLGAERIILMGRHKDRTDLGRDFGATDVVPERGEEGIERVRELTGGDGTHTVLECVGTLPALQMSLGVVRAGGTVSRVGAPQYDDVPLGFQEFMNNITLTGGVAPARAYIDELLPDVLEGKVEPGRVFDRTVGLDDVPAGYRAMDDREALKVLIRP

SEQ ID NO: 11245 - protein, 393 aa, Streptomyces avermitilis
MAPRKRNPNGSGSIWQRKDGRYEARVYVPQPDGTRKRKTVYGTTWEECDTKRQELVLRDRQGIPTPTRSAKLSEWLPYWLKHYVEPRRKLSTYDKYEVQVRLYLVPLLGTRRLESLSVADVRRFITRVQNAHTAATAKESHRVLRTALTAAVREELITRNVASLVEPPRVKQREIRPWSLEETLSFLEAARSDPLYAAFVLAIAMGLRRGELGGLRWSDVDLDNRVVHVRQQTQRRRGTLYDDDPKSRRIRVVPMPALCIAPLRWHRLRQRETFARTGVAWCEAGYVFATRNGRPVEPRNVYRSFTRVAADAGLRVVRLHDARHGCATLLTAAGVAPRVIMEILGHSQISITMDVYTHVVHDTQREAISHMDRLLKRRLPTSLSGGAGSIEFP

SEQ ID NO: 11246 - protein, 66 aa, Streptomyces avermitilis
VLTVVTSEPQALTVPEVMTALRLSRSKVYDLIRSKQLPSYTSGRARRVPVDAVRHYMQDRLEENAA

SEQ ID NO: 11247 - protein, 55 aa, Streptomyces avermitilis
MEAGKRHLNCENVHDADGGVCVICVICVMGCVAGDVPMTHLRAAASHKTAAQKPE

SEQ ID NO: 11248 - protein, 491 aa, Streptomyces avermitilis
MADDETNPARKVITDYAQAHFRYFRTADGTVYAQRNGHPVARPIRSQGTTGSHRQELMVGLFRDGRGVFNGSALKEALDLIEALALYEDVQPVHIRVAPGFDGATWLDLGRDDGQSVRIHPTGWDILTPDPREVCWRRTQLTGELPLPAKDTGGKGIDLLMRLCNFANAETECLAIVWLIGCLGPSVPVPAPFLTGPQGAGKSTGGRMLVRIVEGMSGDLRRAPKDEENLIAAVAAGWVTALDNLSHMTPDLSDAMCCIVTGAESVKRALFTDGDVFRVGYRRPLLLTGIDVGVIRPDLAERLLPLRLERPRVRRTEAELWSEYAEVLPVVLGSLLDLTVKVRAVAAETPTDLRMADFAHLCAQFDAATGLGALAAYRASLDDLNDDVIEGDLLAQTVLRHADTIEPGGAQRMTSTEWLHCLSRLYSGEDLRALPKGWPTTGKVLSDRLKRLQPTLAARGVLIDTGRTSEGRYLEMTRTAPVPPHQQQRMH

SEQ ID NO: 11249 - protein, 286 aa, Streptomyces avermitilis
MTQPTDIRTEHLATALSLAASGIPVLPLRAGKVPFGNCHRCTDNACGGRPNMKNAGPCACPGPCHAWAAATTDPDVIQSGVWRRAWMRASAVAYHPGGAWLTVVDLDNAEAVTWARETLPATQTVPTTRGEHWIYLGPMQSTNAVRPGVDIKSTMAYARYLGPGTGRMAALPDAVRALTVKNPTTARPAPQAITVPALAGGGECRHRTPTYLERGIAMAEQRITAASSAVHATVYRTFLAVLSTHGRCGCLTDTHMARLFAAAQAKGESARHCTDAWTNARTRLGL

SEQ ID NO: 11250 - protein, 343 aa, Streptomyces avermitilis
MTTTVDLVPGWVTTRDVIAATYGCGTFQGIEPADAAGKVFVYSDPSAGEEYGYTFDGRAEDDEFGPLYLYTGAGANGDQKPSGRNGSLLSHVEKGREVHLFVAHGRLPGSGAMRQRYIGQMVLDPVKPYDVRRGPGKDGVMRDVLVFRFRPAEGTTPAWTEADRMPAAAQTAFEIVDPAVAVAQPVVLPEQSGAKVKKTEQHSTVETMADIPAGQRKVLRREGELVKAFVAHLAAAGHETHSFQITIKGEPGALTPDLYDATDHALYEAKGQTTRANVRMAIGQLADYRRHIPGRKDLLRVVVLLPSEPTEDVKDLLGEEYVELVWQTEDGGFAGWPLAYNQP

SEQ ID NO: 11251 - protein, 151 aa, Streptomyces avermitilis
MTHTHRPAALEVHHPQPLAVHPTVAPLVTVQPGPTPAVQSIVLPDGRVVTGYTLTPAPALAPVDARPAVSRTAVNVALGGVGFAAVCGGLVLLTTFIAALTTFISQLITLAAVIFGGWIAVQILGGTRHTGRGGTTINIRKAVIKRSHFHG

SEQ ID NO: 11252 - protein, 692 aa, Streptomyces avermitilis
MTRNNRRNVTDYLDDGRTMATYTVPDMHGSSGGGVGAYLLHRAKPHLPPWIGLAGTGIAGALGNWRWEGSAGAGVGLTLASVALTGATWWAGKSTSQQRRLHSAVTVAAGSAWVTAACLAGPTAGSIDDMFLMGGPVVALSWNVRMMLRHNPEGAVNGSSDGGLLEKVGLARAQIGAAKVEPNRVTAPLAVVAGEQTNDDVTKALARIASALDLPTSAVRYTPDAGSSRRGELVIVPEDMLADVVEWEGPSNLGGSIAEPLVIGRYDDGAPLVVWLPGDPDAERNSTHVLVAGGTGSGKGDAALNLLTEVLSRRDVIVWFSDPKAFQDFAPLRPGLDWAAEGGTDTEVMVEAVKAVIPARTRWLGAHGYRQWVPAAAQQQNDPAHSCQSARACGCAGMPFLVAWFEEAANTLRALGDDAFTGIAQEARSAGISLIVSLQRPSYDQMSTSTRASLPSVIALGCDPRDEGFCLPDTVLDAGAHPGAWGNRRPGYCYTVSPGIPEDRYPSPGRTRRFTLRAVPVMQQLATWAQHNGAHADPITAGAAAGVAGQAYAGRSSDSPTAQPAALRAVQEGDDMTEYGGGLLVDLEDAGIDADAELPEAEDGDDAPIFGQETGRKPSPEEARRFFAEALADFEAAGQMVVGPKDFMDWCDRHNLSRPWVSERLKEAAMDGRLEATNTTGRWRIVPVLTAA

SEQ ID NO: 11253 - protein, 189 aa, Streptomyces avermitilis
MADQASAHRRAQTTSRPRNTNGDGKGNKFANAGAAAGGFVGALGGSFVPPINVTVNNSKQTARTGGGSRPHSESLLPSPEFGSPAQVRQYCNTLRAAAVTLSIEVAMGAEIMKGVLAAVPDPQGRTFGSRVRAAKVARKMQRSADALRDAAKNAAACYSTFQQEFEEEINRVRHRARKPQQPVMNWHQQ

SEQ ID NO: 11254 - protein, 166 aa, Streptomyces avermitilis
VSSRTRARGSKRAAGVHTVSIPRQRGRRRAQPFVIVFPESPSLTREALGFIGRALWKGRRALAPTALALLAFAVTGLLHVMAWWSSLILAPLAAGPLVWLAVMQVRRPGRGAVVLWRAGLALLATFTAAWAALAAGFGPLAGPLDLVWLLMWIAAQTAWLFVRRSH

SEQ ID NO: 11255 - protein, 360 aa, Streptomyces avermitilis
VSARSKRRQPAGDMFPGMADRITGRPPKAESEPEAMTLDEAIARSFAIYDRVLAVFPVVATVGLFSGGNDSVVVNHLFRHRVDAIAHVNTGTGIPETTQHVRDVVAAWGLRLHELHPRHSYRDLVLGNVLATRGKNIGRPVWKGFPGPAGHSVMYRRLKDEPLQRLRGQIIGKRGRSRNVVYLGGMRWAETDRRFRNAEEVDREGALIWVSPIVHWTDAHMREYRARHRCTLPHEHAEHHLCTPDALPLNEVTVHLHMSGECLCGAFARPGELDEIEYFYPQATKPHRELEREAEAAGLPACKWGQRPPGPRSRRSAGRLCTKCDGIEGQADLLAEWRESGLITDAQFATFTSTDEQRAA

SEQ ID NO: 11256 - protein, 325 aa, Streptomyces avermitilis
VNGVHIRSAERALNVGTWLIVCGAMLYSILTVTPLMSAHTPAKWGWTAPILPLVVDAAVVIVVRLDSVLARLGGHGGRWPIVLRWMTGTMTLALNTADSALQKDLVGVAVHSVAPLLLIVTAETGLAYRRAITAAVTALEARQRAEREAAQRAARERQEAARREAREEREHAAMLAREQREHEARLAAEAAEREERRRREEREDRAAREAAEREGRERREREREQRERDREHAEREAAERVAKEAGERAEAARREHAALLDGPPVNSKLPEDHARRIVAAAVAEGVSVRRAADLCGWSVGWVSARYAEYRDPGDGGAQLAIVSQA

SEQ ID NO: 11257 - protein, 96 aa, Streptomyces avermitilis
VMARELRAQLSASRGGWRLYVVVRGSVEPWLEHCFGPGDRLLTFTERARALTALGFVQAPAAEWEWTEFSTDPADPASPVWLLASVLVRSRQEAAA

SEQ ID NO: 11258 - protein, 454 aa, Streptomyces avermitilis
VPPATLWLTPSRTPSGLSVGPVPEHVGCVDAHEVNRVRATLALYVADVFASVPRKDQRAKGDCYLRGLMLDGRRKSIQAMAARLPDGNEQNLQQFVNQSTWDPVPVQRRICERMLPLIAPVAWVIDDVSVPKDGRMSAGVAPQYCGALGKRANCQVAVSVHAASDTASCPLQWSLFLPEEWASDTDRRTITRIPPEVTHREKWRLALDMLDTLAAWGMTPPVIVADAAYGTNAHLRAALADRHIAYMPAVRSDVTAHPFDAKPVAPARNGPVGCWPQPRYRHPAPSLSALAAGLRQDAFTLLTWRQDSRGQLRSCFAAVRIRPAGKAVERPVKAAASAEQGWWDGVLPDCWLLIEWPSDAEAPTDYWLSNLPSDTPIIDLVRLAKVRWRIEHDYRELKHGLGLDHFEGRSWPGWHHHVTLVTAAHAFLTEQRLAPKVPAPDSPSTKSSTPSRTS

SEQ ID NO: 11259 - protein, 336 aa, Streptomyces avermitilis
VAFRYEHQEPGSRVISGGRDHSNRLLERLGFTVIDGRPTTVEGERAWRLAVWSHLQLTEDLSQVPPGVLRAFGVYGGGQGIWMDKARTDAVHEGGITMGVLHTGAHYPDEISDNDVIYHYPTTGRGPGRDESEVAATKAAATLKLPIFVIAKPTPRSSVRIVRLAWVEGWEERSRIFLISFGDSRPEHLLTEDHSDNQPFSLTGNRSRSSRRNVRERPGQRRFKLRVFQRYGPRCPLSGIAVPEMIEAAHLRPDAEDGTDDPRNGLPLNAALHRAYDAYLFAIEPETLSVVTRPQGPTIEELGIFTPHLRELPRRPHTEALRWRYREWQLRIGTQG

SEQ ID NO: 11260 - protein, 131 aa, Streptomyces avermitilis
VGNLGGYQMMTTLAKKVGGPVALAVVTAVSGWAIGRGAEAGGKDIFKAAKAAAKKRNAPCSTKGQVFDVVSDGEDGKGLVLRAGDQYRVMECDGEAILIEVLGGTNNPYFTSSQFLASVSGFSTGEKTKAK

SEQ ID NO: 11261 - protein, 367 aa, Streptomyces avermitilis
MATLEAELSKLGVMFDLRSYTGGFVPLVVIQPSYGNPAARRHWRDTLDAHVDFTTHPRASLLTPDQRKQLNEFHPSGAARFWGATSVQDTKMDRLHAGDIVLFTGKNHVRGIGEIGALFRNAQFANSMWTEDPTKGSWHNVYSLLSFAPTEIPYEEIWALPGFNVGDNFIGLRILDPEKATTILDGLGIEAQVDAELGRQLHEPVARALRTHTDIVDGEALRTQTTRYTLTERELVVHRTEALLLQEYTDSLGIDQPQRLRTPAGITDLHLTRPDGSEVVEAKRASTRRFVREALAQLLDYAPHTPEPATRLTALFPTRPADQELALLHRYGIDCVYRTHPRAFERAPADQEVRAGMTPFWQGRPSN

SEQ ID NO: 11262 - protein, 582 aa, Streptomyces avermitilis
MSVNPTFQSPDDGDPQASPTSQAAIIQIDTALESMRDSGFDLTAAAGEPIDNSIEAGATHIKIATTFGPQKRSIEEIAFADNGRGIKTEILALALSMGFSTRYGQRGSLGRFGVGLKLAGLSLGRRIDVYTKLPGDDVIRHAYLDLQEISKKQQTHIQAREVPAWPAAYEHLMRNQDGTPVDSGTLVIYGRIDKLDGGGPYGTSLDEKLADLRNFIARAYRKFLDQGVIIQLNDTKITLFDPLFLLDNPRILKRYPKEDMHGTVIDADDIPIADGHSIHVTVTIVPAIFRWRSGEGGLRDRDGRDIREFQIADGVGKISMVRNGREINYDIVPKLLPAGVDKVDRYIGIEVTFPAELDSFFQVRNVKRGAVPVDKLRSELRQWLDRPVRSARRAIRSHWGEIETQERAAAQAHAEATAAAARAEKTAPMGQAGKDLTDQESEEILQELLEDLGVADDQEKAEEVREQVKQNPFTLVDGAWRGKEMFEIDHLNGKAIIHLNHRHPFIRDIYDRLKAVADDGANGVEPEELLALIRKTQTALDTLFLAYAKAENMHPKPSQFDDLRSYWGQFTQSYLQELRNEE

SEQ ID NO: 11263 - protein, 156 aa, Streptomyces avermitilis
MLTEQAQHALKLLYRRADKTGDAFDLERIDRALDEVIRLNANAPAAFQIRSALAHAGTVLRDRRVLAPAISLDETDSYREPGALDEHFAVTDIRAWLDTTEALTASQRSLLQQLSADRDPSDLAVERGLSVARMREQVSRARRRARIAYAAEVVRA

SEQ ID NO: 11264 - protein, 379 aa, Streptomyces avermitilis
MANKKGRRRSFGSCRQLASGRWQVRYRDPQTGLLRPAEKTYETKTDAQVALTHIEADITRGQWADPDAGDVNFADYATAWLRDRKLADRTRERNESVMRLHVVPVFGAGSIADVTTARVRSWRGKLLAAGVGEPTVVKAYQLLRALMNTAVDDELIRRNPCRIKGADSYDVPERPVLSVAEVFGVAYAIAPRYRLLVLLAAFTTLRFGELAALRRKDIDLNGRLVVVRRAQAELQNGRLFDKAPKSAAGLRTVSFPAELVDEISHHLKHYAADGQEGHLFVGPQGGQLRRSNFRDDWIKARKAAGVSPKLHFHDLRHTGNTLASTAGASTRELMTRMGHSSSRAALIYQHMTSDRDRTIADRLGAMIRNGEGDLTAAGD

SEQ ID NO: 11265 - protein, 437 aa, Streptomyces avermitilis
LAQHGTLPGILRQLSGLGGCTNPIRLDGHRTEYDVDTRTGEIGNVLHRLDSSSLPAGHLLVRCNNRRTTRCAACAEVYRRDTFHLITSGLRGGKGIPERVAAHPRVFATFTAPSFGPVHNRPSGPAGSVRRCRCGVHHDQDDAALGTPLDPETYDYEAAVLWNAHAGPLWRRFSTYLRREVAKRAGFSQRAFRQYARVSFAKVAEYQKRGAVHFHAVIRIDGPEGGDTPPPAWATAELLTDAIGAAAAHVRVDGPVIDGRAPTFTFGRQLDVRTIRSADFDSGQELTERAVASYIAKYATKGAETATGALDRPLKFLAELAQLDISDHARRLIRTAWALGARKELEDLRLRAWAHMLGFRGHFSTKSRRYSTTLGALRAARAEWRRAQAAAATEGDTGTTLVVSHWVFAGTGLSSAEAWLAASLEPAPGTEGEPIRG

SEQ ID NO: 11266 - protein, 81 aa, Streptomyces avermitilis
VFLPKYPDNSTPPPAHTHTPADPAPVRRTLLQISISPGAVAAVLVGGVVLTALLAAVAVTAISVAIAAVVLRSMLRDHHRR

SEQ ID NO: 11267 - protein, 64 aa, Streptomyces avermitilis
VTVSLPLVVVLGFIAWGAVKFLGVRTWIVVVIALFGFLLSHTFMAPAIDSGTRSGVGIVNGSHD

SEQ ID NO: 11268 - protein, 63 aa, Streptomyces avermitilis
VTANRRFRSVTRIGPVQVGTSYDDRGHEKHTAACTAPRCGFSADYDSRAAAELAARTHRCPVR

SEQ ID NO: 11269 - protein, 208 aa, Streptomyces avermitilis
MRAQLARIDAVLVQALIAAALSFAHLHDVASAAGQDGWKAWAYPISVDLLLVAAWRRLRTGDAKAAGWCWFVIALTASLGANVATAGLLDLDQVPAWLRILVAGWPAVAFLGGTLLAHSAPGPVPHEDTEDEQDQEDAPDPAPELPTQPAPEPTPAPPAVAVPAALVEHARKVAAEHHTRTGTAIDTPTLRARLGVPAPMADAIAAHL

SEQ ID NO: 11270 - protein, 459 aa, Streptomyces avermitilis
MTDLATLLEVGGPVAALGGGAAYTRAKHPGVYWSTVGLLISTARLLSSYSSVMEACGLTVAPSRLRVLAVKATTRREIRPVPPRRGIIRPTSTGLRLRLRLAPGQEPADVAASAERLRHAWGVHAVYVTTVKPGVVELRLVGFDVLRRVRMPRKVDGGFLKVPVALREDATPFVRDYRTVPHQLTLGATLSGKSMYLRHLVAGLAPQPVALVGIDCKRGVELAPFAARLSALATDPEQAAELLPVLVKEMEDRYDLIKARQGIAPDAPDEEITSDIWGLSEHERPVPIVLFVDEVAELFLVATRKDEDRRDEMVTQLIRLAQLGRAAGIYLEVCGQRFGAELGKGATMLRAQLTGRVCHRVNDEASAKMALGDIAPEAVSAACAIAPERPGLAVAGDTSGGWSRIRTPYLSLGDAAEICRQAAHLVPDLPALKRFRSDVPVRPVDTTRAPVLQPRPVTD

SEQ ID NO: 11271 - protein, 118 aa, Streptomyces avermitilis
LRTIRVETSAATILLTEAPEPKVRDRQTGEIAKDINSGEALMTIGVVYIEEGESSLIKVTVPESGVSEGLALGAPVSLPGLVARPWESVFNGQQRHGIAYRSAAVTPAAFPAAMGATA

SEQ ID NO: 11272 - protein, 262 aa, Streptomyces avermitilis
VTSLPTSLLGDLDPTSDRAVFRQIADQLREAIDRGRFKEGEKLPSEAELVEHYGVSRMTVRNSFSILQGEGLVHAEHGKGVFVRPRPPVRRLASDRFARRHREQGKSAFIVEADAAGSHPQVDSLEVKEEKASQDISTRLGSVRRVLARRRRYLLDGRPVEFATSYLPLDIARDTPIAEPNPGPGGIYARLEELGHRLDHFEEEIRARMPSPSEVKTLRLASGVPVIHLIRTAYDTEGRAVEVCDTVMAADAYVLSYQLPAT

SEQ ID NO: 11273 - protein, 162 aa, Streptomyces avermitilis
VGECCCYGGEPSHPRRPRNVTTDRPHSVSVAGVIVDDQGRALLIKRRDNGHWEPPGGIVEREETLPEALQREVLEETGIKIALPATLTGVYKNMTGLIVSLVFRCEAADGTPTTGDETYALRWATREEVTELADEAYAIRVLDALDAASPPAIRAHDGVKLV

SEQ ID NO: 11274 - protein, 142 aa, Streptomyces avermitilis
MHEYTSTARVWGLTCPGFPEEVSRARRWTRDILRGSPLAEDAELIVSELSANAILHTASGQQSGSFHLALAVSSQVVALSVTDDGGTGTAPKTEHADQNATHGRGLGMVSAIAHRVVIHDSQAGHTVTAELFTSARPGGHPC

SEQ ID NO: 11275 - protein, 115 aa, Streptomyces avermitilis
VLTSTTPEDLAAAGQDGTYRCWATAYPLHETSSIPLGAHDATSPRLALRWLRERTRNVTDQLDMAYAQPGRYWLRDETEHERALAYLTTSTAYQLTLHDENTRYVLVAYPPGVTS

SEQ ID NO: 11276 - protein, 129 aa, Streptomyces avermitilis
VNGYTRGFWCECWTEDLTKADSPAFHSSFDAHSAGQADRWIAIALRTITPALDSRASDEAWEWLYEGRIETRRALLCSEPCTVTINQGGTRITWTARPALFLPLAHRRGLELPCCAYDFKPHVTVSSLS

SEQ ID NO: 11277 - protein, 589 aa, Streptomyces avermitilis
VVEQRYHAVMEVAAGVPVTQVAARYGVSRQSVHSWVRKYEQSGLAGLTDRSHRPASCPHRIASEVEAVVCELRRRHPTWGPRRLVHELERRGLAPVPSRATVYRVLIRNSLIEPGVRRRRRSDYRRWERSAAMELWQMDIVGGLLLADGGECKMVTGIDDHSRFMVIAKVVQRATARAVCSAFGEALVRFGVPEEVLTDNGKQFTARFSPGKPGEAMFDRICRENGITHRLTKPRSPTTTGKIERFHQTLRRELLDQQDPFTDLATAQATVDAWLEEYNRMRPHQGLDMAVPASRFVPRPRAEQDALPVRLPARLDPVPAPASAEPEPATVPRAWPMTEGEVGAIEVDRVVPASGNLSLRGQQIWFGPALAGTTVTLRIDVNRLHVLIGGGRHKTLPSKLSGRDLKALLAGGDARPAGPWAEEPGPARDTKGTVEVDRTVNAVGYVGLGGDKVLIGWPFAGQRVTLRLDGRVLQVLDEQRVLKATLPSPLPASACGRLQGSRPAGPPPLLPPPAEQIAERTVSSVGGFMVAGQRIQLGRGYAHQVVTAHLAEDVIRVFHGPELITTVPRVTRKEVVVRKSGEHNRRKIV

SEQ ID NO: 11278 - protein, 133 aa, Streptomyces avermitilis
MYGRSDEAWEQLTDAGLKFLVERAQLHKVTTYTEMNSVLARRTGLPGFDFEQADERAAMGYLLGLIVEQDYPKSGLMISALVHYLGANDAGPGFYTLAQRLDLLPKDSSATARLEFWIGQVNSLHQLHSAPGR

SEQ ID NO: 11279 - protein, 147 aa, Streptomyces avermitilis
MADTGIDDLSKYESGTDPFTASELEAIARFRENLSGIPDIAFKGFDADEIRHLASEHGMGEARKMLHSFATDLLNGRWLAILSLKNDLPTGTDEPPRYSTPAARYVAHLTAQHLNACAKFEHAVTMWFLDLDTHLSSPLYLNRDGEE

SEQ ID NO: 11280 - protein, 515 aa, Streptomyces avermitilis
MLRSRPPARPRRPMDRGETVPSDGVILHGPIGDFARQLSPSDDLQAEEMYAAAISVWSTAIAPTVKVRSYLPGVRPTLVWTAFVGDSSNPSDGLAQSVVRALRVRDYFTSLAGRHPVTSEAHLLSAVESARRYPSLHTPAPRSTLLESSPFQRTPAGRQRLQGELNYALRQAWDGSNFLWIGAKKRTPAQQELDRIPPTVGVLWGLSDMSWEQRPYGPGDDAFYSRFLPFKLRGQPSHGRTVQTGPSPELVAAYEWAIGSQREVKLSRAAAEMWGEIRSLEDSTLLNSPAPRDAAFTIRVGEHTLRVAAALAAAEMSPAIEPNVIEAAWSLVWRSIRDVADLANGASVLLENPLAKTSSAVPTEADPAGICVEPSWPAESATLDFPDTPVRRRAAIVQAQDRDSQVRRQVKVWYDNTCQFCRTKIEFPAQPFSYSEGAHIQALGAPHNGPDRVENMLCLCPNCHIRFDMGGRFLTDELRIIDSATGEDLGPLKVHAQHRIRLAYVRQHRSRWANT

SEQ ID NO: 11281 - protein, 142 aa, Streptomyces avermitilis
MTETAKARRAPRQLGELHDVYAFLEEVRLRPGMWVRGSSLQHLHSMLLGYRVALGVHGIEEPFDFWSPGNQCSFSEWLWGRPGMPNASSLGWATEIERAAEKADRSAMEMFFELLDQFRTTHHDVQPPHRAAPETQQPTVTA

SEQ ID NO: 11282 - protein, 322 aa, Streptomyces avermitilis
LEGPAVVSTRLTLDCHVLCIAKLVLGGRSCGGPLMSAARAPAQGGDMGTSAPSSAGSEPRAAAAALLAATEGLRARTRRQTNGAWTPLLGFGLLALAAIPVARYAFNFGAHGRYVGSYPAFAYAELTGLCVVHEPGTPCLKGEFDGAVLRFVAWGVWFALLPLAWFVFARWYRLRGEARGVVPRRGMWVSVTAVSTTVITTALVALLFGRNQSWEAVLLENSYASPWYLAGIGLLALGIAERSWIAAAAGTAHALLLTGYLGASWGSGWLPWQHPAHPGWADGPQFKAFLLAAILLLAGLGERTAVRRRGAPGVAVAGTVVP

SEQ ID NO: 11283 - protein, 169 aa, Streptomyces avermitilis
VTIKRGTPLIAALAATLLLSACSSPDTDDRRVTDGRTSQWDKNAGAPEASAFMNVTAPKAATEVKGAVQINPQEDIHLLSFVTSEKNAEGIARDLRSEEPLKANKADFAPDGELFKHLGLAEPQTLKGARSAGVCPPCVKDDRRKKVQWIDIYVQALKDDQARVYLKAF

SEQ ID NO: 11284 - protein, 110 aa, Streptomyces avermitilis
VTGSRSRHHSATAFAPLGTCCAFATSSSDGCGSDSASRTLCAPSDGTPTTGDETPTGEYPTRDPRAHTPWSGHRSTLSAGRPAPDRVLNSPLIPGGQDCSSRRASRCCRT

SEQ ID NO: 11285 - protein, 92 aa, Streptomyces avermitilis
VWRSCRTRPGGVGPRCREGTPENVRRSVEGSLRRLNTDYIDLYYQHRIDPGTPIEDTAGTLSELIEEGKIRHYGLSEAAPATITMPGIAYRR

SEQ ID NO: 11286 - protein, 550 aa, Streptomyces avermitilis
LHPRAGFEPAFGGVVGDQADDGSAGAPIVNVRHVVSTTTPLSRTTLQAHQRSSLSSHVCPGGELMSRSHHKRSRRPAVLGATAVAAVLAGGLLITLPGGASAAGSGLADDFNGDGYRDLATGAPGAVAGGKAKAGAVVVNYGSSSGISAARHKITSQSSSGVPGASETSDRFGTELAHGDLNNDGYGDLVVGAPVEDVGGDADGGSVTILWGGSSGLSGGTTISDPNASGHDRFGQSLAVGDFTGDGKADLAVGSTGKDVWIFKGGFTKSGGAAGKLRFDAQIESGAYPRGAVQLAAGDFDDDGAADVVVGSAAGNFVYRGASTGPTLQTEVGTGYAGALTVADFDRDGHDDLVVGTDFVDVISDRTAKGGYVTVFYGGAAGVDTTRSAVFSQDTAGVPGADESDDSFGGALAAGDVNGDGYPDLAVGADFETIGSADQAGSVWVLRGGASGLTGTGAQSFDQGTSGVPGANESSDLFGDAIHLADHNKDGRADLSVGAGGENSDDGAVWVLRGSTGGLKATGAVSFGASSVGIGNSGEDPMFGDAMSGS

SEQ ID NO: 11287 - protein, 177 aa, Streptomyces avermitilis
VRPRTAALASPMSPGRGAVPSAAGRYIPDRCDHHTKVTWRLRAVTTPGRRDRSMNLMNLTLKRLLGVTAVVATGAAALLGTGAGTAGAADRAHCDRAEQDVWSGDPSRNLTGHRCSIPTHKSRWYTVEIDTLVQTRYKGDTVDGGVDRAKTLHNRTIRCMGYTSDNGTVNWFGCPPA

SEQ ID NO: 11288 - protein, 497 aa, Streptomyces avermitilis
MHDFSRRGLLRATAAAGAGAVVLPGITAAEAPGASAATGTAESVKCKPAKLTGRIVRPDDPGYADASLGWDELFVHYPLVIVYAQETQDVVNALTWARQHDVALRVRSGGHSLEGWSNVDNGIVIDVSELKWAHIDTASRIATVGAGLSQLEAVTALAEKDLAVTTGTEGTVGLSGATLGGGFGFLTRYLGMACDSLIGAEVVVASGAECAKVIKADGKNNADLLWALRGAGNGNFGIVTSLTYKVAPLKSVAYLQATWDGLGDLQGVFDTWQRTAPVADNRLGTQLEIHRGEILLFGVLAEGSEAEAEELLAPILSVGNPQVSVQVGNWGDVYAGFQIPTADEPANWKFFSQFTTEPFPEKAISLIASFMQDAPSDDSNFFTQAFGGAVRRSPRGGTAFPHRDALFYSEPGAGWGTRGQAGSGDEITPQAQAWIAEFSQALRPYVNGAYVNVPNIGMQDWETAYWGSNFDRLRKIKAKYDPRNVFQYEQSIPPASC

SEQ ID NO: 11289 - protein, 90 aa, Streptomyces avermitilis
MSGMSGIFLGCGEGGGGEVAAGVQGDVDEADQYGGFEERADDACEGLAGATGWQIRQEEPCQGEHERRADEPGRPRPSPAAIAARIQRAR

SEQ ID NO: 11290 - protein, 140 aa, Streptomyces avermitilis
MPDITAAPSVLFVCVHNAGRSQMAAAFLTHLAGDRVEVRSAGSAPADTVNPAVVAAMAEAGVDISAEVPKVLTVEAVQASDVVVTMGCGDTCPVFPGKRYLDWRLPDPAGQGVDAVRPIRDEIEKRVRGLIEEIAPETQP

SEQ ID NO: 11291 - protein, 134 aa, Streptomyces avermitilis
MSNQELVVLGRSDEAGVCCPGLLTAPLDEGRAGELAKVFKALGDPVRLRLLSMIASRAGGEVCVCDLTPDFDLSQPTISHHLKLLRQAGLIDCERRGTWVYYWLVPEMTDRLASILTRPAGEPLPGRAAAAAAP

SEQ ID NO: 11292 - protein, 156 aa, Streptomyces avermitilis
MSRAQLALRVSDLEASITFYSKLFGTEPAKRREGYANFAITEPPLKLVLIEGEPGQDTRLDHLGVEVDSTGQVNAATTRLRDAGLATFEENDTSCCYALQDKVWVHGPGQEPWEVYVVKADADALGKSAAPNATGDGCHTTQAPEPASASAGCGCG

SEQ ID NO: 11293 - protein, 215 aa, Streptomyces avermitilis
VRHPDHPGGWHRSRARRSGRGIGCGRDGTLNRNSGSARRQALLAAVRSLMIVGALVAGYYLLPLGSAFTAGTVLVLVGGLAAGALLLAWQILRITQSPWPGLRAMEALAATVPLFILLFATAYWLMERSAPNTFSESLSRTDALYFAMTVFSTVGFGDITPRSESARLLTTGQMTVNLLLIGVAARFLVNAVQEGRRQRDRSTTGSQDGTTPDAR

SEQ ID NO: 11294 - protein, 198 aa, Streptomyces avermitilis
MPRPPDPAKRRDLLDRVREYMIRNGLADLSLRPLARSLGTSDRMLLYYFGSKERMVAEALALDERRPLLRARILLGPTDSPRNPAWLRRFMEETWRQLSAPDLRAALPLYLEVMTVSVLHPDRYGPFMRDVLTEWRGLLVSVFRDLGMAEARARTEADLLVDAFFGLLIAPLADGGWDRSDAAVHALLDRLEPGWHDT

SEQ ID NO: 11295 - protein, 242 aa, Streptomyces avermitilis
MYIYRCSECYANARRGTSAAMVASSSERSGSMASQVIGLTTTSLGERLARICRRHGESGQKGASDHHAQRKGRPLKDTPTTWVHRNLALWSRVLAPLQPLDAPRARATAWDASWPLQRELTSARLARRTVTAQLGDWNLEDLADTAELLVSEVVTNALRHTRGPLRLNLQVRGSRLRCEVEDTDPAGPVRRVVDTDAEGGRGTELLDLLSEAWGSTRTATGKTTWFELLTRTPEPEGSPASD

SEQ ID NO: 11296 - protein, 186 aa, Streptomyces avermitilis
MSTHEATSEFRRPPRGRAAWSRSAAHGQEADGPIAFFGGPRDHRRMWGELITRHTSEVEFGAPVSDDALTWAAGVLGSPLPDELISVLRESNGIVGEYGNHLVSPIETIVQRNVELRSSFSELYMAFDQLLFFSDIPGNGDLFGMVLVPGQYDQVFVWDHETDSRNWVASSLADFLERWLTGAIDE

SEQ ID NO: 11297 - protein, 205 aa, Streptomyces avermitilis
MDAGTVAAFLAIDLLLVFTPGADWAYAIAAGLRDRSVVPAVAGLVAGYAGYTLLAVAGLVVIVAGSASLLTALTVLGAAYLIWLGWSVLARPATPQASAEAVAASRWRIVLRGAGISGLNPKALLLYFSLFPQFIHPGEGWPVAAQTGLFGTLHMASCAVVYLAVGVLARTVLKARPTAARAVARVSGTMMIVIGGFLLVERLAG

SEQ ID NO: 11298 - protein, 152 aa, Streptomyces avermitilis
MDALDRKILTELQMDGRLTVTELAARVQLSVSPCHRRLRDLERTGAIRGYRAVVDPAAVGLNFEALVFVTLRWEDRDTVSTFEQAVAAVPQVIQAQRLFGDPDYILRVATADLAAFQELYDRHLATLPGVQRLTSTLVMKHVVNDRPLPEQP

SEQ ID NO: 11299 - protein, 415 aa, Streptomyces avermitilis
VTMPYGSRLAAMMTRRLGRECVYTPSARLALYLALRHWCRPGARVLMSPVNDDVILFVVLAAGLRPVLAPVSVGDGNIDPAAVPESTWRSVDAVLTTNLYGMPDRVVELRRRCEQLGIPLFEDAAHAIGTHVDGQPIGTFGKAAAFSLSKHVAASAGGFLAVEDARTRRELELLRDALLVPRRLHDDLAATLRPLARSAVRTLHLVRPVWRTMQRLGVLERDDFRMALHAERLSGCAREAPSLAAYEPWVRVDLHGFRSRHGALVRGQLTLRMDRLDDDLARRAVGVSLLSGTAWASPALRDRTAHNGHLPLFRVPLLVHDRNALIERLVSHGVVTGYVYDPPLDDYAGAEFVEPSPDPSAARWFASHVLPADPLLARGITNALTAEQAATAHPSTPAAAPAPIPDTTPPTPLGQ

SEQ ID NO: 11300 - protein, 371 aa, Streptomyces avermitilis
VDITIHRPAELNTSLRRAWHQAMDESPDYANPFLAPEFAAGIGTYRGGAQVAVLREGGEPVGFFPYERNSFGVGRAIGLGLSDCQALVHRPGVTWDPQELLRACGLSVFEFDHLVEEQKPFGRYVTGTFASPVIDLKDGGGSYAEWLRGAYPGLAKTTLKKERRLGRDLGEMRFVYDERDPRALRTLMEWKSAQYRRTGRMDRFSRPWIVDLVNHLFHVRDEHFTGVLSVVYAGDRPVAAHFGPRSRTVFAAWFTAYDPELRYYSPGLIMHLRMAEAAGRDGVRLMDMGRGDKEYKDWLKTRELRVGEGFATRPHPVAAAHRLWRRPVRGLRNTVLAHPTLREPADRLLRTVGTLRTSGRADSGGAGPRAR

SEQ ID NO: 11301 - protein, 108 aa, Streptomyces avermitilis
VLIITTLAAIAIGAAASMTYMRYVSARSQGRPISFASLRHECVPPWVDLIFIPAWLASSCVLCFTLPLWAGLSLYCGAALLPGELMRRRHNRQVKNRPPISAGALTSL

SEQ ID NO: 11302 - protein, 281 aa, Streptomyces avermitilis
VNDDYPDLSFPRRERYLGAYPTTSGTGRHRGPVDALHSAVPLEGSDPGWDPVEELTYLLQDAAAEQAAAMVPPPRSEPPSGDGFSGDPMENLAQITAELPPIRRPAAGHRKVRVRKLRFTWLQTVSFVMAAFAAVIVSMVSVFGGMVAYAPLQRIASGTQSGTVPWWPLLVYGPWMVASLSILRTALHQRRAVHSWFVVLLFSSVAMMLCVAEADRTFTGIAAAALPALASLACFQQLVRQITLTRPPRQRTSRHRQRLIPAPQESTEAMPDPVLRETPRA

SEQ ID NO: 11303 - protein, 829 aa, Streptomyces avermitilis
MDIRSLSQAEAERRAALLTVERYDVAVDLTALPDGPDVRCVSTVTFGCREPGAETFVDCAAQVLSATLNGVELTPAADGRIPLPALDAHNVLRVESVQSNTAEGEGVHKAVDPADGEVYVWMSFEPDEARFVWACFDQPDLKAPHAFTVTAPYDWTVTSNSGDPRIEELGERDEPSRPAARRWTFPDTPPLATYNTVVNAGPFHEIRREADGYDLGIYARRSLAQILERDADDVFTVTRQGLAFFARVFGMPFPQRKYDQVFVPEFGGAMENYGCVTWADGFLCRAEPTPAERELLAKVLLHEMAHMWFGNIVTMRWWDDLWLNEAFAEFACNWAAADATSHTDAWAGHLANGKLRAYLADQGPISHPIRQPVRDVAEAASIFDAITYPKGASVLRQLMTYVGESAFSAGMTAYFARHAWGNTTLQDLIDALAEASGRDLDAWRAGWLETAGTDRLTLEREGDGYVLVAHGPDSGPRPHVLAVGAYRASRDGSLERTALVTAEVTGERTPVALPPAADGAPALVLVNDEDLTFATTRPEPTAASAYLSAAARLPTAISRGVAVATVWDMLVTGEVTAAEAGRCVTAVVESETSDAVIEPYLTLAGDIAELWAPDAERPALTALVAAACRRLAEDPRRRQVSLRGLARTATAPDDLAWLESQTAQDIDLRWRLLARRAELGDKTADDVALLLDQDPDPDAWVRALTVRAATPDAEAKEEVWQKLVVERAVPLSSVSQVTTAFWRPSQDLLLAPYAERYLALIPQLERGGMIPAMVFTSRLLPPYAIDAEFLTTAENASRDTVPVVRKTLLERSDIVRRMLGAREYGGAGA

SEQ ID NO: 11304 - protein, 469 aa, Streptomyces avermitilis
MWSTVTATTATTATSESRRRTLATDAPVRPADWAPFPDDPRPFRPARSDRSPAVRLRGVIGVDEDVLDWVPEERARYTRYGAIVVNTALLGGVSMALAMGTFRSDLPLAVVILVAVVWFWVVLALDSWLVSSTHGVPARNPLRVLLPRLVLSVLLGLFIAEPLLFQIFDKEIHQQIAVGNEEKVSTYKGMLVSCNPADGSDTSGRAACGKYQLKVEGSTAQLRDDIQRNTARTKAMRAQVDGINKTLNAKMATEQRECARDKWIWYGDVADVSQTCERARADSSSYRTTSKIKRYEGELENLVAKGRTLTARMEKAGDAYQPALQRSIDAKTRQRAAELDDDGILTRAHALEAVAWSDWYAGFVFVVLHLLILAVDAMPVLAKLMSGCTTYDTLLTARLDTSRRLHSDDLQVQHACATMEYEVRRHRIEQDTSERMRRLEHDHGLAQAERAALFRAELDARAARILRGD

SEQ ID NO: 11305 - protein, 507 aa, Streptomyces avermitilis
MAQRYPLVEQREYGLAQQRGGWLRKRTSRGDGELPPLAAHQVRVFRVGEEYVEDHGRLRPDDGVVVAASSVTVVDRRASVPVVVEMRIPSAEVGDFTLRTTFHCTVTDARAVVRDGVTDVEALLFGYLRGIPGLAEEGGDLRIVDSATVRRRVDARLAAYLDMRPPVVSGLKAVPSAVDVLTPEELAAHLKEVEEARLAREKERLRDEMEQERVRAEADKERLREEIRREEALMKELNRQERERMRTTYERTDSAEGQEHALGLEAQRNGFVRNQITEDLRVIGNDPIAADFYANRSGDLTAGAFAERRREDESGRLEREDALHKLEQEYLERRATLEREDQERRAALDRDERRYRLDRGDRIRELTRQDRNEEAAAKREEQARSRAEAREDRLRERLEGRQDAQLLREEQRKWAERRIDLGKHLVNRGLVDNAAVDMGAFINSVSEIPPYGSAQALGQGRDEEVQKASAERLDKQTRRPAPTDVVDGDGDDGDDSDIGVSEANLGD

SEQ ID NO: 11306 - protein, 788 aa, Streptomyces avermitilis
MNEEQQHEQQQERPGTPAGEQWTAPASAPPPAAAGAGADPGADPGADPGADPDAAGAEAKDTAAPENTVNPEKDTAAAKKDPAAKKDTAAKKDTAARKDETAAEKDASAASAAEKAERAAQVQHNNVNQHFYGSLDARHAHFGIGGIGGTDTPNTRRRAIGRLDAGEADAVLESYVAPPCFEEAVRALRQDGVVVLVGPPGTGKRSGAVALLDAVADGAEYVVLSPGRSLEELATGRPAFEKGNGYVLLDRMNEGSSSGTADFDWRRVRDAVREQGAHLVVTTVHTVDGEPPESVRHLTWQVPALADVLRVRLRKAGCAESTVEQAVGLLPAGCRIAEAVAAADRIARGADPAGVWQEYGSSAAHPVRDWFAAERSLQEAAEVTTLAFVIGAGRRDFELCQEGLEPYLAPAFPQTPTGPGTATADGAPAAAPRRTVDRRRSLARNDLVATEAQKHGALSRTVLVFRSPQYRQWVLEELWANHSTDYWDGVRDWLTDMVRTVPDPDLQMSVASGLALLARPAFDEVAESYLHPWARGTAGPLGQSTATMVLWWMCLLDENLGATALAVARGWAQSRDPGLRSTAMAAFGGELGVRFPSDAVKWLWHLISRAGDESAEAVSALAALVAVQVASRENAGVVFVFAALAHRMGVQGRTGAATHLKEATFDAVQAVLTVRDLGSKRPVCAVLAGRRPQLIDRFGQLWAGLLCNRPRRASALRDLHDTLRALPATCEKPEAIAGRFGRAVGAALPADERPLLDRALRAMAARSDDTVAAALTETFLTAVLSTED

SEQ ID NO: 11307 - protein, 260 aa, Streptomyces avermitilis
VHSREHESRGVGNMSTFGRRLLLAVDAKGYGGVDVLTQTQLQEAIQRLLGQAADAAGLERERWATQEAGDSVLAVLPEGASEPDLVDTFMRSLDAGLRAFNHGRLPQAWLRLRAAVHFGTASPAANGFVGRAPVEIGRIRDSAVLRSALAAAPDAALAVAVSSTVFNDVIREAYTTIRAQEFREVRIEEKEYTGRAWIWVPGYDVRGLELDGAGADGPRPGGGETPAARPPNAPTAPVDTVVQQFYGTVNAEGAVFGISK

SEQ ID NO: 11308 - protein, 172 aa, Streptomyces avermitilis
MPSAGADPDNRPAQYMFTALQTTHQHADTKAGILAAAQAALVGTADTWSRQALHTVERGGAAGVLAGTLLTLFLGGLFVGAGCLAATLRPRVLHSAHANRYSFVHLASGPDILPAEAPGADEATDRRELSHTVRFLARVALRKYRCLTGAVVCTAVMGTSAGLFVVLRPVLA

SEQ ID NO: 11309 - protein, 246 aa, Streptomyces avermitilis
VFTPYDSEEWPARSLLGVLSPPARRELLGLGVETRFEPGEVLLTEGAHDRHVLLLLSGFAKVTATVENGETSLLAVRVGGDSIGEMAAMDGAPRSATVTACGPMTARVLQPGVLHGLLMRRPEVSMALAGIVADRLRWANRRRLDFRGYPAKVRLARLLVELATSYGRPTDGGVVVGCRLTQPEMAALTGAAETTIHKGLRELREGGLLETGYRSTVVRDLPRLRQLANLAPEGREGHEGHEPQGS

SEQ ID NO: 11310 - protein, 410 aa, Streptomyces avermitilis
MRSYSDLFRTREFTPLFVSSCFRTAAATVSGLALGTLVYRATDSPLLSALSMFGPSLAQVVGATTLLSAADRLPPRATVAGIALAFALGTAVMAAPGLPVWTIFVLLLLLGLVQSLGGGVLWGLLNEILAKEGYLLGRSVFNMMSGVAQITGYATGGVLVALLSPRVTLLAAAALYLASALTARLGLTGRAPRASGRPSVVQTWRTNARLFSSPERRTLYLLLWIPNGLIVGCESLFVSYAPSRAGALFAFAAFGMFVGDVTTGRFLAPRVRARLGIPFLLLLAAPYLLFALRPGVALATACVAVASIGFGSSLIQQERLVSLIPDELSGHGLGLHTSGMLTMQGVSAALAGGVAQLTSPGPAMTIMAVASITVTLTLAPSLLRRGAASRDRRHPEVSAPKERRSGVNSS

SEQ ID NO: 11311 - protein, 327 aa, Streptomyces avermitilis
MGWWQVNADTLAGCRFVLSPLAETFASLKLLHAGVASHPGERGWLDAHLPAYRELLAADPVAAQLVRSGLGRDWIADFFTPAPRERETFEEEVARVRSASPEAARGHLTVSLRGPLPARLHRDDLPERAADLLTWLWTEAVRPYWARRRRVLEADVVARTAQLGRGGWAAVLDELRPGTRWLGENRFQVNPHAYPPREISGAQLFFVPVTPQRIGWVSWEEPHRYAVVYPCAGVLAGGGSEAVPASLGALLGPARAAVLVLLGSPLSTSQLVAVTGQRLGSVGRHLRVLLDARLVERRRAGRSVLYSRTPAGEVLVKAQSGDDTERS

SEQ ID NO: 11312 - protein, 169 aa, Streptomyces avermitilis
MTTDNAATSVLDTEIDALQGGSADLSQYAGKAVLIVNVASKCGLTPQYAGLERLQERYAAQGFTVLGVPCNQFLGQEPGTSEEIAEFCSATYGVTFPLTEKVEVNGDARHALYESLVGFADGEGHTGDIRWNFEKFLIGRDGKVVARFSPQTEPESAEVVTAVERQLAG

SEQ ID NO: 11313 - protein, 299 aa, Streptomyces avermitilis
VDRELVELVDQERVRSGELLTIGAFAARSRLSPKALRLYDRLGLLPPAHVDATTGYRYYRADQAERARMVALLRRLDMPLARIAEVVEPAGLDGPSAADRLACYWAEAEARFASQRTLAEYLRGRLSGRSSEMYGKFVVETVDVPEQVLITQTRHILPDELPTWIGAALGRLEDAAQACGGTTGAPFVAYHAEVSQESDGPAEACVPVADEAAARAWAEEHGRAWDTGVRVEPARRLAYTRITKAQVANPQIHAAFEAVEEWIAERGLNHAGPCREVYFADWDAAGPQDAVCDVAFPVR

SEQ ID NO: 11314 - protein, 657 aa, Streptomyces avermitilis
VAAVEPTHADDSRPGSSSTPRITPPAHLHGTNGAARPPGSADTLGAHDAPDTLGAHDAPETLGGPDTPETPDAPGTPGNEHEPAGRFARLRRLIHRHPVLSVTALAGVLHLAWFFTFANSGGDLAAQDAWAEFVGRHPDSAYNLAWYGGMHPVSYSVVSPYLMSVLGVRTTMMIAGTISAGLLTMILIRSRAVREPLWPALAGVFALLCNAVSGRVTYGLGMAFGLGATAVVFCWPYRWRYKRWAKALCAAPLAALSTAASPVAGLFVGLIAVALFFQKRRPGAWALGIAPTVVVAVSAWLFPFSGTQPMGIGSTILPFLFSVVVYLLVPREWKTVRITAAVYGLAVFGVWAVSSQIGSNITRLAMLFAGVVLLAALPFAVPRTRKWYAIVVALAGFTGWIGFKTVDDIMHTTPAASWARELAPLVNQLQVIGAEKGRVEVVPARSHREASALAPYVNLARGWNRQADMERNPLFYDDTLNSANYHEWLQRWAVHYVVLPKGEPDGDGGQRERQLVQRGMPYLKQIWGDANWQLFSVTDPTPLADPPAVVDRAKQGELTIEVQKAGRVLIRIPYSPWLGLVDAEGKSVKPPQETAESKHREEGTPKTYDNVNGCLMEEEQDESGDNWTVLLAPGKGTYRLAAPYQLPRGTPCPEELR

SEQ ID NO: 11315 - protein, 888 aa, Streptomyces avermitilis
VAGESPDRSKQHESSAEPTSGSPAAVPGPTQPPVSAAKVSGDPRLAVARETVRVDQATAVFSTRALKEAEVAATAPAGTGGASEGASTTSASSETAGTVETADAADAADAADTGETEGIGGKGDARLRAAVAAWVRGADDEGGDKGGAKGEEASEEADVEPGDEPGDEPGDEPGDEPGDELQGESAAEGASEEAADEPEEKPEEKPEAEKPAAEKSAAEKSAAEKADGEPKGEPDAAEARGKADKAAEKAAAATAKAGSDASEKASEKAGSGASAKVGSGASDKAGSDASGKAEGGASAEDAVEEQSPVDQPTAIFKAVRRPAVDQPTTMLKLGSTKPAGDKSGADKATEKPSGKPATAKSADKPSGKSTDKPADKPSGKSAAETPAERTSKFVALKPLDEPGSAKPKATPAPGAAASGATATGAAGITAPKPAPSPAEATAAIPQVGPERTTQQPLPPKPPLDLLAELTNTPPPPQTPVRTMVRRVKIWTPLLILLVVVFAVAQAVRPLPTPTLGLTADETYTFEGGKLDLPWPGQGQSAVEVEGVGTVGTAGKQAPKPIASVAKIMTAYVILEEHPLKGTAAGDKITVDQQAEDESKNEDESTAAMTKGQKFTERQMLQMLMIPSGNNAARLLARWDSDSETFVGKMNAAAKKLGMTNSTYTDPSGLEKTTVSTATDQLKLAKAVMQKEVFRSIVGMAKADIPGLKGTIYNNNDLLVKQVGVIGLKTGSSTPAGGNLVWAATKTVNGKVRTIYGAVLNQDAGTGRVWDSLQLALTNSQKLIDKVQQGLISAPVVKKGQVVGYVDDQLGGRTPVVATENMTAVGWPGLKTKISIGAGDTTVPHEAKAGKVVGELTVGDGSSHAVTIPVALQSDLAEPGYGAKFTRVS

SEQ ID NO: 11316 - protein, 251 aa, Streptomyces avermitilis
MGRSRRTIPEELLLLALDPTTGTTAQPQSLDLGLAGAQLVELALAGRIAPDGDRIAVVAPRPTGDPTLDCALELLRRRGAPVRAVNWIGGPRLGLRQTYLSHLERCGMVHAVAGQMCGVLPTTRYQATDTAISREIKARLDNAIRTGVPPDPRTAALAALAHAVGLGKHLYPGNEGRSSRSRLRDLIRHDPMGGLVAHAVMDVQNGVAAQPRRSPAPAGRQAAPGARPAPEPARGMPMQPRHGSMARAVAH

SEQ ID NO: 11317 - protein, 285 aa, Streptomyces avermitilis
VASNVDPTVRRRRLGQELRRLRELKGMTAEEVAERLLVSQSKISRLENGRRSISQRDVRDLCGVYEVEDHRIVDSLMQMAKDSRQQGWWHSFGDIPYSVYIGLETDAASLRVYDPQVVPGLLQTRPYAEALIAGALPETAPGDIDKRVQVRLRRQERISAPDNPLRLWTVLDEAALRRVVGNRSLMREQLEHLVEQSQLPHVTVQVIPFDMGAHPGLNGQYAILEFPDAADSSVVYIEGVTSDLYLEKAADVQKYSVMYEHLRAQALNVEQSRQFIADIAKEYAR

SEQ ID NO: 11318 - protein, 69 aa, Streptomyces avermitilis
MAIQQGATDTWTKSSYSTGNGACVEVKSPVVAAMAVRDSKVPAGPTLAFPADSWNAFVVEVSRGAFDLG

SEQ ID NO: 11319 - protein, 284 aa, Streptomyces avermitilis
MSEDTRGEDTRSEVYAELAAVGPYGVRPGHALITMVEPHPGHEYAYNRWYEDDHYYAGAMAMPWMYAGRRWVATRDLQLLRYPEKSAVAQPVSAGCYLSTYWVTDGRYDDHMKWTVGINKRLNRDRRVYQDRTHVFTAFQDHEATVYRDGAVGPRDFHALDHPYAGLVVEVVDADGPAGRAELLEWLRSRHLPGRLAGSPSAMVTVFRPTPLPGDRMTYVKQVEGVDTRLTLLWFLEADPRECWEAYFTGLDTDVHEAGLGRVELVAPFIPTVPGTDTYVDRLR

SEQ ID NO: 11320 - protein, 261 aa, Streptomyces avermitilis
MSLLQGKTVVVSGVGAGLGHQVAAAVVRDGGNAVLGARTETNLAKAAAACDPDGAHTAYRATDITDEGQCDALAALARERFGRIDAVVHVAAWDSYFGGLEDADFTTWQSVIDVNLLGTLRMTRACLPSLKPCGGSVVIIGTQSSVAAPSQVRQAAYAASKGALTSAMYSLARELGPYRIRVNTVLPGWMWGPPVEAYVQFTAHTEGVPEAEVRQRLADRMALPDLATDGDVADAAVFLASDRARAITGQSLLVNAGELMR

SEQ ID NO: 11321 - protein, 522 aa, Streptomyces avermitilis
MNGLDWAVLVAYFGVMTAIGVWSHKRVDDVSDFFTAGGKMPWWLSGISHHMSGYSAVMFTGYAGIAYTYGVTSYVTWALPIAIGVAIGAKAFAPRLNRLRSRLHVASPLEYLKDRYNVPTQQALAWSGILLKIVDVGAKWAAIATLLSVFTGVTLTQGILITGGITAVYCTIGGLWADALTELGQFVIQLLAGLAMLIIALNKISDQGGLSKALDSPKLDGHANGFAGPYLTVFFIAYLFIKLFEYNGGMWNQAQRYMATGSAKQATRSAFLSAGLWFVWPLVLFIPMWLSPLLVTAKKPDGSDAYGLMTEQLLPHGLLGLVVVGFFSHTMAMCSSDANAIAAVFTRDIVPVLNKAARAWDTRTGLMAGRVTTVAFLGLSMAVATQVNSPTFKDIITVVIKWVAGLMGPIAIPFILGLLRPFRKSGPTAALTSWACGLLAFFFINYNLDFSQRTDVKLEYQVALPMVISLVLYILIGLVKPEDTPERDAIIEKINTDDDGSTAAAVPAQAQTDGTSTSPTGV

SEQ ID NO: 11322 - protein, 371 aa, Streptomyces avermitilis
VGATAGAVWGRAEQQDFRSRVRGTLLGTAVGDALGAPLDALSLDEIREAHGPLGLVDLTFGHGRRGAVTQLTQLTLFSLDGLIRAQVRRDTGAWHPPTDLHRAYLRWAATQHDWGPDERRKEDGWLAREEWLYARRSPSRACLLGLADETMGTPGAPKNPGETGPEAAARSAPFGLLVGWEPQLVLQLAVECAAQTHGHPTAYLAAGAYAVVVHALARGESLDAGVQRALQLLSARPGQQPVADALQHALGAVRQGMPTPARVEELAGDGTAEGLLAVAVYCALVGEDVRHGLCLAVNHGGPSGVAGALTGGLLGALHGETALPPAWLAELEGRPTMLVLADDFAMEMTQGPALHGPGGSSPGWLARYPRA

SEQ ID NO: 11323 - protein, 468 aa, Streptomyces avermitilis
VTHRIRRRSVLGCAALAALLTAPVALAAPAFAAPTTTPPVIDFNGDGFADLAISAPNATVSGVGEAGYLSVVYGSSAGADSAHPKLITRATEGVPGDVTEYDDFGSWTAARDLDEDGYTDLVVGGYRTPVVLWGSAQGLGGGTALAGTTYQVSGGDIDGDGHADLVANVGGSLEVRFGPFTRAGVPARTDTLAFDDEDGPQGFTVGDVTGDGKDDVVTQHGFEEMQYKSRLWKGTSTGLSKTFQSSGHYTVGGVIADVNKDGYGDFIARQVDQVSEMMEYDAGDIRVVYGSASGFSTRTAKINQDTTGVPGVGEAGDNNANYGDQFGYSLAAGDVTGDGYPDIAVGVPGEDIDSIREAGSVVLLKGGPSGLTGTGAQAFTQSTSGVPGASEKGDFFGASVLLADVNANNRADLAVGAPQEDGTYQNSGAAWLLRGSKTGLTTTNITSFGPSTLNAPEKAARFGANFAR

SEQ ID NO: 11324 - protein, 392 aa, Streptomyces avermitilis
MTTATGATRTPPATAPTAETGRTPAPSLPSLTGLRWMAALLVFGLHVRNFGYFDGTGARIATWAFGAGASGVSFFFILSGFVLMWSARPGDRALAFWRRRIARIYPVHLVTAGIALLMGFTLAHQPRPTLHQAVANVLLVHSWWRLWWQTLDPVSWSLACEAFFYAAFPLLAVLLRRLGARGSTALAGLSVLAVVVLARADEHHWLSQPLNSFPAARLPEFVLGAAVARLVILGRWRGPGLEASLALTIIGYFFVPQVTAGYPATPCTVVGFALLIPAAAVADLRGLPSMWRHPWLVRLGELSFAFYMVHLLVLRAGTNLLGKYPHYGMLLGLAATAAAFAVALGLSWVLYEGVERPARRLLLRHRRSAPPRPTPRPTPPKPHPESTTARAD

SEQ ID NO: 11325 - protein, 128 aa, Streptomyces avermitilis
VITGGGVQRFFEQVAGHATSIHSHGPDSRPVSRRGRQMDLGERLVRPHQVVAKTEVTRQIGQRFVRTAHGQQGDGPPHQIPGAIRVEGDGRLHRPVQTDRRAPGGQPVMTGSRTAPRTTSAFTTTTRS

SEQ ID NO: 11326 - protein, 688 aa, Streptomyces avermitilis
VAATVLAAPGTAAAAGNTPPARPLVKDLQTGSKACAAGEDARPYVAEPPKLSAVLYDPDRTQVSGEFEVWWTDTEGAEQRRTYTTTAKLSGTPFTLQLPSDIPPTTVVSWRVRANDGTTTSPWSSAGEDGSACEFVYDDVNPEKAALSSPEYPQPQDVFWVDGVGVYGHFTMDSPSDDVVAYTYGFIGGPYGTVRAQQAGGAVTIPFLPLASGPQRLTVRAIDRAGRSSGQSAYEFNVKSGHAPVSQWKLADPAGTTSAAAETGTAARAGSGVTFAGAAPDGTGLTSTAHLDGGDQAFLTPDAPAVDTHGTFAVSAWVRPERTDRDMAVVSQGAGSTGAGLGLRRGDEGPVWSFTVAGQEVSGGAPETGEWAHVLGLYDAETGLAQLYVNGHEAGTKTKAEPTRTTDAFRIGQGSGLSAWQGDIGDVRAYDRVVVPAEATELGYRKPKSLGHWSLETASDGASPEQSGRAPLKLGAGATVYRVPDSSCLPELDPDCPVVPLPLVGDGHLQLDGETGYAATEQPVADTSGSFTIGAVVRLADAEPAHPMTVLSQAGEHTDAFKVRYQPSEHAWQLVMPVKDERGAAETVVSQIESADGGEGQGHRLAVVYDDATDQVKLYLDGVAGTSATADFPDGWHSSGPLQVGRGHTADGWGEYLHGDVDEVQAYAGALRDRDITGLGWGTDPCLC

SEQ ID NO: 11327 - protein, 117 aa, Streptomyces avermitilis
MDISRRSRALLAPAGDNWLSRVYLAVVVAATGFVLYDAAFVSHPDASLAAVVPWLLTAPLSLLYTLLPDDVLSGAPTGVATALYVAGIAVAATANAVFMGVALRRIRPSAPRTAASA

SEQ ID NO: 11328 - protein, 861 aa, Streptomyces avermitilis
MTTSATSGTGPTANSMRRALKRARDGVALDVTEAAVLLQARGEDLDDLTASAARVRDAGLEAAGRAGVITYSKSVFIPLTRLCRDKCHYCTFVTVPGKLRRAGHGMFMSPDEVLDIARKGAALGCKEALITLGDKPEDRWPEAREWLDAHGYDDTIAYVRAISIRILEETGLLPHLNPGVMSWTDFQRLKPVAPSMGMMLETTATRLWSEPGGPHHGSPDKEPAVRLRVLEDAGRSSVPFTSGILIGIGETYEERAESLFALRKISRAYHGIQELIIQNFRAKPDTAMRGMPDAELDELIATVAVARHIMGPRACLQAPPNLVDSEYGRLIGAGIDDWGGVSPLTIDHVNPERPWPQIDLLREQSAQAGFELRERLCVYPEFVQRGEPWLDPRLLPHVRALADPASGLAHADATVEGHPWQEPEEAFVAQGRTDLHHSIDTEGRTGDRRDDFDVVYGDWEALREAAAPGMVPERIDTDVRQALATAANDPTRLTDAEALALLHADGPALDALTRIADDVRKAAVGDDVTYIVTRNINFTNVCYTGCRFCAFAQRRTDADAYTLSLEQVADRAQQAWDVGAVEVCMQGGIHPDLPGTAYFDIAKAVKERVPGMHVHAFSPMEVVNGATRTGLSIREWLTAAKEAGLDSIPGTAAEILDDEVRWVLTKGKLPTATWIEVITTAHELGIRSSSTMMYGHVDQPRHWLGHFRTLARIQQQTGGFTEFVTLPFIHTNAPVYLAGIARPGPTTRDNRAVMAMARLLLHPHIPNIQTSWVKLGTEGAAEMLRSGANDLGGTLMEETISRMAGSSYGSYKSVKDLIAVAEAAGRPAKPRTTLYGEVPQERQRAAAASDGHLPELLPVLD

SEQ ID NO: 11329 - protein, 502 aa, Streptomyces avermitilis
MCEDDHGIGRRALFVTGAAAALTLGSVSFASGAPAAGQETRTVRGTLPTGSPDFVYVPVEVPSGVQELHVAYTYEKPAVPAGTPGNALDIGLFDERGTELGGKGFRGWSGGARTEFFVRADDATPGYVPGPVRPGTWHIALGPYTVAPGGLPYEITVTLTYGEQGRTPRPGYPPARAKGRGRAWYRGDCHLHSWHSDGRRTPAEIAALARAAGLDFINSSDHNTHSAHPHWADQAGDDLLIMLGEEVTTRNGHVVALGTDPGTFVDWRYRARDNRFGRYAREIRRAGGLVVPAHPHATCVGCNWKFGFGEADAIEVWNGAYTPDDEVALADWDSMLVASVRGDARSWIPAMGNSDAHRDPDPVGTPQTVVLADDLTREAVQEGIRAGRSYVAESKSVSLSFSAAGPKGEHAGIGGRLRVAGDAPVTVRLEVTGAPRCSARFVTDQGVLFTSAVLPVSGSGTVEWRTTAQYAAYVRAELRHEAALGPLPGPLAAFTNPIFLGA

SEQ ID NO: 11330 - protein, 135 aa, Streptomyces avermitilis
MARYDEVKFRAITAFQRRVGNPVLRRLPFQTVLETTGRTSGLPRRTPVGGRRVGDSFWLVSEYGEKSQYIRNIKANPTVRVRIRGHWHPGTAHLLPDDDPRARLKTLPRLNSTAVRAFGTGLLTVRVDLTDTRVT

SEQ ID NO: 11331 - protein, 462 aa, Streptomyces avermitilis
MAASQVSPTGALSPSWSLGRMDGHTPRTPEAERSRRWFMNKALLAGGVAAVATMTGCSAGSSGASSSASASGAPGGMPSGAPSGAPSGGPGGGAGGMGPGASEVKYDDFTGVTTDGKAADGLYSVHATDVSTDAVVKAAQAFLDGLSQKERKATLFDVQADEWLAWSNVDGYQREGVRMGDITAKKRDLGYALLGAALSADGLTQTRNIMKLNAFLGEYSGGGKETLTEGAYFFTIMGTPSTTKPWGFQYEGHHVAINYFVLGDQVVMTPTFMGSEPTSATYKGEKIVTFRTETKAGLTMLRSLTDAQRKKVVSSETKAGDNMKAGAGQDNLKLAYQGLAGSQLTDAQRDKLLDLVRVYVGYMDDGHAEVKMTEVEKHLDDTYFYWIGATKDTSPFYYRVHSPVVLIEYDAQSPIAYGTKSGGGMGGPGGKPTQQHIHTIIRTPNGGDYGVDLLKLHLAHDH

SEQ ID NO: 11332 - protein, 499 aa, Streptomyces avermitilis
MTPGTPGNPAAPVTPGASDAQRLFIGGEWVAPDGGHYEVIDPATEAVVGWAPEASRDQVHAAAAAAREAFAAWSRTPAEERAAVLGRAAEVMRRNLVPYAELAQAESGATTGTARGMQVGVGAARFRRYARVEPAEEPIAPQINEAGPFGRAAVMGALAVRQPVGVVTCITSYNNPWANPAGKIAPALAMGNTVVVKPAPQDPLSVYRMAEALQAAGVPPGVVNVVSGSGAQAGEAAVDCPDVDMVSFTGSTAVGQRIAEVCGRGMKRQLMELGGKGAALVFEDADLASAVSGIGTTFSFYSGQICTAPTRVLAQRGVYDRVVDQLAAYARRLPVGDPRAPGTVVGPVISAAHRDRVESYVELGRKEGARVVTGGERPPCATGFYVAPTLLADCTTDMRVVREEIFGPVVAVLPFDDEEEGIELANSSDYGLIDYVWSADVARAFRVARRLRAGGVGVNTVGRNMEAPFGGFKRSGVGRDVGSYALHAYSELQAIVWPG

SEQ ID NO: 11333 - protein, 576 aa, Streptomyces avermitilis
MLDHVIRGATVVDGTGAPAYTADVGIRDGRIAAVGTVTEPARAGEDAAGLVLAPGFVDPHTHYDAQLFWDPYATPSLNHGVTTVAGGNCGFTLAPLNPDRPQDADYTRRMMSKVEGMSLVALEEGAPWSWHTFGDYLDALEGRIAVNAGFMVGHCALRRYVMGPDAVGGRPTREQLERMLALFHEAMDAGAWGLSTTQSSTHSDGDGQPVASRHARPAELLALARAVGEHEGTQIEAIVAGCLDQFSDAEIDLFVEMSAAAGRPLNWNVLTIDAAVPERVPRQLTASERARKAGGRVVALTMPILTPMNMSLGTFCALNLIPGWGEVLGLPVPERIARLRDPDVRAELLRRADSKEAGVFRRLANFGRYVIGDTYSTANEGLTGRVVNDIAAERGQDPFHCLVEICAADELRTVLWPMPTDNDPDSWALRAETWRHKDVLLGGSDAGAHLDRMCGAPYTTRFLGDCLRGRKLVPLEQAVKMLTDDPARLFGLRDRGRIREGFHADLVLFDPARIDAGKATLVHDLPGDSPRLDSKAIGVTAVWVNGVEAIRDDVVTGAVPGKVLRSGRDTRTVSTR

SEQ ID NO: 11334 - protein, 346 aa, Streptomyces avermitilis
MEETEYVIQADTSGFKYAWASEHHFLDEYSHLSANDVFLGYLAHATERIHLGSGIFNPLAQVNHPVKVAEKVAMLDHLSEGRFEFGSGRGAGSHEILGFIPGVTDMNYTKEIWEETIAEFPKMWLQEEYPGFQGKHWQLPPRKVLPKPYGKSHPAMWYAAGSPPSYAMAARKGLGVLGFSVQKVSDMEWVLEQYKTAVVEARPVGDFVNDNVMVTTTAICAPTHEEAVRIAVGGQLHYLPSLVFRYHDTFPRPEGFPVWPETLPEYNEEFIELLIAEELLICGDPGEVLTQCKRWEQAGADQLSFGLPVGVPKEETLQTIRLIGEHVIPKIDTDPVHRTTRFRQSV

SEQ ID NO: 11335 - protein, 258 aa, Streptomyces avermitilis
MGKLDGRVVLISGAARGQGEQEARLFVEEGAKVVVADVLDDQGEALAKEIGARYVHLDVGREDDWQAAVTVAKDAYGHIDGLVNNAGILRFNDLVGTPLAEFQQIVQVNQVGVFLGIKTVAPEIEAAGGGTIVNTASYAGLTGMAYVGAYTATKHAIVGLTRVAALELAAKKIRVNAVCPGAIDTAMSNPSQLDPGADPEETARALSELYGRLVPLGRIGRPEEVARLALFLSGEDSSYITGQPFVIDGGWLAGVSVI

SEQ ID NO: 11336 - protein, 309 aa, Streptomyces avermitilis
LNGSFAYGIQLPVQSQSTLYTEGWEAGAGPDDLVEIARTADRSGFAYLAGCDHVAIPRRLASAMSTVWYDPVATLSFLAGVTERVRLLSHVAVVGLRHPLVTAKQYATLDHLSGGRLILGVGAGHVREEFEALGVDFERRGFVLDECVDALRAALGPDEFPVHHGKVYDFEGLGQRPRPAQPRVPLWVGGSSPAAVRRAAVRGDGWLPQGDPRDRLPEQIAKLRRLREGAGISDPITVGAITEPLYVGGPGWDVGRRTLAGRPEALAESLRAYRAMGVDQIQVRFRSRSRSELTDQMAAFGAEVAPHLT

SEQ ID NO: 11337 - protein, 419 aa, Streptomyces avermitilis
VSRMETSRTLSAFPKIISVDDHTVEPPDVWRDRLPKKYQDTGPRIVRAPLKEMTFLGGKFAPVMGGPGDDGPLGDWWVYEDLHRPLTRLDTAVGYSRDEIKLEVITYEQMRPGSYDVPRRLADMDVNHVQSALCFPTFPRFCGQTFTEAKDRELGLLGVRAYNDWMVEEWCGPDAHGRLIPLTLVPLWDARLAAAEVRRNAARGVRAVAFSEIPPHLGLPSVHTDDWDPFLAACDETGTVIAMHIGSSSRMPSTSADAPPAVGSTITFANCCFSMVDWLMSGKFERFPNLRVMYAEGQIGWIPYILERADVVWEENRGWGGVADKVHRPPSELFAGHVFGCFFDDAFGLRNLDAIGIGNVLYETDYPHSDSTWPKSREVGEAQMGHLEAEVVERIVRGNAIELLGLTDDGLWAGPGGAR

SEQ ID NO: 11338 - protein, 980 aa, Streptomyces avermitilis
MDGVPRVPEQWRPEESAALRFGVLGPVRAWHGEKALSTGSPQQRALLAALLLREGRTATAGELIDALWGDEPPSQALAAVRTYASRLRKVLPAGVMVSESGGYAIRGLPEEALDVSLAQALAADAEKAKAAGDLCRARALLNEALALWDGEPLASLPGPYAETQRARLDEWRLQLLESRLDMDLEQGCHAEAVSELTALTAAHPLRERLRELLMLALYRSGRQAEALAVYADTRHLLAEELGVDPRSGLKELQQRILQADPGLAEPSGPAAEPPPAPVRPAQLPATVPDFTGRDAFVAELSDVLASAEGRVMAVSALAGIGGVGKTTLAVHVAHQARAAFPDGQLYVDLQGAGQRAAEPETVLGAFLRALGTADSAIPDSLEERSALYRSVLDGRRVLVLLDNARDAAQVRPLLPGMEGCAALVTSRVRMVGLAGAHLVDLDVMSPEEALQLFTKIVGEERVASEREAALDVVAACGFLPLAIRIAASRLAARRTWTVSVLAAKLADERRRLDELQAGDLAVKATFELGYGQLDPPQARAFRLLGLADGPDMSLAAAAAVLDLPAEETEDLLESLVDTSLLESAAPGRYRYHDLVRLYARACAERDEHPPSERDAAMARLLDFYLATAAEVFAIERPGDRLVDHLEQTRTPGLVFPDRRAAQDWLYSEAVPLLACVRQSSGGATLRRAVDLLWAAVDLAESGANAKEYEAAATALRDAARVASDRRAEGRAILVLANARHWSGLFDQADQEARQALALSEAAADPLPCCWAANILGAFAFYQSRYAEAEEYLERAIREFRACGDRSGAAAALCNLSRLHLETDRAHSAVDLAQQGTEMYEELGHSLKVANGRYALGMALSKSGRPADATHRLREALQVFRASRQRLWEGMTLFRLAEVDLLAQRPAQAAANSEMALALLRGIGGEWRRGNVLTVLGKSLNGIGQPGRAQVCWREALEIYVKLNSPEAAEVQALLAPAAAA

SEQ ID NO: 11339 - protein, 87 aa, Streptomyces avermitilis
MSDITKDETVVKPDNTHITDAEAGTEIKPLNTHITDAAAGTTIKPLNTHITDAEAGTEIKPLNTHITDVEDDGETTPDNTHITSNPT

SEQ ID NO: 11340 - protein, 527 aa, Streptomyces avermitilis
VRGDVEWGSIPGLVRSSAERYADTEAVVEGRTRISYAELGARVERAAAACIASGVGVGDRVGIWAPNSLDWIVSALGAVSAGAVLVPLNTRFKGSEAAYVLRRSGARLLFVTGTFLGTSYVASLRRAAGEGEGLRGPLPGLPALEQVVVLADDAPADFRTWKDFLASGEGVGEAETRERARGLDGSTVSDIIFTSGTTGRPKGAVITHAQTLRAYEVWSDLAGLRRGDRYLIANPFFHTFGYKAGVIACLMRGATMIPQPVFNVDTVLANIAAERVSVLPGPPTLHQSLLDHPARDAYDLSALRLVVTGAAVVPLRLVERLRGELGVGTVLTAYGLSEASGIVTMCRRGDDPSVIASTSGRAIPGTEVRVEAPLGSPGEVLVRGFNVMRGYFEDERATAAALTEDGWLRTGDVGVLDASGNLRITDRIKDMFIVGGFNAYPAEIEQLLGLHPDVADVAVIGVPDARLGEVGKAYVVRRPGSVLTGDDLIAWSRREMANYKVPRAVEFVGELPRNAGGKVVKGELRGR

SEQ ID NO: 11341 - protein, 382 aa, Streptomyces avermitilis
MAGLKDATAIVGIGQTPFAKHLPEDERTLACRAVLAALDDAGIAPGEVDALASYTMEETDEVQLAKAVGFGDLTFFSKVGYGGGGSCATVAHLAAAIATGQATVGVAWRSRKRGSGPRPWKNTSAQLPTPAQWTRPFGLLRPADEIGMLTRRYMHEYGATRDHLFNVALACRNRANQNPAAIMYDRPLTREMYMTSRWISEPLCLFDNCLETDGALACVVVSAARARDCPQRPAYIHSAAQGLPAQHHGMVNYWNDDPLTGPAWTAARHLWKHADLSPQDVDVAQIYDAFTPLIPLSLEGYGFCGRGEGGAFTEGGALEIGGRLPLNTGGGGLSEAYVHGFNLINEGVRQLRGTSTAQVPGAATCLVTAGEGVPTSALLLRS

SEQ ID NO: 11342 - protein, 138 aa, Streptomyces avermitilis
MLTPVVDDDGAPFWEYAARGELRVQACADCGEPRFPPRPCCPHCRSFASEWRLMSGKGRVWSYVVPHPPLLPEYAAQAPYNVIVVELAEAPRIRLVGNLVSEADAPLDGVAPERVRIGARVQAVFSSAGLPQWVLERP

SEQ ID NO: 11343 - protein, 262 aa, Streptomyces avermitilis
VGTGAAMTLRVVADKDTGVAVVTLDRPERLNAIDLETAAELAAVWSALRRDDSVRAVVLTGAGGRAFCTGIDRGVDVPQPTSPYMADDPLLTVGPKSNDLWKPVVCAVNGMACGGAFYLLGESEFVVADSTATFFDPHTTYGMVSAYESVLMAQRMPYGEAARMALMGTAERISARRAYEVGLVSEVTAPGEALAAATRCAAVIAGCPTEAVQGTVRALWAAKEAARTAGYAQAPHLIALGNLPGERQAELFGERSREHRLR

SEQ ID NO: 11344 - protein, 333 aa, Streptomyces avermitilis
MAHPYARIMVNHRMIDVNGIRLHIAEQGEGPLVVLLHGFPESSYSWRHQFGPLAAAGFRVVAPDQRGYGRSDRPESVDAYTILHLVGDVIGLIHALGEETAYVVGHDWGAPVAWHTALLRPDVVRGVAGLSVPPPFRGERPPLDAMDEMFDGQFYWNYFAQPGVADAEFGRDARGSLRKFLYSASGDAPGAGSGRQPLVAPGRGFLDGMPDPEVLPGWITEADLDVFAEEFAPGFTGALNWYRNLDRNWELTAAWQGAVVSPPALYMYGDRDAVPAFPGTAELIEKLPALMPNLRREPLVLPGCGHWTQQERPNEVNAALVDFLTGLRGEQRI

SEQ ID NO: 11345 - protein, 199 aa, Streptomyces avermitilis
LRCSRTPIQRFSTGVENVQLRHVRAIAVFGIAVVALTGARGSHGGGCHSDSGGSGSSSSSGGGSTGSTGGGAYKDDNDSTTTGGSSGSGSTTGSTTGGGKATDPAKDVKIETCVFDDARGIVAHVSATNSSASTTYTYKFSVTFKGPDGSVVRTSNSTIPYVSANSTDTLDVAASYVPAAGQSASGSTCKLSAVTRTAE

SEQ ID NO: 11346 - protein, 215 aa, Streptomyces avermitilis
MYTRGRTLKFAAVLTMVVLALTGFSRGRGHGGHGGHSGGGGCSSSSQNHDSSSSSTSGGGSYSSGSTTSGAGSDDSYDDSYGDSDDDSYSSGSSSSGSSGGSTYNRRPTHRSNPTSSSGDGDDEPLKDGTARVVSCATKKAPYATVEVKNPNARKGTFWITVTFKDKDGLEIVDHYADVRVPAKGKATVDVEVGGAGLVDYVDHCDVDPVAESSS

SEQ ID NO: 11347 - protein, 203 aa, Streptomyces avermitilis
MMSTVLSGHPASGALHADDRPLIVGLGGTARRGFSSEVCLRTALEAAEQAGARVELFSADALDLPMYQPASSHRTERAVALVEAVRACDGLILASPSYHGNLSGLVKNALDYFEDLRDDARPYLEGRAVGCITCAAGWQGTVATLTSLRGIVHALRGWPTPLGVTVNSATPVVVDGAIEDAGPRQRLGLLGEQVVGFAHARRG

SEQ ID NO: 11348 - protein, 105 aa, Streptomyces avermitilis
VGLLDRVQYASDPDRYEYRLTAAGRELFGAIVVLMRWGDTHLAGPEGPPIVLTHRTCGEVTHPRLTCDVCGEEITIHSVTPSRGPGFLEADPAPPEDPARSERNS

SEQ ID NO: 11349 - protein, 187 aa, Streptomyces avermitilis
VVSGAAGAVGSVVGQIARIHGCRVIGVAGGPEKCRTIVDEFGCDVAIDYKSENLRDALRKHAPDGVDVYFDNVGGKTLDSVLTRLARGARIVICGSMSQYNATERPPGPANYMALLAARASMTGMVVFDYEDRYPQASAELARWLKDGRLRSREHIVEGGVRAFPETLLKLFSGENTGKLILALGNG

SEQ ID NO: 11350 - protein, 782 aa, Streptomyces avermitilis
VVDQLTQHDPRRIGPFEVLGRLGAGGMGLVYLARSASGRRVAIKTVRTELAEDQLFRVRFTREVEAARAVSGFYTATVVDADPRAAVPWLATAYVPAPSLEEIVTECGPLPAQAVRWLAAGVAEALQSIHGAGLVHRDLKPSNVLVVEDGPRVIDFGIASGVSNTRLTMTNVAVGTPAYMSPEQAKDSRSVTGASDVFSLGSMLVFAATGHAPFHGANPVETVFMLLREGPDLEGLPDELRPLIESCMQMEATGRPNPADLQAQLAPHLFGSGSDDSGTASAWLPERAVGLIEARRGGRPAIKPPAGGSQGGAGGRSGARPVVPPPPSHDPVPVGVGAPDAGPVRLAGAPVPIGPGPRVADARAAAVKAPPPEAGLAASWSRPRPGVNGAEPVPAVAPPVAPAESASGWRPWRFRMSNDVWGTPAVADDLVYVTSFEVHALDVATGRRRFKTRDVAWSMSVADGRVHASDGPTLFALDAREGADLWRLSTDAWVYALKADRGTVVTGTRGGGVQAWEAANGQKLWEITGAQQDFESPEAGPVVHDGTVFVWKDARLRALEARTGEERWSYPIGDAASCGGVPVRLTPAPDGYVYVSAGTRVLAVDIAGGHVRWHFEAPAVFLSPPTFVPGPAVAGGGIYLADYLGTVYALDATDGRDRWRIATESRASLDPVLVAAGHVHVGSGKGLYTLDAVTGTPKWRFQAGGDIVGAPAVAEGRIHFGSTDHLLYTLKADDGRLRWKLATGGEITGAPVVKDGVVYACSKDRCVYALDAEKGTGTARTA

SEQ ID NO: 11351 - protein, 264 aa, Streptomyces avermitilis
MAETPPSTASDRNGAAFPEGVPCWVDAQLPDVEAGKRFYGELFGWTFEPAAGAEHGPADGPAPGSSVWAYLDGAPVAALAPKADGRMPTVWTVYFATPDAAALVGRIRTAGGQVINPPTPLAPFGTFALAADPEDAVFGLWQAGAHPGFGRRHEPGSFGWTELYARDTAAADSFYADLFHDALFGPGARPDFGRASVTDVFPAEMPPHFLVHFGVREGDDALEDAIRAVNRLGGRVQVPSFDASYGRVAVVTDNQGASFALLQR

SEQ ID NO: 11352 - protein, 211 aa, Streptomyces avermitilis
VRTVDGRVAGRRGQATRQKLLDCLSEMLSSSPYRDVKVIDVARKAGTSPATFYQYFPDVEGAVLEIAEQMAAEGAGLTELLEGRSWVGKAGWQTSQELVDGFLEFWRKNDAILRVVDLGAAEGDKRFYKIRMKILNSVNNSLSDSIAELQSKGRIDKDVNPAAIAGSLVAMLAAVASHQKGFQSWGVKQAELKPNLALLVHLGVTGKKPTK

SEQ ID NO: 11353 - protein, 245 aa, Streptomyces avermitilis
MTITDKNRLTGEADPRRTSLYGPPSMDALTERALHLARAGRALLGIVGEPGAGKSTFAEQLRARLEKERPGLAVTVSMDGFHLAQKVIEARGQAADKGTIDTFDADGFVALLRRTRAETGDTENTESTVWWPEFDRDLEDPVAGSIEVAPHHRLVIVDGNFLLSAQEPWRQVKGLLDETWFLDALPEPRRERLTRRYISYGFTPEAARAKTLGVDEDTSALIRSTVSRADLVIGEARESGGVSDC

SEQ ID NO: 11354 - protein, 157 aa, Streptomyces avermitilis
MPPGLRLLHRMSSSPAFARYAPRIIPAVDLTVHRLTRGRVQLSAQMLPGLVLTVRGARSGLPRRTPLACMPQEPDAWFVVGSNFGRPAHPAWTANLLAHPEEARISWRGRDIPVTARLLEGAERAEAWKRLLTFWPPYATYQARITREIRVFRLSSR

SEQ ID NO: 11355 - protein, 413 aa, Streptomyces avermitilis
MDARFTAEQDEIRRTVRELLLKRWGPEEVRAAVGAGAGYDPALWSALAEQLGLPGLALPEAYGGVGCAVTEVALACEESGRALAPSPLLATAVLAAPLLLALGTETQRAELLPRIAAGALTAALAVPGTALSLALGLVGDNRGNWAGGGRAGGVQARRAEDGWRLYGQVEQVLDGHSAGLLVVAAHAGGFARPRTLLFLVREGAAGLVRARQTSLDVSRPQARVQLRDVPAELLGDEHVDVADALMATGDAAAAVLATEAAGAADRALERTVDHVRQREQFGRAIGSFQAVKHRLADVYVQVQAARSAAYYAAWAAGTGPERAGQVGQVGRTERTERVGGLALAQALEALRTAAAEGIQLHGGIGFTWEHEAHLYFKRATGDELLFGPVHRLRAYAAERSGIFSLAGSEEVAV

SEQ ID NO: 11356 - protein, 389 aa, Streptomyces avermitilis
MTPGKRKVAVVGVSLSDCGRVDDATPYALHAQAARRALADAGMDRSLVDGFASAGLGTLPPVEVAEYLGLRPTWVDSTAVGGATWEVMAAHATDAIAAGHANAVLLVYGSTARADIRAGRRTGTLSFGARGPLQFEVPYGHTLIAKYAMAARRHMHAYGTTLEQLASVAVQARANAALNPEAMFRDPITVDDVLSGPMIADPFTKLHCCIRSDGGAAVLLAAEEYVRDCRTPPVWVLGTGEHVSHTTMSEWPDFTVSPAAVSGRLAFGRAGIRPEEIDVAEIYDAFTYMTLVTLEDLGFCEKGEGGAFVEKGRLLVRGGELPVNTDGGGLSAQHPGMRGLFLLVEAVRQLRGEAAGRQARRPDGELPCLAVASGTGGWFCSSGTVVLGR

SEQ ID NO: 11357 - protein, 395 aa, Streptomyces avermitilis
MPFHLQAEDVKATSRYGTQDHRLTVDVRGSEGVVRLKAVGLRKSGTRCVNDTVRAVCDVSGAYNSWSDLDRVHPVAAEGSKPGDTGIVRFTFTTKGGKTLTTRTRVVVGEPEVKVRTLKVIKDVRPGADVTVPVVVRNDGEVPVQGLALELGSGELDFRQRYANCRYPPQRHGHTAVCRFPGLRVPPGGTVVLHPALRLRASTKRMYGSFSQEAWPLDSGPGQYTVVPPGGDHGDGPPLTAEALQGADDTDGTFAEGDVSTDVRLDTHADYEVFGVELRGSPGTKRSLRLKVRNNGPGIPGAGTKLLFTPPPGTVLEEPMEAIDEDAYEPYCDSDGPAYSCLVGQLDPGETRDFEFTLSLDGPGQGSAALQDTQPSTGRRDPNPANDTAPVTVLP

SEQ ID NO: 11358 - protein, 218 aa, Streptomyces avermitilis
MGTDLHELLRSLRVWDVELPSFDPASAPAEPLPLFVEWFAEAVAAGQTEPHTMTLATSDEDGLPDVRIVMLHGADADGWAFATHATSRKGRQLAARPYAALSFYWPTQGRQIRLRGPVEVAPAQEGQADLHARSTGALAAALVGRQSEVLGSMEELGRASDGAWDRAQSDPDAPAPTWTLYRLRPEEVEFFQGDARRRHVRLVYRRTEEGWLKELLWP

SEQ ID NO: 11359 - protein, 135 aa, Streptomyces avermitilis
VSGRRFDEPETDAFTRPYWDAAAEGVLLLRRCAGCGRTHHYPREFCPHCWSDDVTWERASGRATLYTWSVVHRNDLPPFGERTPYVAAVVDLAEGPRMMTEVVECAAAELRVGMELEAAFRPAGEVTVPVFRPRG

SEQ ID NO: 11360 - protein, 137 aa, Streptomyces avermitilis
VLRIGLGLWWLESWRHKDKKAWFERGTGIAWAADVAAKHRWSVVRGGFDAVVAPRPRTMAYVVVYAELALGLGLIVGLLTPLALVGGLLLNLFYLVLMIHDWAEQGQNSMMALISVVGLFGMSWQTWSLDSAFGLFQ

SEQ ID NO: 11361 - protein, 401 aa, Streptomyces avermitilis
MADSTATSTPRAVPSHEDRPVYVIGGGPGGLAAAHALRAQGVRAVVLEKSDRVGASWRRHYDRLHLHTTRRLSALPGLPMPRSFGRWVSRDNVVRYLEKYVEHHQLEIVTGVEVSRVEPAPDGTGWLLHATGGRELTGSAVVVATGHNHTPHLPDWPGRDAYTGELLHAGDYRNATPHAGRDVLVVGVGNTGAEIAVDLVEGGASRVRLAVRTAPHIVRRSTAGWAAQFTGIVVRRLPVRLVDLLAGPMARLSVPDLSAQGLPRPDTGLYSRVREGSIPVQDVGLIDAVRKGRVEIVAAVDGFEDGKVVLADGNRIGPDVVIAATGYARALEDLVGHLDVLDGRGRPTVHGARTPRTAPGLYFTGFTNPISGMFRELAIDAEKIAKAVAKALARTTARTPA

SEQ ID NO: 11362 - protein, 713 aa, Streptomyces avermitilis
VHGRPAEADDLDVSGRPLYAGVPDLDRFFRPGSVAVIGASDTEGRPNTGITRQLLTWAERVGARLHPVHPTRQSVFGIPCSPSVADLPEPVDLAVLLVADPLPVIEQLAGAKVKFAVAFASGFAETGEAGAAAQARLAAAVGRSGLRLLGPNTNLNAFEEFREDLDGPAIALITQSGHQGRPVFTMQELGVRLSHWAPTGNEADLETADFISYFSERPEVGAIACYIEGLKDGRSFLLAADRAARRGVPVVAVKVGRTETGARTAASHTGKLTGADAVVDAAMRQYGVIRVDGLDELQDTAALLARARAPQADGVVVYAISGGTGAHFADLASEAGLRLPVLSDAKQAELHEWIPEYLNVTNPVDNGGHPVGDWRGRKIIDAILADPAVGVLICPITGPFPPMSDKLAQDLVDAAEATDKLVCVVWGSPVGTEAAYRETLLGSSRVATFRTFANCITAVRAHLDHARFTASYRSPFDEAPRTPSPSFRKAQALMRPGQQLSEHAAKQLLRAYGIRVPREQLVTSAAAAVRAASQVGYPVVMKASGAQIAHKTELGLVKIGLTSASQVRDAYRELTDIARYEGISLDGVLVCQMVERGVELVVGVTHDQLFGPTVTVGLGGVLVEVLRDVAVRVPPFGEDQARAMLGELRGRALLDGVRGGPPVDVDALVEVVIRVQRMALELGDDLAELDINPLMVLPRGQGAVALDALAVCR

SEQ ID NO: 11363 - protein, 279 aa, Streptomyces avermitilis
MTASPEESVDSVDPVDPVDSLVLHATDNHVSRITLNRPDALNAITPDQRERLIRLLGDASADPAVRAVVITGTGRGFCAGADLRGGPPAGERTAGDVARVIRSGAQRLICAVLDCEKPVIAAVNGTAAGIGAHLAFACDLVLAADSARFIEVFVRRGLVPDGGGAYLLPRLIGPQRAKELMFFGDALTAADAGRLGLVNRVVPADDLEKTAREWSARLAAGPTRALALTKQLVNASLDTDRGSAFAAEAAAQEINMTTADAAEGVTSFVERRSPRFEGR

SEQ ID NO: 11364 - protein, 199 aa, Streptomyces avermitilis
VMGHAGMAAAAVRYLRSAGAPTVAEPVGTPPRPQLRAVRDDERAPLDPTEFRRVLGTFATGVTVITAPGEQGPAGFACQSFSSLSLDPPLVAFMVGRTSTTWPRIARAGVFCVNVLGAHQADLCRGFAVSGADKFAGVGYDAAPFSGSPRLSGSLAWIDCAVHAVHLGGDHLIVVGRVQSLGTSDTHQEPLLFHRGRFL

SEQ ID NO: 11365 - protein, 436 aa, Streptomyces avermitilis
VTQTTDAIAASQEPPAPRRTRIHRAWFVAAVTFVTIIGAAAFRSLPGLLIDPLHQEFHWSRGTISAAVSINLALYGLTAPFAAALMDRFGIRRVVAVALVVIAGGSGLTVWMTAAWQLLLCWGLLVGLGSGSMALAFAATVTNRWFTERKGLVTGILTAASASGQLIFLPLLSWIVTEHDWRPAAVTVSLAALAVVPFVWLLLRDHPADVGVKPYGATEFVEKPAPMPGAARRAVTVLLSAVRTGPFWLLAGSFAICGASTNGLIQTHFVPAAHDHHMPITAAASLLAVIGVFDVVGTIASGWFTDRFEPRRLLAVYYALRGISLLFLPMLLHPTVHPPMIFFIVFYGLDWVATVPPTLALCREQYGEDSAIVFGWVLASHQVGAALVAFLGGLARDLLGSYDVVWYASGALCAAAALMALVIRRRPVRGVVAAAA

SEQ ID NO: 11366 - protein, 337 aa, Streptomyces avermitilis
MADPKASPLHRVVVLALDGLIPFELGIPQRIFGKARDADGRPLYEVVTCSVRPPGPVDTDADFAVLVAHGPETLATADTVVVPASYELGPVHEEGVLTPELAAALAHIRPGTRLVSICTGGYVLAAAGYLDGRPATTHWYHAEHFQGLFPKIRVDADVLFVDDGDVLTSAGVASGIDLCLHLVRRDHGAAVANEVARRTVVPPHRDGGQAQYIRRPVPEPQVATTTAARAWALGRLHEPIQLRDMAEQEAMSVRTFTRRFREEVGVSPGQWLTQQRVEHARHLLESSDLSIDQVARDAGFGTAQSMRQHLQAALGVTPTAYRRTFRTGSGTSPAGLA

SEQ ID NO: 11367 - protein, 349 aa, Streptomyces avermitilis
MRGVVFDGKQTQVVDDLEIREPGPGEVAVAISAAGLCHSDLSVVDGTIPFPVPVVLGHEGAGVVEAVGSGVTHVRPGDHVALSTLANCGACAECDRGRPTMCRKAIGRPQQPFARGGRPLYQFAANSAFAERTVVKAVQAVRIPKDIPLPSAALIGCGVLTGVGAVLNRARVEHGDSVLVIGTGGIGLNVLQGARIAGALTIVAVDANPAKEAVARQFGATHFLTSTEGVRDILPTGADHAFECVGRAALIRQAVDLLDRHGQAVLLGVPPATAEASFLVSSLFLDKSILGCRYGSSRPQRDIALYADLYREGRLLLDELVTATYPVEDFEKAAADAHEGRVARAVLTF

SEQ ID NO: 11368 - protein, 383 aa, Streptomyces avermitilis
VEFGFDAEDEVFRTEVRGWLSAQLTGDMGRRDWERRLGGAGWIGLGWPEDGYGNRRVSLTRQVVWAEEYARSGAPARSGHIGENLLAPTLIAHGTPEQKDRFLPPVARGEELWCQGYSEPGAGSDLAGVRTAAARDGDAYRVTGQKIWTSLAHEADWCFVLARTEPGSRRHHGLTFLLVPMDQPGRIEVRPIRQLTGTSEFNEVFFDGAVARAAHVVGGEGNGWRVAMGLLGFERGVSTLAQQIGFAAELGRVVRTAVANGAADDPVVRDRLVRQWALLRTMRWNALRTLGNAADAGAPSVAKLLWGRWHQQLGELAMQVRGAAGAVGPADWSPSAPYELDAYQQLFLFSRADTIYGGSDEIQRTIIAERVLGLPKEPRGPEG

SEQ ID NO: 11369 - protein, 301 aa, Streptomyces avermitilis
VGNFLAGKVVAVTGAGRGIGRAVALAAAAGGARVVVNDHGVSVEGAEPTSAVAEGVAKEIVAAGGEAVAVADDISTMAGGQRVVDAAVTSYGRIDGVVCVAGILRERMLFNMTEEEWDPVVATHLKGTFTVFRAASAVMRRQGSGTLIGFTSGNHQGSVSQANYSAAKGGIISLVRSAALGLHKYGVTANAVAPVARTRMSAKVPMELKEIGEPEDVAALVVYLLSERARQERITGQVYTIAGPKIAVWAQPRELRAGYAEGSWTPEKIADFLPGTVGTDPMPLLQQVEAMARAAAKRSAG

SEQ ID NO: 11370 - protein, 311 aa, Streptomyces avermitilis
MSRPALHPAFHDIAKRVNNWGRWGADDEIGTLNLITDEVVREAAATVRTGRRVPLALPLREDGVQTGLIPGRVNPLHVMVQINQEIFGPGTVACSDDAVTMGLQAATHWDALTHVSHSGKIYNGRPADTITPHGGAEFSGIDKPRHIVSRGVLLDVARARGVDRLAGGHAVTPEDLDAAEELAGTRVRPGDIALVRTGQIQTYLAGAKDAYGYPSPGLSVRTPEWFHARDVAAVANDTLTFEIFPPEIDDLWLPVHALDLVEMGMLQGQNWNLEELSTACGQEERYCFLLSAMPEPFVGGTGTPVAPVAIL

SEQ ID NO: 11371 - protein, 177 aa, Streptomyces avermitilis
VQVLQVQLEIRPDPAEVGRARRWARSRLVGSGIEADEPLSETLILLVSELVTNAVVHTGCPAVLRLLLTGVRDDSSGAPSGTVRLEVADLSACPPAPRHAEGDETGGRGLELVDGLADRWGWTPEGAGKRIWCELDRCAAATEGAAVSYSGDASCGVDASCAGEVATSYKGFAYEAV

SEQ ID NO: 11372 - protein, 290 aa, Streptomyces avermitilis
VRFQLTEDQKALRDGVRGLLAGRFGRAALRAAVEAPGLDRTLWRELGAAGFFALRLPEAEGGVGLGLPEAVLAFEEAGRFLLPGPLVATHLAAGEVAGAATGETVVTAVHGGLVEWLTQADVVRGDTAGAEPLRSVDPLTPLHRVPGTAEPAPLVMLLTAAEQLGTAARTCELAVQHARTREQFGQPIGAFQAVKHLCAEMLVRVETARVAVYAAAVTADPLDIAAARLLADEAAVRGTRDCLQVHGGMGFTWESDVHLYLKRAWVRTQRGESVTESEERLARELLSGTG

SEQ ID NO: 11373 - protein, 384 aa, Streptomyces avermitilis
VDLTRTPEEEEFRAGLRTWLAKALPSLPPKPSPDDWPARRAYDLGWQRMLYDAGYAGLHWPLDAGGRGATPTQHLIFLEETEKAGAPYVGANFVGLLHAGPTIAAEGTPEQRARWLPPVLRGEEVWCQGFSEPDAGSDLAALRTRAWRDGDDYVVSGSKIWTSHAEVADWCELLVRTDPAAPKHRGISWLALRMDAPGVTVRPLRTLAGSTEFAEVFLDDVRVPVAHRVGAENDGWRVTMVTLSFERGTAFVGEVVACRRVLGELAREAHRNGRWDDPVLRRHLGRLNAEFRALWRLTQWNVSEAQSTGGVPGVGGSVFKLRYSHARQELYDAAAEVLGPDAADLGREWTLDRLSSLSYTIAAGTSQIQRNIVAERILGLPKGR

SEQ ID NO: 11374 - protein, 422 aa, Streptomyces avermitilis
MTELPRIISVDDHVIEPAHLFETWLPKKYRDRGPKPLTAGIGELAYVGGKYQITMDPKGPPTDWWIYEDLKFPYKRNIAAVGFDRDEMTLEGITRAEMRRGCWDPVERLKDMDANHVEGSLCFPTFPRFCGQTFAEAHDKEVALACVRAYNDWMVEEWCGDSGGRLIPLCLIPLWDIGLAVAEIRRNAARGVKAVTFSEIPTHLGLPSIHSGYWDPFFAVCQETGTVVNMHIGSSSQMPAASPDAPPAVQAALSFNNAMASMMDFLFSGVLVKFPRLKLAYSEGQMGWIPYALERADDVWEEHRAWGGVRDLIPEPPSTYYYRQIFCCFFRDKHGVASIDVVGRDNATFETDYPHVDSTFPHTKEVALDHVEGLDDETVYKLMRGNAIRMLDLDLDRDLDHLGNRDHLGARDTLSSRDKADR

SEQ ID NO: 11375 - protein, 499 aa, Streptomyces avermitilis
VNDTAHALSTSGTLWELVVRRAGLTPDRTVLLQDDRSLSFGELRDRAERVAAGLYDMGVRPGTVVAWQLPTRIETALLSFALARLGAVQSPVIPFYRDREVGFALRESKAEFFAVPGTWRGFDHTAMARRLGAKGIFEAYDALPDGDPALLPAPPAQGTDVRWIYWTSGTTSDPKGVLHTDRSLIAGGSCLAHALRLTADDVGSMAFPYAHIAGPDYTVMLLLYGFPAVMFEQFALPDALAGYRGHGVTVAGGSTAFYSIFLAEQRRQPDTPVVPTLRLLAGGGAPKPPEVYHRVVREMGVQLTHGYGMTEVPMITMGSPDDTAENLATTEGRPPEGMEIRIVDGEVRLRGEAVCQGYLDPRQTAEAFDEDGFLRTGDLGHLTGSGHLVLTGRLKDVIIRKGENISAKEIEDLLHRHPAVGDVAVIGLPDAERGERVCAVVEQPPGAGALTLDAMTSYLRAEGLSVHKLPEQLEVVDALPRNETLRKVLKYRLRERYAR

SEQ ID NO: 11376 - protein, 170 aa, Streptomyces avermitilis
MVSTEYERKIAARFAGFDQDGNGYIDREDFNAATKAVLAEFGTPARSDKGQSLYIGAEAFWQGMAGIADRDGDQRITREEFVGGAVKRLRDNPERFAEIARPFLHAALAVADTDGDGAATVDEAVRVLKALGVPEEIAAAAAGTLDADADGRIGEAEVVSAFARYFTVPE

SEQ ID NO: 11377 - protein, 126 aa, Streptomyces avermitilis
VAVVFKVTEGKRGDWAVLQVAGEMDLMTSPVMRQRVHDAVADGHRSLVLDLSEVLFCDSSGVGVLIATRRLIRSCQGRLRLILPAQGAEDGSHVNRVLAALGVRRLFDVHPDLASAVDEEARPLSA

SEQ ID NO: 11378 - protein, 193 aa, Streptomyces avermitilis
MAAKNAPPRWDRKMQQRLARGEAAALGELYDRFASLVHGLAHRVLGDERAADRITREVFAHVWEHPDAYDPKQGPLRSWVAGLTHRLAVQRLRATETAALARGGRGTTEDLERRVRRASVAARADYIVTSMPTPLRAALERAYFQRRDYRQTAVDLGITEDEARRRLRLGLQLLSTANDPGTSGLPPEDGRPR

SEQ ID NO: 11379 - protein, 494 aa, Streptomyces avermitilis
VSGAEGFEEAEGSEEAERHDGQDGAEEGNGTERHDGPKGTPGTEGTTGTEGTAEAKGVTGTGRAEGADGAEGADGADGLKGVGGAGGSGGSGVGGSGRLPRVPPPRVSVEDSGRPLPDLGPLPLVLEHRVLKSLLGAWALTACSPEETAAVEEHLGDCGPCAEEALRLRDAVGLLHPAESLDLDPALRTRVLEGCLDRRPPRIPVPKWAAAYDAETARLDALLQDIGDAEWHAPVRLRWFDGQRPASRRTTVAGVIAHLLTVDGLVAVALGLDDPLAGTPAGNGTPTARTEAYWRAAHFPPTRSVRGPWREQSHSLVRTVSFAGGGSGKLPVPYGGFELSLRDSMLDRAFECWVHADDIADAVDYPYDPPAPRHLHTMIDLAARVLPVSLAERRRAGLAAPPRRTRHLVPAGAPGRSLRLEIEGLGGGEWLIPLDSPAATGSAAHEVAHVALDGVEFCRLAAGHVSPEEAAAGQDGDREAIRDVLLAAASLSRM

SEQ ID NO: 11380 - protein, 293 aa, Streptomyces avermitilis
MNEQSVRAAAPAEQYVLTLSCPDKQGIVHAVSSYLFMTGCNIEDSQQFGDHDTGLFFMRVHFSAEAPVTVEKLRASFTAIGDAFHMDWQIHRAEDRMRVVLMVSKFGHCLNDLLFRARTGALPVEIAAVVSNHTDFAELVASYDIPFHHIPVTRDNKAEAEAQLLELVRSENIELVVLARYMQVLSDDLCKQLSGRIINIHHSFLPSFKGAKPYHQAHARGVKLIGATAHYVTADLDEGPIIEQEVERVGHDVTPDQLVAIGRDVECQALARAVKWHAERRILLNGRRTVVFA

SEQ ID NO: 11381 - protein, 166 aa, Streptomyces avermitilis
VTVQGSENSSRRGRRSSTMGGMPLNDMPWWRWRSNVRSALHMLSDPAFQRDVWLAGVDGYGDVTDAVYRLVEDTWLDNWSAEKYVGTIFRDSQEAALVDTAVLRVLRIMHQVGPDAPVSAYLDHHAWPEAVRAARDAHVRLAVSDEEDPDVPPRTLEVLRILTRTA

SEQ ID NO: 11382 - protein, 428 aa, Streptomyces avermitilis
MTGRRRTSFLPRPVKTAALSAGALAACAALAVGCGVVPGVTGGSGDDTVTVMTWAPEKTTATNEPGMPAMAKAYARWVNAEGGLNGRKLRVLTCNDHNDTVDAAKCARRAVNEGAVAVVGSYSQHASSFLSPLESAGIPYIGGYGVTDDEFKSVLSYPVNGGQPALLAGLGEELGKSCGPVALIRPDTFAGDQLPVLFGSGLKAGGHSAAADLRADEDASEFAGQARQALRRASADPLNKGCVVPALDERTNTFMDSFRRQRDDYPTVRTASVLGSVDQSVIDATGGASGPYEGAYVTGWYPVASDARWGPMKKVIREHAFGDNRIDPADAGVQTTWIAYTVLKKVVESLDGEVSARTVRRALDDGVKVETGGLTPRLSWRFEDMTAVVDFPRVVNADVTFQVVREGRLVAARRGFVDVSKVLESNAY

SEQ ID NO: 11383 - protein, 559 aa, Streptomyces avermitilis
VLPSDGGAPLLPGTTGDQRPAPAGGQAWGQPWGPDGPGQTPPAPGWGAPTDAGQPWTAPEPPQSAPAPDWGTSGAQPSWEASQDLRSGWDGPQGQPSDSGYPVQQQQQQPHQQQPHQQQPQQAAGSAFPAQPQPQPQPQPQYAPDSGFQPQSQQAPAPGFSAPHGTGGAGPLPPEGAQAFPPVPGGAPLPPVDEGATQYLPPVPAAPDEGATQYLPPVPAVDEGATQYIPPVAPGALPPEVSADATQFLGHGPQAGSRPAADPDAQATQYLPPVPAEPDAGSYGIRPGAPDERQPPAEFDNLFRSDSAGASSTQQLPQFQPPAAGAPGAPGGRAAARRAAGDEGGGRGGRTGSRVPLIAAVGVGIAVLGIGAGALLSSGGGSESKGDDSKPVSASAPAKESSASASADPAKEQAVALDQLLADSGNSRDSVIKAVGNVRTCNNLDQAAGDLRDAAKQRGDLVTRLSGLSVDKLPNHAALTAALTSAWQASASADTHYAAWADQVNGKKGCKKGQARTTGQTVAGNRASTTASAQKVKAAGLWNTIASTYGLTQRQPTQL

SEQ ID NO: 11384 - protein, 461 aa, Streptomyces avermitilis
MAARPLVARQPNERLQALIQEAGCSNAGLARRVNMCGAEHGLDLRYDKTSVARWLRGQQPRGRAPAIIAEALGRKLGRTVTIDEIGMANGKNLASGVGLQFSPTVLGAIEQVCELWRSDVGRRDFLSGSSVAASALVEPSRDWLISVPDSQVARSAGPRVGISDVAAVRAMTQALVDLDHTYGSGHVRPVVVHYLNSVVSGLLAGSYREAVGRELFAAVARLTELAGYMAIDTGQPGLAQRYYIQALRLAQAAGDRGYGGYVLAASMSHLAAQLGNPREIAQLARAAQEGARGRVTPRAEAMFYAAEARGHALMGDARAAQVASGRAVTALESADPSSGDDPAWIAHFDEAYLADELAHCHRDLGQAEAAARRAEESLAGHPESRARRRAIGYVLLATAQVQQREVEQACHTGLRAVELLGTLRSNRGAEYLDDLQQRLEPYRDEPVVREFGARMELQAAA

SEQ ID NO: 11385 - protein, 217 aa, Streptomyces avermitilis
VEETIAGPQAAQIPKQRGESLQDTAVRYAEERHWDVFAGTWLEAVEGVPRCSCGDAACAVPGAHPAREDWATQATGSATVARRMWAKQPTASILLPTGRTFDAIDVPETAGFLALARMERMELTLGPVTCTPDRRMQFFVLPGAAVKIPDLVRRLGWPPASLDLVALGEGMYVAAPPTRYGSRGAVQWACRPTPANRWLPDAEELISPLAYACGRER

SEQ ID NO: 11386 - protein, 263 aa, Streptomyces avermitilis
MAEGAVVDVPAVRVRGLWKRFGEQIAVAGVDLELPAGRFVGLVGPNGAGKTTTLSMVTGLLRPDQGAVEVVGHDVWQDPVAVKARIGVLPEGLRLFERLSGRELLGYTGRLRGLPGVEVDKRAAQLLDVLDLAGAQHKLVVDYSTGMRKKIGLAAALLHNPEVLFLDEPFEGVDPVSAQTIRGVLERYTASGATVVFSSHVMELVESLCDWVAVMAAGRIRAHGPLAEVRGSAPSLQQAFLELVGANGRAAATDLDWLGGGAR

SEQ ID NO: 11387 - protein, 544 aa, Streptomyces avermitilis
VSAADPTSTADPTSTPSLTSVVVRLKLSLLRNGLRQSAGRRAAYVTSLVLVLPFAGLQLLGLIALRGTTHAPAVAVLLVAVLALGWAVMPLFFPSGDETLDPTRLVMLPLRPRPLIRALLAASLVGIGPLFTLCLLAGSAVSVAHGTAACVTAVVGVALALLGSVALARAVAAANIRLLSSRKGRDLAVLSGLVVAIGAQLVNFGAQRLGSAGGLSQLDPAADVLRWVPPAAAIGAVDSVSRGWYGAGVAQLVLSALALVGLLALWSRSLTRLMTSPDGSTLQAAEPGRDRAGRSSGLGRLLPAGRTGTVMERSLRYVWRDPKTKAAWATSLAIGLIVPVFNALQGTGSIYFACFAAGMLGIQMYNQFGQDTSAFWMVAMTISSTRDAYAELRGRALALLVITLPYATLVCVLTTAMLGDWPRLPEVLGLSFALLGAMLATGAWSSARFPYSIPQEGYKNVAPGQAGLAWISIFGGMVSAALLSAPVIILTIWLNVAAGGGEWTWLLLPVGAAYGALLTLLGLRLAAPRTARRLPEILAAVSKG

SEQ ID NO: 11388 - protein, 307 aa, Streptomyces avermitilis
VDRSARRGSERSERSQGGARTMVRRIDVTGAGGVRLAAWEFADPPKNGESERTPGVLLLHGLMGRASHWASTARWLSERHRAVALDQRGHGQSGKPPEAAYTREAYVEDAEAALEQLGLAPTVLIGHAMGALTAWQLAAKRPDLVCGLIICDMRASALGAASQREWEDWFKAWPVPFATLADVRKWFGEDDPWVERPNPSRGEFYAEVMHESDDGWRPVFEPEQMLKSRQTWVYDAHWEELAQVRCPALVVRGLDGELGRAESQEMVRVLPYGQYAEVAEAGHLVHYDQPEAWRAAIEPFLDGVLAP

SEQ ID NO: 11389 - protein, 230 aa, Streptomyces avermitilis
MSGLIDTTEMYLRTILELEEEGVVPMRARIAERLDQSGPTVSQTVARMERDGLVAVASDRHLELTEEGRRLATRVMRKHRLAECLLVDVIGLEWEQVHAEACRWEHVMSEAVERRVLELLRHPTESPYGNPIPGLEELGEKDGADPFLDEGMVSLAELDPGADGKTVVVRRIGEPIQTDAQLMYTLRRAGVQPGSVVSVTESPGGVLVGSGGEAAELEADVASHVFVAKR

SEQ ID NO: 11390 - protein, 251 aa, Streptomyces avermitilis
MSESKLAEQFLDAAIGLLQRVRDEDAEPIAAAGTLIADTVADGGRLFAFGAGHSSLAAQDLVYRAGGLALMNLLAVPGVVGVDVMPATLGSALERVDGLASAVLDSSPVRSGDVLVIISLSGRNALPVEMSMNARALGVKVIGVTSVAYASQTRSRHVSGTYLKDHCDIVLDSRIAVGDAELTLDTIEAPFAPASTVVTTALLQAVMATAAGTLADRGIEPPLLRSGNVDGGHDWNDRVMREYGDRIFYRR

SEQ ID NO: 11391 - protein, 476 aa, Streptomyces avermitilis
VSASRRSGTTDELGPDGPDPERDGPDGADLLAALLDGMDAALCAFDADGVVTHWNREAERILGWTAAEAVGRRGFAGWAVRTADAEDVEARLMTAMQAPGRQVHEFALLTKDGGRVLVRTQSAAVHGPDGKPAGVYCAFSEVHTQIDLERSIALSEALFEDASWGVVLVDADLRPAVVNAHAARALGTGRTTVLGRPLGDLLSQGVEELESALTHVLAEGAPPAPAEMWVSVRTAEGEKRRCWRSGFLRLASPLAEEPVPLGVGWLFQDITEAKQTEQEAALLRFRTNQLHRAARAAAECEDPGEAATVHLDFSLAGFADHALIDRVAGGPVADGDRDGDGPPVRLVRAADTPSGAPGPSLLVGKAELPVWYAEGHPALQCVERAGSVRASAGVSDAERAREWAISRQWPGDAVHALCAVLRSRGRTLGVVTFLRGAGRSQFERADAVYAEDVAVRIAAALDLAGLAGLAGPAGER

SEQ ID NO: 11392 - protein, 224 aa, Streptomyces avermitilis
VTDRDPIHDPAAMREHYRLEGLDETELAAHPMDQFTRWFAQAAQAAAQGVVYEPNAMVVSTADADGRPSSRTVLMKQYDEQGFVFYTNYDSRKARDLAANPYVSLLFPWHPMARQVVVTGLARRTGRDETAAYFRTRPHGSQLGAWASAQSSVIFSRAELDAAYEQLGVRYPEGEQVPVPPNWGGFRIAPQTVEFWQGRWNRLHDRLRYVAEPDGSWRVERLSP

SEQ ID NO: 11393 - protein, 366 aa, Streptomyces avermitilis
MSDFVPGLEGVIAFETEIAEPDKEGGALRYRGVDIEDLVGHVSFGNVWGLLVDGAFNPGLPPAEPFPIPVHSGDIRVDVQSALAMLAPVWGLKPLLDIDAEQARHDLARAAVMALSYVAQSARGQGLPMVPQSEIDKAHSVVERFMIRWRGEPDPKHVAAVDAYWTSAAEHGMNASTFTARVIASTGADVAAALSGAVGAMSGPLHGGAPSRVLGMIEEIERTGDAEAYVKKALDKGERLMGFGHRVYRAEDPRARVLRRTARELGAPRFEIAEALEKAALEELHNRRPDRVLATNVEFWAAIMLDFAEVPAHMFTSMFTCARTAGWSAHILEQKRTGRLVRPSARYVGPGSRGPQEIEGYEDIAR

SEQ ID NO: 11394 - protein, 345 aa, Streptomyces avermitilis
MTNTATTPSYQRYQQLPIIDLSAADRGPQARALLHAQLHSAAHDVGFFQLVGHGVTQAETDELLRAMHAFFALPEADRLAIDNVNSPHFRGYTRTGDERTGGSRDWRDQLDIGAERPVRTPGPGEPAYWWLEGPNQWPAALPELRTAALAWIDKLSAVAQRLLHELLTAIGAPAGFYDPVFGEHAHPHLKLVRYPGSAGDGADQGVGAHKDYGFLTLLLQDQVGGLQVQREDGLFHEVPPLPGAFVVNLGELLEVATNGYLLATNHRVVSPPGATERFSVPFFYNPRLDARVEPLPFPHASTAPGVTDDPANPLFAEYGLNELKGKLRAHPLVAARHHAELLTPA

SEQ ID NO: 11395 - protein, 215 aa, Streptomyces avermitilis
MGDHFQTIVDLDASAGEAPELAARVIEWLVTEGIVLAERTDCVLGRPLGHPPGPNWRRAVGENPDLDPSDGLAVHTRRTAFDAGQGGPESVTCPRCGATTELAGEDYADGADGADYEDAAGAEDRSESDEGAADGVWDRFAAAIEVWHATGAATVACPACAHPVPLADWTWNDDCFAFGHLGFEFWNWPEFTSGFRADIARLLDGHRTAYVWGKF

SEQ ID NO: 11396 - protein, 199 aa, Streptomyces avermitilis
MGAVNTADRVPKQDRSRATRQRLLEAAVACLAEHGWAGSTVSVVAERAGVSRGAAQHHFPTREDLFTAAVEYVAEERSTALRVLFPEGAADRRAVVSALVDLYTGPLFRAALHLWVAASNEDQLRPRVTELEARVGRETHRIAVDLLGADESRPGVRETVQGLLDMARGLGLANLLTDDASRRDRVVTQWAALLEETLG

SEQ ID NO: 11397 - protein, 244 aa, Streptomyces avermitilis
MTLIGITRARGIATLALDSPGNRNALSADLVTELADALTACGKDPDVRAVVLTHSGNTFSAGADLRQPPDPAAFVGLLRGIVELPKPVVARVTGHVRAGGLGLLGACDIAAGGPGTSFAFTEVRIGVAPAVISMPLLPRLEPGAARRYYLTGERFGAAEAVRIGLLTASGDDVDETLAPILDGLRAAAPGALAETKALVTARVLESFDRDTAALTALSARLFATAEAREGMTAFLERRDPAWAL

SEQ ID NO: 11398 - protein, 524 aa, Streptomyces avermitilis
VFRSEYADVPPVELPIHEAVLGRAAEFGEAPALVDAVDGTTLTYEQLDRFHRRIAAALAEAGVRKGDVLALHSPNTIAFPTAFYAATRAGASVTTVHPLATAEEFAKQLSDCSARWIVTVSPLLDTARRAAELAGGVREIFVCDSAPGHRSLIDMLATAAPEPRVDIDPAEDVAALPYSSGTTGTPKGVMLTHRSIATNLAQLEPAVPTGPGERILAVLPFFHIYGLTALMNAPLRLGATVVVLPRFDLDTFLAAIEKHRITHLYVAPPIVLALAKHPAVAQYDLSSLKYVISAAAPLDADTAAACSRRLGVPPVGQAYGMTELSPGTHVVPLNAVNPPPGTVGKLVAGTEMRILSLDDPDQDLPVGEAGEIAIRGPQVMKGYLGRPEATAAMIDEDGWLHTGDVGRVDADGWLFVVDRVKELIKYKGFQVAPAELEALLLTHPKIADAAVIGVYNDDNNEVPHAHVVRQPSAADLSAGEVMMYVAERVAPYKRIRHVTFLDEVPRAASGKILRRQLRDLREHS

SEQ ID NO: 11399 - protein, 386 aa, Streptomyces avermitilis
MTRVIETEEHQALRSAVAALGKRYGREYLTRVVAEGDYPDELWSETAKLGYLGVNLPEAYGGGGGGIAELSIVLEELGAAGCPLLMLVVSPAICGTVIARFGTEAQKQQWLPGFADGSRSMAFGITEPDAGSNSHRITTTARRDGTDWILSGRKVFISGVDIADATLVVGRTEDARTGRLKPCLFIVPRDTDGFGRRPIDMELHGAEKQFELTLDDVRLPADALVGDEDAGLLQLFAGLNPERVMTAAFAIGMGRFALSRAVEYARDRSVWKQPIGAHQAIAHPLAQAHIDLELARLMMQKAAHLYDSGDDVAAGEAANMAKYAAGEACVKAVDQAVHTLGGNGLTREFGLASLITASRVARIAPVSREMILNYVSHQTLGLPKSY

SEQ ID NO: 11400 - protein, 616 aa, Streptomyces avermitilis
VIASVLVANRGEIACRVFRTCRASGIRTVAVYSDADENALHARVADAAVRLPGAAPAQTYLRGDLIVKAALAAGADAVHPGYGFLSENAGFARAVRDAGLVWIGPPPEAIEAMASKTRAKKLMGLEPLTEVTPPDLPVLVKAAAGGGGRGMRVVRDLAELDAELAAARAEALSAFGDGEVFVEPYVEGGRHVEVQVLADTHGTVWALGTRDCSLQRRHQKVIEESPAPGVDAELTAELHELAIRAARAVGYTGAGTVEFLVADGRAHFLEMNTRLQVEHPVTEAVFGIDLVAQQIRVAEGAALESDPPRARGHAIEARLYAEDPSRDWAPQTGTLHRLALPREADVRLDTGYTDGDPVGVHYDPMLAKAVAHAPTRAEAVRTLADALERAEIHGPVTNRDLLVRSLRHPEFTAARMDTGFYDRHLTELTAPAPDPYAPLAAALADAHGRSRFGGWRNLPSQPQTRRYLMAGDEHEARYHHTRHGLTAEGVRVVHADAGLVVLEIGGVQRKFRVSRYGDQVHVNATALTELPRFPDPAARQEPGSLLAPMPGTVVRVAEGLAEGARVEAGQPLLWLEAMKMEHKISAPTAGTLGALHATPGQQVEVGTLLAVVQRAL

SEQ ID NO: 11401 - protein, 532 aa, Streptomyces avermitilis
VTVLASALDTTGPEYAANREAMLGKLAQLTAEHAKALAGGGEKYVARHHKRGKLLARERIELLLDPDTPFLELSPLAAWGSEYAVGASLVTGIGVVEGVECLITANDPTVRGGASNPWSLKKALRANDIAYANRLPCISLVESGGADLPSQKEIFIPGGAIFRDLTRLSAAGIPTVAVVFGNSTAGGAYIPGMSDHVIMVKERAKVFLGGPPLVKMATGEESDDESLGGAEMHARVSGLADYHAVDEQDALRQARRVVARLNHRKAYGDPGPAVPPKYDEDELLGIVPGDLKVPFDPREVIARVVDGSDFDEFKPLYGTSLTTGWATLHGYPIGILANAQGVLFSQESQKAAQFIQLANQRDIPLLFLHNTTGYMVGKEYEQGGIIKHGAMMINAVSNSKVPHLSVLMGASYGAGHYGMCGRAYDPRFLFAWPGAKSAVMGPQQLAGVLSIVARQSAAAKGQPYDEDADAALRAMVEQQIESESLPMFLSGRLYDDGVIDPRDTRTVLGLCLSAIHTAPYEGVRGGFGVFRM

SEQ ID NO: 11402 - protein, 562 aa, Streptomyces avermitilis
VTEPTAPLRIGNFSGFYGDRFDALHEMLTGGELDVLTGDYLAELTMLILGRDRLKDPTAGYARTFLRQLEGCLGLAHERGVRIVTNAGGLNPAGLADAIRNLAGRLGIPTRVAHVEGDDLTAAHPGSLAAHAYLGGFGIAACLREGADIVVTGRVTDAALVTGPAAAHFGWQPGEYDRLAGAVVAGHVLECGAQATGGNYAFFRDADVRRPGFPLAEIHADGTGVITKHPGTGGLVDVGTVTAQFLYETAGARYAGPDVTARLDTVRLTQDGPDRVRVEGVRGEAPPPALKVGRNRLGGFRNEVVFVLTGLDIEAKAALVQAQLTDALAKSPPGEVRWDLVRTDRPDADTEETASALLRLVVRDPDQEAVGRALSGAAIELALASYPGFHVLAPPGKGAPYGVFEDVYVPHGAVDHVAVLYDGRRIPVSPAQDTLVLHDVAEPPLPEAPPPGPTRRAPLGLVAGARSGDKGGNANAGVWVRTEDAWRWLVHELTVDRFRDLLPECRPLPVVRHVLPNLRALNFTVEGILGEGVAAQHRFDPQAKGLGEWLRSRHLDIPEALL

SEQ ID NO: 11403 - protein, 267 aa, Streptomyces avermitilis
MSDPTRVLDDLRAESEELDRLVAELSPEQWALATPAPRWTIAHQIAHLAWTDHSALLAVTDEDAFRALVDKALTAPESFVDEGADQGSRLPCAELVKRWRESRAALDRALREAPPGARFPWYGPPMSAASMATGRLMETWAHGQDVADALGVVRTPTDRLKHVARIGVRARDFAFGIHGLPVPAADAIRVELTAPTGEGELWTYGPEDAPQRVTGPALDFCLLVTQRAHRADLAVRATGPDADRWLDIAQAFAGPPGTGRPGKGTAE

SEQ ID NO: 11404 - protein, 573 aa, Streptomyces avermitilis
MTTDRNKTAERDTTHKPLRVTARGRAVLADPRLNRGTAFTDEERRALGLVGLVPPRVLTQDEQADRAYAQFREQPGDLAKNVYLTALHDRNEVLFYRLVGDHLEEMLPIVYTPTVGTAIKRYSYEYRRPRGIYLSVNAPDDIERSLRAAGLGADDVDLIVATDGEGILGIGDWGVGGIDIAVGKLAVYTAAAGVDPRRTLPVMLDVGTNRQELLDSPLYLGNRHPRVDRDTYDAFIDAYVTAATKLFPRALLHWEDFGPANARRIFNHYRDDVFTFNDDIQGTGAVNLAAVLSGAKAGDLPLRDHRIVVLGAGSAGIGVADQLRDALVAEGLSSDEATARFWCVDRYGLLTADQGDKLRDFQVPYARPADEVSDWQRDDDLPGIPLDEVVRRVHPTILIGTSGQGGAFTETVVREMAAHTPRPIILPMSNPTDLAEAKPADLLAWTDGKALVATGSPFDPVELNGTTYRIGQANNALIFPGLGLGAIVARATRVTDRMLRAAADAVANQTDVTDPGAPVLPPVRDLRETSFAVAVAVARAAAEDDVARAGTDDIEAAVRAVTWEPVYPPVQAV

SEQ ID NO: 11405 - protein, 317 aa, Streptomyces avermitilis
VNNPSAVPSPAAPPVVPATDHVPTAGGGPGRRGALGPVGLVLAGGISVQFGGALAVTLMPRAGALGVVTLRLVVAAIVLLVVCRPRLRGHSRADWGTVVVFGITMAAMNGLFYQSVARIPLGPAVTLEVLGPLALSVIVSRRALNLVWAGLALGGVFLLGGGGFSDLDPVGVAFAVSAGAMWAAYIVFSARTGRRFPQADGLALAMVVAAVLFVPLGIAESGTKLLAPTTLGLGAAVAVLSSVLPYTLELLALRRLPASTFAILMSLEPAVAATAGFLVLHQSLSVLESLAIALVIAASMGAVRTQVGRGKALPPDA

SEQ ID NO: 11406 - protein, 791 aa, Streptomyces avermitilis
MHPQQSEHGAYADYEDGDGHGDGGRDGDGDGDFEGSQDPDTPSIPARVAFRRFWPMTKGLRGFLLIVWLCTVLNALTETVAILLFSDLTDHALQQGSLDAFWSPAAQWLGVAVAGAAVGFAGNSLAAWATERFVMRLREHVFDHVQQLPPHFFQRHRQGDLLSRLTADVEAIEQMVVSAMVGAASAAFSALFYAAAAFWLRWDLAAATFVLAPLFWLAARRFSGSIKSVSREGRVADGAITSVVEESLGNIVLTQAYDRRDAERRRLNQEAGAWFRAAVRSTRLNELYEQLVQVIETVCVLAVIGLGVWEISTGRMTLGQLLAFAAFLGYLYPPVRGLAQLGLTVTAATAGAERLIEILDVRPAVADPARTSESIGRPDGSVEVRDVSFRYPGADKAALEGLSFAVRPGELVIITGPSGAGKSTVSKLLLRFYDPDAGSVLLDGVPLNAFPLARLREYVTLLPQETLVLHDTVRANIACGRPGASEHAIVEAAKAADAHAFITGLPDGYDTRVDPNSARLSGGQLQRLAIARAILRDAPVLVLDEPTTGLDAMAARRVVRPLRRLMAGRTTIMITHDLNLAPDADRILVVDHGRIVETGRHDDLLSRAGAYARLHRSQNNALMDTGELRLPLFTGPEGRAEQFAYGTAHGATPGAVPGTAPGAVPGTAYGAGHGTAYAAVPGTVYQAAPGTAYAAVPGTAHHAANGNAYGTSDQVAYGTSDQVAYGTSNQAAFGTSYGAAGGIPTDPPYSAPYNSPHSPPYGFTADVPSDFPVTLPGGRPLFRDEVPWHGV

SEQ ID NO: 11407 - protein, 61 aa, Streptomyces avermitilis
MRRGPMVHHRPSFSPLDHLPSTLGGFGACFGFGLGFGGGGSSFDLGFGGSGASFLKLIPTP

SEQ ID NO: 11408 - protein, 188 aa, Streptomyces avermitilis
VDDLHRGLNQQWRRNIKKAEKAGVKVVQGGYHDLPAFYTLYTETAARDRFIPRPLPYFQRMWTALTAEDPHRMRLYLAHHGGEVLSAATMLTVGTHVWYSYGASTSRRREAQPNNAVQWRMLTDAHARGAEVYDLRGITDTLEDSNHLLGLLRFKVGTGGEAAEYLGEWDFPLNRLLHKALDLYMARR

SEQ ID NO: 11409 - protein, 180 aa, Streptomyces avermitilis
MSLRVQPITREEHLAFVASRPSASHMQVPSWGDVKPDWRAESLGWYDEGDGGARGGRLVGAGLVLFRPLPKLKRYLAYLPEGPVIDWYVPDLDRWLDPMLAYLKARGAFSVKMGPPVVVRRWSADAVKTAIADPGAHRLRDVTATAHEPRAFDVADRLRRMGWQQTEPAGEDGFAAGQPR

SEQ ID NO: 11410 - protein, 982 aa, Streptomyces avermitilis
VRGEVAFDATARALTTMDASNYRRVPLGVVAPRDADDVAAALSVCRAHGVPVVPRGGGTSIAGQATGTGVVLDFTRHMNRIVSLDPAARTAVVQPGVVLDRLQEAAAPHGLRFGPDPSTHGRCTLGGMIGNNSCGSHSVAWGTTADSVRELKVITGRGQRLTLGRDWAGAPEGLRPLVDGELARLRTGFPALPRRISGYALDALLPEKGADVARSFCGSEGTLGVLTEAVVRLVEAPRARALAVLAYADEGAAADAAAGLLPYGPLTVEGMAADLVPSPADLPRGGAWLFVETGGATEAEARARAQAIVRAADVMDALVVTDPAGQHALWRIREDASGTATRMPDGTEAWPGWEDCAVQPARLGAYLRDFRGLMSAHGLRGTPYGHFGDGCIHVRIDFDLLTEVGIGRFRRFSQELADLVVSHGGSLSGEHGDGQARAELLPRMYGPELVALFERTKDIWDPDGLLNPGMLVRPARLDENLRFAVLPRKPVDVEFGYPADGGDFSAAVRRCVGVAKCRTTSVSGAGVMCPSFRATGEEEHSTRGRARLLHEMLAGEVITDGWRSAEVRDALDLCLSCKGCRTDCPVGVDMATYKAEFLHHHYEGRRRPAAHYAMGWLPVWLSAVSRTRAGAVVNALASVGPLAAVAKRLGGIAPERGIPRVARETFSRWWSRRFRDRVRAFVREAKRGERTRVPGAGRESVVLWPDTFTEHLSPAVGRAAVRVLEAAGLAVLLPPTFRMKSPAVMDGVSKAPAGFNVFMPHRRRRVCCGLTYVSTGQLDRARTVLRRTLDLMEPVLDAGLPVVVLEPSCAAALRTDLPELLHDDPRAARLAAAVVTFAEALERHAPAWTPPRLDRPVTGQTHCHQHAVLGDAADRRLREAAGLTGELTGGCCGLAGNFGFEKGHYDISTACAEDQLLPAVRASTADTIVLADGFSCRTQLEQLGGVRGRHVAEVLAEGLGEAPGDVLGKGPGGGPGGGPGER

SEQ ID NO: 11411 - protein, 746 aa, Streptomyces avermitilis
MTAPLPPGERPTLGSIAPFPLVTAVAAGIAVAGAVFAAPDSVRAPLAWGGGAAVLLLCTAVALAAHGMRAAKLARGRLDAVTRDAGRLLQERARLAEDFSQERGRLTDGFIEERARLTEDFARERVRLTDEFAQERARLTGEFDQERTRRTEEFDRERDELTTDYTRERDRLTADFTRERDKLTADFTGERDRLTADVTRLTADVARLTEENARLAERARHAAGARAAAVSVTGNVAGRMQALATGMLADLRGMEERHADEEVLTDLLYLDHRTAQAGRLADSVAVLAGARSGRRWARPIVMESILRGAMGRIGGYQRVRVHSSSEAAVAGHAAEGVMHALAELLDNAANFSPPTAEVHVYVEEVPAGVIVSVEDSGLVMSDVQLRRAERAVSGESSDLGGLTGTRLGLAVVGRLARKHGLKVSFRPSARGGTGVLVLIPQDILSTVPAVPPAPAPAQPVTAAAAATTTAATAVEPAATDPAVATSTDATSTDATTPDASPATAPPAAAPPAAAPSRPLPSYAAARSPEDLDPDPVPTHESAERGGGDTGGLPKRRRGRALAEAERGRPHATGRTEREPRTADDAKARVARFSSFRQAVRGTMPDQAAVQGTTTDPTPEAQDRDRARAEDRDRNRAKAEGRNQDQAEGGDRAEGRDRAKAEDQAQDRDRDRDRDQVQVQVQDRHPAKLTKPTKPAPPTTPPAPVRATAPATPVQDPPPATPSQSQPHPQPQPHPHSHAHPEGDTTS

SEQ ID NO: 11412 - protein, 135 aa, Streptomyces avermitilis
MTGTTTADEKLTWLIEGLIERTPGTRHALVPSRDGLKLCRTPELSVDQADQLAAIAAGIQSLSHGASVEFGDGSGGVRSAMAEFYGGVLFIVEAGEGAHLAVVTTEDADAGLVGHNMSELVEQLGEHLSAPPRTS

SEQ ID NO: 11413 - protein, 115 aa, Streptomyces avermitilis
MSRPGRDDAPDRLYTLTGGRSRSGDDSRFDLVTLVVAECDPVPGMQSEHAAILRLCDRPTAVVEIAAELRLPVSITRILLADLLAAGRISARHPRKAALPDPDILEQVLVGLRNL

SEQ ID NO: 11414 - protein, 180 aa, Streptomyces avermitilis
VVVGGFGVGKTTLVRSVSEIRPLSTEETMTRAGETVDDISEVRGKSATTVAFDFGRISLDTRNILYLFGAPGQERFWFLWDRLFAGTLGAVVLVDTRRIDDSWYAIDRLERHGTPFIVACNDFGGPAHTPEQIREALDLDPHVPLIDCDARSRESSKRVLITLVEHLKSLYVPRAPELAL

SEQ ID NO: 11415 - protein, 411 aa, Streptomyces avermitilis
VTPAPAPAPVPLSGPRFQTDPAALYREMRREHGSVAPVLLDGDIPAWLVLGYRELHQVTGDPVLFSRDSELWNQWPNIPADWPLLPMIGHKQPSILYTVGERHRERAAMISDALEAVDPFELRSLTEKFADELIDAVCAKGETDLVADYAALLPVRVLALLYGFAEEQGPGLVTALNDMIDGRDRAIAGQTHLATSMAQLLADRKAEPANDVVSRMLADSGGFTDEEIAQDLMVMMAAGHQPTADWIGNSLRLMLTDERFAASLFGGRNSVAEAMNEVLWEDTPTQNVAGRWASRDTQLGGRRVRAGDLLLLGLQGANNDPQVRIDGAALTGGNNAHFSFGHGEHRCPFPAQEIAEVIARTGIEVVLDRLPDIDLALPAGSLARRPSPWLRGLTELPVKFTPIPALGGSPA

SEQ ID NO: 11416 - protein, 400 aa, Streptomyces avermitilis
MTTRIALDPFVSDLEAESAALRAAGPLAAVELPGGVPVWAVTHHAEAKKLLTDPRLVKDINVWGAWQRGEIAPDWPLIGLANPGRSMLTVDGADHRRMRTLVAQALTPRRVEQMRERITKLTEELLDRLTGEVVDLKADFAYPLPMYVVADLMGIDEARLPRLGELFEKFFSTQTPPAEVIATLTELAGIMAETVAAKRAAPGDDLTSALILASEDGDHLTDAEIVSTLQLMVAAGHETTISLIVNAVVNLSTHPEQRALVLSGEADWSSVVEETLRYSTPTSHVLIRFATEDVPVGDKVLPAGDALIVSYGALGRDEAAHGPTAGEFDITRSTENRHISFGHGPHVCPGAALSRLEAGVALPALYARFPKLDLAVPAAELRNKPVVTQNDLFELPVRLG

SEQ ID NO: 11417 - protein, 372 aa, Streptomyces avermitilis
VAEIQIPSDIKPADGRFGAGPSKVRTEALDALAATGSSLLGTSHRQAPVKNLVGKVREGVSELFSLPEGYEVILGNGGSTAFWDVATHGLIDNKSQHLSFGEFSLKFAKAAKLAPWLAEPTVISSDPGTHPEPAAEAGVDVYAFTHNETSTGVAAPIKRVAGADEGSLVLVDATSGAGGLPVDITETDVYYFAPQKSFAADGGLWLAVFSPAAIERAERIHASGRHVPEFFSIPTAIDNSRKNQTYNTPALATLFLLNEQLEWINGQGGLDWAVGRTAASSSALYGWAEDVKYATPFVTDPAKRSQVIGTIDFADEVDAAAVAKALRANGIVDTEPYRKLGRNQLRVAMFPAIDPADVEALTKCIDYVIEKL

SEQ ID NO: 11418 - protein, 328 aa, Streptomyces avermitilis
MRMRRSFPFLAGSALLVVLSAPAVAADGDEGFTIGDSRITESSGLAASRLHPGVYWTHNDSDDGPYLYAVDSRTGKTVATVTLSGVGSPRDVEAISIGPGNEIYVGDIGDNLGGQWDHVWIYELPEPKVLEDQTIRATQYVVKYADGARDAESLMVHPKTGRVYIVDKKEDGGHLYEGPARLSASGTNVFEPLGAVGLWATDAAFSPDGKQLAVRGYFGGIAYTWNGGKIKRQGQLSVPLQRQGESVTYTADGSELMYGSEGADSAVKPGSVPGYSGSGAKSPSGGGGSASAQDGDSDGSHANYKVGALALAVALALGLGVKRLLRRG

SEQ ID NO: 11419 - protein, 228 aa, Streptomyces avermitilis
MLRFMPVGDSQTIGSAGEHTWRYRMWQHLRAAYGGPFRIVGPRETLYDKATDAPDSYEYADPDFPRAHLAGWGEGWLHMAPLIGEAVRTCRADVLLVALGLIDLGFYTNAPQTAENVRSFVAEARTANPRIRMIVLPVIPNVRAESDTAFAAEVASFNELLAKAVADLDEPQSPLLLASPPPSYDTDFDTYDGTHPNASGEHKIAEAFAEAMYQAWDVGEPYAAADFA

SEQ ID NO: 11420 - protein, 264 aa, Streptomyces avermitilis
VTALDALVRPDRYPRSSAYDPGWLLGLDMGPNPLWLLEDLARDLDLRPGMRVLDLGSGKGATSVFLAREYGVDVVAADWWIGADEATAVFEAAGVGGQVAAVRAEAHQLPFEEGSFDAIVSIDAFEYFGTADSYLPYLVKFLRPGGQLGIATPALTREIRELGAIPPHIKALVGWEAIAWHTAEWWRFQWEITELVTVTSARLQEDAWRDWLLWSRAGAEHLPEGRAAHQPVIDMLTADAGEFLSFALVTARTQGPSGGPARST

SEQ ID NO: 11421 - protein, 511 aa, Streptomyces avermitilis
MSADSTAVVAPAGPDTSGAGSPSAGRHLGLALVVIAAAQLMVVLDATITNIALPAIQTDLGVSDANLAWIVNSYALAFGGLLLLGGKAGDLFGRRKMFQVGIAVFTLASLLGGLAPNEGLLIAARILQGVGAALAAPSALALITTTFPVGKPRNTAMGVYAAMGGVGATVGLLLGGTLTDVLDWRWVFFVNIPIGLAVLAGTRTLVEAERHPGRLDVPGAIAGTGGLIALVHGITRGGEHGWTGGLTLASFAAAAVLLAAFLWLQARTAHPMMPLRLFKNRSRSGSYATMLFIGAGMFATFYFLTLYAQLILGYSPVRTGFAFLPFSFGMAAAAGVSSKLVARFAPRVIAGPGLLVAAVGMFWFATLEPDSSYAGHLMPAMFVTALGLGMSFVPMTLGAVSGVSHEDTGVASALLNTAQQIGGALGLAVLSTVSTSAADDKLPEAAGALYRGLAAKDSALVAEAGDALTHGYTMAFAAAAGMFLAGLAVTALAVNAGKQRHVEGAAPVHMG

SEQ ID NO: 11422 - protein, 232 aa, Streptomyces avermitilis
VSIPLRTRVRAGNSSAFAELYDSYARAVYNHAFRLTADWSTAEDVMATTFLEAWRLRERVDPEGGSLRPWLLGIATNTARNQYRSNRRYRAAANAAAAAQLSVPDHADEVAGRIDDRHRLATALTALAALRRPEREVIALCLGEGLDYEAAAEALGIPVGTVASRLSRARKKLRALAGAEADARPAAKSASASASASASAKKVRGKREGARPGRQTRGDHAHAIRPAQEGNR

SEQ ID NO: 11423 - protein, 369 aa, Streptomyces avermitilis
MNANTSRQHPAEWEEGAQLFTRTARDLPTGRHQFHKERLMAQIQQEQQEQRGEHTGRSAVPAKTRRLRLPRPAIVLPAMAATVAAAVVAGVAMSDGGGVRDGGVATGPALTAEVGAATSKGLPQLLDQISLVAAKESHPVVKPGQYVYIESKTADTFLKTVDDKTSLASHALHRRQVWNSPDGTKGWLIDPAVNTDSAGETLSLPDEQGNTPKGSLNYPTYDYLAKLTTDPDQLLALIYKETKGQGNTPDQQAFTTIGDLLGESYPPAELYSALFKTAAKIPGVVVVPEAVDAVGRTGIAVARLDETSGQREEWIFDRKTHVFLGERSVQVKKNTGTEALMKPGTVTFTSAILHRAVVDGMKQAPSQAG

SEQ ID NO: 11424 - protein, 330 aa, Streptomyces avermitilis
MEYTQLGRTGLKVSRLVLGTMNFGPQTDEADSHAIMDAALDAGINYFDTANVYGWGENKGRTESIIGNWFAQGGDRRDKVVLATKVYGNMAAGGDPWPNHDKLSALNIRRAVDASLKRLQTDYIDIYQFHHVDRSTPFEEIWQAVDVLVQQGKILYVGSSNFPGYKIAQANEIAARRHGTIGLVSEQCLYNLAERRAEMEVIPAAQEYGLGVIPWSPLHGGLLGGVIKKEAEGGRRASGRAADSLANTAIRAQIQSYEDLLDKHGVEPGEAALAWLLTRPGVTGPIVGPRTAEQLDSALRAVELELSEELLSGLDEIFPGPGPSPEAFAW

SEQ ID NO: 11425 - protein, 350 aa, Streptomyces avermitilis
MKAIAFRETGGPEVLRLVELPDPQPGPGEVLIRVAYAGVNYGEVQHRLGDFGAPEGETVTGLEAAGHIAALGDGVTGPAVGDGTGVSGRSFGDGDGARGLSVGDAVAAYLPDGGGYAEYVVAPAAFVFPLGGLDLRTGGGAALVLTTAYGVLAGAARIAPGETVLIHAAAGGVGSAAAQIARALGATAVYGTVGTPEKAAYAKRFGYDAVFVRDGFGDAVRAATGGRGVDIVLDPVGGPTRLAGFEVLAPFGRLAVYGEAGRHPDLRLPVLPLWKNNRTLTGYNIGDLARRDPALVRTHALAALALAAAGDLHIDITDEYALPDAPQAHRVLQSGANRGKAVLAVAPPRP

SEQ ID NO: 11426 - protein, 190 aa, Streptomyces avermitilis
MRLFAAVLPPDDVVRELASAVDELHRLPGADGLRWTGRPGWHFTLAFYGEVDDELVPELSVRLERAARRTAPFPLAVRGGGQFGHGRALWAGAEGDLGTLRLLAERAEAAAGRAGVPMGEHRRYRPHLTVARSRDAVDARPYVEALDTFASRTWTVGELCLVRSRLPKSGVPGEQPRYETVAGWPLGAGA

SEQ ID NO: 11427 - protein, 170 aa, Streptomyces avermitilis
MKIRKGTTDDIPAILGLLDGAVAWLVSQGRTRQWGTRPWTERPGAVEMVHTYVAAGTPWIAEVDGVPAGTLTLSEGPGGYVAPAGEPERYVHLLAADHRFAGHGVGGALLAHAAEETRRAGVSLLRVDCYAGDDGKLVAYYEGNGFVRTEPFTVTVDGADWPGQVLARRV

SEQ ID NO: 11428 - protein, 448 aa, Streptomyces avermitilis
LSTGSGADSAPAPAAHDSPSAPRRSSMFSSLRIRNYRLFFTGQVVSNTGTWMQRIAQDWLVLSLTGSSTAVGVTTALQFLPMLLFGLYGGVLVDRLPKRPTLLATQSAMGVTGLALAFLTLSGHVQVWHVYLAAFAVGLATVVDNPARQSFVSEMVGPGQLQNAVSLNSANFQSARLIGPAVAGVLITGVGTGWAFLLNGLSFIAPIAGLLLMSSRELHVVERAPRGKGQLREGLRYVAGRPELIWPIVLVGFIGTFGFNFPVWLSAYADDVFHAGAGAYSLFNTLMAVGSVAGALLAARRGTARLRVLIASAVAFGALEIVAAVAPSLWLFSLLMVPIGMFGLTVNVTANTAVQMGTDPAMRGRVMALFMMVFMGGTPLGAPVVGWITDAYGARVGFAAGGLVSALAAVTIGLVLARVGGLRLSVGWHHGHPQVRFVPRERELATAA

SEQ ID NO: 11429 - protein, 145 aa, Streptomyces avermitilis
MVDLTHGDDAAAVNALRSAVMRLSRRLKHQRVDESLSPTEMSVLGTLARCGSATPGELARKEHVQPPSMTRIVALLESKGLVRLEPHPEDRRQKVVTQTERAEAMLEESRRRRNVWLAGLVEGLDDDEWAKLRAAAPVLEKLAHL

SEQ ID NO: 11430 - protein, 60 aa, Streptomyces avermitilis
MGTSVLSLRIDGELLERLRHHAAKRGMSVQDYVVRTLIRDDFDERFQAAVDETEKFYGVT

SEQ ID NO: 11431 - protein, 483 aa, Streptomyces avermitilis
MSTSAPAKVPAPEQPGDRPAYGALDRYFKISERGSTLSREIRGGFATFFAMAYIIVLNPIILSSAKDMYGHQLDYGQLVTATAVTAAFTTLLMGVIGNVPIALAAGLGVNTVVALQLAPRMSWPDAMGMVVLAGLVVMLLVATGLRERVMNAVPLGLRKGISIGIGLFIMLIGLVDSGFVSRIPDAAHTTVPLQLGTDGHLNGWPILVFVLGALLTLALIVRKVPGAILISIVAMTVLAMIINAVAHVPSWGLTTPKWPGNPVASPDFGLIGKVSLFGGFSEVGALTGILFVFTVLLSCFFDAMGTIMGVSDEAKLTDAEGNMPGINKVLFVDGIAVAAGGASSSSATTCFVESTAGVGEGARTGFANIITGGLFAVALFLTPVATMVPSQAATPALLAVGFLILSNSVKEIDWADYTIAIPAFVTMMMMPFTYSITNGIGMGFITFVVLRLAAGRGREIPVAMYVVAAVFGFYYLMPALGLT

SEQ ID NO: 11432 - protein, 88 aa, Streptomyces avermitilis
MAKWTPTHEAPEPLEGPVVATITGGTILWFVLFLVQLPFYGWFDDHGHTWWVWTCLAGAGLGLIGIWYVRGRDAAIKRDAAEKQPQVK

SEQ ID NO: 11433 - protein, 797 aa, Streptomyces avermitilis
MTHIDAGAELDPVHPMPLPGRARGLSTAQVAERVARGEVNDVPVRSSRSLGEIVRANVFTRFNAIIGVLWLVMLFVAPFQDSLFGYVIIANTGIGIIQEWRAKKTLDSLALIGEAKPTVRRDGVASEVSTSEIVLDDVIETAPGDKIVVDGVCVETDGLEIDESLLTGEADPVVKHAGDSVMSGSFVVAGGGAFKATKVGREAYAAQLAEEASRFTLVHSELRTGISTILKYVTWMMVPTAIGLVISQLVVKQNDFKNSVARTVGGIVPMVPEGLVLLTSVAFAIGVIRLGRRNVLVQELPAIEGLARVDTVCLDKTGTLTEGGMDVTELRPLGGADEAYVRKVLGALGESDPRPNASLQAIINAYQDSDDWRCTESLPFSSARKYSGASFSEGNGESSTWLLGAPDVLLPADDPALAETEQLNEQGLRVLLLTRAVRDLDDREVKTEARPTALVVLEQRLRPDAADTLRYFAEQNVHAKVISGDNAVSVGAVAGKLGLTGGVVDARALPAERAEMAKGLDKGTVFGRVTPQQKRDMVGALQSRGHTVAMTGDGVNDVLALKDADIGVSMGSGSEATRAVAQIVLLDNSFATLPSVVGEGRRVIGNITRVATLFLVKTVYSVLLAVLVVCWQVEYPFLPRHLTLLSTLTIGVPAFFLALAPNKERAKPHFVRRVMRYSIPGGVLAAVATFVCYLLARHHYTGPGALDAETSAATLTLFLISMWVLAIIARPYTWWRICLVAAMGGAFLLVLVVPSLQQFFALKLVGVTMPWLAVAIAAVAAATLEFLWKWVDRRFPA

SEQ ID NO: 11434 - protein, 303 aa, Streptomyces avermitilis
VGPSPLGECMRIRATVAAATGALALSAFAVPAAQAADSVSRADIAHAWGLSTAASGKSGFRPATAGTAADLDVTFSDMKVNKSKNIVVGTTKEVAIPVTYTLTHAADLDMSEDNFANGPLIYRGSSVDEPTNVFISDEPATCTATSTTVASCVGTIYLRPGDGDLVNADAATWKAGGLAITADGDETVQGDLGTTKVQRYSKLTVNASPEPVKKGRTITVTGALTRANWDTGKYAGYTSQSVKLQFKKKGSSTFTTLKTIKSDSKGNLKTTVTASADGTFRYSFAGTSTTPAVDSAGDAIDVQ

SEQ ID NO: 11435 - protein, 1094 aa, Streptomyces avermitilis
VSKFVRPAAEGADPFGTARLRRGVLDAWAISPARFREDANAEEDLVLGGYRDRLVVELAQNAADAAARSGVPGRLRLTLRDGVLAAANTGAPLDAAGVESLSTLRASAKREGHESAVGRFGVGFAAVLSVTDEPAVLGRHGGVRWFLAEARELAADTARHSPGLGDEVRRRDGHVPLLRLPFAAEGTAPETYDTVVVLPLRDTAAEDLAERLLTGIDDALLLALPGLEEVVVEVGEGDARTLRRLTEGTEHGAAADRTGTDAGQVAPDPSGADRTTTAHRTVRIEDTRDGTTRWRTVSQHGPLAPELLAGRSVEERLRPHWSVTWAVPLDSEGVPAFPRTAPVVHAPTPSDEPLGVPALLIASLPLDTSRRHAAPGPLTDFLVERAADAYAGLLAAWRPVTPGIIGLVPGPLGKGVLDGALRQAILDRLPRTAFLPPAAEGADRQAADRQAAAEGPAESPAEDPADWDAVAPVALRPRDAEVVEGAGADTVRVLAEVLPSLLPAGLERRVELRTLGVARVPLTEAVDRLAGLEKDPGWWRRLYDSLAGVDPDRLSGLPVPLADGRTTIGPRQVLLPTADGPQAAPEALARLGLKVAHPEAAHPLLEKLGALPATPRAVLTTPQVRAAVAASLDDEAPAWDQEGPDAEELADTVLALVRDAGLEPGDEPWLGALALPDEEGEPAPAGELVLPGSPFARVMRDGELAFVDAELADRWGEQPLAACGVLADFALVRTTDVVLDPDELEPRDSDFAEPDDAGLLDAVDVWCEDVLDRLPDTPVPPVATEIVAVRDLDLVDDDCWPQALALLSRPPLRDALIQPVRILLPDGTHEVVRPYTAWWLRGHPVLDGRRPAGLRAAGGDPLLRGLYDEADATGFDDEQVLRALGVRTSVAALLDEPGGAAELLDRLADPEREVSGAQLHALYGFLADLDPERVTLPDELRAVVDGEVVVVDAADAVVVDSPDLLPFTAGTPLLPVPPSRAAGLAELFQVRRLSESVTGEVDSEGVEHDVPESVRVLLGPSTPASYVEHEELVVDGTELDWRRTRDGVLHASTLEGVAAGLAWAAGQWPRRFEVAALIEDPSRTEELARDRWFD

SEQ ID NO: 11436 - protein, 308 aa, Streptomyces avermitilis
VSAATTRSRTPDRLCTEAVDLARAAAEEAAAPGVVGEHVGVVSEGDRVVTHFFECKEFGYRGWRWAVTVARASRAKVVTLDETVLLPGDDALLAPEWVPWSERLRPGDMGPGDLLPTEADDLRLEPGYTGEDEPLPNSAVSEEMAELVEAEDAEVAGGAPAKLPIPPTRGSIAAVAEELGMRRARVLSRYGLHIAADRWEEAFGPKTPMAQAAPAACVSCGFLNRIGGSLGQAFGVCANEFSPADGRVVSLAYGCGGHSEAAVMPKPPRPAEPVIDETKVDPFPLRPSPDSGSVPETTDESSAELGHS

SEQ ID NO: 11437 - protein, 474 aa, Streptomyces avermitilis
VAAAKSPQGAAGIGGVKGSSGSGGSGRVRGAVRSVGRALHFPVTGTARGIRRATHAHGAGESGLGKLIELHAVNGAGDVMITVALASTVFFSVPTDEARGRVALYLAITMAPFTLLAPVIGPLLDRLPHGRRAAMAGAMLARALLALIISGAVASGSLQLYPAALGVLVASKAYGVVRSAVVPRLLPPRFSLVKANSRVTLGGLLATGVAAPIGAGLQALGSRWPLYGAFVIFVAGTFLSFSLPPKVDSAKGEDTALLAADPEHLHGPHRGQLKRPGLRTVGTAVTHALAANAALRCLSGFLIFFLAFLLREHPLTGESAAVSLGIVGVAAGTGNALGTAVGAWLKSRAPEVIIVTVVAFVLAAAITAALFFGAFLVTCLAAVAGFAQALAKLSLDALIQRDVPELVRTSAFARSETLLQVAWVLGGAIGIALPLNGSLGLSVAAGIVAVGWLTTVRGLLGAARHGGPARPRVD

SEQ ID NO: 11438 - protein, 152 aa, Streptomyces avermitilis
VRRRRAVAAAGAVSAGLLVLSACDKPTPLSTITVGQSSVSSEASCYNDGKPLATADLAKCLKDTDIKSIKVDPDETVRFGVDPDVAKKGWTILMNGQALTEASKKTYRTIPGSVFFNAQYGASGNSTLVSIQEGEKAPFTGLWSFKLKKDAG

SEQ ID NO: 11439 - protein, 223 aa, Streptomyces avermitilis
VARAFTPAPHEVPLPGATLHRILHGSGGHDLLAAGVGPALAAASTATALTAAALAGTPYDLVVSAGIAGGFQPDAPVGSLVVADTITVADLGADTATGFLPVTELGFGTVTHHPPETLVRAVADSTGARAGVVLTVSTVTGTAERAAELRARHPRALAEAMEGFGVAEAAAAHGTPVLEIRAVSNPVGPRDRAAWRIGDALAALTEGFGKLAPALESWNPHEL

SEQ ID NO: 11440 - protein, 284 aa, Streptomyces avermitilis
MSSESRPLQIAYSPCPNDTFVFDAWAHDRVPDAPALDVTFADIDITNGMAERGEFDVLKVSYAVLPYVLDEYALLPCGGALGRGCGPLVLTREADADLTGRTVAVPSEKSTAYLLFRLWAADTVPGGVGEIVVMPFHEIMPAVRDGKVDAGLVIHEARFTYQNYGLHKLADMGEHWERTTGLPIPLGAIIAKRSLGVETLTRLASATRASVRAAWADPAASRPYVLEHAQEMDPAVADQHIGLYVNEFTADLGEDGYAAVRGLLTRAAAEGLVPPLGPDALNFP

SEQ ID NO: 11441 - protein, 127 aa, Streptomyces avermitilis
VPTGKVKWFNSEKGFGFLSRDDGGDVFVHSSVLPAGVEALKPGQRVEFGVVAGQRGDQALSVVLLDPTPSVAAAQRRKPDELASIVQDLTTLLENITPMLEKGRYPEKTSGKKIAGLLRAVADQLDV

SEQ ID NO: 11442 - protein, 209 aa, Streptomyces avermitilis
MAHMTSRALTVGFDLDMTLIDSRPGIHACYQALSARTGTYIDADLAVTRLGPPLADELVNWFPAEQVAAMADVYREMYPTHAIAPTPAMPGARAAIAAVQAAGGRAIVVTAKYEPNAKLHLEHLGIEPDAVIGDLWAEGKAEALLEHAAGVYVGDHTGDVRGARTADAYAVAVATGPCDAAELRAAGADVVLADLTEFPGWLESHRSRS

SEQ ID NO: 11443 - protein, 179 aa, Streptomyces avermitilis
VPGFTGGVEIPEILKPPQEDSAREDRPHGAGQGPGAEPVVDASPAGAPAGEEAAAAPPRRMLLRPRLSGWSNPLLLLAAGLLVAGAVLGNWFALGLGWLIAYASRRLTPVESKWAVLGLPGAAAAAGIVWLWGRTERRWGDPIATGHMNDAVTETWPWVVRGAAVASALFLVWRSQRRR

SEQ ID NO: 11444 - protein, 47 aa, Streptomyces avermitilis
MRRTTAGLSTGVFARRRSISLRSSETSRIRVPDGSCRCWARSPTRLR

SEQ ID NO: 11445 - protein, 860 aa, Streptomyces avermitilis
MSNEDKPAAAPRSLAEALRARDDASLSALLRARPDLITPVPTDLTQLATRAGTRASVVRALERLDRFTLQTAEALAVAPDPATYDELLALMAGDDADRAVTNALPRALAALRDQALVWGSDDRLRLVRTARELLAPSPQHPSPTGLGPTVAEATAGMSPGRVQEILTAAGLPTTHDAVSAVASLGALFSDRTRMSALLDEAPADSLDVLSRLVWGPPYGQVTADPATRLRWLLDRGLLLPTAPGTVVLPREVALHLRAGRAHRSTEPLPPQVEIAATHRPPLVDATAAGQAYTALATVEELLKDWHEGGPAVLRAGGLSVRDLKRTAVALDVPEPTAAFWVELTYAAGLLASDGEAEERYAATPAYDEWLELPAAERWSRLATAWLAATRTAGLVGGRDAKERTLSALGPGLDRSAASEVRRRVLALLADLPEGASAAPASVLARLRWERPLRGTHPSPSPSSAPSSSDDLRTRLAEWTLSEAEQLGFTGRGALSSHGRALLGAPPAPAKPPAPSGPGDKLPVHHRHHDMPAEPQAAPLSPAEQAAAAAEATRLLAPLLPSPLDHVLLQADLTAVAPGPLERPLADTLGVLADVESKGGATVYRFTPASVRRALDAGRAASDLHAFLAAHSRTPVPQPLAYLIDDVARKHGHLRIGAASAYVRCDDDTLLNEILADKRSAGLRLRRLAPTVLAAQADPATLLEGLRAMGFAPAAESAEGDVLITRAHAHRTPPRAAPEPVPDGPPVPDTTLLTAAVRAIRAGDLASTAPRKPTADPAGADGGLPRTSSAETLATMQAAVLTGEAVWIGYVNAEGTASQRVIAPIRVEGGFVTAYDHTADEVRTYPLHRVTGVAELADDQA

SEQ ID NO: 11446 - protein, 547 aa, Streptomyces avermitilis
VNGPLIVQSDKTLLLEVDHEQANECRRAIAPFAELERAPEHIHTYRVTPLGLWNARAAGHDAEQVVDALVQYSRYPVPHALLVDIAETMDRYGRLTLSKHPAHGLVLTTTDRPVLEEILRSKRVAPLVGARLDPDTVAVHPSERGQIKQTLLKLGWPAEDLAGYVDGEAHPIELAEDGWALRPYQKQAVENFWHGGSGVVVLPCGAGKTLVGAGSMAQAKATTLILVTNTVSARQWKHELVKRTSLTEDEIGEYSGTKKEIRPVTIATYQVLTTRRKGVYPHLELFDSRDWGLIVYDEVHLLPAPVFKFTADLQARRRLGLTATLVREDGRESDVFSLIGPKRFDAPWKEIEAQGYIAPADCVEVRVNLTETERLAYATAETEEKYRFCATTATKRKVTEALVRKFAGQQILVIGQYIDQLDELGEHLNAPVIKGETSNAQREKLFDAFREGEISVLVVSKVANFSIDLPEATVAIQVSGTFGSRQEEAQRLGRVLRPKADGHQAHFYSVVARDTIDQDFAAHRQRFLAEQGYAYRIMDADELLTES

SEQ ID NO: 11447 - protein, 398 aa, Streptomyces avermitilis
VARARRFVATARATAPAPAPALSRLARLRHPATASVVLLACSLGSFGALCLLQGVPMADALVYRAAGAAVLSGADLYGFTVTEWGLPATYPPFAALLFVPTTWLAPGALKVAFVAGNVALLAALVRLSGRLAGRPAPLPAVCAATALALWLEPVFQTVLFGQINLALACLVLWDLTRPGARCRGAALGIAAGVKLTPAVFIVYLLLRGRRREAATAAAAFAGTVLLGALLLPAASVDFWTRRIFETGRVGKAWIVDNQSLQGLVARVLGEPSPGLAWALPTAVVAGAGLWLARRATSERRGILLAAFTALLVSPISWSHHWVWCLPLIAVLYAEGHPRQAAATAAVFTARTLWLLPHQGDLDLQLSWWQQPPASPYPLLALLVLVQLSVRSSSASMIR

SEQ ID NO: 11448 - protein, 83 aa, Streptomyces avermitilis
VRVTSWDRRIRRGRIHDGCMSAATFSPGPARHSPASGATALRADVHHRHLLGDALRAVKVFARAAMDVVLLGEYGEEAGVHRR

SEQ ID NO: 11449 - protein, 682 aa, Streptomyces avermitilis
VSSLSESPADPLSRERAHLAGSRAALRAMREDVENLDIRDVTANWVNAEVLARQIDDRIKALADLSHTPLFFGRLDYLHAPGADRAEGAEGERFYIGRRHVHDAEGDPMVIDWRAPVSQPFYRASKKDPLDVGLRRRFGYTAGDLTAYEDEHLSDPAEAATTSKLLQQEIERPRVGPMRDIVATIQPEQDEIVRSGLSGSVCVQGGPGTGKTAVGLHRVAYLLYAHRERLARTGTLVIGPNRSFLHYIEQVLPALGELEVKQATVDDLVAHVEIRGTDDAAAAVIKGDARMAEVLRRAVRSHVTLPTEPVVVVRGSRRWRVPAYELEQIVRELMDRDIRYGAAREALPQRIAHAVLVQMERSGEAPDDRVQDAVARNAAVKAAVKAIWPPVDPAKLVLRLLTDADFLAVHADGVLEEDERKEILWARPVRSTKTAKWSAADAVLIDEATDLVQRTHSLGHVVLDEAQDLSPMQYRAVGRRCTTGSATVLGDLAQGTTPWATRSWDEALAHLGKGDAVIEELTAGFRVPTDVITYASRLLPHIAPGLTPVASVRENPGFFEVRTTATDAAVIDACAELLRNEGSIGLIAADARVPALAEALTAAGIGHLGPGEETTHDTRLTLVPASLAKGLEYDYVVLDEPRAVVDGEPDERTGLRRLYVALTRAVSGLIVTHTAPLPSQLG

SEQ ID NO: 11450 - protein, 409 aa, Streptomyces avermitilis
MPSIRRRGVTAATAVIAAVLVTATACDSEKTDDAKASPSSSAQADQKIDTGQDDGDTTIGGYKLPAGVPTDLTGEALRQWKNGGWKDYSNWASKAEDFANPYIENFWTPEKMAEAKANAPAVVDAGSASSGSSGTTKTYLPDGTVKKKSATRVAASYHHSAPPVGKLFFSSPQGSMVCSAAVVTDPAHPGKSNLVWTAGHCVHAGKGGGWYRNIAFVPSYNNDARLNIQQASQNARSKSVSPYGIWWSDWATTSGAWIKGGAHQATTAYAYDYAVLHVKPEKGGKSLQEQIGSALPVWFNAPSAKKIKTMKARGYPAESPYDGSKMYDCRGATKRLVLGYRYPSDYPAQYMLGCTLNGGASGGPWFLAHNGRTYLVSNNSLSDRRTFVSGPRLGKNAKQVYLATSNKFK

SEQ ID NO: 11451 - protein, 232 aa, Streptomyces avermitilis
MSTRAVLEVIALDAEDAVAAQAGGADRLELVADMSADGLTPPVETFARIRAAVDIALRVMLRPADGFAAGDADRFAALVRAAGELRAAGADEFVFGFLGEDGGADLDAVERLVADLDGCHWTFHRAIDRAADRDALRKQLADLPGLDAYLTAGSADGVDDGLPTLLAEAARSGEPGYTQRLLVGGGLRLDHVPRLRAAGIDAFHIGGAARPAGWSGPVSAQAVQEWRTAVDA

SEQ ID NO: 11452 - protein, 225 aa, Streptomyces avermitilis
MTIADRYDDVRDPELPGRLLSTERDALIPLLRARPDGDFALRTACPGWTVRHVLAHCSAALTRVVESRFEEGVFSPEANERDIAERGDWTNTQVVDELERGMTEAGAVIAKAGGALDMVALGEWVHAGDVREAFGEPGAYGGGGLAHALLLLAHVSREKRHVPLHADLDDLDEPLLLGDAAGDRTPARYIGDAPTLVRLYAGRPLVGTRYELAGAGERELNIFGR

SEQ ID NO: 11453 - protein, 225 aa, Streptomyces avermitilis
MRRMVDHDALHRRWLGALVGARGGAAQPDPAPYGENLLRRWSEPQRRYHTVEHLAAVLDRVDLLAEYADDPDVVRLAAWFHDAVYFPDRSENEERSARLAERALPEAGVSGARTAEVARLVRLTVTHDPADDDRDGRVLCDADLAILAAPPKTYAAYAAAVREEYAFVPDDSFRAGRAAVLRQLLDLPRLFRTPYGEREWEERARENLREELARLDDRGTSGAAQ

SEQ ID NO: 11454 - protein, 328 aa, Streptomyces avermitilis
VRTPWQRALDSAGITTAKLRRDYTTAARRLLTRETAGYAAVRALLPARLQPHLVAATAFSCATDDIVDAERPVAVRTAAFGRWREATRTALDTGRSRFPVLRAYAHTAAVCEQSPGGVLEYLEGTAGDLEFTGFETEAAYQAYVDRLTLPFLMISTGLQYPGGGDPAVRARWRPFADASQRLDFLTDLHTDLRAGRLCLPREDLTRHGVTVTDLAGARDTYGVRRLIAETCARTRAALTEAHGVLEIATPDYQPLVRAGLSLWEHRLNEVERRGAAVLRRPVSTGIREPLSILLRETRERGRERERGQRQGQGQGQGRASASDGVFSD

SEQ ID NO: 11455 - protein, 94 aa, Streptomyces avermitilis
VTLYIDPPTWPGHGHLWSHLVSDVSFDELRLFADGLGVPRRAFERDHYDLPSHRYADAVRAGALEVSSREVVRLLHASGLRRPKHRGPAGPVSR

SEQ ID NO: 11456 - protein, 127 aa, Streptomyces avermitilis
MDPISPLEQALHAARALVLADLVAGQVAEADVVSLVEESVVERRWWLEQWPDGADYVAGLVAQDVQDALLERYGRWPLCPVCGAGDPHALDVEPELGPDPHWVCHKAGVKVASVGTLGSATGGKSSS

SEQ ID NO: 11457 - protein, 308 aa, Streptomyces avermitilis
VTHDVKEIFAGTTGGAPPAPAALAAKVRTLAPSMTRSMQRVAEAVAGDPAGCAALTVTGLAELTGTSEATVVRTARVLGYPGYRDLRLALAGLAAQQQSGRAPAVTADIAVDDPIADVVAKLAYDEQQTLADTAAALDTVQLGAAVTALAAARRVDVYGVGASGLVAQDLTQKLLRIGLIAHAHSDPHLAVTNAVQLRAKDVAIAITHSGSTGDVIEPLRVAFERGATTVAVTGRPDGPVTQYADHILTTSTARESELRPAAMSSRTSQLLVVDCLFVGVAQRTYETAAPALSASYEALAHRHRNTPR

SEQ ID NO: 11458 - protein, 311 aa, Streptomyces avermitilis
MTSMSHHRSLQAELETLTTEAFRPELAEIDQLPTLEIARLMNGEDATVPAAVAARLPQIAAAIDAVADRMARGGRLVYAGAGTAGRLGVLDASECPPTFNTDPSEVVGLIAGGPSAMVTSIEGAEDSKELAAGDLAGLGLTADDTVVGVSASGRTPYAIGAVEYARARGALTVGLSCNADSALAAAADHGIEIVAGPELLTGSTRLKAGTAQKLVLNMLSTITMIRLGKTYGNLMVDVRASNEKLRARSRRIVALATGAADEEVERALAATDGEVKNAILTILGGVDGPTAARLLEESDGHLRAALAAAPR

SEQ ID NO: 11459 - protein, 545 aa, Streptomyces avermitilis
VRTTPHSATAAAILPLVGGAANVTSVAHCMTRLRLGLADRSLVDEESLRALPAVLGVVDDDTYQIVLGPGTVAKVTPEFEKLLASETTEAPANALPVTAGAPTPAAPTAAEGPATSETPVAAEPPARGSAPGTEAARLAARGAALKAAQRQRHATPVRLLLRRIANIFVPLIPALIGCGVIAGVNGLLLNLGWLPSLTPALAAVASGFMALIAVFVGHHTAKEFGGTPILGGAVAAVIVYAGVAKVTVFGTTLSPGQGGVLGALAAALLGTYVEKWCRTWVPDTLDVLVTPTLTVLLTGLVTLYGLMYAAGAATSAIGTAATWLLSTTGVFAGLILGGLFLPLVMLGLHQALIPLHTTLIEQQGYTVLLPVLAMAGAGQVGAALAVYVRLRHDHSLRTTIRSALPAGLLGVGEPLIYGVSLPLGRPFLTACAGGAAGGAFVGLFSMLGDRIGSTAIGPSGWALFPLLAGSGGLLPSAAIYAGGLLTGYAVGFGATYFFGSFGVVGGVCEAERTDIAAPTGTAAPAMTTTPTDTAAPHDPEGNRTL

SEQ ID NO: 11460 - protein, 195 aa, Streptomyces avermitilis
VNHAQLTALGRALRLVGEHGEALSSQTPDARLHEVKADLKRALDLLEDSVSAAAPSTRCAEHPNGPVDEDAPDLCLLCETRRRAARRSQVNDTYPHGRPPGADGTAERAQSRYGVRGDRPQPQQRWLPELWNGQVWQLCGTPRRDKREAEQYLAAQRRGPRPAMAYRLVHEFTDYEVLRIWGEPLKVDIEPMGNL

SEQ ID NO: 11461 - protein, 125 aa, Streptomyces avermitilis
VLVPMSSVRRSEDRGKWAVVVLTGEVDCDLTPALREAVDSLTAEDHGLIVLDLGQVSFMDSAGLGVVVYGMRRAGALGGRLRLAGPGEQVRELLRLTGLDAAVEVFGDVPAACAYGPTPKGLERI

SEQ ID NO: 11462 - protein, 574 aa, Streptomyces avermitilis
MGCVESSPGGDEDFDANEALTSALFEAVGAGMYAVDGQGKVIACNPWAERLLGYAPGTLLGVDAHHTLHPMEGDENGLPAQRPVLADIVLGKRISGDRAVLLRADGTPVQVWWSAAPLPEEMGYDKGAVVVFHDASARRARDGRRARRYAHSETMREQAEYDLSEITWLSELTLAMVSTLDADEALGRLVRQLVPRLADTALIDLTAGLTRRRAAATHHLPGVLPSGPHDIGEPLPGHPAHDAALSRVFGGAGTQHLTAPLPAGPAYPGRDLFALVDAHEALVVPLRLRASTFGALTLVRAPASPPFNEADRILAEEVARRAALGLDNTRLHAAQADIAATLQRALLTDLPTVPRLELAAHYQPAQRAAEVGGDWYDAFLLEDGDLAMAIGDVTGHDIQAASRMSELRNMLRALVVDRPEENPGQILRRLDTAQARLTLADSATAILTRLHPTADGTWDLAWSVAGHPPPLLITADGTATYLTGPRAMLLGVRPTAERPTAHTRLPGGATLLLYTDGLVESRAQPFDVGMTRLRQYATTHRQLPLHRLCAQLAHDLGDTRDDITLIAARTPPTA

SEQ ID NO: 11463 - protein, 375 aa, Streptomyces avermitilis
VTVTTDATDRAAQILSRPVTLNGLTVPNRIVMAPMTRQFSPGGIPGEDVASYYARRAAAGVGLIVTEGTYVGHESAGQSDSIPRFHGEEQLAGWSKVADAVHAAGGTIVPQLWHIGMVRGAGEPPFADAPPVGPSGIGTEGAEVTGKAMTQQDLDDVIEAFAKAAADAERIGFDGVELHGAHGYLIDQFLWAGTNRRTDAYGGDPVARTKFAAEIVAAVRSAVSPSFPVLFRYSQWKQQAYDARLAETPEELEAILAPLAAAGVDAFHASTRRYWQPEFDGSDLNLAGWTKKITGKPAISVGSVGLNGEFLKAFQGEGSTVRGIDDLLDRLESGEFDLVAIGRALLQDPEWAAKVLAGRFSELAAYDASSLKTLH

SEQ ID NO: 11464 - protein, 855 aa, Streptomyces avermitilis
VKSGSRLSIRCDRFEHRANKRTLMGRHIRRMAALAAPLALGATLLAPATAQAETVVSGNYTSVFNYPKPTTYDSSINTSVGDLIDLAAPSSTLYMGMYWFNSSDLRAKLTAAQTRGVTLRIISESANRPSSDLDSLALTGNSTLTWCSRGCLGNGSGDTNAIDHDKYLVLDSLTDGRKNVVWQASQNLAGGQDGEINNAVVVSGNATLASRYRAHFNDQVKHAGDSLHTTYDYSTGDPSSPVEAYFSPRDTASDAAHYGNADILASFIDQVDCSNDGKIRISAAELDQRTTRPAVYDALATKRSQGCSVDANARDLSDGGGNDGINDLTALDIAAYGNRPGGCRYKTSAGASCNHGTTHSKYLLTEWKKSDGTQVQHVYTGSHNWTAGSLKTNDETILRIDDAGTYQAYVANFNKVRASAVDLDAAKYGSTSQHYSRVNVNANGDQHYSAVASGGTSSVYTAVAYEQGDRHDSSDSELGTDVYLRLYKDGAPLWDEKLLSNGNTGTGTTWSHQKPDVGVDDQGNAIVVWAKDDDGNKYADIAVRKVTPDGTVTTLPRPHASGDGDQLRPTVAVAGDGSYSVAWENTADGSTLNQVYASSWSATGALRYQDVQVSTINSGAAGSNRRPDAAIDNAGNTVIAWEEDADGNGGLNIGVAKLNTSGGFTVARKVGNSLTDGQQTKPAVASAGDGRFVVAWTDEYTTGAGTLVRPQRINQRFFSAAGSPAAADQRTTEDGTSSGPYVDGKRPISDQTDADVTVADDGTFVVAWKEAFDVLVGNPATLYAGKDDVWARGFNADGTTTGRFPATRMNVVTGGGQGGPAVAVASNGRLALTYSDDYDGNGHNEMRLRDAFSNS

SEQ ID NO: 11465 - protein, 541 aa, Streptomyces avermitilis
MAKIIAFDEEARRGLERGMNQLADAVKVTLGPKGRNVVLEKKWGAPTITNDGVSIAKEIELEDPYEKIGAELVKEVAKKTDDVAGDGTTTATVLAQALVREGLRNVAAGANPMALKRGIEKAVEAVSGALLEQAKDVETKEQIASTASISAADTQIGELIAEAMDKVGKEGVITVEESQTFGLELELTEGMRFDKGYISAYFATDMERMEASLDDPYILIANSKISSVKDLLPLLEKVMQSGKPLLIIAEDVEGEALSTLVVNKIRGTFKSVAVKAPGFGDRRKAMLGDIAILTGGEVISEEVGLKLENASIDLLGRARKVVITKDETTIVDGAGSADQVAGRVNQIRAEIENSDSDYDREKLQERLAKLAGGVAVIKAGAATEVELKERKHRIEDAVRNAKAAVEEGIVAGGGVALIQASSVFEKLELTGDEATGANAVRLALEAPLKQIAVNGGLEGGVIVEKVRNLPVGHGLNAATGEYVDMIAEGIIDPAKVTRSALQNAASIAALFLTTEAVIADKPEKAAAGGAPGGMPGGDMDF

SEQ ID NO: 11466 - protein, 68 aa, Streptomyces avermitilis
MAQGTVKWFNAEKGYGFIAVDGGADVFVHYSAIQMDGYRTLEEGQRVDFEISQGQKGPQADMVRLATG

SEQ ID NO: 11467 - protein, 91 aa, Streptomyces avermitilis
MSVNVRIPTILRTYTGGKAEVPAQGATLAEVIADLEKNHTGIAARVLDDQGKLRRFVNVYVNDDDVRFEQGLETVTPDGAGVSIIPAVAGG

SEQ ID NO: 11468 - protein, 432 aa, Streptomyces avermitilis
MAAQTVASTSVTSPANSVDLGPAAALSCRECGHRVPLGPVFACDECFGPLEIAYDFSGYDTEELRKQIEAGPANIWRYAPLLPVPADVAEKPNINPGWTKLVQADNLARELGVDAGKLFVKDDSGNPTHSFKDRVVAQAIEAARAFDFTTLSCSSTGNLAGAVGAAAARAGFRSCVFIPHDLEQGKVVMAAVYGGELVGIEGNYDDVNRFCSELIGDPAGEGWGFVNVNLRPYYAEGSKTLAYEICEQLGWRLPDQLVVPIASGSQLTKIDKGLQELIKLGLVEDKPYKIFGAQAEGCSPVSVAYKAGQDVVRPQKPNTIAKSLAIGNPADGPYVLDIARRTGGAVEDVNDEQIVDAIKLLARTEGIFAETAGGVTVGVAKKLIESGLLDPTLTTVVLNTGDGLKTLDAVAGTGLTATIRPSLDSFREAGLA

SEQ ID NO: 11469 - protein, 314 aa, Streptomyces avermitilis
VLNEVERWLSTRSWSLTDRPLHKIMAAKRSSGSSVSVVLPALNEEETVGEIVAVIRHDLMHQVPLVDEIVVIDSGSTDRTSEVAAAAGARVVHRDEILPRLPAVPGKGEVLWRSLLVTSGDIVCFIDADLKEFSSDFVSGIVGPLLTDPGVDLVKAMYDRPLGGAAGQGGRVTELMARPLLNMHWPQLAGFVQPLGGEYAARRSLLEQLPFPVGYGVELGMLVDALHLVGLDALAQVDVGVRKHRHQDGQALGRMAAAIYRTAQLRLARGHLIRPALTQFERGEDGFEPRTYSVDTEERPPMAEIAEYARRKAA

SEQ ID NO: 11470 - protein, 463 aa, Streptomyces avermitilis
MASTRGAQILVASNRGPVSYTLDETGTLTSKRGGGGLVSGLSAIGPDAGALWVCSALGEGDREAVRRGVGEPGVRMLDVDAEVHADAYNGIANSVLWFVHHMLYQTPLEPVFDAEFRRQWAAYETYNHAFAAALAEEAAEGAAVLVQDYHLTLVPRMLRELRPDLRIGHFSHTPWAPSEYFRMLPDDIAAQVLGGILGADRAAFLTQRWADAFTDCCHAVLGPGIPSGTRIGVHGLGADADFLRERAHRPDVEERMAALREEVGEGRKTIVRVDRTELSKNIVRGLLAYRELLASRPDWRERVVHVAFAYPSRQDLAVYRDYTAAVQRLADEINAEYGTPGWTPVVLHVKDDFARSLAAYRLADVALVNPIRDGMNLVAKEVPVVSDEGCALVLSREAGAYEELGEDAITVNPYDVVGTAVALHEALSMPAGERAERTKRLAGAATALPPARWFLDQLHALDT

SEQ ID NO: 11471 - protein, 287 aa, Streptomyces avermitilis
MGSHTDSTDSRDSLPTPATPAGRDGLDAILARPGRAVLAFDFDGTLAPIVPDPDQARAHPDAVPALAALAPKVASVAVITGRPAGVAVRYGGFAGVPGLEHLVVLGHYGAERWDAVSGTVKAPAPHPGVAAVRAELPGFLDRIGAWQGTWIEEKGRAVAVHTRRATDPQAAFEALREPLTDLATRHGLIVEPGRMVLELRPPGMDKGVALLEYARETGAEAVMYAGDDLGDLPAFAAVDKLRSDGVPGLLVCSGSSEVTELAERADLVVDGPPGVVSLLYALAARLG

SEQ ID NO: 11472 - protein, 81 aa, Streptomyces avermitilis
LAVMSSMEELSPREQAVLALERRSFGGPGAKERAIREQLGLVPVRYYQLLNALLDDPRALAHDPVTVNRLRRVRENRRAER

SEQ ID NO: 11473 - protein, 425 aa, Streptomyces avermitilis
VQRRTTGLIAVLSALGMTATLAGCGSSEDSGDVTLKLVAADYGDSSANSSQKYWDTLVKEYEAKHPGIKVEVSVYSWNDVDRKVKEMVAAGKAPDMAQIGAYADYAAAGKLYTADDVLSIPVQADFVSELSTAGQLNRVQYGMPFAASTRLLFYNKKLFAQAGITGAPKTWDELAADAKALKAAGVKTPYALPLGPEEAQAETMQWLLSGGDGYLSSVGTYNLDSAQNVATFAWLKDELVGKGLTGPTAPAKLNRAAAFAAFTRGEVGMLSGHPTLMKMAAKKGVKFGMVPMPGVDSGPKATMGVADWMTAFRKNGHKQQIGDFLDFVYNEKNVLAFSHEYDLLPVTNSASEAMAADKDDADMGPFLEELPTSQLYPVGKTSWASVSADIKKQIGKAVSPSGNPAAILGQLQRTADAADTSDIAE

SEQ ID NO: 11474 - protein, 301 aa, Streptomyces avermitilis
MKAALVGASGELLHQARRATGRERGPDAVVDTVLGFAAELRAYGERHLGEPAAAAGVAVPGIVDAGRGLAVYAANLGWSDVPMRKLLGERLHGVPVALGHDVRTGGLAEGRIGAGRGTDRFLFVALGTGIAGAIGIDGTVEAGAHGFAGEIGHIVVRPGGTPCPCGQYGCLERYASAAAVSQAWAQASGNPDADAASCAQAVESGDERAVRVWRRAVDALADGLVTALTLLDPRTLIIGGGLAEAGETLFTPLRAAMERRVTFQKLPALVPAALGDTAGCLGAGLLAWDLLSTHDSPEVTA

SEQ ID NO: 11475 - protein, 381 aa, Streptomyces avermitilis
MATSNVLAGARVVLPTGIVDGGRVIVEGTRIAGASSEDAPVVDLSGHWLVPGFVDLHNHGGGGASFTSGTAEEVLRGVHTHRLHGTTTVVASTVTGEMDVLAQRAGLLSELAEQGDIAGIHFEGPFISPCRKGAHSEELLRDPDPAEVRKLIDAARGRAKMVTLATELPGGIDSVRLLAEHGVIAAIGHTDATYEQTVEAIDAGATVATHLFNAMPALGHRTPGPIAALLEDERITVELINDGTHLHPAALQLAFHHAGAGRVAFITDAMDAAGFGDGRYLLGPLEVEVSEGVARLMEGGSIAGSTLTLDRALKRAVTVDGLPVEDAVAALSANPARLLGVYDQVGSLEPGKDADLVVLDAEFTLKGVMRKGEWVVDPQLG

SEQ ID NO: 11476 - protein, 309 aa, Streptomyces avermitilis
VILTVTLNTALDITYRVRALTPHASHRVTEMAERPGGKGLNVARVLAALGHEVTVTGFTGGATGRALREQLAHTPGVVDALVPVGGATRRTIAVVDETTGDTTQLNEPGPTVTPAEWAAFQEAYGELLRSASAVALCGSLPPGVPVGAYAGLVRAARAQAVPVLLDTSGEPLRRGVAARPDIVKPNAEELAELTGSHEPWQATRDARRRGANTVVASLGAEGLLAVNAEGHWRATPPHRVRGNPTGAGDSVVAGLLSGLVDQLPWPRRLARAVALSAATVLSPVAGEFDRRTYEELLDRVAVTGDATAA

SEQ ID NO: 11477 - protein, 316 aa, Streptomyces avermitilis
MTPGNNGASTPEDDDPFGYLYADGQANGATPPSGGGGYGYPGSVNRVRAVGERQYGQQNATAAYGQVPQQGTYGQQQPGYGQPNAHYAAPETVPGGAVTSRQAPVGGGRGRGPNTKGLLIGAIAVVAAVVIGITVVMVGGDSDDDKNGSEAGSTPTAAQSAEPSKSAGQKSPEAGKLPTIDAKALKLDGGATTASDVEGAKADGGIYVSGLSTVGAQVTWTVNGIPKDGLYTVFARYNVVGENQSMTVTVNNKTFGSKLNLGNFTGATDPAKGWMKTYAWPTLTKGTNTISISCQDGDKCNILLDQLWLKAGKVKD

SEQ ID NO: 11478 - protein, 568 aa, Streptomyces avermitilis
METESEPYVRLTTLRQLHQVMADMNTARSLADTLQTVADGVVNGLGYELACVNLVRPDGDLVVAAFAGNSAAEALITGRVGSRVSWDRRLDMGEAWGDLRFIPHTEGWVLDEDDVPQWYTDGPEPRFEDEWHPSDRLFAPMYTPGVQGASCGELIGVLSVDRPRNGRKPGAWGREALQMYAFQAAIAISNARLRANMQRALVRLEREQQALRASEESFRQAFEYAPSGMAIAEMGGDQHGRILRTNDALCRLLGRPASAMRRYSFSDLVHPEDIGTLLRTSAEGGRAELRLGRRDGTYVWVSLRNSVVADAADGPRFLLTHVEDIEERKRRELQLAHRASHDSLTGLPNSAELRSRLSARLCRRPQSAELGAVESLDAAYAHGQYTTEHPAAYDTSGHGEQPGHGHGFDFTQGPGPYDAFDHHVHTVAPEGQTDDGTKGLAVLFCDLDGFKSINDRFGHNAGDAVLIEVARRLSGAVRDGDTVARLGGDEFVVLADGLGRADAQDLAVRLRNEIIQPVRVDGRTMRVGASFGIGWAHCGMTADEVLKSADERMYVEKRSRPKQHRRAG

SEQ ID NO: 11479 - protein, 192 aa, Streptomyces avermitilis
VLNTPPALPPAAVPAAPPVHAEGVSNDEFRAAMSRLAAGVVLVTAHEPALDPDGPGGEDIGMTATAFVSVSLDPPLVMVSLREGSRMDDLLAEQPLWAVSVLSDNQRHIAGRFAMKGRISDRLLFQDIPYVRGEAAGALLVGGALATLECRTEQRVAAGDHTLVIGRVLTADVPGADGGPLVHFRGRYRHLE

SEQ ID NO: 11480 - protein, 142 aa, Streptomyces avermitilis
MSGPYVIRGSVSLPEAELMWRFSRSSGPGGQHVNTSDSQVELRFDLAKTEALPPVWKERALAKLAGRLVDGVISVRASEHRSQWRNRETAAVRLASLLAEASAPPPKPRRATRIPRGINERRLREKKQRSDTKRGRTGRDWG

SEQ ID NO: 11481 - protein, 191 aa, Streptomyces avermitilis
MAVSLSKGGNVSLTKEAPGLTAVTVGLGWDVRTTTGTDFDLDASAIAVNPTGKVYSDAHFVFFNNKQTPDQTIVHTGDNRTGEGAGDDEAINVNLAGLPADVDKIVFPVSIYDAENRSQNFGQVRNAYIRIVNQAGGAEIARYDLSEDAATETAMVFGELYRNGAEWKFRAVGQGYASGLVGIAQDFGVNV

SEQ ID NO: 11482 - protein, 284 aa, Streptomyces avermitilis
MPPRDIPTARQARLGAELRKLRELAGKTAREAAGLLSTDQAKISHIEAGRIGISEERIRRLAVFYACDDRDLIEALCAIARESRGQGWWDEYRGVLAPGFLDIGELENHATYLRTVAVMTVPGILQTEDYIRAIHRSATPPLPAEEVDARVEFRLKRRSIFDRDTPPPFRVIVHEAALRMRFGGRKVAKGQLEYLLEASEWPTVTVRVIPFTCEDFVEATYPLLYAGGVVPQLDTVQMDSPVGGVFITAAAQLKRYVGMLDTAERSSLSELESAQLIHRIAREL

SEQ ID NO: 11483 - protein, 138 aa, Streptomyces avermitilis
MNATLITPGTYHLTTPNSPLTPKICRDTVAILLATNGHAPGLADTARTLVSELVTNAVLHTASPTIDMETAVLSDGVRVAVYDDSPAAHLEPLAPAWDGEGGRGLLLVQALAQAWGVATARPYGRKHVWFELRSGSGG

SEQ ID NO: 11484 - protein, 318 aa, Streptomyces avermitilis
MRLDALPLTPDHDIPAPLLTELTALYAAHREFHALSGDFPDPDDIRPEQVAAALADELANPDVEVLLARSAGRLVGVVITLAHHPDPADPDPWIGLLLVAVEEQRRGYGRELAARVEERFRAAGRTAVRLAVHDDNPGGLAFWTALGYEVVDHRTDRQRGRPCAVLRKPLPSATPRTPRRAARVAVLDPGGAVFLFRYDNEEVGVHWALPGGGLDPGESAREGALRELREETGWTDLEPGPPLCTWEHDFTRAGVPVRQLEHVYVARGPRRDPVGDQVGAAHAEDGILGWRWWTPQELADSPEALWPPHLPRLLAELD

SEQ ID NO: 11485 - protein, 349 aa, Streptomyces avermitilis
MPSGGCCRDGPGAGRLLRAWRYGHGLCWPARTAAVTPRVAARMGVNRGTVTKWRARFLRDRLDGLADEPRPGVPRTITDAQVEEVVVRTLEETPEGATHWSKRELARTVGISPASVLRIWHAFGLQPWRTETFKISPDPLLIDKIRDVVGLYLAPPANAAVFAVDEKPQIQALERTAPVLPMLPGVPERRSFDYVRHGTVDLFAALNTATGRVITKLSAQHRAVDFRDFLDEIDRQTEPGLAVHVICDNLSAHKAPVVHKWLLAHPRFRLHFTPTYSSWINQVERWFAELERRCLERGVFCSLDSLKAALEEWIKVWNEEARPFKWTKTADQILDRICRYCSRISEPAH

SEQ ID NO: 11486 - protein, 469 aa, Streptomyces avermitilis
VPRSAAAVPSALALSLVLALTACDGGVQGTPGGSGLRDPYFAKMGNGGYDVTHYDLTLAYDPGRRHLTGTAVITARAKQDLTAFALDLDGLDVGGVTVEGRPARWNRTGQELTVRPHDDLDKGETFRTTVRYSGTPVTITDPDGSKEGWLKTADGALGLGEPTGSMAWFPGNHHPSDKASYDIEVTVPKGLRAVSNGELTRETTSGDRTTFAWHTPEPMASYVATVAIGHYDVRRSTTKSGLPVYVAVDPTQAKASAKVLAKLPEIMEWEENNFGPYPFSSTGAIVDRENDAGYALETQNRPVFPGAPDTGTLVHELAHQWYGDSVTPKSWRDMWLNEGFATYAEWLWQEDHGGETAQETFDALYRGDGGGDGAADKARWAFPPGKPPGAAHISDRPVYERGAMVIHKIRETVGDDTFYDIIQGWAATHRHGNADTADFTTYVEKKAPGKDFSAIWDEWLYGEGKPAKP

SEQ ID NO: 11487 - protein, 166 aa, Streptomyces avermitilis
VLDIGYALSNRFPDPPQTDYRRADVHALRHDLFCGDVYLADTKSDRELSTAWGWVPVLDFAWALCDIVEQLDRDPRGSRASRPQHAELDFTESTDRMLFERRFGWVDIEADWMPGDEPPLTFSHAELRREARDFLHDLLADLTDLHEALRENPAIWALEARFPRVS

SEQ ID NO: 11488 - protein, 264 aa, Streptomyces avermitilis
VNTQVGAIVSGGVQDEGMVRKAAGAAVRGTAVRGTAATGKAVRGKVVKGARRPEVRLPVLESYAGGELEPDGDYDGLEFRDADFAGQDGGGARFMDCALTGCAVDETRLPHARVLDSVLTGLRGVGTDLAEATLRDVELVDARLGGVQLHGAVLERVLVRGGKIDYLNLRTARLKDVVFEGCVLVEPDFGGARLDRVEFVDCVLKGADFHAATLTDVDLRRAAELGIARGVDRLAGAVISPTQLMDLAPVLAAELGVKVAAAGA

SEQ ID NO: 11489 - protein, 389 aa, Streptomyces avermitilis
MQRITLTVVGGGLAGLTAAVTAAEAGAKVTVYEAHHTLGGRARTAQGPYRTNEGPHALYSCGPHWTWLRQRDLIGPLAPVPPLEAARLRLRHKGVLRRTPPFAMLKLLRRTARQAPADVDFMTWATEQAGEEGARAAANHAAISLFHHDPGSLSAAFVQERLRRTAKLPPEAHHPRGGWASVIDRMAARAWNLGVRMETLARVDTIPENRGPVVVATSLDAARRLLGDDSLAWDSGRTALVDLAVRTRRGDAFAVSDLDAPGWIERRTAQDRSLAPAGEQLLQGQIPIAPHESRADGVARAEQLLDLAFAGWRERVTWRREAVAQGRTGAVDLPGTSWRDRPAVDRGDGVYLAGDQVAAPGVLSEVSFNSALTAVSLALGRHTLDLKQA

SEQ ID NO: 11490 - protein, 329 aa, Streptomyces avermitilis
MHAVRLHAFGPAENLAYEKVEDPEPGPGQVRIAVAAAGVHLLDAALREGVRGPAPEPTPLPTIPGREVAGTVESLGAGVPGDRLGKRVVAHLGFAPGGYAELAVTDADRLHEIPRNLDFAQAVAMIGTGRTALGILQFAELGPDSVAVVPAAAGGIGTLLVQYAKSAGATVIGLAGGPQKVARVRDNGADLAVDYRDPDWPERLAQYRGRATVVFDGVGGDTARTAVGLLGPGGRHLVFGWSGEGIQNGQPLLVDDKDRGIVSEQVLGPVMLRRAGGPHPLRALELRALAEAAAGRLTPAVQRFPLAEAAAAHRALESRRTVGKVVLEP

SEQ ID NO: 11491 - protein, 499 aa, Streptomyces avermitilis
VNVTRTGESTYVLDPDPRRWWSLVVIALAQLMVVLDATIVNIALPSAQRALGMSDGNRQWVITAYTLAFGGLLLLGGRIADLVGRKRTFIIGLIGFAAASALGGAATTSGMLFGARALQGAFAAVLAPSALSLLTTTFTDPKERGKAFGIYSALAGSGSAIGFIAGGLLTEYLNWRWCLYVNIPIAVIAVCGAFALLHEQPRHAGARLDVPGALLGCGGLVAIVYGFSEAEPRGWTDPRVLALFAVGIVLLAVFVWWQTRAPQPLLPLHIVKDRNRAGCFLTMALAVIGLFGMFLFLTYYLQVVLGYSPLKTGLAFLPLTVAIIIGSTQISARLMSHVAPRLLMVPGTVLAAGGMLVLTRITVHSPYASELLPALILIGLGMGLTFMPVFATATAGVAPQDSGVTSATVNTAQQVGGSIGTALLNTIATTTSTAYIAAHLRDPARKELVIREGIVHGYTVAIWCAAGVMLLAGLAAGLMVTTKPPRHTPSDTPVPESVG

SEQ ID NO: 11492 - protein, 157 aa, Streptomyces avermitilis
MIRAATSADIPVIHAMIRELAEYEKVPDEARADEPQLAEALFGERPAAFAHIAEDRGLPVGFALWFLNFSTWRGVHGIYLEDLYVRPEARGGGHGKALLTELARICVERGYERLEWAVLNWNKPSIDFYEALGARAQDEWTVYRLTDGALTALGARA

SEQ ID NO: 11493 - protein, 471 aa, Streptomyces avermitilis
MSSSASSLGRVVNGGISFWYADDGFPAPREPLPGDATADVVIVGGGYTGLWTAYYLKKAAPYLRITVLEQKFCGYGASGRNGGWLYNGIAGRDRYARLHGHEAAARLQRAMNDTVGEVVRIAAQENIDADIHQGGVLEVAYTPAQLARLKEFHAHELAYGEKDRELYGARETAERVRVADAVGSTWTPHGARLHPVKLVKGLAAAVEAIGVTVHEQTPVTEIRPQHAVTPYGTVRAPYVLRCTEGFTANLKGQRRTWLPMNSSMITTAPLTAEQWDAIGWAGRETLGDMAHAYMYAQRTADDRIALGGRGVPYRFGSRTDNDGRTQAATVEALYEILIRFFPSLTGVRVDHAWSGVLGVPRDWCATVTLDRSTGLGWAGGYVGSGVATANLAARTLRDLVRQDSGQAGATELTALPWVNHQVRKWEPEPLRWIGVHGMYATYRTADRRELTTHSVQSSRLARMADRVAGRH

SEQ ID NO: 11494 - protein, 196 aa, Streptomyces avermitilis
VWLAILFVTTVALHHMSPDFEEDFLRQRSTNIHELSRDPVRVLITSAMWIDGGHWLPYAVLFTVFHAQAERWLGTPRWLAVCVAAHVLATLASEGALLEAIRDGVAPRSAVNTLDIGVSYALAGVIAVLTYRIAEPWRYGYLVVVLAVYGGSLAASPTFTDFGHFLALLIGLACCPLARGRGKAWNPKETLAALRG

SEQ ID NO: 11495 - protein, 297 aa, Streptomyces avermitilis
MVGRVIDVPEELAASQQKFNGAAGRAFIAGLPRRAADFLERWELRVDGPSMYGVCALVLPVLRADGTPAALKLQPLDEESAGEPLALRRWDGAGAVRLLEHDEATCTLLLERLDEARSLAETPDTREAVLVVARLLARLTALPAPEGMRRLGDIAAAMLEQVPWAVRQLADPGDRRLVEDCAAAVREVAAEPGDRLLHWDLHFDNVLASHRAPWLAIDPKPLAGDPGFDLLPAIRNRFEPAEIRWRFDAMTEILGLDRERARAWSLARVLQNTLWDLADGRPLEAAQREIGRQLRER

SEQ ID NO: 11496 - protein, 378 aa, Streptomyces avermitilis
MATVSFDKATRIYPGSEKPAVDALEIDIEDGEFLVLVGPSGCGKSTSLRMLAGLEDVNAGAIRIGDRDVTHLPPKDRDIAMVFQNYALYPHMTVADNMGFALKIAGVNKAEIRQKVEDAAKILDLTEYLGRKPKALSGGQRQRVAMGRAIVREPQVFLMDEPLSNLDAKLRVSTRTQIASLQRRLGITTVYVTHDQVEAMTMGDRVAVLKDGLLQQVDSPRNMYDRPANLFVAGFIGSPAMNLVEVPITDGGVKFGNSVVPVNREALKAASDKGDRTVTVGVRPEHFDIVEQGGAAAKALTKESEDAPAGLAVSVNVVEELGADGYVYGSAKVDDKLTDLVVRVSGRAVPDKGATLHVVPRPGETHVFSTSTGERLSD

SEQ ID NO: 11497 - protein, 152 aa, Streptomyces avermitilis
VKHSTTNQRTRHGRGPARRIGRTLALVLPVVLVFSGTLAVTRVNWSGNSSHSVLTASEASSSDVSTRASSRAAQDVLRDKLLVELQEKNPGVALTHLQEAVHDRPSLAKHCVSIARALGRAAVRVYGPPRAQSFARPVCDTSFASGVAAQHT

SEQ ID NO: 11498 - protein, 243 aa, Streptomyces avermitilis
MTDPNAASRPVQAVVLAGGQGSRLRPYTDDRPKPMVEIPGTGTPIIGHQLTWLAEEGVTDVVVSCGHLADVLQKWLDAADLPLNVTTVVETEPLGRGGGLKYAAAHLPHPDKPWFATNGDIWTRFSLRDMADFHTERDAVATLALARPRIPWGAVKTDGFGRVTDFIEAPPTTYEINAGVYVFSAEFAGMLPERGDHERTTFPRLARERLLAGFPIPQGAYWRAIDTAKDLTEAAKELASLGR

SEQ ID NO: 11499 - protein, 565 aa, Streptomyces avermitilis
VDTRTPRTPTGDRSSGFDDTPALSMVKVPSDPAQVIVNHASFRVQLNASAWTTRSPRIARHLSATEDTARVPVVGTAGRAGAAGQAAGARRRAPVVWSGKSAPDDTGAHRLLQAVRSTSVGHGEAPAGDAGATQVIPRIDVGNLPGETVATPGAGSRRTHGARHSGETRLLPGMRTAGSAYDEPAYADQEFADDDLADDGFEDDGFGDDGLDDEETTSKRHGNEPVRHAYYPGRRMNLGVVLLPLRVFLGFISIYAGMGKLCDAVYFDGGKRGSMVTWLNTLHPWEVAEPLRQFALQHPVGAGLVIAFLQVIVGVLTVLGLWQRVAAVVGAMLSAALIVTVSWKTVPAYDAPDIIYLAAWSPLIIAGAPVYSVDGRLAGGAWRRLGPRADIWELRWYVLRRGALVTAITVGLTLLLGSLLGGAVRDADRVVVPGPGEAPRNELPGSPLPEEPVKRHHRASPSASETPTQGATSSPSGAATTPGAIRESGPATGGQPSQTQGTGQAPPQQSAPVQQAPSTSAGPSSSGGSGSTGGSAAGGSSSTGGSSSGGGSGGGSDRLVGGLLG

SEQ ID NO: 11500 - protein, 313 aa, Streptomyces avermitilis
MAANNRRMSGKKGAQVGSGGQRRRGLEGKGPTPPAEMRKGHKKNRIATAKTKQVQRRPAPRGRGGKSASEMVVGRNPVVEALREGVPATMLYVQQFIDNDERVREALQLAGERGGIHLMEAPRPELDRMTNGLNHQGLVLQVPPYEYAHPEDLSAAAYDVGEDPLVVALDGVTDPRNLGAVVRSVSAFGGHGVVVPERRAAGMTAGAWKTSAGTAARTPVARATNLTRTLESYKKEGLVVVGLTADGEVELGDLEALAGPVVIVVGSEGKGLSRLVGETCDFRVRIPMPGGAESLNAGVAAGVVLYEAARRRG

SEQ ID NO: 11501 - protein, 466 aa, Streptomyces avermitilis
VTIRLYDTSARQIRDFTPLLPGCVSIYLCGATVQAAPHIGHIRSGLNFDIMRRWFEYRGYDVTFIRNVTDIDDKIIAKSADHGRPWWAIGYENERAFNDGYDVLGCLPPTYEPRATGHITEMVEMMRTLIERGHAYEADGNVYFDVRSFPEYLQLSNQELDNLLQPSGEGETGKRDPRDFAMWKAAKPGEPTWETPWGRGRPGWHLECSAMAHKYLGSAFDIHGGGLDLIFPHHENEIAQAKAFGDEFARYWVHNAWVTMSGEKMSKSLGNSVLVSEMVKQWRPIVLRYYLGTPHYRSMIEYSEEALREAESAFARIEGFVQRVVEKAGGVVEPSPEVPPAFAEAMDDDLGVPQALAIVHTTVRQGNSALAADDKEAAVARLAEVRAMLGVLGLDPLDPQWAGEGDRGEDLHGVVDTLVRMVLDQREAARARKDWATADAIRDQLNQSGLVIEDSPQGPRWTLGPR

SEQ ID NO: 11502 - protein, 174 aa, Streptomyces avermitilis
MASEASDVRLPPGGPVVLPLVGIGTDIHAFEDGRELWCAGLKWEGEGPGLAGHSDADVVAHAACNALFSAAGLGDLGQHFGTGRPEWSGASGVTLLTEAARIVRAAGFTIGNVAVQVVGPRPKIGKRRDEAQKILSDAVGAPVSVSGATTDGLGFPGRDEGLMAVATALVVRAG

SEQ ID NO: 11503 - protein, 250 aa, Streptomyces avermitilis
MSDDSRPSPSGARTAAVIPAAGRGVRLGPGAPKALRALNGTPMLIHAVRAMAASRAVSLVVVVAPPDGTAEVKSLLDAHALPERTDFVVVPGGESRQESVKLGLDALPPGIDIVLVHDAARPLVPVDTVDAVIEAVRDGAPAVVPALPLADTVKQVEPAAVPGEPEPVVATPERARLRAVQTPQGFDRDTLVRAHETVTDNVTDDASMVEQLGARVVVVPGHEEAFKVTRPLDLVLAEAVLARRRLNDGF

SEQ ID NO: 11504 - protein, 160 aa, Streptomyces avermitilis
MTFKVGDTVVYPHHGAALIEAIETRQIKGVDKTYLVLKVAQGDLTVRVPADNAEFVGVRDVVGQDGLDRVFEVLRAPYAEEPTNWSRRYKANLEKLASGDVIKVAEVVRDLWRRERERGLSAGEKRMLAKARQILVSELALAENTNEDKAEALLDEVLAS

SEQ ID NO: 11505 - protein, 220 aa, Streptomyces avermitilis
VSSSLRRGALAAAAIAFSIASLAACGAGNNAQTLEVKPDNAATSVGDIMVQNALVITQPDPKATGPAVISATLFNNGRTAQTLDSISVEGDGTAELSPAKGKGKVTVPAGGSVVLGGKGNASAVLASPGADVKTGNAQKVTFSFSKTGDVSLRAFVVPAESYFSKWGPSQIPAAPGATASATATATTSPSGSASGTPTDKASSSTATATATATASNSAGH

SEQ ID NO: 11506 - protein, 223 aa, Streptomyces avermitilis
VLVVEDEESFSDALSYMLRKEGFEVAIATTGPDGLDEFERNGADLVLLDLMLPGLPGTEVCRQLRGRSNVPVIMVTAKDSEIDKVVGLEIGADDYVTKPFSSRELVARIRAVLRRRGEPEEVTPAALEAGPVRMDVDRHVVTVSGSKVDLPLKEFDLLEMLLRNAGRVLTRMQLIDRVWGADYVGDTKTLDVHVKRLRAKIEPDPGAPRYLVTVRGLGYKFEP

SEQ ID NO: 11507 - protein, 425 aa, Streptomyces avermitilis
MDVNAAVAAAAAIAGVLTGVIAMLAFRWSERDQKRPTRTSLHTDPVLPPGVDTVLSVLRSSAVVLDEADAVVKASSAAYALGLVRGGKLAIEPMIKMTRDTRRDGEIRQVELDLPRRGTGRGEALAVSARVAPLGSRLVLLLVEDLTEARRIEAVRRDFVANVSHELKTPVGALSLLSEAVMDASDDPEAVERFAGRMQIEATRLTNLVQELIDLSRVQNDDPLEDAEPVRVDELVAEAIDRCRHQAGTKQITMAAGGTAELHVWGNRGQLAAALGNLVENAVNYSPARTRVGIAARRVTAPGGDLIELAVTDQGIGISEKDRERVFERFYRVDPARSRATGGTGLGLAIVKHVAASHGGEVTVWSSEGQGSTFTLRLPEAGTARDRERALLTPGLDEDDEDGQPDGTTTVSSTYEPLPAPEVLP

SEQ ID NO: 11508 - protein, 229 aa, Streptomyces avermitilis
MRDAYHEELDSIGEGLVEMARLVGSAIGRATTSILDSDLKLAESVIAADQKVDDLQHDLEARAIALLARQQPVATDLRIVVTSLRMSADLERSGDLAQHVAKLARLRFPERAIPHDLHATILEMGQLAQRLMAKAAEVIITKDVDLALQLEQDDDEMDLLHRTLFQHLMDDRWKHGIETAVDVTLLGRYYERFADHAVSVAKRVVYLVTGEHADELQADIQPVTGVEGA

SEQ ID NO: 11509 - protein, 50 aa, Streptomyces avermitilis
MAETPSTPDPTQERETQHPAEIKSLPLFGACGCGSGCGCGCQSGNPCQCG

SEQ ID NO: 11510 - protein, 340 aa, Streptomyces avermitilis
MTQQDNTLPKRTLPKRTLGTQGLEAGAIGLGTMGMTMAYGAGDEPGGIATIHRAYELGVTLFDTAELYGMGTGSNEQLLGRAVKGFRDEVVLATKFGFDLSDPANVGVALDSRPGHIREVTENSLRHLGTDHIDVLYQHRVDPDVPIEDVAGTVGELIAEGKVRYFGLSEAGPEIIRRAHAVHPVSVLQTEYSVFERAVEADVLPVVRELGIGFVPYSPLGRGFLTGAVRPASAYPADDMRSWDDRWQPGNYEKNVAAVSELTTLAAAKGISVTQLALAWLLAQGDDIVPIPGTRSPQRLAENVAAAHVTLTPADLVRVQEILPKGAAGSRYPEVMMPSW

SEQ ID NO: 11511 - protein, 308 aa, Streptomyces avermitilis
VPEHLPDRLGGLDSLAAAIARHNEGLWSDSAVPRLTLVALDELIAPVDLLYAPMICFIADGAKRTLAGDRSWVTGRGDMFLNSLVLPVTCTFEQAPYRSAVLHLDGRLLADLLLELDGTDPLPLPRPGAPGAQVTASMTPALLDAVTRWVRLLDTPDDIRPLASRIEAEILYRLLAGPLGPILRQYTLADSGAARVRVAAAYISTHYAEPLSIATIAATAHMSPATLHRHFKAATGMSPLRFQKLLRLQEARRQLVAGNTTAAVVAEAVGYASATQFNREYRRTYGLPPGQDASLLRGRLTEARGRAD

SEQ ID NO: 11512 - protein, 435 aa, Streptomyces avermitilis
MSPVSLRRAARETVSGLPREFWWLWTSTLVNRLGAFVATFMALYLTLDRGYSASYAGLVASLHGLGGVVSSLGAGVMADRLGRRPTLLIAQSSTAVSVALLGFMHDPVAIAAVAFLVGMTSNASRPAVQAMMADIVRPEDRVRAFSLNYWAINLGFAISSMAAGFIAEFSYLAGFLIEAGMTLICALVVFAKLPESRPAPTGKASAEPEVGLRTVLRDGRFMSVVGLSFLVALVFQQGSVGLPVAMGEAGFTPADYGMAIAVNGVLIVALQIPVTRFIEHRDPRRLLVLSSLLAGYGFGLTAFAGSVGVFALTVCVWTLAEIVNAPTQTGLVVGLSPTHGRGRYQGMYTLSWSVAALVAPLLAGFVIDRFGAEWLWGLCAVVGTGAGVGYAALMRRLPVQEPAVAAPVQEPAVVAPVQEPAAPSPAGGKPEVSAT

SEQ ID NO: 11513 - protein, 253 aa, Streptomyces avermitilis
MADAPYKLILLRHGESEWNAKNLFTGWVDVNLNEKGEKEAVRGGELLKDAGLLPDVVHTSLQKRAIRTAQLALESADRHWIPVHRSWRLNERHYGALQGKDKAQTLAEFGEEQFMLWRRSYDTPPPPLADGSEFSQSDDPRYASIPPELRPKTECLKDVVNRMLPYWYDGIVPDLLTGRTVLVAAHGNSLRALVKHLDGISDEDIAGLNIPTGIPLSYELDTDFKPLNPGGTYLDPDAAAAAIEAVKNQGKKK

SEQ ID NO: 11514 - protein, 438 aa, Streptomyces avermitilis
MAGHIQDRWYKTEVGPDGKTRRVKSDRYGSGARYRARYVGPDGTEKSKSFPDRQKRLADQWLAHTEADMARGQYIDPRAARVTFQQYAETWVSTQGADPNTQASMESQLRLHAFPYLGSRPLGSFQPAHIRDWVRQLSENGIRGSYARTIYSNVRAALSAAVDDGHLSRNPCAARSVRPPTVDDRRVARTPERVFAVRAGMPERFRAMVDLGGGCGLRQGEILGIAVDAIDFESDTLHVVQQLKLSRSKAVFAPPKGGKLRDVPLPGPVADALRAHMKRFPPVDITLPWKVADGPLITKRLIFTGPRGGHVWRTSLNEEAWKRALASAGVIPDRKPGKSYAESRENGMHALRHFYASVLLDAGENIKALAEYLGHSDPGLTLRVYAHLMPSSQERTRKAIATTYENSILLRTPARIKLRESESDIPHQEPGISPHQTK

SEQ ID NO: 11515 - protein, 79 aa, Streptomyces avermitilis
VASRRLALADVATEPRTLPSRYLTPDDLVEMFELPSVETVYQWRRKRTGPRGFRVGRHLRFDPADVRAWVDSRREGAAA

SEQ ID NO: 11516 - protein, 455 aa, Streptomyces avermitilis
VPVRRRTVIFARATPPPLPELSNLAAGGTLPGILRQLSGLGGCTHPIRLDGHRTEYDVDTATGEIGRVLHHLDSGDLPAGQLLVRCNNRRTTRCPACSEVYRRDTFQLITAGLRGGKGTPEHVATHPRVFATFTAPGFGPVHNRRTDGRPCRCGTQHDQEDGQLGTPLNPATYDYEAAVLWNAHAGPLWRRFSIYLRREVSKRAGLSQRELRDHARVSFAKVAEYQKRGAVHFHAVIRIDGPGGGETPPPSWATAELLTDAIGAAASKVRVDGPTIDGRAHVFAFGRQLDVRTIRSADFNDGQELTERAVAAYIAKYATKGSETATGALDRPLKFVAELAQLDISEHARRLIRTAWALGARKDLEHLRLRAWAHMLGFRGHFSTKSRRYSTTLGALRDARAEWRRAQAAANAPAPETTYVLAHWVFAGTGLSDAEAWLAASIEPAPGTEGELTRG

SEQ ID NO: 11517 - protein, 93 aa, Streptomyces avermitilis
MTRRVDKESAVFLPKYPENPTPPPAHTHAPTDPAPVPVRRSLPSVSIDQKTVAAVLVGGVVLTALLAAVAVTAISVAVAAVVLRSLLRDHHRR

SEQ ID NO: 11518 - protein, 64 aa, Streptomyces avermitilis
VTVSLPLVVVLGFFAWAAVKYLGVRIWIVVLITLFGFWLSRTFLAPAIESGTRSGVDVVNGSHD

SEQ ID NO: 11519 - protein, 63 aa, Streptomyces avermitilis
MTANRRFRNVTRIGPVQVGTAYDHRGREKHTAACTAPRCNFSADYDSRAAAELAARTHRCPVR

SEQ ID NO: 11520 - protein, 209 aa, Streptomyces avermitilis
MRAQLARVDAVLVQALIAAALSFAHIHDVAVAAGQDGWKAWAYPVSVDLLLVAAWRRLRSGSAKGAAWCWFVIALAASLGANVATGRPARPRRRPGLAAHPRRGLARPRLPRRNPPRPLGTKGGRRQPRSSEDEEHEPESDPEPPTPAPPAIEAPPHRPAVPVPAALIDHARKVAAEHHTRTGTPMDVATLRARLGVPAPMAEAIAAHL

SEQ ID NO: 11521 - protein, 431 aa, Streptomyces avermitilis
MSDLTTLLEVGGPVAALGGGAAYTRANHPGLYWSAVGGPISTFRLLSSYASVMEACGLTVAPSRLRILAVKATTRREVRPVPPRRGIIRPTATGLRLRLRLAPGQEPADVAASAERLRHAWGVHAVYVSTVKPGVVELRLVGFDVLRKVRMPRKVKVEGGFLKVPVALREDAMPFVRDYRAVPHQLTLGATLSGKSMYLRHLVAGLARQDVALVGIDCKRGVELAPFAPRLSALATDPDEAAELLPVLIKEMEDRYDLIKARQGIAPNLPDEEITSDIWGLPESERPVPIVLFVDEVAELFLTATRKDEERRDEMVTQLIRLAQLGRAAGIYLEVCGQRFGAELGKGATMLRAQLTGRVCHRVNDEASAKMALGDIAPEAALAACAIAPERPGLAVAGDTSGGWSRIRTPYLSLGDAADVCRETAHLVPRI

SEQ ID NO: 11522 - protein, 118 aa, Streptomyces avermitilis
VRTIRVETSAATVLLTEAPEPKVRDRQTGEIAKDAVSGEALMTIGVVYIEDGESSLIKVTVPEGGVSEGLNLGAPVSLPGLVARPWESVFNGQQRHGIAYRAAAVTPAAFPASMGASA

SEQ ID NO: 11523 - protein, 262 aa, Streptomyces avermitilis
VSPLSSGLLGDLDPTSDRAVFRQIADQLREAIDRGRFREGEKLPSEAELVDHYGVSRMTVRNSFSILQGEGLVHAEHGKGVFVRPRPPVRRLASDRFARRHREQGKSAFIVEADAVGSHPKVDSLEVKEEKASQDISTRLGSVRRVLARRRRYLLDGRPVEFATSYLPLDIARGTQIAEPNPGPGGIYARLEELGHRLDHFEEEIRARMPSPAEVKTLHLAAGVPVIHLIRTAFDTEGRAVEVCDTVMAADAYVLSYQLPAT

SEQ ID NO: 11524 - protein, 162 aa, Streptomyces avermitilis
VGECCCYGGEPSHPRGPRNVSTERPHSVSVAGVVVDDQGRALLIQRRDNGHWEPPGGILEREETIPEALQREVLEETGVKIALPATLTGVYKNMTGLIVSLVFRCEAADGTPTTGDETRALRWATREEVSELADEAYAIRVIDALDAAVPPAIRAHDGVKLV

SEQ ID NO: 11525 - protein, 154 aa, Streptomyces avermitilis
MAAYQHEGTCMHEYTSTARVWGLSCPGFPEEVSRARRWTRDVLRGSPFAEDAELIVSELSANAILHTASGLESGSFHLAVAVSAQVVAVSVTDDGGTGTAPKVGHQAQEQDAEHGRGLGMVSAIAHRVVIHDSDGGHTVTAELFTDVRRGGHPC

SEQ ID NO: 11526 - protein, 130 aa, Streptomyces avermitilis
MLRTTTSPGFWCECWTERLGGQQPPALFGSFDAYSAVEANNWVATILRTISPALGTAASQEAWTRLHDDRIDTRRALLRREPWTVSVTHVSTRITWTVRPALFLPMAHRQRKQLPSCAYDFKPHRSHTTD

SEQ ID NO: 11527 - protein, 144 aa, Streptomyces avermitilis
VGCEARKKLDEWPYSQCHPAPIPYAVDPHTVEQAWFMASRWSAPLYERPGRHGPRLLGSAWVDGVRDGSHPTHAPTDPQPGTAPPLSRCRPIPRRRHRSDRGRSHAAVVSWPSARCCARGTGAGRAGAGRRQERRPGRGPGRAR

SEQ ID NO: 11528 - protein, 374 aa, Streptomyces avermitilis
MEVSNAFLRLYESDARFGRAFASIHERLNKHFESINDRAETTGHYWAEQSREMLALLKELNDFLRSLKHAGVVVHLAESYMAAMKSCQSWLVRSGGSAVPDDFEQIEIIKYAPVLSRPDAEIKLKKSTVRHQLQLIGEGSYAKVFSFTDPDYGIKFAVKRANKDLDDRDLYRFRQEFDILKRLSFPYIVEVYQYDETRNEYKMEFCESTLRNYIKKRNSELQFSSRKRIALQFLYGINYIHHEGLLHRDVSLQNVLVKTFSGGAVLVKLSDFGLAKDRNSEYTRTKTEMRGTIRDPLLASFKEYDVCNEIYAIGWVLSYIFSGREALMSQTDAPSQIVRKCTAHDVGKRYQSVRELIGDVEKLEATPAPTDAPA

SEQ ID NO: 11529 - protein, 298 aa, Streptomyces avermitilis
MHRKPSARIASIGVTRTQLAVEAGLGWLFREQPTEDYGIDAHAEVVDAELVRGRLLALQIKSGSSWFREQGQGGWWFRPNAEHVQYWTNHSLPVAVVLYHPERDHCYWQLVNHNTLIETTRGGWKLLVPDTQVLDERARDALSRAAEGDPYTLRIRELQLARPWMRMLIEGKRLVIDIEEWVNKTSGRGTITLGVDNEDGNDPEQLASWTVFLGLSSYVEVVPKLFAWANVSLHAETYDDVEYDDYPYERDDWGALHPYMNPSGEVDFYRLELTLNELGRAFPLVDLFATEGTRQLTV

SEQ ID NO: 11530 - protein, 160 aa, Streptomyces avermitilis
MFVTAPRALLGRRVLAPWRVPCCCERWRTQEGKGAPALGRTRSYRRTRGKLPRSSLTISMARRALPSSEVNAAKRAQMATTVVISNGERANRHRKDTGRQLHDEWICPAAYGSPVRSGFVVLGMSGFSVPGLCEVRLRLGPDLVPRASSRSLRDPLKRGA

SEQ ID NO: 11531 - protein, 144 aa, Streptomyces avermitilis
MSTAGAPSNTATLNRFHSAVNSGDLDIISKAIDEFVAPDVLFHAPVPMGATGAEALKRVWEMLLRAFPDIHVAVEEMITEGDKVVSRNTVTGTHRGEYQGLAPTGKTVTYGEIFILRFADGRIAEIRGIVDVLTQLRQLGAVPS

SEQ ID NO: 11532 - protein, 174 aa, Streptomyces avermitilis
MEAIDVIKSVRWHRKMPWQVKPDTIDPPHRSPDVRPGEEQLPAPGWVAYCIAGLLRLFVSGALTGVIASSHPQVADPLVSFLIGLGALSGVEKVATLVPLAVKSIGRAALGSTVDAVQEQRQIPQQPPQPPQQGHVGSAGPQQGPGTAGSLGQGPQPNSDIPAQQDPTGTGGAL

SEQ ID NO: 11533 - protein, 335 aa, Streptomyces avermitilis
VTVTAESFVGRVIAVFSRRSPGFRPPSPGTPGSPGEAHRTAAGLRSGVAATADSTAPGEGPGGGQDEGGSQGSQGLRLARATSPWKSTSSHTRLWQRRVLLELFAYVRAAHRHAAGCNLRQELDFVRSLAGDLALVHDAAVVRTLDTAVVQRLESLRGTVRDLVQDLGQARELAHELVRNLRSAPSPSNDRNLAQVLARTLDEIVEDTLARDVVLVRGRASVLPADRDLILVRNLVFDLVRVLDLVLDLALVSDLAEARDNLSDAANNFMGADVTDVDPAAMNLAWIRWNRETRWPTREWADRIRRASVESPPGSGIFTVLPEQEYGPAEVALVH

SEQ ID NO: 11534 - protein, 169 aa, Streptomyces avermitilis
MGRRMTRLRVLVCVSALLAAGSACASPQVCAGVGVESGVGVMFLREGYGDLADASYELCARGECAKGELRQEDLTRVRLGLPDDVDPDGGTVRFRVTRKGGTSPVIDASADVRLTRQSDECGGGAYNRGLAFTKKGGLTTKIPPSVTAAWREQVRELRSPSTGATTESP

SEQ ID NO: 11535 - protein, 193 aa, Streptomyces avermitilis
MTRSVERPVLFLDVDGPLIPFGPSSRRLQPRAAGSVAFSDEGNPLLGRLDQAVGPRLMALGCELVWASTWMNDANESVAPRIGLPRLPVVEWPEASTHEGPRGLHWKTRHLVEWAGHRPFIWVDDEIGAMDRLWVAAQHQGPSLLHRVDPAQGLTDGDFSVLADWLRTAVPGLAVPTRVEGGSGRLGRRSGGR

SEQ ID NO: 11536 - protein, 114 aa, Streptomyces avermitilis
VTAFLVSGLGTQVPEVIGDPYEDADGVRYLPMFRQPVLVFEGSKETLTAAHTRALTRALPRALFTSDLFGTGNDHDNRAAVRAVRTTELDVVGLAVYGPRNAVDKVLKGARMHP

SEQ ID NO: 11537 - protein, 270 aa, Streptomyces avermitilis
LYVVCMVDRREISAWRPRVPGVVEVFHAHYTEYAYPMHVHDAWTLLIVDDGAVRYDLDRHEHGTPDDTVSLLPPHVPHNGSPVSEHGFRKRVLYLDLSRLDASLIGPAVDAPDVVDPLLRLRVGQLHTALAHAGDELEAESRLAFIGERLRGHLRPRAAQRQRPPDRGVAPRLRELLDARLVDGVSLDEAARLVHAHPAHLVRAFSGAFGIAPHQYLMSRRVERARRLLLEGMRPAEVASATGFYDQAHLNRHFKRLVGVAPGRYRNSSR

SEQ ID NO: 11538 - protein, 588 aa, Streptomyces avermitilis
MEGWAGMSQGSRENQGHAGVSRRGLLGSAIAVAAVAATGTTATAAARTAAARTGSARTAAARSGSGPSGEVPSLWHEFTRAPYTHPQIPYVGRSGHRRGAARFPRRPVVADVRDHGAVADGTTDSAPAINRAIAAAGRAGGGTVLLPPGTFRIDDLIRIGYDNVVLRGAGSSRTKLYATKNLTELIGVYGSRYGGDKSSWSWAGGLIWLAPRARWDSLVAAIRAKAWPFEGWTGNGRDEWETLTTVSPARRGSWSVTVADARLLRPGQLVLLRLADDAGHTLLEHMSGGGPGPEAYSWDDKIKLTSYVPYEWPVRIARVRGRKVTFERPLPLDVRPEWDPRLTTHVEALTGAGVEGLTLEAVETPQSPHLLDKGYNGVAFQCAYDCWADDVVVRHVDNGFGLVAASSCTLRRTTVAGRGSHHPYFCREGSHDNLVEDFTIEQRTVPAPAGTQLHGINVEGLSSYNVWSRGEMRMGTFDSHRGLPFANVRTDITVNNNGRHGGDASAGPLFGARFAHWNIRVTNGRAGLMKIDGLAPYSATVGLNEVTEFDQTDVPDFTGDLHARVELYGTTDVVRPRNLYEAQRELFR

SEQ ID NO: 11539 - protein, 163 aa, Streptomyces avermitilis
MADAASIIEQVLGEAELEWESPEPGSYVVKLPGTRKLSTTVSLIVGKHSLSLNAFVIRHPDENDAGVHRWLLERNLKLYGVSYAVDRLGDIYLVGKLPLAAVTPDEIDRLLGSVLEAADGSFNTLLELGFAASIRKEYAWRVARGESTRNLDAFSHLTQRPAN

SEQ ID NO: 11540 - protein, 464 aa, Streptomyces avermitilis
LEGAPRRPDRHARSEEERHVSQYASRLGRRSPAAPTRRRMLRKPRRVAMLSVHTSPLHQPGTGDAGGMNVYIVELAQRLAAINIEVEIFTRATTAALRPTVELSPGVLVRHVDAGPYEGLAKEDLPAQLCAFTHGVMQAWAGHRPGYYDLVHSHYWLSGHVGWLAAQRWGTPLVHAMHTMAKVKNAALAEGDTPEPAARVIGEMQIVAAADRLIANTSEEADELVRHYEAERGKVAVVHPGVNLDRFRPADGRAAARARLGLPQDALIPLFAGRIQPLKAPDVLLRAVAVLLDERPELRSNLVVPVVGGPSGSGLAKPEGLQKLAARLGIADVVRFRPPVGQEQLADWFRAASVLVMPSYNESFGLVAIEAQAAGTPVLAASVGGLPVAVADGRTGFLVQGHDPAAYARVLRDFADDPALSARMGRAAARHAECFGWDTAASATADVYTAAMQAHRRRVRSHHG

SEQ ID NO: 11541 - protein, 272 aa, Streptomyces avermitilis
MTARAASRPVGTVTRGTTNPNRLRRMDRWIAAAHGAELRRAADPVAVDLGYGAAPWTAVELLLRLRTVAPHARVVGVEIEPARVAAARPYEREGLVFRHGGFEVPVPGRPTLIRAANVLRQYDEDQVAAVWERLCARLAPADPATGSRGGLLVEGTCDEIGRRHVWVALGPEGPRTVTFATRLGSLDRPSDLAERLPKALIHRNVPGEPVHAFLRDFDRAWAAAAPYASYGARQRWIRAVRALTADWPVTDDAGRWRQGEVTVTWESLAPRG

SEQ ID NO: 11542 - protein, 363 aa, Streptomyces avermitilis
MGTGKRTLTMAAIALVCAVTVLGAPGAAHASPSKPTPTPAPTPSGSPTPAADKELEEVRGKLEKLYHDAAVATDAYNAAEEDTQKQSGQIVELAREIVKGQAKLADLKDRAGAAARAQYRGGGLPPEARLWLSENPQAYLDGAGRVRQGEHATKGLLAEMTRTQEDLQQYARDASAQWKRLEANRKDKAAAKKKVKKQIAAAEKLESQLEKEEKERLAKLEAAAAAKAQTAWLDSGVLDEINTKASEQGRKAVRFATAQIGKPYEWGAEGPKTYDCSGLTSQAWAAAGNGIPRTSQEQWKQLRHIDVKDMRPGDLVIYFDDASHVGMYVGDGAIVHAPRPGRTVTITGAGTMPILGVVRPDAG

SEQ ID NO: 11543 - protein, 482 aa, Streptomyces avermitilis
LPYRTPPSIPLRRLLPLWSPSVGRGPSPRHALGGREGTQTMPVPVPRQRAIPAAECGQAQTVPQAGRPFPEGPAGHAKAPVDRAGSPVGTTPANLTLLVIEDDPGGSPIVPEMLDSAGQPIRIRTARNLTEAGRLLTDDVHCILLDLALPAPGRSADSDDELATLKHVLKIAPRHAVLALTASGDTERGTEAVRVGAQDYLFRDELDGRLLSRAIRYAVERKRSDTAERRLTESRLRAQENRRLERGLLPTPLLDGSPLRFAARYRPGRSRALLGGDFYDTVRTPDGTVHAMIGDVCGHGPDEAALGVELRIAWRALTLAGLCGDELLSTLQQVLEHERSDDEIFATLCTVDIAPDGRRAGLCLAGHPSPLIARPGRPAQLLPYENNGPALGLLPHARWPRMQVELGAAWSLMLYTDGLIEGHIGQGKERLGQDGMVELVRRRLAEGLTGEELLRATVNEVRDLNGGELTDDVAVLLLDRVG

SEQ ID NO: 11544 - protein, 113 aa, Streptomyces avermitilis
MLMLGFAGFMGVLKIVLMALAAFGLFDAAFRREDAFRAADKQNKWFWLLILALALVVSWLFSILSFLPIIGVIASIVYIVDVRPALRQVSGGGRGGRRGSSSDGPYGPYNGGR

SEQ ID NO: 11545 - protein, 200 aa, Streptomyces avermitilis
MAITEDLRKTLSDPTPLYFAAGTADLAIQQAKKVPGIVEQLAAEAPARFEAVRSTDPKAVQEKATARAKEAQETLQSKVTGFISTLDTDLKKIGESAQDFALRGVGVAAEYAVKARETYEKVAEHGEQAVRTWRGEAAEEIEELAIAVEPKAEPVEVKDDKPATAAAEPAAKKASVPAPAEPKKAPVRKPTAKKTTPPAK

SEQ ID NO: 11546 - protein, 158 aa, Streptomyces avermitilis
MASLNVGNLGEYLREQRRSAQLSLRQLADAAGVSNPYLSQIERGLRKPSAEVLQQVAKALRISAETLYVRAGILDAERDRDEVETRAVLLADPTLNERQKQVLLQIYESFRKENGFEIGTADEDAPTNAQGRADAQDTPVRGPRTAGGSDADPQQAAG

SEQ ID NO: 11547 - protein, 137 aa, Streptomyces avermitilis
VTNSPQPTGASPAGCRPTRSIPMSIAHVVVTLLAAAMAGYSAYAVLFRAKWVVEALTDYSVPAAWWPWLGAAKAAGAAGLLAGLFVPVVGVLAGIGLVLYFTGAVVTVARARWYAHIPFPLVYAAPVIGSLALGFAA

SEQ ID NO: 11548 - protein, 336 aa, Streptomyces avermitilis
MTRNRASADGVPQPLMATYYAQRASAGLIIAEAATPNAVGQTYPNITAIHDATHVAGWRGVTDAVHAAGGRMFLQLQHGGRVGHPATSGLTPVAPSPVPLPETIFTPSGHRPSVVPREMTAADIRTTVADFAAAARNAIDAGFAGVEVHSANGHLLHQFLATNTNRRTDAYGGSVAARIRFAVEVTEAVADAIGAERVGVRISPGTTVNGVEEDDTELLYPAFVEALAALGPAYLHLVHADPDQPLFRHIRENWPTTLMANPVLGPELPADGGAHAAGRLLTAGADLIALGRPFLANPDLVTRLRTGAPVNPVRDRFMMYVGGERGYTDYPTLTVA

SEQ ID NO: 11549 - protein, 125 aa, Streptomyces avermitilis
MRIGQLAERTGVSERSLRYYEKQGLLAADRTPGGHRDFPDRAVDRVILIQELFAAGLHSKKIAELLPCMRDTDGGPSEVATPRLVADLSGERDRIDRMINDLIRSRTVLDEVIEAASAGLRRPHV

SEQ ID NO: 11550 - protein, 681 aa, Streptomyces avermitilis
MTSPDPALHHALTRERAYHDTCRTALAAMVEGADEHVITGEDVSASGADAEVLGHRLRSRAKHMRELPEGPLFFGRLDFAPDSGDREHAGQSYHLGRLRITEHPAAPPLVVDWRAPVSRAFYQASARAPQGVAVRRRFGWAPGSRGDTADLTGLEDEHIGAEQHAPSRILTHEIERPRLGPMRDIAATIQPEQDDLVRADLATSVCVQGAPGTGKTAVGLHRAAYLLYTHPQRIRRGGLLILGPNRTFLSYIAEVLPALGETGVRQSTVADEIGARHRVTAVDDERTAVVKHDPRMAEVLRRALYGRIGTAADSLTVPDGSYRWRVPADALARIVEDVRTEQPPYAVGRERVRTRVVGRIQAQAERRAGPRTHAWVRKIERARPVSAYVDAVWPRVRAEEVVAGLLADPDALAAAAEGVLDADEQRALLWTGPPRSYRSARWSAADLVLLDEVAGLIEHPEGYGHLVVDEAQDLSPMECRAIARRAVFGSLTVLGDLAQGTTPWAARDWSELLPHLGRPDAHVVPLTTGFRVPEAVVGLANRLLERLDVAVPAARSLRRDGELRMRRVGEAAEVAAAVAEAVREALAHEGSVGVIAADADVAAVREALSCAGLEPAGPDRLGARVTVVPATVAKGLEYDHVVAVEPAAIAEAESRGLHRLYVVLTRAVSRLDVVHARPLPW

SEQ ID NO: 11551 - protein, 204 aa, Streptomyces avermitilis
MGEIGLRERKKQRMYQAVSDIAIGLFLEKGFDAVSVAEVAAAAEISKPTLFRYFPAKEDLVLYRFADHETEAAGVVGSRGEGQSPVAALRAHFLDGLARQDPVTGLNDRPGVLAFHRLLYGTPALAARLHGYLERSEGALAAALGGDLDARLAAGQIVAVQRVLALENWRRVAGGERAADVHADAVAAAERAFGRLADGLPSYA

SEQ ID NO: 11552 - protein, 322 aa, Streptomyces avermitilis
MRAAQVKEFGGPEVLVPVDLPDPVPGPGEVVIEVAYTDTIFVETQLRSGWGREFFPAEPPYVPGGGVSGVVGALGPDVPAEWLGRRVTSFVTGSYAERAVAAVSSLTPVPDALDLLTAAALVHDGVTATGLLELTTVTETDRVLILGASGGMGTLLVQLAHARGARVVGVARGEAKVALVRKLGADEVVDATLADWPSRARHALGGDGAADVVLDGVGGELGAAAFTLTADGGRFSAHGAPSGGFAALDPDEAGRRGITLFGIGDVQFGPADLSRLTAGALAEAAAGRLRPVVGEVFALEKAAEAHAAIEGRQSAGKVLLRR

SEQ ID NO: 11553 - protein, 745 aa, Streptomyces avermitilis
VGAPPVPRPPVRERAADVLPDSAFDAFVRVAAERGVPSSGQHHQNFVTPLAEPVARLLGRAAGTPVVVRIPRAEALPVVIRTWRDEAEILGALHGVLPHVPECLVKRENAVIHSYVPGVPLSSLCGNGKPVDGLMLKALAGLLARMAQVRREALPPLPADWPRNDKDGQAFLRTLAHLADRQIRQPNWAAYGGLFAALGVPGDALTRLAGRVPAMARRPYSLLHTDLHRDNVIVPYSGDPPLVCVDWELATYGDPLHDLATHLVRMRYPAFQRDEVIHAWADAMGATRPAAVNGLATDLRHYVAFEQAQSVFPDVIRAARSLTDSRDEKSLDAATAEVHRALWTAAEPLGLAQVPGTAEIRGALYRWQASSPQRSPGARRATIGWVPDRRVPEHPEFPHPAVLSALMAEGAAPAARVFKGTAHLNSVVRVPGVGFPVVVRRRLASVCRREPSFLSEHAVLRAIESSRVAVTAPRVLALGESAERDPFAIHTYVGPPDGDQPPNHPVHGLLPHEADGLVDQLCALTDVDHGALDPMAGEPDFYTWLSGQLVGLVRGLPRESQQLARLLGLPDAARLGQILARHEVTPRSPSLLHGDLNPWNLVRRPDRFALTIIDWEMAMVGDPLYDLVRHLHLTPTRPEIRDRMFRRWERGLAPTHTKDWQRDWRVYRWIEIVRSAYVDLDRLVTGAGLDAPNVRRAVSSYAMTLRAATASLGLPLGRLSQPCLARALPDGGRGGTGPAGLPVGG

SEQ ID NO: 11554 - protein, 267 aa, Streptomyces avermitilis
VVQRPLGNHHDGPDTLLVTSDATQTELVTAETEKLRELITRARFVLFDFDGPICRLFAGHKAERVAVELVEWLEGRGLHALLSETEREALDPHIVLRAVDRRHPGSDLVAELEERLTKQELRAASSAMPTAYADPLIRTWTAVGARLAIATNNSPRVARKYVASRGLSACFAPHIYGRTQDLHLLKPDPHCLNRALNAMGAAPSASLMIGDTPSDYFAAQRAGVPFLGYARNDRKEKLLKEAGAEEIVGSLELVLRVLREQSASARP

SEQ ID NO: 11555 - protein, 292 aa, Streptomyces avermitilis
LVVTQENVAVNGSRRLSPQEIADTLRDRIRAGDLKAGDRLPTQAELAEEFGVERGTVRQALRALQEDGLLSNVSKGSPPRIAEVTPTRDEPQPTMVGLAPRLTAAFGVPHVHVDAACLTAETLMLALGEPVRQIHEGRLRPESIDVRILLPSRDINLAFPIQVDGRTEGDPVHKRWLEQRNAQGHVLRHNLQALRSSHGIDVRVTFRALPFTPPVKLYLLNEEEALIAYYMLTKREEEVESRTLEMYDALGSKSLLFSFESRVGQRDAAFVDQSQKWFNALWETITTDLTLS

SEQ ID NO: 11556 - protein, 62 aa, Streptomyces avermitilis
MPVIALLTAVFVVGFEQIVQWRYGASGVVGLLLLSIGVKAKNPTCSSIGAVVLALTVAGPAL

SEQ ID NO: 11557 - protein, 305 aa, Streptomyces avermitilis
LYCFVVDPEHASVKGRKRSRQPQASHREVADELRSRIRSGVLRPGQRMPTQARLADEFGVERGAVREALRILQAERLLSNVSKGSPATVAQNIGGVPTGPETPPQPTMVALAPRVSAAFAVPHVEIDALCLTSVSLTLAMSEPLREIHAGRIKPAKVDVRVLLPSREIDLAFPAPVDASHNGRLQRRWLTQRNAQGQVLRHNLLALRATHGVDVHVSFRALPFTPPVKLYLLGESEALFAYYTLTRRGEEIDHEYLEMYDAEGTQSMLFAFAQGASLRDTTFVEQSHLWFNALWETISSELEFTN

SEQ ID NO: 11558 - protein, 418 aa, Streptomyces avermitilis
MSRPDDIDVRPIAEAETADWIRALNTGFLRSPEVSEREVADRSSYLVPARTLGAFDNGRCVATFRSFPQELTAVGGASVPADAISNVTVTATHRRRGLLTRMMAQDLAAAKERGDVVATLIAAEYPIYGRYGFGAATHSTEWTIDVPRTGLDPRWSGPGDGGRIDLVDGEDVRKAGPELHERLRRTQPGAVSRDERWWQVHTGVVRLDRSPWTEPFYAVYRSASGEVEGLVSYECDDHWGDAKQPQNTAKVNWLIATTPAAERALWHYLCSIDWITKVRTGWRAPDDLLPHFLPDPRAARVTTHADWLWVRILDVVRALEARTYDGSGTLVLDVVDRHGLAGGRYRLTVGPDGAVCEPTTRDAGLTLDVGELAALWLGDASAVRLAALGRVREQQEGAASVADALLRTSGRPWCPDMF

SEQ ID NO: 11559 - protein, 329 aa, Streptomyces avermitilis
MSAPATPAIPAAPAVSAVPPVLAEVVRSGFVEGRHRGSLVLLAADGSVELALGDVTAPVFPRSSNKPMQAAGILRAGLELDGERLAIAAASHSGETFHRDLVQKMLAEHGLSAAQLQCPPDLPLDGVETEAYLAAGAVRDRVTMNCSGKHTAMLAVSALRGWPLDSYLDPAHPLQQLIHTVVEEAAGEPVAAVGTDGCGAPLMAITLTGLARAFRSFVLAADGTAERRVADAMRAHPEYVAGTRRPDTWLMRELPGALSKMGAEAVQAVALPDGRALAFKVDDGATRALGPVLARALALMGVAAPVVARIGAAPLLGGGREVGEIRAAF

SEQ ID NO: 11560 - protein, 198 aa, Streptomyces avermitilis
MSTPITSTGQLPGVGTHRPPVQRTDSPLPAAPPEPDLSVLRLPELRTLRRDAQRDEADLSYVRRLLQGRIDILRAELARRGGLAAPAGGTPAGVMERLSEILTDAPARQRSSARHVTVGTPHGEEPRRLASEMLAEVELSDLEARTDDELGAGMGRLVRYERQVSRSRQQLQRTADDCSAEIARRYREGEAQVDDLLM

SEQ ID NO: 11561 - protein, 145 aa, Streptomyces avermitilis
MRAVVQRVDGASVVVEGENGPETVGEINGEGLCVLVGVTHDDTEEKAAQLARKLWSVRMLADEKSCSDIDAPLLVISQFTLYGDARKGRRPTWNAAAPGDVAEPLVDEVVARLRALGATVATGRFGAQMRVSLTNDGPFTVLIEN

SEQ ID NO: 11562 - protein, 321 aa, Streptomyces avermitilis
MKSPLLSLPGAVPAEGADEGVAAHYGDLFREQRALAGGAGFVDLSNRGVVTVTGEDRLSWLHLLLTQHVSELPAHRATEALILSAHGHIEHALYLVDDGTTTWAHVEPGTQEALIAYLESMKFFYRVEVADRTGEFAVVHLPAGSIADVPADVVVRETAYGRDLFLPRAELESYADRSGPAAGLLAYEALRVEHHRPRLGFETDHRTIPHELGWIGSAVHLEKGCYRGQETVARVQNLGKPPRRLVFLHLDGSEVHLPPHGTELRLADDGPDGRKIGFVTTSVRHHELGPIALALVKRNVPLDAPLVADNTAAAQEVVVEP

SEQ ID NO: 11563 - protein, 145 aa, Streptomyces avermitilis
VVSTDWKNDLRQRGYRLTPQRQLVLEAVDKLEHATPDDILVEVRKTASGVNISTVYRTLELLEELGLVSHAHLGHGAPTYHLADRHHHIHLVCRDCTNVIEADIGVAAEFTAKLRETFGFDTDMKHFAIFGRCQNCALKSSTTKS

SEQ ID NO: 11564 - protein, 191 aa, Streptomyces avermitilis
MIEIPSDLHKDLVPLAFLLGNWAGAGVHDFPGSEKCNFGQEVSFTHDGRDFLEYHSHTWVLDADGNKVRPLETESGFWRVDAARKVEAVMTRDDGVVEIWYGELAAKKPQIDLVTDAVARTAAAGPYSGGKRLYGYVKSDLMWVGEKQTPEVELRPYMSAHLKKVVTPEDVERWAKALPDDMPDDGIAFFK

SEQ ID NO: 11565 - protein, 281 aa, Streptomyces avermitilis
MTEQTDTQPLAPPVPPVPPVPPAPPVKKDRRVLRAVLRWSAAVVVFAAVGAASAYGIAAMERTDVPGLATASDGRWEYPEIVKPPLPSGSPGPLAEANKAGTHYADLRALVLPAPEGAKEDRTLRGEDGWLPAKTFVAEYAGKDDRDTVRQLLADNGLRHIAARGWTTQDGTRTRIYLLQFDTAAVVDDLLSSELTDYDAPRYALRGAAQLSRDEKFPESTWVEGVDRAVFAETRPYGREQDRQAYLGASDTLAVVVQSGAGGAKAVPFQQTVTLQSQMLG

SEQ ID NO: 11566 - protein, 263 aa, Streptomyces avermitilis
VVLPEAGTAPKKPVRRGRVAAVTGSVLLAAAVVAGTGYTVVTVNGADRDAGAPVWNLPKAKKEATTETAASSGLGGMLVPYETDGFTRGPDLDEFGADAELSGARATALRKESLRDLPRSQRLRLEKRIDKQRIKGMVMRSYLSTSQAGNSTLYADKAFTVSMVLSQLESRAAVRDISTFQNEFLTALGVLRKGPKVEGHKNAQCYLPPKDADEKLDAMICSAYQGDVLVSATAYGAKPLNAKGVAMLLRTQLDRIAEPGEAV

SEQ ID NO: 11567 - protein, 297 aa, Streptomyces avermitilis
VRADTESTLRVLWGDVLEVSEVPERPEAADVPVSADVPVPAEAPVSADAPVLAEAPEAAPSASRRRGRTTSLIATAAVLGVVAGTCTGFLIQADREPTRLPSLSQPVVAQAKGKGPEPLSAARDRRVRTDGDLRELLLKRPAGARDTAYTPGHDGWVGLAEYAEGFKQPAGAFSGAISDEFRRSAATTWRVGSTYNVRVQLVQYRQEENLAAADSAADLQYWAEKEAGTRSWTVPGTGDGMAYVHTTPDARPGYQPVYSAEAHAWRGDIVMQLWVFDTKPIPKEKIMDLAARQMGRL

SEQ ID NO: 11568 - protein, 115 aa, Streptomyces avermitilis
VIKVTAGTDAPERCSQAFTVAAVAVASGVEVSLWLTGESAWFALPGRAAEFELPHAAPLPDLIDSVLAGGQLTLCTQCAARRDITEKDVLDGVRIAGAQVFVQEAMADGTQALVY

SEQ ID NO: 11569 - protein, 103 aa, Streptomyces avermitilis
LDARGAALRHVRAYAGRMYARRRHVYFAMMGTCIGLFVLAWAVVRLWSIPVAVGMCVVAMVIPPLAAMVANRRGPEDRWWDDPSGDPKSDEWWDELDGKKRRQ

SEQ ID NO: 11570 - protein, 95 aa, Streptomyces avermitilis
MCGAKAGGPDASTIKPGETTIQGQVTKDGEPVVGYVRLLDSTGEFTAEVPTSATGQFRFYAAEGTWTVRALVPGATADRTVVAQTGGLAEVAIAV

SEQ ID NO: 11571 - protein, 279 aa, Streptomyces avermitilis
MSRSDVLVDADWVQDHLDDPSVAIVEVDEDTSAYEKNHIRNAIRIDWTKDLQDPVRRDFIDQEGFEKLLSEKGIANDTLVVLYGGNNNWFASYAYWYFKLYGHENVKLLDGGRKKWELDSRDLVAEVPTRATTDYKAKAQNTAIRAFRDDVVAAIGSQNLVDVRSPDEFSGKLLAPAHLPQEQSQRPGHIPSARNIPWSKNANDDGTFKSDDELKELYVEEQVDLAKDTIAYCRIGERSALTWFVLHELLGVENVKNYDGSWTEYGSLVGVPIELGANK

SEQ ID NO: 11572 - protein, 247 aa, Streptomyces avermitilis
MRALRILLIIAVILGGLFVIADRVAVGFAEDQAAEKIKTTEGLSSTPDVSIKGFPFLTQVAGGELDDVELGIENYEADTGSATSGTGKIRIDDLNAEMHGVVFSGDYSSATADSATGTATIAYSELLKAAKSEPTRVGPALTARVVGLSDGGNGKIKVEVEATVLGAKVPRPVSVLSTVTVEGDTVKVHADSLPKLGVELAETEIRSITDFQQKIDELPGGIKLDKVEAAKDGVEISVKGSNVKLVG

SEQ ID NO: 11573 - protein, 404 aa, Streptomyces avermitilis
VTGPMSNQPYEGSYDGPYDGPYEGYDPHQHQQPYAQQQQQQQQHQQPQHQQPQAWPGQQAYDDAAQQQQYTQQWQGQTWETQTQKPVSAADTTYLPQQQYGIAGQPLPHEAPAYDPSAHAAHAAPAAPVARSTPQAPAEGSGYGPATTTGNARITDAQRARLEGRSPIIEPGMQPAALTAVLGALLSVSATIGEYALVVPLVILQAVTAAGWFRLNGMWPARQGIALAFAGALTADVALLAAGRENAPAAILGTLGVWVLLTLVLQLRSHADPDERMYGLMATVTSAALAIVATGHLAATPDAVTVGAAAVAVAILARALPLPTAASVVVALLAAAGAGVAVGGVTDLGTQGAFLGLGAGVCALIGHRVASYDYPSRFVHMTAGVALPLAAAAPAVYLLGRALG

SEQ ID NO: 11574 - protein, 84 aa, Streptomyces avermitilis
MPQGTVRYWAAAKAAAGVAEEPYEAATLAEALDAARERHPGEFVRVLRRCSFLIDGDPVGTRGHETVRLAEGGTVEVLPPFAGG

SEQ ID NO: 11575 - protein, 297 aa, Streptomyces avermitilis
MSTGPAGHTARSSDRPHSETARRTRLRRFLRTVDGVTIDAVYEPGNVVYDGGTPPSTASRDAAPAAGRPAIVVAHGFTGDLERPHVRRAASAFAQYGAVVTFSFRGHGASGGRSTVGDREVLDLAAAVAWARELGHTRVVTVGFSMGGSVVLRHAALYGPEHEGRTQARTDAVVSVSAPARWYYRGTAPMRRLHWLVTRPVGRAVGRVGLRTRIHHRDWDPVPLSPVESVPRIAPTPLLIVHGDRDGYFPVDHPRMLAAAAQDHAELWLEPGMGHAEHAADDALLSRIGAWAAAHAS

SEQ ID NO: 11576 - protein, 269 aa, Streptomyces avermitilis
MSSLLLLTNALQPSTEVLPALGLLLHNVRVAPAEGPALVDTPGADVILIDGRRDLPQVRSLCQLLRSTGPGCPLILVVTEGGLAAVTADWGIDDVLLDTAGPAEVEARLRLAMGRQQIVNDDSPMEIRNGDLSVDEATYSAKLKGRVLDLTFKEFELLKYLAQHPGRVFTRAQLLQEVWGYDYFGGTRTVDVHVRRLRAKLGPEHESLIGTVRNVGYRFVTPEKGERGGGSDEAKAKAGGTSGPAAIPAKPEDADETAHVVASEVTAEA

SEQ ID NO: 11577 - protein, 347 aa, Streptomyces avermitilis
VAKVTRDDVARLAGTSTAVVSYVINNGPRPVAPATRERVLAAIKELGYRPDRVAQAMASRRTDLIGMIVPDARQPFFGEMAHAVEQAAAERGKMVLVGNSDYVAEREVHYLRAFLGMRVSGLILVSHALNNQAAAEIEAWDARVVLLHERPELIDDVAVVTDDIGGAQLATRHLLEHGYAYVACLGGTAETPSVGDPVSDHVEGWRRAMQEAGIPTEGKLFEAPYNRYDAYQVGLELLAGPNRPPAIFCSTDDQAIGVLRAARELRIDVPGELAVAGFDDVKEAALTDPPLTTIASDRSAMARAAVDLVLDDGLRVAGSRRERLKLFPSRLVVRRSCGCAPQETPGS

SEQ ID NO: 11578 - protein, 587 aa, Streptomyces avermitilis
VIPALRGRLRPRRLVTAFPAAALALALSCAGVLASQPATAADGPGGLPDPGVAAQQRATPRPTASTKELRDRVIAAAEDQATQAETPKNTPFIIGGSETTIAGAPWMVQLAYYDDATGDGYFCGGTLVAPNKVLTAAHCVAGLDWVKNGAVLAGTTDLYDDTNGTVAGVWRQWNHPNYNPVTIKNDIAVLTLDRPLEQKWMRLAAAGDTPWYTPGQTATVYGWGLTEGAGTELSSKLRKADLPIVDDTTCNSAMQSVLGEDDFVEGSMFCAGTPAGGTDATTKSPCNGDSGGPVIYGNKIIGIVSWGVAGCTGKGAYPVFTKVSSYTWAAQPRIDDTDLSYDGRADLLARTPSGGLFEQDSKGTSLAQRAYQGNGWQSASWVLQADLDRDFFQDLIVRDKTDGKLYRSYMDHTSGEFTWMQISSVWGGYKSYAVPGDLTGDARPDLVAVDADGSVYLYPGKGNGQFYGRVKVVDKAWKNVKIFGHGDLSGDGRADLLVRSTDGTLWLYKGTQQEKAPWSSRIKARTGWNFTSYVANGDVTGDGIADVITRDSGGKLWLYPGTNKASSSLFGSRIALGSGFNQYNLLF

SEQ ID NO: 11579 - protein, 411 aa, Streptomyces avermitilis
MIAGEPSFMTESFRRSGEYPEGDHQQPAYPQQQHSSSPVNPEWPPPPAYEPVTPVAVEPGTTVWPSPAQAQAHGHVAGQAADHTFAATGDGGYGGGHGGDTALFTTSPEGAGAAPKKRARGPLALLAAVAIVAAAIGGGTAYGIQELTGNDTASSSTSTNVVPTAKKGTVAGVAQAVSPSIVEISAASNAGSSTGAGVIITSSGEIITNNHVISGASEIKVQLNNGKSYTAKVVGTDSKKDLALIKLESAPSGLKAATLGNSDGVQVGDDVVAIGSPEGLTGTVTSGIVSALDRDVTVSTDESQGQQQQQGGGGNGEWPFSFGGQQFNGDTGSSTTTYKALQTDASLNPGNSGGALIDMNGNIIGINSAMYSAASDSSSSSSSAGSVGLGFAIPINTVKADLETLRSGSTG

SEQ ID NO: 11580 - protein, 84 aa, Streptomyces avermitilis
VSTSRFKRLKSSKEYAMIKNLSHTVADTDPAEVARALAVALELHAPAPRAPEVAVPPQLMGLRMPATRRHRRKVVLSHLGGVCV

SEQ ID NO: 11581 - protein, 243 aa, Streptomyces avermitilis
MSPAEGDREPQRILIVDDEPAVREALQRSLAFEGYDTEVAVDGADALEKATAYQPDLVVLDIQMPRMDGLTAARRIRGAGTTTPILMLTARDTVGDRVTGLDAGADDYLVKPFELDELFARIRALLRRSSYAATAVGVPEDDALTFGDLRMDLATREVTRGGRSVELIRTEFTLLEMFLAHPRQVLTREQILKAVWGFDFEPSSNSLDVYVMYLRRKTEAGGEPRLVHTVRGVGYVLRSGGAE

SEQ ID NO: 11582 - protein, 494 aa, Streptomyces avermitilis
MNRAVRRFRTLPIRSRLALLVAAAVAFGVAAVSVTCWFIVQGKLYDEIDTNLKAQKGPVSYGSVKRAGYNCGRDPKSSDESLHGRSEYYTQVVKADGTVCAFDGSAGTVKVTSSDMAMVKNPSWAGGAPRTGTDSEGNPVRVLIMPLIVTDGPVPVPTPVDNTAVVVAAPLEGTQSTLKDLALLLLLVSGIGVVGAGAAGLAVARAGLSPVDKLTDTVEHVARTEDLSVRIPVEEDSEDEVARLSRSFNSMTSALASSRELQQQLIADAGHELRTPLTSLRTNIELLTRSEETGRPLPPADRKALLASVKAQMTELAALIGDLQTLSRSDAGHPADRVEVVSLQDTVEAALRRARLRGPELTITADLQPWYVRAEPSALERAIVNILDNAVKFSPEGGTIEVALDKGALTVRDHGPGIETDELPHVFDRFWRSPSARALPGSGLGLSIVARTVQQSGGEVSLRRAENGGTVATVRLPGAATPPPDLDPDDAGSQ

SEQ ID NO: 11583 - protein, 71 aa, Streptomyces avermitilis
VQIMNGTPDLTTAVWRKSSYSDGGDSNCVEVADGYPGLVPVRDSKAPQGPALVFGAEPWAAFLAMAKGEGR

SEQ ID NO: 11584 - protein, 277 aa, Streptomyces avermitilis
VDELVDGERESGRAALGRTLRLLREKSGKTLGQLAGETSYDKSYLYRLETGERLSKRAVMEDLDRYHGSGDLLVRLWRDARKDVIKDKYKAFMELEATARVMWKFQLRVPGLLQTEDYARVVLSGLSRAQTTAGNGEEVEEQVAARVGRQEMLHRQPAPSVRVILDEGALRRRVPKEKVWADQLVHLVDVAELASVTLQVLPFTAGVHDLMNSDLTLMWQRVGEPVAYVEGNGFGELVDDPDKVLSYRLSYDLVRDAALTPAESTTFIKRLLEECRS

SEQ ID NO: 11585 - protein, 98 aa, Streptomyces avermitilis
VTSVDGTSEQLRLLPWTTPDGRPCYLSAASDHSRLSLLADDMEAAQLDSAEQVLAGAKAVLADPKAGERAVRFALTRATESLGDTLRIAVSRGGRLPG

SEQ ID NO: 11586 - protein, 557 aa, Streptomyces avermitilis
MVEGTESATGAASAGDLVEGRHAAPKARAGKGGLARSSLLMALGTVVSRATGLIRQVLQAAALGTGLLASTYNTANTVPTSLYTLLIGGALNAVLVPQLVRARATQPDGGRAYEQRLVTLVLCVLGVGTALAVWAAPGIVALYMRDTPDSHEAFELTVVFARFLLPQIFFYGVFSILGQVLNAREKFGAMMWTPVLNNVVLIGMFGAYLSLMTVPDRVEDITGQQVRFLGVCTTAGIALQALALIPFVRAAGFRFRPRFDWRGTGLGKSVHAAKWTLLLVLANQVALTVVTNYANAVDQELPKAGAGYTAYTYAQTIWMLPQSIVTVSLVTALLPRMSRAVAEDRLPDLRADLSRVLRISGVVIVPAGFLFLALGPGIATLLFAHGAADAASAQPLGHMLQAFGLGLIPFSAQYLLLRGFYAFEDTRTPFFMAVWIAVVNIALATACHLLLPARWAVTGMAAGYTLSYLAGLLLTARLLRKRLGGRRLDDGELRRTYGKLLCASAVAAGAGWAAARATATTTPTALALAAGAVTMALVYVALARLLKVSELRLPGRG

SEQ ID NO: 11587 - protein, 601 aa, Streptomyces avermitilis
MREVKEAFARFWPLTRGDRKWLALIIGCVIVSALAETASILLFAELTDHALKAGSLSAFWGPAVAWLGAAALGAFVGYLGNSLATWTAERFVLRLRANVFRHVQDLPPDFFQKHRQGDLVERLTGDVEAIEQLVVSGVVGTFSAAFSAVFYAAAALWLRWDLALVTFLLAPLFLVTARRFAGRIKESAQDERAADGAITSVVEESLGNIVLTQAYNRRGAEEKRLDREARAWMRASVRGARASEMYEQVVEVVETLCVLAVIGLGAWEISQGRMTLGQLLAFAAFLGYLYPPIRNLGQLGLTLTAATAGAARLQEILDAKPAVTDPAAPVAPWPVRGWVSFHGASFRYPGSGRESLHDVTFTAGPGELVLVTGPSGAGKSTLSKLLTRFYDPTAGAICLDGVPLSDVPLEFLRENVALLPQETLILHGTIRENIECGRPGATDTEIESAARDAAAHDFIAALPDGYDTEIAPGTAALSGGQLQRIAIARAMLRPAPVLVLDEPTAGLDALAARRVVLPLRRLMSGRTTIMITHDLSLAPDADSILVVDGGRLVETGTHTELIARGGAYARLAAPLPETVTETVSVAETMSVPGEDTLMLRL

SEQ ID NO: 11588 - protein, 57 aa, Streptomyces avermitilis
VAPPRGGRQPCLPTGRRLGAAFFGACFLGAAFFGAGFSFFLMGVILWKLMGMPLSAN

SEQ ID NO: 11589 - protein, 44 aa, Streptomyces avermitilis
MSFHKVAPVKKPRKAAPAAPAPKKAQHKPARRQVRRPVGNKSQD

SEQ ID NO: 11590 - protein, 359 aa, Streptomyces avermitilis
VEDWAPPNHRRRGARRRRRRFAGLPLAMKAVVGVLVLAAFLTLADRWALLYAEQRAAGALQDRLGLSAAPEVEIDGFPFLTQLGDSRLDSVKLTVPDVAADRVSLAKVSATATGVRINGGPTSPRGARIPELHGEVLLAFDDLDRELGASQVRFRGEGRDRVLARGTLPVAGHDLRLRAQARIERDGARGIATRIGGMRLDIGDVATYRPGTRPSEGLHLSRRSAARLAHETAKAKALLSVPSIVRALRVPDAAVRAALSDDTKLAELTGSDRFARQAMGLNLIDVAAAHPELLKRFGLDPALLDGLSRLTRPVLVDRLSFGFRLPQPEHGDLWLRDVRVMKDGIRVRLVGSGLRVGKS

SEQ ID NO: 11591 - protein, 603 aa, Streptomyces avermitilis
MPPTYRHRRIHRILSTAAGLATVGALVAALPASAGGGRPGGHGHGLPGRYQDVQLLSFNDLHGNLEPPAGSSGRVTELQADGTSKTVDAGGVEYLATHLREARKGKKYSITAGAGDMVGASPLISGLFHDEPTIAALNKLDLDVTSVGNHEFDEGAKELARLQNGGCHPKDGCYDDDSEKFRGADFPYLAANVTDEKTGKPLLKPYWVWKKNGVKVGFIGVTLEGTPNIVSADGVKGLKFGDEVETINKYAKVLQKQGVKSIVALIHEGGAPASTAYNYDCDSPGAGDGISGPIVDIAKNVTPAVDALVTGHTHQAYACTINDPAGKPRMVTSASSFGRLYTDTTLTYDRRTGDIARTAVKATKSVNRVVTRDVTKAADMTALITKWKTLSAPIASRPLGYIAGEIGNTGAESPLGDLIADAQLAYARSVDPEADVALMNPGGIRAPLTYAASGGEGDGVVTYGEAYTVQPFANTVNLVNLTGAQLVTALQQQVSGSNEAAPKILQISGGLTYTLDLTKAGAARVVTDSVKLNGSAIDPAASYRVAMNSFLAGGGDGFAELGKGTNVVVGGDDLAALEAYLTANSSAGTPYPVPAANRITVVK

SEQ ID NO: 11592 - protein, 308 aa, Streptomyces avermitilis
MTSDDTVWPGAGRSIETLAALSPGQAEAVLALLDEAARVDGQPAVSEQGRLQLRGGEREGVRHLLLSAGDTLVGYAQLEDTDPVEAPAAELVVHPAHRGRGHGRALGTALLAATGKRLRAWAHGGHSAARHLAQVLGLTLFRELRQMRRPLAGLDLAEPKLPDGVTVRAFVPGQDDAAWLAVNAAAFAHHPEQGSLTQRDLDDRKAEPWFDPAGFFLAERDGELIGFHWTKVHAQEGIGEVYVLGVRPGAQGGGLGKALTTIGLRHLEAQGLPTAMLYVDADNKAAVSVYERLGFATHETDLMYRTES

SEQ ID NO: 11593 - protein, 192 aa, Streptomyces avermitilis
VRSAWCSPGCRGCGPGRAFPRCGPAPCASPSGSPSCSTTRPGTPPPRCRPGGRYAPGCAWQLVAPVAALWWTAVLLLAPGRPPAGPVTLEAAALAALALAGAAAAVRWSDTAEPGAATAAWLLFAACAGLLLLPGRWSLYVGPADPRWQAAHVRWAALLAVGVLVWAASGPEPLRARRLTSGTRRRPPRSGK

SEQ ID NO: 11594 - protein, 523 aa, Streptomyces avermitilis
MSTSTTPSALRDADTEGAAPAMDEPVRPDGRPAAAVLALARFEARELLHHIPVFVFLPLYFGFTGWQLFAGDAAGDYPILQDVDRGTQSGPLFLAIALLACVNRTVLRSRRNGTDGHFDVLVMEPWRRTLAHALSVVPYAVVTALVVAFEFSWAALKPGAVGHGSVAELAVGPLMVLLTGILGVLLARLIPYSLAVPLLVVGAFFFAVLVAAGTNDGHWQKWLWPTVSETGAPPLPSDLLGRPAAWHALYLVGLAGLLLGAAVLLSGGRARRVKALTALALAVTVAGAAGQSPGDSAALAKARTTASRTPEKVQSCAPLGRSTYCAFPEWSGQRADWAEVVERVQSLAGGAAGGERLTVRQRVADISDLTSDAAIDPVRTPRQVTVGTEWGGNQRLKFAVAVASVLVAGNENATVEMCDARVVTIMWLALGTESDPVYALGDVRLDDSVEGSALALTPTDGLSMTRGQTTVVRELFERPRYGVTARVKTHWTELTSSKTSLTRAAELLGVAAPKATGDECADE

SEQ ID NO: 11595 - protein, 288 aa, Streptomyces avermitilis
VTSAPTVSGCGLTLRYGGTAALDDVTVRLHPGVTGLLGPNGAGKTTLLRVLATAVPADRGAFTVLGHDPGTAAGRQEVRRELGYLPQTPGFHPDFTAFEFVDYVAILKELTERGTRHREVRRVLDAVDLSDVRGKRIKRLSGGMRQRVALAAALVGDPGFLVLDEPTVGLDPEQRMRFRELIAQAGEGRTVLLSTHQTEDVAMLCHQVIVMARGRVRFEGTPAELTARAAGHVWSSTERDPGARAGWRTGTGSFRNVGDPPEGARLLDPTLEDGYLLALDGEPAEVAA

SEQ ID NO: 11596 - protein, 68 aa, Streptomyces avermitilis
MPGPRGLLRGWRPRAARAARLTAAAVLTGAAAALLVLDAVLRVLGPVARIGLGGTRSHQTFGDDGGDS

SEQ ID NO: 11597 - protein, 285 aa, Streptomyces avermitilis
MRDTTWHVPEDDLRAYVQGELAPPRLWSADTHLAACERCRAALAEAGDPVALDAAWERLDAELDAPRPGMFESLLVRAGVADHTARLLTATPVLRRSWLGAVAFLLVMTVGIVLTVDSPALFLALAPLLPLAGVALSYGPVLDPTYEMAVVAPLHGFRLLLIRTLAVLATGLLLNGLATLALPGYGLRALAWLLPALALTGTGLALTPRLGPVLAPALTGGAWIGLLLVAQARTHETLAPFTMAGQGAAAVVAALAAGLLYRTRDRFDSVAARLPFAHLPGGGAV

SEQ ID NO: 11598 - protein, 179 aa, Streptomyces avermitilis
VRETRSDGELLRAAADGDRRAFEELYRRYAPWLTARLRGRCADAGLVDDVVQETFLAVWRGTARYREDGDVAGWLWRVGSRRLIDALRGDGARGRLRQALARLRHRDEASAEERVLAGVEHGDLAGALVRLSPELRAVLQATVIDGLTTREAAVLLGIPPGTVKTRALRARKQLREALA

SEQ ID NO: 11599 - protein, 132 aa, Streptomyces avermitilis
VVERVVEYRIDRRSGVATYVQIVQQTKQALRLGLLEPGDKLPTAREVVEATAINPNTVLKAYRELEREGLVEARRGLGTFVRRTLGAAPADSPLRTELDAWAQRARTAGLDREDVAALLGSVLDEHFPKGDQ

SEQ ID NO: 11600 - protein, 305 aa, Streptomyces avermitilis
VSSTRTTADVALEAYRLGKRYGRRPSAALDDCSFRLPAGRVSALVGPNGAGKSTLLALAAGLLRPTSGTLTVLGGAPGEARDRVAYLSQDKPLHPQLTIAETLRLGAELNPGRWDAAHAASLVEQGSLDPATKIRRLSGGQRTRVALALALGKRPDLMLLDEPMADLDPLARHEMMGTLMADAAERGTTVLMSSHIVAELTDACDHLLLLGDGRIRLGGGIDDLLTAHSLVTGRGTPADLAPHTVVESRASGRGLTALIRRDGPVDSGWEVQEPSLEELLLAHLRAPGAPALITPGTAVSVEVTA

SEQ ID NO: 11601 - protein, 313 aa, Streptomyces avermitilis
MSATTLATPRRRTLPGPRGLVWTVLRLHRTALWIWLAFVTGTAGLLLWLYGPGATAAQQAFDTYGYYVPGGLNSTKEAYDDLFYRPATLISVATFVVPLFAGGALIGRELETGTAQLAWTQSVSPARWLAARLAVPALLIATGTGLLVALYRLLWSAHNGLLVAGYAPRELYFAIGPATVVHPLLGLALGALIGLLVRRALPAIAVAAGTQYVLTALHNRLWPFQHNTPYSPPAELSVHSGAFTSGGALIPDPGCYDSKRCLAEHHVVGFTRDYLPSPEYWPRQLLETGLLLAATAVVVAVAFRVLNRSVTTP

SEQ ID NO: 11602 - protein, 317 aa, Streptomyces avermitilis
VRGLSWTVLRLHRSAVVLWGGALLAATVALIWMYAIGDDARAGIGACATPATGQLPPCSAVHAITADGIYADTLASVGTAVSYLMFPVAAWAGGALTGRELETGTAHLDWTQSVTPARWLAARLTVPAALLASGTAAAVLLNVWARQDGNPDLVGDWYYADVFVSTGPAAVAHVLAGLALGALAGLLTKKTLPAIGLALAATLVLHNALDWYRTSLWPTVTTTGRAALDLPRSALDLEHGVITTTGERIGNNTACVGSDSLADVQRCKSSSNLTDFWATYHPRSHFWPLQFMETGLLLALAAAATATAFWLLRRRTA

SEQ ID NO: 11603 - protein, 784 aa, Streptomyces avermitilis
VPEPSPPPVNGESKRTGRQVVALPPARSDAPFPRPARKNGAMSQPNVQAQVQHPQPSVGSIAAHRPHTVAAAVSDLEPDLDADLDAYEDTDADGVQLPQGRFLDRERSWLAFNERVLELAEDPNTPLLERANFLAIFASNLDEFFMVRVAGLKRRIATGVATRSASGLQPREVLEMIWARSRELMARHAACYQEDVAPALAEEGIHLVRWNELTEKEQARLFTLFRHQIFPVLTPLAVDPAHPFPYISGLSLNLAVVVRNPVSGHRHFARVKVPPLLSRFLEASPDRYVPIEDVIAAHLEELFPGMEVLEHHTFRLTRNEDLEVEEDDTENLLQALEKELMRRRFGPPVRLEVEESIDRHVLDLLVRELKVSEAEVYPLPGPLDLTGLFGIGALDRPELKYPKFIAGTHRDLAEVESASAPDIFAALRERDVLLHHPYDSFSTSVQAFLEQAAGDPDVLAIKQTLYRTSGDSPIVDALIEAAEAGKQVLVLVEIKARFDEQANIKWARKLEESGCHVVYGLVGLKTHCKLSLVVRQEGETLRRYCHVGTGNYHPKTARLYEDLGLLTADPQVGADLSDLFNRLSGYSRRETYRRLLVAPKSLRDGLVSRINKEIQHHQAGRPAFVRIKVNSMVDEAIIDALYRASQAGVPVDVWVRGICAVRPGVTGMSENIRVRSILGRFLEHSRVFTFGNGGEPEVWIGSADMMHRNLDRRIEALVRVTDPAHRAALNRLLETGMSDTTASWHLGPDGEWTRHATDAEGQPLRNVQEMLIDARRRRRGTATP

SEQ ID NO: 11604 - protein, 360 aa, Streptomyces avermitilis
VAQRHLDPPTDPTAGPAPTGDALAGYLRAQATEFLRSLRQHRETGAVSGSEDSVDAARALRRSARRISGTLHTFRPLLDTDWSEAMRPELAWLSGTLAREHAYAARLERLLLALHRLSGSAAFPTPSAGPAPRAQTSPDRGNLTVGAAKAGALLDRQLTLARTRAHSAALQALGSSRFHAVADSVAVLASEVPLTPAAATADPRPFAAAADERLCDAVSALPLVTAGHPYNAEALIHGLSPDTAPHPQDAPWHQVRLLLRLHRYAREALYGEEDTALPERGRELGGARVDVRLRSAGQALNRHRDAAEAAAAASSAARTPRIAPATAYALGVLHADQRHEVEAARFAFQQSWQKEAVGTP

SEQ ID NO: 11605 - protein, 137 aa, Streptomyces avermitilis
VTDDIIRAAGCVLWRRSPVDGKLEICLVHRPKYDDWSHPKGKLKRGEDPLSGAVREVAEETGRTCTPGARLPTLRYQVNGRLKEVGYWAAEAGAGTFTSNREIDRILWLSPTAARHRLTRPRDRDLVDALLSALHLA

SEQ ID NO: 11606 - protein, 368 aa, Streptomyces avermitilis
MNRRALTLGALAVSGALALTACGSDDTGKSNTDATTSSNSAIKCDNAKGQLQASGSSAQKNAIDAWVKAYTASCKGVQINYNPTGSGAGVTAFTQGQTAFAGSDSPLKPEEVTASKKACGGSQAIDLPMVGGPIAIGFHLSGVDSLTLDAATLAKIFDGKITKWDDEAIAKLNPSAKLPSTKIQAFHRSDESGTTDNFTKYLKAVAPSDWKYSGGKAWQAKGGQSAQGSSGLAQQVKQTEGAISYFELSYAADGISTVDLKTGAATPVKASVENATKAISTAKVAGTGKDLSLSLNYKPTEEGAYPLTLVTYEIVCEKGNKADTLPATKSFLTYIASEDGQKLLTDAKYAPIPDEIISKVRTTISSLS

SEQ ID NO: 11607 - protein, 335 aa, Streptomyces avermitilis
MDISTQNTEAPPPAPGPPVAAPTSASRGATRPGDRIFLGLSRGSGIFLLVIMAAIAAFLTYRAANAISKDHTNFLTTFEWNTNLEPASFGIAVLAFGTVVSAIIAMALAVPVSVGIALFITHYAPRRLGGPIAFVVDLLAAVPSIVYGLWGALVLVPHMDGLFGWLDHYFGWTGVFEWQGGAPRSMLTVGVLLAIMILPIITNVSREVFRQVPRMHEEAALALGATRWEVIRMSVLPFGRSGVISASMLGLGRALGETMAVATVLSPTFEINASLLDPGGGTFAQNIASKFSEATPLGQDALIASGLVLFVITLLVNGAARMIINRRKEYSGANA

SEQ ID NO: 11608 - protein, 353 aa, Streptomyces avermitilis
MSNAAVTDKRPSTLRGASLPKWSPWAIAAGSVALAVVIGVLGGLGSKVQWGLIAALLFVLGTYAVAAKVEGRRQAKDRVATSLVWVCFLIAVVPLASLIWETVKRGVKVFDVYFLTHSMGVVADTETGGGIYHAIIGTLEQVGIATLIAVPIGVLTAIYLVEYGRGRLAKAVTFFVDVMTGIPSIVAGLFVLSFWILILDMGYSGFAGSLALSILMMPVVVRSTEEMLKLVPNELREASLALGIPKWRTILKVVLPTSIGGITTGVMLAVARITGETAPVLLLVWGTNFINTNPFSDPQASLPLYIYQQYANSAGSGAAYDRAWAAALALIAFVMILNLAARGIARWKAPRTR

SEQ ID NO: 11609 - protein, 258 aa, Streptomyces avermitilis
MAKRIDVSGLTAYYGSHKAIEDISMTVEPRSVTAFIGPSGCGKSTFLRTLNRMHEVTPGGRVEGKVLLDDEDLYGQGIDPVSVRREVGMVFQRPNPFPTMSIFDNVAAGLRLNGSYKKSELSEIVEKSLKGANLWNEVKDRLNKPGSGLSGGQQQRLCIARAIAVEPNVLLMDEPCSALDPISTLAIEDLIGELKERFTIVIVTHNMQQAARVSDRTAFFNLAAVGQPGRLIEVDETERIFSNPSVQATEDYISGRFG

SEQ ID NO: 11610 - protein, 332 aa, Streptomyces avermitilis
MDTFALIVTIGVALGFTYTNGFHDSANAIATSVSTRALTPRAALAMAAVMNLAGAFLGSGVAHTVSKGLIETPEGSKGMGILFAALIGAIVWNLVTWYFGLPSSSSHALFGGMVGAALAGGTEVIWSGVLDKVVIPMFLSPVVGLVAGYLVMCAIMWIFRRANPHKAKRGFRIAQTVSAAGMALGHGLQDAQKTMGIVVMALVIGDVQGADDPIPVWVKIACALMLSLGTYAGGWRIMRTLGRKIIELDPPQGFAAETTGASIMFVTAFIFKAPISTTHVITSAIMGVGATKRVNAVRWGVAKNIVLGWFITMPAAGLVAACSFWIVNLAFL

SEQ ID NO: 11611 - protein, 206 aa, Streptomyces avermitilis
VRFRLTPRETSFYDMFAASADNIVTGSKLLMELLGADASARAEIAERMRAAEHAGDDATHAIFHQLNSSFITPFDREDIYNLASSLDDIMDFMEEAVDLVVLYNVEELPKGVEQQIEVLARAAELTAEAMPHLRTMDNLTEYWIEVNRLENQADQVHRKLLAHLFNGSYEAIEVLKLKQIVDVLEEAADAFEHVANTVETIAVKES

SEQ ID NO: 11612 - protein, 118 aa, Streptomyces avermitilis
MTTTEAGATVPSEGTPAVVTDHDRGIHGYHQQKGEHLKRLRRIEGQIRGLQRMVEEDTYCIDILTQVSASTKALQSFALQLLEEHLRHCVADAALKGGAEIDAKVDEATKAIGRLLRT

SEQ ID NO: 11613 - protein, 62 aa, Streptomyces avermitilis
VMRVAPVGGTAVQDHVALAEIELCGDLMIAASAADEDRLSMESIDEVLKVAEERAHEVEPGR

SEQ ID NO: 11614 - protein, 277 aa, Streptomyces avermitilis
MTARQHTRTGTAVAVATGLIVCTGGCAGDPADAEDAHAGADAVAVLHKAAGALVSAGSSKARTAMEMATGGTRVTIRGEGVYDYRRQVGQLKVLLPQDPAGAREHRSITELLAPGALFMKNRGAGVPADKWVRVDTASLSDGNLVTGGVTDPYAAAELLRGARTATYVGRTEVAGEPVRHYRGTADLGLAAKSASGVNRAQLRAAARGFATAAVPFDAYLDDQGRIRKIRHRFSFVNGQRKGTVAVASTTLLYAFGAPVRVRLPEAGDIFAGKIAEG

SEQ ID NO: 11615 - protein, 525 aa, Streptomyces avermitilis
MQRRTFIGGGAAAIAAAATAACSAGNGGGGDAKTSAAGEGAETSGTAIRSATTSSRVAANWTALARDLDGALVRPGDRSWPAAHQLYNTRFDSLKPAAVAYVAHADDLRTTMAYARAHGVKVAIRNGGHSYAGWSSGNGRLILDVSKLNKTRASGGTAVVGAGSKLIDVYRALAAKGVTIPAGSCPTVGVSGLTLGGGHGVVSRAYGLTCDSLTQATLITADGKQLVANATENKDLFWALRGAGNGNFGVVTELHFKTHPAPQGVSAYMTWPWSKAAAVVKAWQEWGPDQPDEIWSSCHLANAAGGTPTVSVAAFSLGTYGELQNAVDRLADKIGAPARSVSLKRRSYEESMEVYAGCSSFPTDAQCHLPGTTPGRSPQGALGRETYAARSDFFDRSISSAGVQTLLNQMTAVRGGAGSIALTALGGAVNRVSPTATAFVHRRSRMLAQYIASWRAGTSGTTAQSWLTGAHAAMQRHASGAAYQNYTDPTLTNWRKAYYGDAATRLTRLKHQYDPNGFFTYPQGL

SEQ ID NO: 11616 - protein, 232 aa, Streptomyces avermitilis
MAVLAESGSNPDVTLLYDINGLAKDAPHWFDRAMEFVGEYGLLLAMVLLVVWCWWGVRRRSGEDAASSVAALVWAPLAAGIAVLVNVPIRGFVERPRPFVDHQGLEVLVSGKTDFSFVSDHATLTMAMAVGLFVASRKFGLAGIGLALLEGFCRVYMGVHYPTDVVGGFALGTAVALLLSPLAMALLTPVMRAVERSSRAGWLIRARGTAPADTLIPGTRPGTATEERDLAA

SEQ ID NO: 11617 - protein, 335 aa, Streptomyces avermitilis
LTVRKAWVVAFAAVGAGLSFVMLLVVGVYVVAGNLANGVGKGSVGLAKGAVPAAYQSLVQKWGNLCSAINPALLAAQLYQESGFNPNAKSPAKAEGIAQFIPGTWATHGVDGDGDGDRDVWDPNDAIPSAASYDCKLASYVKDAPGNQTENMLAAYNAGAYAVVKYGGVPPYKETQNYVKTITSLEKSFAAPVTRVDPSKQAAAAIYYAQKKLGTPYLWGGNGTADQGGRFDCSGLTKAAYESVGVTLPRVANDQYNAGPHPKRDELLPGDLVFFSDDLTDSRAIRHVGIYVGGGYMIDAPRTGAVIRFDPIDTPDYFGATRVTEDGAKALPTTV

SEQ ID NO: 11618 - protein, 574 aa, Streptomyces avermitilis
VEGLRDRDPARIGAYTLLARLGAGGMGQVYLGRSPGGRLVAIKVIRDEITDHPEALARFRREVETAGAVRSAYTANLIDASLDAAPYWLATEYVSGPTLGGAVTERGPFPPDSARRLFAALAEALASVHGYGVTHRDLKPQNVILSGQGPLLIDFGIARNTTDTALTQTGLAPGTPGFTAPEVLTHNQVTSAADVFALGATIANAATGRPPFGSGPAHAVSYRAVHEDIDVDGVDPELAALIQACVAKDPVERPGLETVIARCAVTSALTEDPFYRPLAGTGDTAPPDLPAAVAAGLVPVGHGMATPPAHRPTVGPGYVPTLAPVTPPPAAARGWRRPLVAGIVGAVVLAAASIVAWQVLPDDRGSAKGGGGASGSPSSSSSAGAASQKVPAYIENDRISRDNWTLSDNPDDAANGIGKCAQIGAVSAPEELQYSARDADDPQLAYVKEKAKISFRFKYAELKNKKPEPYYVSVGVKPPHDIDSETGKPYEVMAANKTIGYSSKPVDIYKHWKSGGTIELTYPDDFQQHWKGETLDAIPVTHDPGDWTAVFYHVKGSPTDYESFGCTGFRGGQG

SEQ ID NO: 11619 - protein, 274 aa, Streptomyces avermitilis
VARGDVFGRSQRLSHLGGTQWRVMKRIARPPGARRLALFGAVVLLALTTSSVAAADRGPGPFGVTVQAEPSPQMVRVGALFGGDGDLLGNHFCTASVVRSTAHDLIVTAAHCVDGGGKTWFVPGYRDGQAPYGVWQVTKTYVGDAWSGGQDEDSDVAFAVVEDLGGLEVEDLVGGNAFVTGQATGATAVTVTGYPKSLDVPITCTNKPTVHSRTQQRIECPAFPGGTSGSPWVNGDGAVVGVIGGYEEGGSTDDVSYSVVLGDEAAALYRAAAN

SEQ ID NO: 11620 - protein, 143 aa, Streptomyces avermitilis
MATVSPSWAYTLQLPHDPRAPGIARATLRTVLAAHGLAELTPTAELLASELLTNAHLHTKGPYALRIRSTEPDRLRVAVWDTDPRVPPGFGQEGASVVVPDQEAENGRGLQLVRACADSWGVSVLRELGVSKGGKLLWAECVG

SEQ ID NO: 11621 - protein, 290 aa, Streptomyces avermitilis
MHGREAEDGVRSNPTGRQLRFGAELRKLREQAGLSATDAGQLLGIKQTQVSNMEAGRVGVSADRVRTLACHYECSDKALVEAIAAMTGDRTRGWWEEYREILPVGLLDLAELEHHATRLRTAVTVHIPGLFQTTEYAREIFRQAVPELPQPDVEHRVSFRIKRQAILFRDPPTPHQIIVHEAALRMRFGGSDVTRDQLKYLTAMNEREHISVQVIPFDTGVLPGSGQSIYYAEGPVPQLDTVNLDQSHGPVFLDAGAQLRKYRGLLDRMESAALSPEDSQKFIHTILKAL

SEQ ID NO: 11622 - protein, 71 aa, Streptomyces avermitilis
VREPTMPTTKLTWQKSSYCPEGNSCVHIAADPSTETLHLTETGDSTGAILTTTPTAFRTLLHTLKKETHRG

SEQ ID NO: 11623 - protein, 81 aa, Streptomyces avermitilis
VAEVPSNLTWVRAAPDDATGPGPWIELAFGDNDLVYIRETSDPENVVTTTQRKWDAFVLGVQAGEFDHFVEGVESAAADES

SEQ ID NO: 11624 - protein, 124 aa, Streptomyces avermitilis
MKRIDIDDPEVDMDLSLRLLYRGELFTGEVEEYLGGVRVSLASYADGFPHGPSRSWHKNGTRQSEGTLRTGSPAGVWRTWHANGTLAVRMVMSDDGARQLARCEWDEDGKLTKEWHADGHADGG

SEQ ID NO: 11625 - protein, 159 aa, Streptomyces avermitilis
MASGQPTQEVLGWLTERGWFPGRDIGEQAEELVRVRLQDSERQGVPLTPVSAAVRFIHTYGMLRLDHPKASGCAWVMKPTIGYDGDAGNIKELGAGLGVELFPVGYEASEFGILLVDGRGRLFHLHHTGGYYLGADAFDAFSRFVEGLPDLDAEDFYVQ

SEQ ID NO: 11626 - protein, 205 aa, Streptomyces avermitilis
LCKDWTPGKFPEGRTASQRLREWIDAGAGGLDAVGLDLTGADLSYGDFSESWFTDAKLVNARLVEAELYRSDAQGADFSGADLTGCSLVRVNLDDAVLRDATLDLANLVKASLCDVDASGASCRGTQFRGASLLGVNLRSADLSNAMFQENSFQVTLDQNTKIDGASGSVFGPAAIVEGDVSRELSGAALGGWIKAKGGDIRVLS

SEQ ID NO: 11627 - protein, 303 aa, Streptomyces avermitilis
VSYLCEGWTPGKFPEGRTASQRLREWIDAGEGGLDAVDLLTEVSAELSRAVLERLRAVDWHGDWDVANSHTRSRALLMREYMRRAALWARAYGAEAEWPFFDVTEFLDPTFQLDPEVASELEEYLAHNVGTPSTARTCRGAVRWAALRAVRGDDFPALPDPYEPLLLMYGRGGGYSIEEFIDLYGVMIPYGNFDSSLNAEPFLSLAPSTLDALDAWAEGRITYYAKISEGYPRSSPRGILRRRLVGREAETHDEAFTRNLRWEPTEYLRLYELGHNDVDHVQISEREAAAFIEAVTKKLTGVR

SEQ ID NO: 11628 - protein, 774 aa, Streptomyces avermitilis
VIKPEAIPQYTGDLALLESAYGDLKTDASHIRSTGKDVHSQFQGLAAYYTAPEAEQLFASTKPVADRADGFADDLEKVSGALSSYGTEIRPLVDKLKQLKIDATNFVSSVKDDDDWEYDEDKIDKHNKIRDDVTATVAAFWAAERTCHNAITKLFGGTQMVAGDGSDRKDQYGFNADDLKNAKLPWGDPMEEKHHVWEVGHWVKSFVWDGLIVDGVWGTIKGLGTLVGFGGWDAMGQAWKGLAQLATGLAISSIPGASALFWTLPDDKLPSWLRDSRTAMKETGKALVAWDEWGKNPGRAAGAVTFNVLTTVFTGGAGGAAAGAGKAGAVAKVLSVAGKAGKFIDPMTYITKGAGAGLSKIGDIAKGLKGIGNIEIPKLPDNAITLPEGALKLPDGSVHIPEGAAIPEGAVKLPDGNFKLPDDTPAFPEGTTKLPTEPGAPAQYLDPNGNILDHQGNVVDNVDNAPTDVVDKPATGGHPAAGSDVPHVESPVKEPALVGAGSHSGHDLPSGTPHSGHDLPAGGGHTPDAPHGTGHDTPAGHADDASHGGGHDGPGHDGPGHDGPGHDGAGHTDDMAGHGDDAAHTGDHDGTHAETPSSDSSAPGHPHGGEAVPGQTGGAVRPPDNGSVRSYMKTEEWAGEAYDAIRDADDVDAMASHLQDAPRIDGGTGFTSEEIEAIKHHVFTEEHPLESVDGDIVHARYDANPDMAEAWIRLRSGTHTESDLLLLEHELAEHRYYQAHPGSTYAEAHAAATKIADWASHMEPPRRENYTWEN

SEQ ID NO: 11629 - protein, 130 aa, Streptomyces avermitilis
VVSGWDLKPQGIQGVLKTTGETASHIETHAKSYGEHLTSAATNAGTISAEGGGGGEKAAGGLVALALSQYAEHAATDLKFIAARAGKSLQGAVDATTAYLNGDQEMAAEAQRKALSAPDLDPMKPGVQTS

SEQ ID NO: 11630 - protein, 105 aa, Streptomyces avermitilis
VMAGAGSDRRSYDTGASADAQGNIQAVIGRLEEVIAARDRQVKAAMSDFAADGVADEYHGKELRWNRASTEVKSIIQLLKTTLEKNDGTAQSTISKAKAAVDNIG

SEQ ID NO: 11631 - protein, 110 aa, Streptomyces avermitilis
MKFDMGSQVLSTLISNSRGSSDDLGTLIRQLVQAAQPLEGKFNGAGRVAFDSFKGRSDEITASLNSALSGILGGQSGMESAFGSGDQEQGENARTNEKAANFDGARFSGR

SEQ ID NO: 11632 - protein, 102 aa, Streptomyces avermitilis
MFLAADKGDITTIIGGIAPDWGPFGSLGNEAKVMIEVVMAVAILLCLGIAIWGAAKQRIGATALRDTFSAEQGKGLIIAGLTGVFIIGSLGTLFTIVYGMAV

SEQ ID NO: 11633 - protein, 283 aa, Streptomyces avermitilis
MSLGDEPGYGDAPRGEDGGYGGTGQTRTRLPDRAGDVYGGARRGRSSSRSLVTVVGVVVLLIAAIAFANRGDDESASGAGDSDKTNTAPTAATGEQPVQSKVGDIPAGFAHSDQGAQSAAANYGVALGSTGMFNANQRHAIVNTVYAPEVAAARQSDLDRAYSSEKFLANIGLAKDGSAPSGQTFVSRIVPVGTKVTKFSTDSATVELWYTSLFGLSGERSTNPVSESWFTTTYDLKWIDGDWKITDFTQKDGPVPVGRDQQASTADDMTKAVEEYGGFTYAR

SEQ ID NO: 11634 - protein, 444 aa, Streptomyces avermitilis
MRAKRRVLRVAAAVTAVQTTTVLLATRAFAEPTPKPSKSGDPCDLIRGPAKDYCERGNPSSKTGGATGGDSLTDSTLDPLSSLAKGCADAASWTVDKLSEAVKSTANVDFTNPKFLQQYAVVFAASTILTLLLWLLAVAKRAVRGVPLTTAISEAVGFLWLTVLASAFTPLILYTVVSATDGVTQVLAKTTGNQTDTFFGTFSAALGKGENIGGGPIMLIVVSMVSILAAGVLWLELVVRAALLYVGALLGTVVYAGLVDKNLWGHVRRWAGIMIAVILVKPVIVIVLGLAGALSSDEGPDAFSAVVSGLAIILLAIFASAMIYRFVPGFGDEIANSRNNRIMQGAEGKAAAVISSPATLVAQGIKTHSTRADNNGGGGGGQSSSPRPANAASGGMAAHSSRPSNGGGGSGSSAAPPPRSSPANTPHASNSRNSSSNSSGGDGR

SEQ ID NO: 11635 - protein, 513 aa, Streptomyces avermitilis
VSHVVTPRRTYLIGRARPNAIVGRNRESGEIALIIAGAFLGMMCGLLVPVLALRIVLLTGFPMLALAAVYVPYKRRTFYKWFEINRSYKRTLRRGTTYRSTVMEAGTRLDGREIEIGPPPGIGRISWLAAPFGPDEIAVLLHADRRTVTAAIEIEGPGVGLRDSEDQEALVDRFGTLLKHVANGDGFVTRIQMLARTLPADPDAHAKDVAMRGDTRSPGWLQQSYDQLQSMVSTSSEQHRAYLVACMHYSRELAAEAQAMARAARPQAGRKLDRDAGLAVVMARELTDICSRLQEADIRVRQPLGQGRLASLVHSMYDPDHPIDHIQAMTKRNAWPAELDAMSPTYLQAKTRESSTRAPWCHATAWVKEWPMTPVGVNFLAPLLVHTPDVIRTVAVTMDLEPTEVAIERMLTEKTNDEAEASRAAKMNRTVDPRDVASHNRLDQRGEDLASGAAGVNLVGYITVSSRSPEALARDKRTIRASAGKSYLKLEWCDREHHRAFVNTLPFATGIRR

SEQ ID NO: 11636 - protein, 476 aa, Streptomyces avermitilis
VVMRDPLSILTDAFTSFLFGKVETTRLPVRTSTGQAQAVYLPTAAPGLGDSGVIIGREVYSGKGYIYDPFQLYGQQLPAPHWLVLGESGNGKSALEKTYVLRQLRFRDRQVVVLDAQGEDGVGEWNLIAEELGITPIRLDPTAALDMGIRLNPLDPAITTTGQLALLRTIIEVAMGHGLDERSGFALKVAHAYVNETILERQPVLTDIVEQLRHPEPESAEAMNVALDDVRAWGLDVALVLDRLVDGDLRGMFDGPTTVGIDLDAPLIVFDLSHIDRNSIAMPILMAIVGVWLEHTWIRPDRKKRIFLVEEAWHIINSPFVAQLFQRLLKFGRRLGLSFVAVVHHLSDVVDGAAAKEAAAILKMASTRTIYAQKADEARSTGRVLGLPRWAVEIIPTLTPGIAVWDVNGNVQVVKHLITETERPLVFTDRAMTESSADRLADDAHRAAELEAEERAAAFVEQHLSDLDDSSESTVA

SEQ ID NO: 11637 - protein, 542 aa, Streptomyces avermitilis
MSRDRQTYRDRGREHDHSQGGVPDGLLIGVLAFLLGMTLMVWSATGLAGWFARGAWPDAVTFTRTPLAMRHLIGRPHDIPGAWPDTPEGQLSGYGLFWGLFIGQLMVLLVLTVFVMGTVARWRAVRAGRRASRSTAAVAAADPDPTGHEVPAQRATTERTGTSDPTGTPDPTGAAEPAWTAEQAGSAAPAGSAAPAGSAAPAGGAAPAATGGVGGMAKSAEETALAHLMARDRAGGREIVLGPPETRTAAATQAIHDAAGPVLVLTSNPALWSETKDARAKLGPVLLYDPTHRCDTPARLHWSPSAGCEDKPTAVARAAALLAPVRPTAKIDQALAETAETLLRSYLHAAAIEGRTVRHVHRWAQGTQVQEAVRALRANPKAAPGAGGELESALTSHPERRDMAQELTARALSSLFTVNIREACTPNRNDSLALDSFVDEGGTLYVVGEPIEDPRQHPGAMPFLTALVSHVVERGRRMAERSSSGRLDPPLTLVLDDVAAVAPLPQLPELLSTGADRGMPTLALLRSQEQARSRWPQYELPV

SEQ ID NO: 11638 - protein, 181 aa, Streptomyces avermitilis
MSHLIRSIRTGEWAEAKKLRLVALQDPVAHLAFLETYDDAVARPDSYWQDRTAGAAEGVAERQQIIAEGPDGEWAGSVTVLVEEAGSRDPFDVAVERRQGHVVGVFVRPEHRGSGVTRALFDAALEWSWAAGLERVRLFVHEKNGRAEAFYRKAGFMPSGVSVPAPGDSGDQELEFVIERT

SEQ ID NO: 11639 - protein, 182 aa, Streptomyces avermitilis
MADTPGAGEPTLDEQIAAYQREFQDLDPQVEKIVSALSRLNRRMNVAYGRQTAALGISNAEWEVLKALVLSGAPYRLGPGDLAKRLGLTPAAMTHRIDRMLAEGLVTRERDESNRVRVIVELTAEGREKWLEAMRLASVFEEDLLQDLSAEERAALGEVLTRLLRRVEHAQPDAGGRLSDLD

SEQ ID NO: 11640 - protein, 423 aa, Streptomyces avermitilis
MGAAMRRIHVGNALSAFGLGFTVPYLYVYVAQVRDLGAVTAGLVLAVFAVAALVVLPFAGRAIVRRGPLPVLLAALVTAAFGALSLGLASSATTVLLSAAALGAGQAVMQPALATMIVDCSTAETRSRAFAMQFFLANLGLGIGGLIGGHLVDASRAGSFTLLFAIEAVMFLLLVVIMSTVRMPHAPKIEGSAPQAEGSWKQLLGNRAMVQLCVVGFVLFFACYGQFESGLSAYGVEAAGISTSALGTALAANTAMIVVAQFAVLKFVERRKRSRVIAAVGLIWAVAWLAAGYAGLGHGSRTMATAAFISTYALFGLGEAMLSPTVAPLVADLAPTGLAGQYNSAFALVKQLALAIGPAVGGPMGASLHAPYIVTFLLFSLGITFLAVRLGRQLTPVQNQPSLAKSRVVAQGGAPAEPLPANV

SEQ ID NO: 11641 - protein, 271 aa, Streptomyces avermitilis
MADESGFQSKGSAPERYEQYVAPIAAPFVTAVLDAVDLFPGAAVLDLACGTGFAARAAAPLVGPAGRVSGIDPDEGMLRVAAAHRPRMYPDIEFTEASAEKLPHTDAAFDAVVCQQGAQFFADLDAAAAETARVTRPGGRFAATVWAPKDLSPYFAAQYEAIKKYGGEETAAEYTKAFTCTAERLTAAFRSAGFQHTTAREVTFGIALPRLADFAPGHLSALPWGQEIVDTGGPEALAGVGRAMCARLADRTTPDGTATLPFTATLVTGIR

SEQ ID NO: 11642 - protein, 549 aa, Streptomyces avermitilis
VNFTRWSARLPGTQRRAAARAEHTVSPDRRGDGSVPTARGEQLTDDTQRVPAVDELPVRDVLDRVPALVALVHGPDHRIAYVNDAYTAAFGERPVGEPARKGLPELDELGLLPLLDQVLRSSKSRTVKSRKTPGGRSYTFTCTPVDASEDKDGGVLVFAVDVTDHAEAAERLRASERGQRETAVTLQRSLLPQELEEPDDLRIAATYQPGGTEAAVGGDWYDVITLGGGRTALVIGDVMGRGVRAAAVMGQLRTAVRAYARLDLPPHEVLQLLDGLAAEIDANQIATCVYAVHDPNEGRLVYASAGHLPILVRDDSGIVLRADEPTGPPLGTGGWMHASGSVPLGPGSTAVLYTDGLVERRDQDLDEGIAALSRALAGATGTPQVVCDRLVRSAGVTADHDDDVAVLVLQHPARTGADSDLFRNAALELLGGVEAAPRARAFASGVLTSWRFPTELHDLGVLAASELVANSLQHGTPPMRLRLRRTDRRLIVEVTDGDDHLPRRRRAEPADEAGRGIAIVATIASSWGSRRTPGGGKAVWCEFALPRTT

SEQ ID NO: 11643 - protein, 439 aa, Streptomyces avermitilis
VGLYTALRLQRKLKPELQRGDVEIVVVSPDPYMTYQPFLPEATAGNISPRHVVVPLRRVLTECRLLVGEAQSIDHAKRVATVATLATQETGRTEQITYDELVLAPGSVSRTLPIPGLADHGIGFKTVEEAIGLRNHVIEQMDIASSTRDPAIRDAALTFVFVGGGYAGVEALGELEDMARFAARYYHNVKRDDMKWILVEATNRILPEVGEEMGKYAVTELRRRNIDVRMETRLESCADRIAVLSDGSRFPNRTVVWTAGVKPHPILAATDLPLNEHGRLKCTPQLTVDGATHAWAAGDAAAVPDLTAKEPGKETAPNAQHAVRQAKLLGDNIAHALRGEELETYAHKYVGSVASLGLHKGVAHIYGRKLKGYPAWFMHRAYHLSRVPTFNRKARVLAEWTLAGLFKREIVSLGSLEHPRAEFELAAGGKPSRDPKGSS

SEQ ID NO: 11644 - protein, 252 aa, Streptomyces avermitilis
MHIQESHWSTASAVAPGGVVGAAAGNGRGDSSRTTPLRVDAQRNLEHVLRAAREVFGELGYGAPMEDVARRARVGVGTVYRRFPSKDVLVRRIAEEETSRLTDQARTALGQEDEPWSALSRFLRTSVASGAGRLLPPQVLRVGVADEGLGEAVADEARVPQQRPAPDLRLVEQRPAPEAEQDDVGAATLLEVVGQLVDRARAAGELRADVTVSDVLLVIATAAPSLPDAAHQAAASARLLDILLEGLRSRPV

SEQ ID NO: 11645 - protein, 1133 aa, Streptomyces avermitilis
VRPGENRCVRYGILGVTQAQDDQGALVPIGGPRVRALLTALALRPDRTSAPQTLIDEVWSEEPPLDAPAALQALVGRLRRAIGRDAVVSEPGGYRLATARDSVDLFRFEDLVKRGRAALERGDAGAAARDLGEALALWHGPAFADLPDRTAAARPEALRLDATRARVEAELRLGRAEDALPELKELTTAHPYDEPLHALLVRALRDTGRGADALAAYENVRRALSEDLGTDPGPELKALHAELLSPETPAGASRAAAPAGGIRAQRAAERTGNLRPRLNSFVGREPELAAIRSDMHRARLVTLTGPGGSGKTRLAEEAAAGLPQAWLAELAPLDRPEAVPGAVVSALGLRETVLIGSEMASPLDDPVALLVEYCAPREQLLILDNCEHVIDAAAELAETLLTHCPGLTILATSREPLGVPGESVRPVEPLPPDPARRLFMERAAAVRPDPETVLRESDAVDEICRRLDGLPLAIELAAARLRMLTPRQIAGRLDDRFRLLTSGSRTVLPRQQTLRAVVDWSWDLLDERERTVLREVSVFAGGWDLAAAEAVCTGPTADLVGALVDKSLIVATPYGADDGDGMRYRMLETIHEYATERAAEAPELRAAAERRHRAWARALVEEAEPLLRSAGQLPWIRRLETELDNIRAALYHAVVSGDEEQSSALALAMGWFWWLRNYCREGAEWVDHVLRLGVALDASAANPDPEAVNGRSHPCTAPATADVFDELATIDPVAAYLADAEEDHPLHRTRMKLRLLQLFLLSESQPVGAMQDERSRAYVARVRSAFAKGGPDAATLPGLVWPLTEYYIGAVEDRPPHVDMRPQLDAVVANCRAYGGDWEIGVTLMLRTHIVVDSPGGLHGIDGDLAELRTLSRRVGDRWMRAQVCSAAGETDMARGLFGDAKSEYEEALRLAYEVGAYAETPFLIARLSEIAFRDGDRAGALTALEEASDAADRYGVTDSRAYVRLLRAQIALDAGETAHARVWWEEARAETLRGTPPPHFVAALDGMDALVTLAESGPERGLPRAADALRRAVRGRCAEPVTAGLVDIAASVLAQLGDHPRTVRLLAAACHWRGGHPRAMPERAEADRAEAAARQALGADRFASERTLGTSFTAEDVLRDLAEAIEEYPVDG

SEQ ID NO: 11646 - protein, 582 aa, Streptomyces avermitilis
VTVCGDLAGARPVFYTPWAGGTAYATAALPLADLIEANLDFGHLAALLAAPDVPAAVHDSTPYDGVRRIPPGHALILRAGAREIAGYEPVASLAVAAPPADPGRAVDAVRDALIDAVRARLAAPRHVPDVDPGPVPGMGPAERRAARGMPVPGIGADLSGGPASGTLVLLAAGLPGRPGTVLGHGTGAGERLLAVTFNDLAVGGREAELERAGTLAANPRLHHVVVAGGEEMLPYADLDGPLTDEPGPSLVTAARHRARLASGSADHFTGYGARQVLDAHPARLADLLMDRKRRHLVRPVAALAKADGSVMVPARVYGAARKLARTPYRTGVDGLADRLMRRRFEEPGGAVGASLAALTWARPGPAARWLTGEALAEVSVRLQGATGRPGVGPGQRPGDFRARAALTRHAADLRVLEQAAEIRFQRLHAPFLDNQVVRACRALPEALRVQPGARAAILRTVLEGAGVADLPPGWGAPSHASSAVAARTGLRVAVDSLVALFDTPLLAEAGLVEARVVRKAVRAAAQGEPVPLDGLADLVSLELWLRRLLARRGTCWTGTPARQRAVPAGIAPQGRALGAASS

SEQ ID NO: 11647 - protein, 474 aa, Streptomyces avermitilis
MSREQRGPNEKLGAVLALAGISNAGLARRVNDLGAQRGLTLRYDKTSVARWVSKGMVPQGAAPHLIAAAIGQKLGRPVPLHEIGLADADPAPEVGLAFPRDVGQAVRSATELYRLDLAGRRAGAGGIWQSLAGSFAVSAYATPASRWLITPADSSVAREANPGEEAGAPLKVGHSDVQKLREAAEDARRWDSKYGGGDWRSSMVPECLRVEAAPLLLGAYSDEVGRALFGASAELTRLAGWMAFDTGQQEAAQRYYIQALRLARAAADVPLGGYVLASMSLQATYRGFGDEGVDLAQAALERNRGLATSRTMSFFRLVEARAHARAGDAQAAGGALKAAEGWLERARDGDNDPSWLGFYSYDRFAADAAECYRDLKAPRQVRRFTEQALSKPTEEFVRSHGLRLVVSAVAELESGNLDAACEQGVRAVEVAGRISSARTTEYVKDLLHRLEPYGDEPRVVELRERARPLLMAPA

SEQ ID NO: 11648 - protein, 413 aa, Streptomyces avermitilis
VHYRSREVEQVVQKIAYDCDVLVIGGGIVGLSTAYAITRAAPGTRVTVLEKEQGPARHQTGRNSGVVHSGIYYRPGSLKARYAVRGAAEMVKFCTEYGIDHAVTGKLIVATERAELPRLHALVQRGRENGIPVRELGPAQIAEYEPEVRGLAAIHVGTTGICDFVAVARQLAESSGAEIRYGANVLRIDRRPSLGVAVRTGDGAVVRARVLVNCAGLHCDEVARLTGDDPGMRIVPFRGEYYTLARPELVHGLVYPVPDPAFPFLGVHLTRGIDRSVHIGPNAVPALAREGYGWGTVRPRELGATLAWPGSWRIARQHWRYGAGELRRSVSKGAFTQAVRRLLPAVTEDDLRPAAAGVRAQAVLRDGTLVDDFLIREGARAVHVLNAPSPAATASLPIGREVARRALAALADT

SEQ ID NO: 11649 - protein, 290 aa, Streptomyces avermitilis
VSDSLHTPEEPRPGPGEQLAHAHDGSLRHTRAKGEPRFPDGPKADPAGSHFERRIRSFQPRRSRVTAGQADALQRLWPKWGLDIDGHALDLTELFGNTHPVVLEIGFGMGEATARMAAEDPDTGILAVDVHTPGQGNLLNLADQHGLTNIRVANGDAIILLREMLPPDSLDGLRVYFPDPWPKKRHHKRRLIQPEFLTLAATRLRPGALVHCATDWEPYAEQMLDVLTAHPDFENTQPTGGYAPRPGFRPLTRFEGQGLDKGHVVNDLLFRRVQPRDQHRDLPPSATEAD

SEQ ID NO: 11650 - protein, 453 aa, Streptomyces avermitilis
VATCPPYPTHPTGPAGGVLRRHTHWWQRRWVRYGALVTLLALSGLVILALVRQQTGTEGFLVGLGLAVLPVPLLIAAFRWLDRVEPGPWRNLLFAFAWGACAAALIAIVANSFATRWIATATADPTSADTLGATVIAPVVEESAKAAAVLLVFLFRRRDFTGIVDGVVIAGVTATGFAFTENILYLGTAFGTDQLSGERGLASVTAATFFVRVVMSPFAHPLFTVLTGIGFGIAALSAERQHLRRVLVPLAGLLLAMGMHSVWNGSSSFGEYGFFAVYASFMVPAFALLTWLVIWTRQRELRTVREELPAYAAAGWLSLPEPFLLSSMRARRLAREHAGHHFGKAAARSVAEYEAYATSLAFLRHRAHRGRAEANFAVRERELLHELWSRRGVARPALAYAGRAMTPVAVQPPWPVYGYTARYGQQSRYGHPGYGQPPYGAAAPYPAYNPYRV

SEQ ID NO: 11651 - protein, 314 aa, Streptomyces avermitilis
MTSLRKLGPSDLEVFPLSLGGNVFGWTADEAQSFAVLDAYTAGGGNFVDTADAYSAWVPGNEGGESETIIGRWFAARGNRSEVVLATKVGAHPRFKGLAAANIKAAAEASLRRLDTDYIDLYYTHYDDPSVPVEEIITALDGLVREGKVRAIAASNISPERLQESLEFSDREGLARYVALQPHYNLVSRDTYEGQLQDVASRNGLAAVPYYALASGFLTGKYRPGTKVDSARAEGAGKHLGTERGVRVLAALDEIAGARGAEAATVALAWLAAQPTVAAPIASARTVDQLPALLAVGELTLTDAELSKLTQASA

SEQ ID NO: 11652 - protein, 347 aa, Streptomyces avermitilis
VASNRPAQQTSFAPSEKSYESETFGFRGDEGPWEEWNPTAESIRPVRGRHRVAKQRGGGLARSSTVLGVGVIAAVGAGGMATAQTGKPPVSISMPDLSSVTESAKAFVGAESSTPKGSSTPLTSAGLTTADTVAGSADAGEALRARIIQQAESQQDQVDQAAARAAETAAAKKAADAAAKAQDDAKAKEAAAKKKAEDEIEAEKEAARLTQLAKSYSLPTSSYTLTSRFGDSGSMWSSGYHTGLDFAAPTGTLIKAIHSGTITEAGWAGSYGYRTILTLDDGTELWFCHQSSISASVGQKVATGDVIGRVGATGNVTGPHLHLEVHPGGNATGIDPTAWLQSKGLNP

SEQ ID NO: 11653 - protein, 376 aa, Streptomyces avermitilis
MPHPYVLLSAAVSLDGFLDDTGPDRLLLSGPADFDRVDEVRAASDAILVGAGTLRTDNPRLLVNSAERRAARVAEGLPEYPLKVTVTASGDLDPDAQFWHTGGEKAVYTTDKGAERLRELGIAADVVAVGAELEWRAVLDHLGRVKGVRRLMVEGGGRVHTQLLQQGLADELQLAVAPLFVGQAQAPRMFGSGGYPPGRMRLVETRPVGDVVLMRYVPTAPGTGRLATAADRHWLALACELADRCPPSRTAFSVGAVIVAADGTELARGHSREGGDPVVHAEEAALAKLDAEDPRLAGATVYSSLEPCARRTSRPRPCARLILDAGVRRVVTAWREPDTFVAAADGSGVLVAEGADVVVLPEYEARATAPNRHLLG

SEQ ID NO: 11654 - protein, 166 aa, Streptomyces avermitilis
MTTRWLTPEEQRAWRAYLAASSLLEDAIDRQLQQEAGLPHLYYSILANLSEAPDRRLRMTDLAEKLKITRSRLTYAVTRLEKDGSVCREGCPSDRRGSIAALTDAGMAVLERTAPGHVETVAASVFDHLTPEQVEQLETICAAIARTIQGDERRPACDELPWRRRS

SEQ ID NO: 11655 - protein, 235 aa, Streptomyces avermitilis
MRDLPSATVRTRVTVPLRFGDGYTVTGELVTFHGLADGQEHVAVVLGEPGPNPLVRLHSECLTGDVFGSARCDCGPQLREAVERIADRGGVLLYLRQEGRGIGLYNKLDAYALQDQGLDTYEANAALGLPEDGRDYTAAAQMLGALGIDALDLLSNNPDKAGQLRDLGLTVTDRVPTGVFTTAQNVRYLRAKVVHTQHTLPLTELTELTERAERAGLAKLTERTGLTEMTELTAG

SEQ ID NO: 11656 - protein, 511 aa, Streptomyces avermitilis
MTDDAMASGLSDEERLAQLGYTQVLARRMSAFSNYAVSFTIISVLSGCLTLYLFGMNTGGPAVITWGWVAVGLMTLFVGLSMAEICSAYPTSAGLYFWAHRLAPAKNAAAWAWFTGWFNVLGQVAVTAGIDFGAASFLGAYLNLQFDFEVTPGRTILLFAGILVLHGLLNTFGVRIVALLNSVSVWWHVLGVGVIVGALAFVPDHHQSASFVFTEFVDNTGWGSGPYVVLIGLLMAQYTFTGYDASAHMTEETRDAATAGPKGIVQSIWTSWIAGFVLLLGFTFAIQSYDKELNSPTGAPPAQILLDALGATAGKLLLLVVIGAQLFCGMASVTANSRMIYAFSRDGALPLSHVWHTVSPRTRTPVAAVWLAALSALVLGLPYLINYTAYAAVTSIAVIGLYVAYVIPTLLRLRKGAAFERGPWHLGRWSRLIGIVSVIWVGVITVLFMLPQVSPVTWETFNYAPVAVLVVLGFAAAWWVASARHWFLNPEHERTIARETARAGAPEPVDP

SEQ ID NO: 11657 - protein, 747 aa, Streptomyces avermitilis
VPKNSGRFAFRMSVSSTDHIVVPENNEGDTNEGVQAIETVEIVETVESAPELTFGDLGLPEGVVRKLAQNGVTAPFPIQAATIPDALAGKDILGRGRTGSGKTLSFGLPTLARLAGGHTDKKKPRAVILTPTRELAMQVADALQPYGDVLGLKMKVVCGGTSMGNQIYALERGVDVLVATPGRLRDIINRGACSLANVEVAVLDEADQMSDLGFLPEVTELFDQIPAGGQRMLFSATMENEISTLVKRYLTNPVTHEVDSAQGNVTTMSHHILVVKPKDKAPVTAAIASRKGRTIIFVRTQLGADRIAEQLRDAGVKADALHGGMTQGARTRTLADFKDGYVNALVATDVAARGIHVDGIDLVLNVDPAGDHKDYLHRSGRTARAGRSGTVVSLSLPHQRRQIFRLMEDAGVDAARHIINSGTAFEPEVAEITGARSMTEVQAQSAGDAAQQAEREVTQLTKELERAQRRAAELRGEADRLVARAARERGEDPEAAVAAAAEAVAEQAVVAQAPAEAPVSEQPAERPAYEQSRQRRDERGNYERRDDRGGRSFERRDDRGGFNRDRRDNDRGGFRRDDRRDDRGGRSFERRDDRGGFNRDDRGGFNRDRRDDRGGRSFERRDDRGGAGRDDRGGFNRDRRDDRGGAGRDDRGGRSFERRDNDRGGFRRDNDRGGRTFERRDERGGHRGSDRPFNRDRQDNRPSSGARSGSHDRPYARRDDHRGTTGTGTSTGSFGRRDDKPRWKRNG

SEQ ID NO: 11658 - protein, 146 aa, Streptomyces avermitilis
MAIVAAAGCMSVGDDGAKPGASHSAGRHGGEAPDGRAAGSGGHGGFPGGRGAHGGSPKPGKSVSGSASPDASASGRAKPSAKATSKDGKGGTGGAGGPAGGGEQPEPSKGEPSPTHTTEEPTPSAEPSSPDPTTAEPSSSAHEQST

SEQ ID NO: 11659 - protein, 116 aa, Streptomyces avermitilis
VLEMTREEFEELVAEALDRIPPELTRLMDNVAVFVEDEPDPSDPQLLGLYEGTPLTERGEWYAGVLPDRITIYRGPTLRMCETREDVVAETEVTVVHEIAHHFGIDDERLHALGYG

SEQ ID NO: 11660 - protein, 545 aa, Streptomyces avermitilis
MARVPAAKSTAETTTEGTVTTTATTTALRRTLHRALRRTGKTPGALARYYRARRAQPRPVTELTPQPHPWTRALGLVAVVLLGAWLGLLVVGNVRAPVGPMNTTMTLRPSLTGGTKINVSPLGALELHSHEAPVRLDVNVDQLDPVRAQALVDHPERISGLQDEITQDVEHGTLDLAVRSCAAVVSGATALGLAVYRRPRRALAAGGLALSLLAACGATAYATWNPKSVLEPKFSGLLSSAPSLVGDARSIVTEFDVYQKELARLVTNVTKLYDVTSTLPAYRPDPTTIRVLHVSDIHLNPASWKIIASLVQQYDVNVIVDSGDTMDHGTAAENGFLDPIADLGAPYVWVRGNHDSHATQRYLERMKNVHVLDDGRAVTVAGLRFAGIGDPQFTPDRAIKAAGDPAEELAGARLAAAVSDQRTAGTPVDIAVAHEPAAARGTDGEVPLALAGHLHHASMEVMKYGTRLRVEGSTGGSGLRAVEGKYPDPIEASILYLDRDTRRLQAWDEIKLGGLGLTTAEVSRHLPKENTPGATGSPTRTPSGR

SEQ ID NO: 11661 - protein, 107 aa, Streptomyces avermitilis
MSKGQGGPRSGEDSDLERARARYGLLAVVLSNLAIVVVTVVGVWQLDGDKSVIVGVLTASFTAVSSMTTAYLGIKAVSNTAKSLAQTEATRRDRPQQPQLPSQTAGS

SEQ ID NO: 11662 - protein, 1325 aa, Streptomyces avermitilis
MSTHPAPVLGVLAPRLAELSLRDAHRLGRRLEGARKIRKPEARAAVLAEIEAEVAKGEQRMAERRGRLPGITYPEQLPVSQKKDAIADAIRDHQVVIVAGETGSGKTTQIPKICLELGRGVRGMIGHTQPRRIAARTVAERVADELDTPLGEAVGWKVRFTDQVNQDSTFIKLMTDGILLAEIQTDRELRAYDTIIIDEAHERSLNIDFLLGYLAQLLPKRPDLKVVITSATIDPERFSRHFGEAPIVEVSGRTYPVEVRYRPLLEEDGDDADRDQITAITEAVEELAAEGKGDILVFLSGEREIRDTADALTKKNYRFTEVLPLYARLSHAEQHRVFQPHTGRRIVLATNVAETSLTVPGIKYVIDPGTARISRYSHRTKVQRLPIEAISQASANQRKGRCGRTSDGICIRLYSEDDFLARPEFTDAEILRTNLASVILQMTAAGLGDIEKFPFIDPPDHRNIRDGVQLLQELGALDPTEKDVRKRLTETGRKLAQLPVDPRLARMVLEADKNGCVREVMVIAAALSIQDPRERPADKQAQADQQHARFKDETSDFLAYLNLWRYVREQQKERGSSSFRRMCKQEYLNFLRIREWQDIYSQLRTVAKQMGIHLNEDDAPEQHVHISLLAGLLSHIGMKDVKETGGESGRSTGKNEYVGARNAKFAIFPGSALFKKPPRFVMSAELVETSRLWARVNAKIEPEWVEPLAGHLLKRTYSEPHWEKDQAAVMAYEKVTLYGVPIIAQRKVNYGRIDPEASRELFIRNALVEGDWRTHHKFFADNRKLLTEVEELEHRARRRDILVDDETLFDFYDQRVPEHVVSGAHFDSWWKHKRHEEPELLDFERSMLINERAGDVSKDDYPDSWRQGRLKFKVTYQFEPGADADGVTVHVPLQVLNQVTDEGFDWQIPGLRGEVVTELIRSLPKPIRRNYVPAPDFAKAFLDRAAPLQEPLTLTLARELKRMVGVPLTADDFDWSRLPDHLKITFRIIDERRRKLAEDKDLEALKLRLKPKARQAISQAAAATAERTGGESLERTGLTDWTIGSLTRVFETRRAGQPVKAYPALVDDGPTTNTVSVRLFDTEAEQAQAMWKGTRRLILRNIPVNPAKFASDKLTNAQKLALSANPHGSVQALFDDCAMAAADKLIGDFGGPAWDEESYRKLYDKVRAEIVDTTVRTVNQVQQVLAAWQACERRLKGVRSPTLLANLTDVRTQLDALVKPGFVTATGLRRLPDLMRYLVAADRRLQQMPTGVQRDTSRMEKVHEMQDEYAWLLEQLPQGRPIPSSVLDIRWMIEELRVSYFAHALGTAYPVSDKRIVKAIDAAAP

SEQ ID NO: 11663 - protein, 63 aa, Streptomyces avermitilis
MAVSARHETRALLRAHLSAASGYRHLTRHCPICRQLLRLAMEPAPNGEDGPETAAEEEILSKA

SEQ ID NO: 11664 - protein, 68 aa, Streptomyces avermitilis
MTARTPDAEPLLTPAEVATMFRVDPKTVTRWAKAGKLTSIRTLGGHRRYREAEVRALLAGIPQQRSEA

SEQ ID NO: 11665 - protein, 281 aa, Streptomyces avermitilis
VPKKVSSVIVPYASYLRVYEPLAAFPEPERGHWARYARRRERPSYQDELRRSLADLLPTPPIPVPVHESGDAFVLDVEGVVCVCPWRTRLRGWQALGELAEEFPAPVLDAVLPPLVRRQAAQDYERWLARNPDARPWIRTSTWQVPLNWFVLVSDEERKYEKGAGEVPPVLRYRTPMVQARRRVARGLRTLKDTIDEGPLIDGLLDVGRWLEEFHPRSLVELDYGGLVHVLPAGHLDGDHSAADVAAGIEALRIGDGAAAGEAYGRLVERWRSVRDRRSAN

SEQ ID NO: 11666 - protein, 361 aa, Streptomyces avermitilis
VTDVSDGVLHTLFRSDQGGHEQVVLCQDRATGLKAVIAIHSTALGPALGGTRFYPYASEEEAVADALNLARGMSYKNAMAGLDHGGGKAVIIGDPERIKTEELLLAYGRFVASLGGRYVTACDVGTYVADMDVVARECRWTTGRSPENGGAGDSSVLTAFGVFQGMRASAQHLWGDPTLRGRKVGIAGVGKVGRHLVRHLLDDGAEVVITDVRTDSVQRILDQHPTGVTAVADTDALIRVDGLDIYAPCALGGALNDDSVTVLTAKIVCGAANNQLAHTGVEKDLADRGILYAPDYVVNAGGVIQVADELHGFDFDRCKAKAAKIFDTTLAIFARAKEDGIPPAAAADRIAEQRMAEARRG

SEQ ID NO: 11667 - protein, 83 aa, Streptomyces avermitilis
MGRGRAKAKQTKVARQLKYSSGGTDLSRLANELGASTSSQPPNGEPFEDDDEEDDPYAQYADLYNDDEDEDDESGPTSQRRGA

SEQ ID NO: 11668 - protein, 364 aa, Streptomyces avermitilis
MSAVFDQGTPSPGTGASYASAGVDIEAGDRAVELMKEWVKKTQRPEVLGGLGGFAGLFDASALKRFERPLLASATDGVGTKVDLARQLGVYDTIGHDLVAMVMDDIVVCGAEPLFMTDYICVGKVHPERVAAIVKGIAEGCVLAGCALVGGETAEHPGLLGPDDFDVAGAGTGVVEADRLLGADRIRKGDAVIAMAASGLHSNGYSLVRHVLFERAKLSLDQHIEEFGRTLGEELLEPTKIYSLDCLALTRTTEVHAFSHITGGGLAANLARVVPDGLHAVVDRETWTPDPVFDLVGRTGDVERLELEKTLNMGVGMIAILPEESTDVALATLADRGVNAWVAGEITDRGDHETGAALIGSYAN

SEQ ID NO: 11669 - protein, 526 aa, Streptomyces avermitilis
LQNAPDSERCTISPTLGGVPRGDGRLNHDLLPGEKGPQDACGVFGVWAPGEEVAKLTYFGLYALQHRGQESAGIAVSNGSQILVFKDMGLVSQVFDETSLGSLQGHIAVGHARYSTTGASVWENAQPTFRATAHGSIALGHNGNLVNTAQLAEMVADLPKENGRSPKVAATNDTDLVTALLAGQRDDEGQPLTIEEAAAKVLPQVQGAFSLVFMNEHTLYAARDPQGIRPLVLGRLERGWVIASESAALDICGASYVREIEPGEFVAIDENGLRSSRFAEAKPKGCVFEYVYLARPDTDIAGRNVYLSRVEMGRRLAKEAPAEADLVIATPESGTPAAIGYAEASGIPFGAGLVKNAYVGRTFIQPSQTIRQLGIRLKLNPLKEVIKGKRLVVVDDSIVRGNTQRALVRMLREAGAAEVHIRISSPPVKWPCFFGIDFATRAELIANGMTIEEIGTSLGADSLSYISIDGMIEATTIAKPNLCRACFDGEYPMDLPDPELLGKQLLETELAAGPAATAAADAIRRP

SEQ ID NO: 11670 - protein, 291 aa, Streptomyces avermitilis
MYRQRLTLPALTLTALTLLPLAVACGNEKGGGTGSSSVGADTEPSVTGVHWTVDSVTVNGTTHQAPDGAHVEIAEDGRATGNYGCNSFHSTATFKGDRITLSRTLSTEMACEKRPMEFETTLARALAAGPLTAEAGQGKLTLTTAKGDRVHLTEEKDAPLYGTKWTVNSLIGGDVAQSLPAAADGKAWLTFTKKSESGDKKSGEKERGDKEVGTVSGSLGCNRVSAMATVRGSHITLGAPRTTRQMCSGSLMTTEKSLLKLFDSTVSYRIDHRAITLTSENGEGIGAIADR

SEQ ID NO: 11671 - protein, 265 aa, Streptomyces avermitilis
MPPAKKRTRTYDPARIRAAVLAQFGNVREGVRALDDEQLARPTHLGDWNVRELAAHTTMAIEAVNKFIDRPAPPKQEVTLLDWPFVTAVNAEAIADTSREPAAGHPDLDAFLAVTEQRFTERLAAHPDTRLLLTGTGPMSLGDYLVTRTVELVVHTDDLNRSVPGLDIPYDRQALAACTRLLADALAVKAPGASTEVRIPPYAVVQCVEGPRHTRGTPPNVVETDPLTWIRLATGRLDWTTALDDAQVSASGERADLGGLLPLMS

SEQ ID NO: 11672 - protein, 752 aa, Streptomyces avermitilis
MSRTPLDTVEHAAATPDVELPWAELGLKKDEYERVVEILGRRPTGAELAMYSVMWSEHCSYKSSKVHLRQFGEKAPQSDALLVGIGENAGVVDVGQGYAVTFKVESHNHPSYVEPYQGAATGVGGIVRDIIAMGARPVAVVDPLRFGAADHPDTKRVLPGVVAGIGGYGNCLGLPNIGGEVVFDACYQGNPLVNAGAIGVMRHEDIHLAKASGAGNKVILYGARTGGDGIGGASILASETFDDAKPSKRPAVQVGDPFQEKLLIECTLEAFAEKLVVGIQDLGAAGLSCATSELASNGSGGMRVTLDDVPLRDSTLSPEEILMSESQERMCAVVEPEKVDRFLAICEKWDVIATVIGEVTDGDRLEIYWHGGKIVDVDPRTVAHDGPVYERPYARPEWQDALQADDANKLPRPSSSEELRDQVLKLVASPNQASKSWITSQYDHFVQGNTVLAQPEDSGMIRIDAESGLGVAIATDGNGRYAKLDPYAGAQLALSEAYRNVATTGAKPLAVSDCLNFGSPEDPAVMWQFAEAIRGLADACQQLGTPVTGGNVSLYNQTGEVAIHPTPVVAVLGVIDDVARRTPVAFQEEGQLLYLLGDTREEFGGSAWSQVVHDHLGGLPPQVDLERERLLGEILISASRDGMIDAAHDLSDGGLIQAVVESALLGGKGARLVVPDGLDAFTFLFSESAGRAVVAVPRSEELRFNDMCGARGLPVTRIGVVDGDSVEVQGEFTLPLAELRKAHEETIPALLA

SEQ ID NO: 11673 - protein, 234 aa, Streptomyces avermitilis
VTARIGVVTFPGSLDDRDTQRAIKLAGAEPVALWHKDKDLKQVDAVVLPGGFSYGDYLRAGAISRFSPVMETVIEQAKSGMPVLGICNGFQILTEAHLLPGAMLGNNHLHFICRDQKLRVENADTAWTSDYEAGQEIHIPLKNMDGRYVADERTLDMLEAEGRVAFRYVVGGAAADGYGNPNGSLRDIAGITNEAGNVVGLMPHPEHAVEPLIGTGRTDGLPFFTSILKKLVNA

SEQ ID NO: 11674 - protein, 88 aa, Streptomyces avermitilis
VARVVVDVMLKPEILDPQGQAVQRALPRLGFEGVSDVRQGKRFELEVDGPVDDAALTRIRELAESFLANTVIEDFTVKVEDEKVEAGK

SEQ ID NO: 11675 - protein, 105 aa, Streptomyces avermitilis
VAQRVVVTLSDDIDGSEAAETIVFGLDGKSYEIDLNQANAKKLRKALAPYVEAGRKKAKSGKAYTHTALTPDPAAVRAWARSNKLEVPPRGRIPKKVYEAFAEAH

SEQ ID NO: 11676 - protein, 337 aa, Streptomyces avermitilis
MNTSEHEREHDHVIEVTDLRRVYGGDFEAVRGITFSVERGELFALLGTNGAGKTSTVELLEGLAAPSGGRVRVLGHDPYEERAAVRPRTGVMLQEGGFPSELTVAETVRMWAGCTSGARPVGEALSLVGLERRPDVRVKQLSGGERRRLDLALALLGRPEVLFLDEPTTGLDAEGRQETWELVRELRDGGTTVLLTTHYLEEAEGLADRLAILHEGRIATAGTPAEVTAAQPSRISFDLPDGYFLGDLPPLADLGVSTHETTGRTVRLRTHELQRTATALLLWAQRAQVELRGLDVRSASLEEAFLRIAREAAGDRPGRPGRTDVSGTTASGKEAVA

SEQ ID NO: 11677 - protein, 259 aa, Streptomyces avermitilis
MSTVAPTTPAGRLRALARAETMLLTRNRGVIVTALFVPLALPFSAKPAADQMDLKSEGFTFGTVMLTAAIGFSLLFAVYSALVSVYVSRREELVLKRLRTGELSDPEILVGAALPAVCIGLAQSVLLAVGCMALLDAGAPRAPHLVVLGLSLGLILCAALAAVTAAFSRTVESAQVTVLPMLFVSMLGSGITIPLEALPDRAASVCELLPLSPAIRLLRAGWTGGLSMYDTLGAVCTGVAWIVIAVFAVRRWFRWEPRR

SEQ ID NO: 11678 - protein, 418 aa, Streptomyces avermitilis
MSTPRAWWRGKTTPAKVETYTRWSFHFFGLIEISAIGLVAFGSVPEPFSVLVLVAVCAHAALCMATASQALDWTRGRREQPIRMLGALGAATALIGIGALLLASHGPGGTDAAGAAGTVFVAVLGFGAGTMALGIRNRRRMLSMVAGFAVGAGSVSFPLGLSGPVALATAIAVLVTTGFLAFSSAFSVWLLDAVYTLDEARETRARLAVAEERLRFGRDLHDVMGRNLAVIALKSELAVQLARRERPEAVEQMIEVQRIARESQREVREVVRGYREADLGTELAGAQGVLTAAGIDCEVSGSAAGLPAPVQSALGWVVREATTNVLRHGNAARCVVTLRTVEGHVVLTVENDGVPDSAPGGGSGLAGLRERLSVVDGTLRAAPSGEGLFRLTARIPLPAPPAPPLSTPVLPSVSEVTP

SEQ ID NO: 11679 - protein, 200 aa, Streptomyces avermitilis
VRVLLADDEHLIRGALAALLALEEDLLVVAEAATGPEALAMARAHAPDVAVLDLQMPGADGVRVSTSLRAELPGCQVLIVTSHGRPGHLKRALEAGVRGFVPKTVSAQRLAEIIRTVHAGNRYVDPELAADAISAGDSPLTVREAEVLEFAADGAPVAEIAERAALAEGTVRNYLSSAVSKLGAENRHTAVRLARERGWV

SEQ ID NO: 11680 - protein, 299 aa, Streptomyces avermitilis
VSGFVEKPEPLQVPGLVHLHTGKVRDLYQNEAGDLVMVASDRLSAFDWVLPTEIPDKGRVLTQLSLWWFDRLVDLAPNHVLSTELPPGAPADWQGRTLICKSLKMEPVECVARGYLTGSGLVEYNETRTVCGLALPEGLVDGSELPGPIFTPATKAAVGEHDENVSYEEVARQVGAETAAKLRQTTLAVYARARDIARRRGIILADTKFEFGFDGDTLVLADEVLTPDSSRFWPADQWEPGRAQPSFDKQFVRDWLTSPESGWDRKSEQPPPPLPQHVVDATRAKYVEAYERLTGANWS

SEQ ID NO: 11681 - protein, 514 aa, Streptomyces avermitilis
MGSEQIRRWESGALAHAVTDPFGQGPVPWLRGDEQYFDDTGQVVPWYIDPAPGATALQGDTPARDNGRGTSRTGSAARAIPHPRAGGPRSADDVHRQIKGFTATGAAAPGEAIDFHITVDPPQEFSVDIYRIGHYGGDGACKITTSPRLSGIVQPPPLTADRTVSCHHWWLSWRLQIPTYWSIGAYVAVLTTADGYRSHVPFTVRDNHPADLLLLLPDITWQAYNLYPEDGHTGASLYHAWDETGRLLGEADAATTVSFDRPYAGAGLPLHVGHAYDFIRWAERYGYDLAYADARDLHAGRVDPTRYRGLVFPGHDEYWSTHMRRTVELAREHGTSLVFLSANTMYWQVELGPSPSGVTDRLLTCRKRRGPGKPALWREIDRPEQQLIGIQYAGRVPEPHPMIVRNADHWLWEASGAYEGEEIGGLVAGEADRYFPRTALPEHQDRILLSHSPYQDSEGSTRHQETSLYRAPSGALVFAAGTFAWSPALDRPGHVDTRIQRATANLLDRICKHD

SEQ ID NO: 11682 - protein, 660 aa, Streptomyces avermitilis
VTGMGVEVGVQAARSRALAVLRIRSRALAVALLPAAVAVVLIAGGTSGHISGGHWGVTRWIVTGVAVVVLLCAAGVALVVARARPAVSPTVQIAEDSAPDLYRMVRDLADRLEVPAPSAIALTPDCDSWLEDRTHRAQSPPAAESGDDTDGIRGLAGPRHGRPPIAPVLVIGSPFLWWMRVGELRAVLAPVVAGTGPSAHPDIAAARRFVRGLDAAVAVTAAPTRGPLARTVLAGVGWVTRLLLRSCRGHAAEMERGVAAAAAERAQTVDYGVRIVAQEQVGLAYAGWDRLLTRVALPAWRMGRWPSRLDAGVVAALTELSRRDRLAEGFTSRLGERPACDLLEEPGVVDEAASLLAARLFHGGPAECGPDWAPVGWQEYPDEVVDRTWRTDAARLHRVLDAQGVHVTTHPPTRDADAPTLSRVLDHLTVTPADRHAAPSAPRGGRPEKTGAAGPAADPTEPAVPTDARERHDDEHQQHHHDGEDGDDGDRGGVGSGTGTGDRDGGRDGDKDGDKDGDGDGDEGTLGTERTATLAAGLSAELAREEAAAPVRGGGTEQTGPDRTLWDDGMLPLFPLQPPRSGREILADHVTAMICCAAMDTAGATPGLDWLDGPTLLINGERAADLTPRVLTLIEDGDPTPLRSWLHHSGIRPEKPVRLV

SEQ ID NO: 11683 - protein, 417 aa, Streptomyces avermitilis
VKVLVIGSGAREHALCRSLSLDPDVTALHCAPGNAGIAEVAELHPVDALDGAAVAALATELGADLVIVGPEAPLVAGVADAVRAAGIPVFGPSKEAAQLEGSKAFAKDVMAGAGVPTARSYVCTTPEEAEEALDAFGAPYVVKDDGLAAGKGVVVTSDLDAAKAHARACERVVIEEFLDGPEVSLFAITDGVTVVPLQPAQDFKRALDGDEGPNTGGMGAYSPLPWADPKLVEEVLQTVLQPTVDEMRRRGTPFSGLLYAGLAITSRGVRVIEFNARFGDPETQVVLARLRTPLAGVLLAAADGTLADLPSLRWSDDSAVTVVIASHNYPGTPRTGDPITGLDEVAAEDAPHAYVLHAGTKHDGDAVVSAGGRVLSVTATGSDLVQARERAYTAVDRIGLDGSQHRTDIAAKAAVGA

SEQ ID NO: 11684 - protein, 846 aa, Streptomyces avermitilis
VSSLALYRRYRPESFAEVIGQEHVTDPLQQALRNNRVNHAYLFSGPRGCGKTTSARILARCLNCEQGPTPTPCGACQSCQDLARNGPGSIDVIEIDAASHGGVDDARDLREKAFFGPAGSRYKIYIIDEAHMVTSAGFNALLKVVEEPPEHLKFIFATTEPEKVIGTIRSRTHHYPFRLVPPGTLREYLGDVCGRENIPVADGVLPLVVRAGGGSVRDSMSVMDQLLAGAGADGVTYAMATSLLGFTDGSLLDSVVEAFASGDGAAAFEVVDRIIEGGNDPRRFVADLLERLRDLVILAAVPDAGEKGLIDAPADVVERMQAQAGVFGAAELSRAADLVNEGLTEMRGATSPRLQLELICARVLLPAAYGDDRSLMARLDRLERGVNFSGGGAGPAMGYVPGPGAHGGASVPQMSQPAQTPQVPQMPQMSQGSYAQQAPQVPPGGGVDAARAAVRGGPGGAGGPAAGQGVPGAEAAYGDVDAGVAGSGAASAPVQEAPAEAAPPASQPTAEQPQPQPPAQPQPHTQPQAPAAAPAPAPGAWPTASAAGSGRRPGGWPTATPAGGGQPQTPAAAASAAPPASGPAPASAPAPSAPAPAPAAAYAPAAGGPDPRMLWPNILEAVKNRRRFTWILLSQNAQVTGFDGTTLQIGFVNAGARDNFASSGSEDVLRQALAEQFNVQWKIEAVVDPSGGSAQAAGGGSGPRVRRRRCRVQRGRRLRLRRRVRRSSGRPAPRAAAVRPTGAGPRRVGGSGPVRQTDCARPGIHTTARSATAHRPRGRHGGGRRPRPRRVRPLGPRTDRPGARGDGDGGVLPRVRAPAAARRGGVWLAASRMSHSPRPFLARPFD

SEQ ID NO: 11685 - protein, 897 aa, Streptomyces avermitilis
VFLLQVVIVVLLVVAAVAAMVLEAAREAVQQAQRDSVVAAQSFASAPGMVEALRGPHPTAVLQPRAEEARKKAGVDFVVVMNTRGIRYTYPYPQEIGKKFVGTIEPALHGRTVVEQAGGPPLPTGEGTAVQAVVPVTDARGTVVGLVSAGITVKNVARLWLPQLPIALGAGAAAVALAGAGTTLVSRRLLRQTRGLAPAELAGMYEHHDAVLHAVREGVLIIDADGRLVLANDEAKRLLGLPGDARGSLVRELGLPEQITRLLTSPEEVTDEVLLAEDRLLAVNKRPTFPDEGRGGSVVTLRDTTELATVSGRAEVARERLKLLYEAGVRIGTTLDVRCTAQELADVAVPQFAGVVTVDLLDSVLQGWEPTAEGWRRLRRAAIGGEHEMMPMYPLDEVITFSPKTPQMLALNQGQGVLEADLRQARGWQEQDPERARAVLERGVHSLVSVPLRARSVSLGVANFYRTGDSPAFEPEDLSFAEELAARAAVAIDNARRFTREHAMAVTLQRSLLPRGQPEQDALEVAWRYLPAEAGVGGDWFDVIPLPGGRVALVMGDVVGHGLHAAATMGRLRTAVHNFSTLDLPVDEVLGNLDDLVIRMDNEESADDAAQAHEGEGVTGATCLYAIYEPVTGACTVARAGHPDPIVVRPDGTVTCPDVPASAPLGLGSHPFETAELHLPEGSQLVLYTDGLVRDRTRDPDVGLDGLRLALKGAGERTPGETCQAVIDALKPTHPSDDIALLVARTRLFPPSHVAEWDVPSDPAVVPSVRARCREKLREWGLEESEFTTELILSELVTNAIRYGSPPVTVRLLYGRCLSCEVSDASSTSPRLRRAATTDEGGRGLFLVAQFAERWGTRYTPYGKVIWAEQTLHDSASAAPAHTPIDVLLEQFGDPAM

SEQ ID NO: 11686 - protein, 532 aa, Streptomyces avermitilis
VKASFTRSPRESAGRGRPRRGRRTRRTALALGLALAGAVGITGAAVLVGALPYGGHRSPAHPGTHAPGASAASSGAAPSPGAPGIGDPLLPLDGNGGYTVGHYTLAFDWRTPRTPFEAATTISATATQALSRFDLDFAGNTLHTVTVDGAPATAVRDGDELVVTPAKPIPHGSAFTVRVAYTADPTQRRHRSDAIAHYGWVPTPDGTVLYPQPNGAKMIFPANDHPSLRAPVTFRITTPADLSAVANGRLVERVRRPDGRVRWTYDSEQPLAAQLVQVAIGKFAFAESTGPHGLPVRDVVPDGLVTDTEAYRSLTPGHLAWLERRLGPYPFSRYGVLVGDTDLPVALETQSLSLVPRADLLGARVGAERNLVHELTHHWTGDSVAIRRWSDLWLSEGHASFYERLYSDTHGGDSFEGAMRAAYEQHDQWRHDDGAPAEPSAEPALFKQMRYDGSALVLYALREKVGEETFDRIERAWVTKYRGRAVGTRDFVALASEVAGEDLNAFLTPWLYGAHTPPMPGHPDWQVDPVQD

SEQ ID NO: 11687 - protein, 671 aa, Streptomyces avermitilis
MRRRLAPRVAGAVRRRRRTVRVTASAALLVPLLAGPSACVGGTTPDRHLQNDFTDAADDYHVPLSVLMGVSYLQSRWDSRPGAPSVVGGYGPMHLVDTHQDRTPSPSAPRRGSAQPPAVAAGPSAAQGATSSGSPSAQPAADLRRAARLIGAPAGQLRTDAAANVRGGAALLAATQRQLGKPLSADPADWWEAVARFSGTGDTAAAATYANDVFSVIRRGANRTTVEGQHLTLPASPGVRPHTPRPQGAQRPKEVECPAELSCDWLSAPYVEMDDGQYGNHDLADRPRDQKIEYIVIHDTEAILPSMLRTVQYPTEASWHYSIRSSDGHITQHVRTKDVAWHSGNQFVNARSIGIEHEGFLTQPDAWYSEQMYRSSARLVRYLAKKYGIPLDRQHIFGHDNVPAPTASSIPDMHDDPGPFWDWRHYFDLLGAPLRATAGPDSDVVTVLPDFATHKPLFTGCGKSGEPCAQHGSSAVRLHTEPDEDAPLIQDPGRRPDGDDSTEDVNDLGSRASAGQTYAVAGRGGDWTAIWYLGRKAWFRNPKEHPTAVGASGRTVTPKDGLSEIPVYGRALPEEDAYPEGVPEQPESPLPYSLLAGQRYVTQSRDVGSYIDRSSFSDTPDLVVKGREEYYEIQFGHRLAYVRASDVDVDEVSAPATAQPPSGEGARRPRR

SEQ ID NO: 11688 - protein, 67 aa, Streptomyces avermitilis
MATGTVKWFNAEKGFGFIEQDGGGPDVFAHYSNIAAQGFRELQEGQKVNFDIAQGQKGPTAENIVPA

SEQ ID NO: 11689 - protein, 502 aa, Streptomyces avermitilis
MNRTRTNDRFDRTRTKSSGAARGGSRFGAAKSGSPSRSGGHGRRPSAPQGEFALPVTTTPALPAAEKFADLAMPSQLLAALSSEGVTTPFPIQAATLPNSLAGRDVLGRGRTGSGKTLAFGLALLARTAGQRAEPRQPLALVLVPTRELAQQVTDALAPYARSVKLRLTTVVGGMSIGRQSGALRAGAEVVVATPGRLKDLIDRGDCRLDQVGITVLDEADQMADMGFMPQVTALLDQVRPEGQRMLFSATLDRNVDLLVRRYLTDPVVHSVDPSAGAVTTMEHHVLHVHGADKHQATTEIAARDGRVIMFLDTKHAVDRLTEHLLSSGVRAAALHGGKSQPQRNRTLSQFKTGHVTVLVATNVAARGIHVDNLDLVVNVDPPSDHKDYLHRGGRTARAGQSGSVVTLVTPHQRRDMSRLMTVAGIVPQTTQVRSGDAELNRITGAQAPSGVPVTISVPVVERPRRSASSSRGRRSRTAQNRRNGQAARGSSQRQTTVSAAA

SEQ ID NO: 11690 - protein, 98 aa, Streptomyces avermitilis
LTLVQMQQRSVDATPTAVVDVMDTAGPQVWAAMTVEVALSVMASARAEHLFLCDEDGQCTGLITRAQLTVVRDSPSYTDQVRLGDILGDASGVLEFSR

SEQ ID NO: 11691 - protein, 104 aa, Streptomyces avermitilis
MRCVIARFPFDLSKSGVVASMKGVKPEPIVGESVQIGRRHFPVKQVGEVVTRQDRRDFSAQEVVRAMTRLGFTCHDLAEPAPARVLTPLQSASALLGTPAPAPA

SEQ ID NO: 11692 - protein, 531 aa, Streptomyces avermitilis
VAMSLRSRLALSFAAVGAVVAVLVGMLSYRAASDRVTAEIDRTLRSVTVALARDQDRALALSDEVTQGPDLFPGPDRPGPGDEAEWQVTVQAVAPDGTPTHLGGPPVALPVSDAARALAASGEPGESRTTEVVVDRATHRQLTTALGRDRGALQVAVQVDQTHYVLGGMAREIAGAGLVVMLAAAGAGWLLARRITRRLVRLAGVAEEVSVDGRVDGAALVDGRRDEVGRLSASFGRMLTRLAVAREAQERLVQDVAHELRTPLTSLRTNATVLRRITELSPDARDRLLHDVEGETRELSHLVDSLVELALARSREEPEGPVELAEVARRAARRVHRRTRRLFHIDADDTVVHGRPEALERAVGNLLENAAKFDRDGLDPIEVRIHRGTVTVSDRGPGIGATDAERVFDRFHRADTARGLPGSGLGLAIVRDVAEAHGGTAFARPRPGGGAAVGFTAHSSRLLPRSAPERAGGPERVAGPEQAADPEQAADPDHLVGPDHVVDPDHLVEPGHVVEPDRGAGSSRPRATPDT

SEQ ID NO: 11693 - protein, 240 aa, Streptomyces avermitilis
VGHHVDVVNRVLVVDDDRAVRESLARALELEGYDVVAVADGVQALARARRGSFSALVVDVMMPYVDGVGVCRVLRADGDRTPVLMLTARAGTRDRIAGLDAGADDYLPKPFEIPELLARLRALLRRGDLTPDVDEPVARAGDVLRIASLLVAPAARRVWWADEELRLSRTEFDLLELLVRNEGIVLDHAAVYRRIWGHDVGVDAKNLASYVGYLRRKLADAGAPDLIHTVRGVGYAVRRP

SEQ ID NO: 11694 - protein, 397 aa, Streptomyces avermitilis
MSTVSVRLARRASVAAACVALAATGCTALNSASSTSALAAKARIPASAARHGAGGANTAQVVAAANAFLATLSDEQKDTVLYDFDDAAKKTGWSNFPTPVVARNGLKFGDLTDEQEAAALKVMEAALSKKGYEELVEIRKADDYLATLPPRTPTPPTSTPTATPTGTPTATPTGGGGRPPGGGGGANFGSEWYYISFFGLPSRTGEFTVQYGGHHAAYNLTYAGDNVSISPTLTAVEPMEFNWEDLYYAPLEDKRTSTIGAIQSLTADELTAAEIDGSFDDLYLGPGHDGPFPQQPEGVLVSSLTKKQRAEVTAMLKAWVDDLDEKAAKRLIAKYVSEYDKTYIGWSGGTTLDNNQTYVRLDGPSAWIEFSNQPGASTDGIHQHTIFRDETADYGWE

SEQ ID NO: 11695 - protein, 429 aa, Streptomyces avermitilis
MRRFLPALLLAALMLVGGLASPAGAHPMSTSAVLLDIGDDRVEGEVQLPIDRLAIAVHRDLTRDSVLAADRAFLKRYVARHISAVGENGTPWAVTLGTASVRTIDGAAHLVHPLTIRPPDGHVTDFDLRYDVVVEELLTHRVIVTVRYDFDRGILKADDASTLGVFDWDTRSLKVPAGEGSWTRGFATTAGLGIEHIGEGADHLLFLLMLLIPAPLVATGGRWHAAAPSARRGIVRVVHVVTAFAVGHSLTLALAAAGVIDVPARPVETLIAFSIAVSAVHALRPLVARGEVFIASGFGLVHGLAFASLIGDLGLGRGSLVTTLLGFNLGIELTQLLVVALMMPSLLVLARTSVYPAFRIGVALVGLLFSVSWMLERATLTSADPFEGIQTWLVGHPLLVAASVAALAVVARRTAPRTPRATPEHSGAH

SEQ ID NO: 11696 - protein, 358 aa, Streptomyces avermitilis
VFLGELTERPVSLYAAAVLRIGYGLLYLAFLLREFPHRDEIWGPGSPWTPELARQLFDQTGWVSILTLSDGRAYFEACYALALVTCALFLLGWRTRAVSVLFAVVVASFHARAIFMTDGGDNLVLLMAVYLVFTACGRRWSLDARRTRLRAGASPAASPPARQEADGFRRQLGASRRTLTAVLHNCGMFVIAAQVCFLYGSAGLYKVQGGSWGNGTALHYVLNLDLFRPWPELSLLTDEHDVLMAIACYLTVLLQVAFPFVLFGRLKYPVLTVLLGMHLGIAVLLGLPLFSGAMIVADAVFLPDRCYLLLGRLWRRAGRRTGSTEAGAPARGESAFLPPQSAVSSPRTAAAPVRGRRA

SEQ ID NO: 11697 - protein, 291 aa, Streptomyces avermitilis
VLGSSRPHEREGRAARGGSLSIPPRAADQSPGETVRGAGMERPGGAVLGGVAAPDADADESELPGAGPTAPREGRRSVALPGASQPGSALLRAGTTAAVALCLTTVLVHVLLVFLHVAPPNPLSQQYSRQINAWVFPLFEQNWRLFAPDPESVNRQIVARTMHTAPDGSVRVSDWSDLTAVDDAAVRHNPFPSHTAQNMLRRAWSCYLETHGSDDLPRTQRALMTQRYLANIAADRVAAHRGGTFESIQLRVVTLPVAAPAAADGTRPATVAPKPVDTRYLPWWKVESHGN

SEQ ID NO: 11698 - protein, 428 aa, Streptomyces avermitilis
MTLDIPEAPLRRTLSVWIAAVTALVMAAAVLVLTPTRAHAATAVPLGTAATFGVLAGSTVTNTGPSVIQGNVGVSPGSAIVGFPPGQVLAPGVLHPGDATALGAQNDLSIAYGQAAGQTPPTATYLDDPHEFGGQTLTPGLYKANVSAGITDTLTLDALGNPNAVWVFQIGSTLTTASASHVSLINGASPCNVYWQIGSSATLGTNSSFVGNILAQASITATTNAVINGRLLARTGAVTLDTNTIFQGGCAAGTGGTTGGTTGGTVTGGATTGAIGGVIGGVIGGVVAGTTTGGVSTSGGTTGATSGGTNGGVNGGVIGGGNGGVIGGGNGGGNGGVIGGGNGGVIGGGNGGGNGGPGHHHPGGQPGRPGDHDHGGQPGEHHGHDHGGQPGEHHGHEHGGKPGAGEHHGHGEHSGKPGKHDSYGGARS

SEQ ID NO: 11699 - protein, 118 aa, Streptomyces avermitilis
MIQAADIREWRDHDVVDPKGRKIGVLEAIYVDTTTDEPAVATVRTGLPTRQRLVFVPLDKAVLGPGYLKVSYAKSLVKKAPSIGTDDILPAEQEESIFQHYDMPYQPGPNGERQLARR

SEQ ID NO: 11700 - protein, 589 aa, Streptomyces avermitilis
VLKKAPAAITLTFTESVGLLDDSFRVLDPENRRVHIGEPQHAGGRSETARVTLPDDMGTGTFTVGWRVVSADSHPVSGALTFSIGKPSATTAVIPTQAAGDTASATLYDIARYFAYGGLALLLGTMVFSLVTGVEAARGLLLTGWWTLLASTIALLLLRGPYERGGGPAAAFDPSVLAETATSRPGVTLLVRLVLLAGAAFFPVRAGGRWWKAGGGLLTLALAGTWAAAEHASAGVQVPVAMVSAVLHLLAMAAWLGGLAALLTALYRAPEELPASAVTRFSRLALTAVTVLVATGVYQSWRGLGSLDALATTSYGRLLVAKLVAVLLLLAAATYSRRWTARLAAPVERRADVRERVLEPVGAAADAEVSGTDTSAGTGTDTSAGTGTGTGSDSGAETGTGTETGSDTATETGPQSGPLPPTAGGDPGAYRRGLRRSVLAEAIVAIVVLVITTLLTGTQPGRAATEAAASAAEAARPMASTTVIPFDVGTPGGHGKIQIELTPGRVGENSVQAVIFGPDGGLATVPELRLTFTLEKQDIGPLDAKLADRGGYWTSDTLNLPLPGTWTMKATVRTTDIDQITVSRTVRIE

SEQ ID NO: 11701 - protein, 135 aa, Streptomyces avermitilis
LGTGLGAGDGIVGRAGTGGSITHIASIEARHPAPLHAHYSASKAAVVMHARSAALEYGPYGVRVNTVSPGLIDREGLAEAWPEGVRRWQQAVPTGRLGRPEDIGDACVFLASPLASWITGHDLVVDGGVSARPTW

SEQ ID NO: 11702 - protein, 307 aa, Streptomyces avermitilis
VPAVSGLLAGQVALVTGAAGGIGRGIALRFAQEGAAVAVHHRTRSADDVVALVRESGGAAIALRADLTDEAECRRLVRAAAEWGGGRLTALVNNAGVQPTQALPGMTAAQWRAVLDTNLSSVFACTQAAAEVMRANGDGDGVGDGAGGRGRDRGACRDRGQHHAHRLHRGPSPRPAARPLLRVQGGRRDARPFGGAGVRAVRRPRQHRLARPHRPRGSGGGLAGGGAAVAAGGAHRTVGAPGGHRRRLCVPRLTARVLDHRPRSRGRRRGVGATDLVRRFEPTRRQGSSRPADRVRADPMTGSGPTG

SEQ ID NO: 11703 - protein, 159 aa, Streptomyces avermitilis
VTPEDLVAHYRLEPIPREGGRFRRTWAGPERADGRPEGTAIMALLTAEPDDFSALHRLPADEVWHFYLGDPLELLLLAPDGSARTPVLGPDVLDGQDLQYVVPAGTWMGARVVAGGAWSLFGCTMAPGFTYGGYEHGDAGELSVRYPAEAARIAGLCRP

SEQ ID NO: 11704 - protein, 204 aa, Streptomyces avermitilis
MTAEPYAPARRAVHEQVVEGFGTVRILPLDPPADVDVVHGWVSEERAAFWGMNGLTKEQVLEVYAHLDTLDTHHAFLAVKDGEPVALFQTYEPEADRVSECYQVEPGDIGVHLLLAPAGSGGGRPGWSAALLTAFTSFVLVGLDRRRIVVDPDERNTKAIARFVRQGFVPGPRVVLPEIDLPDVYLPEKRAQLAFLTREAAFGK

SEQ ID NO: 11705 - protein, 735 aa, Streptomyces avermitilis
VTIEIYRDAWGIPHLRAGGARELARAQGRVTAVDRAWQLEVERHRARGTSASFLGTEAAAWDVFARRSRLDDTARRCFAALERTDPETADWVRAYVDGVNEGLAEGARRAPEFAATGLVPGRWEPWTPLGVWLGTHILFAGFPAKLWREEVVRRLGDEAVGLFATDGPGTAGSNGWLVSGERTVTGQPVIAGDPHRFIEDPGVYQQIRLSCPEFDVVGLAVPGVPGIAHFAHTGKVAWAITNAMADYQDLYRERLRRTPDGNGNGNGIGDGTGTGDGAGGGAGVEALDPDGTWRPAARHTETVEVAGGDPVEVEVIETARGPVVIGGVTGSGDDPISLRYPPRVTEDLGFSALLPLLRAREVADVDRAFDLWAEPVNVVQAADTEGGLLHRVAGNVPLRGRDNRTRLVPAWEPGHEWHGWHEMPRGTVEDGLAVMANQRGPATPLGVEFAPPHRAARIRELLEERPTWSAPDMAAIHMDTHLASAGALLDHLAALDGLTPQASALRDRLLSWDRRMTAASTEAAQYAELRGAVVRRLAAHPAFTALTDPPAYPEVFRPWLALLPRVGFALENLLKADELYGIDRAAVVREAVAEVAAETAGKAAAETVKAAGASGTWGDTHRLAPWRALPTAAYAAPASPASYAYDEPGLSGDHDCVLCTSAVPGLTDLSARGPAARYVWDLARREDSRWVVPFGASGVPGSPHHRDQLPLWLKGDLAPVVTDWEHLTKENSDDR

SEQ ID NO: 11706 - protein, 208 aa, Streptomyces avermitilis
MDPKHPKSVTLHLAQQPEADELLGRSPLAVMIGMLLDQQVPMEWAFAGPYTIAQRMGTDDLDAHEIAAYDPEAFAELLSRKPAVHRYPGSMAKRIQQLCQYLVEHYGGDASAVWEGVESGAELLRRLKELPGFGAQKAQIFLALLGKQFGVRPPGWREAAGPYGEPKAFRSVADITGPESLAKVRAHKQELKAAAKAEKAAKSPKTGK

SEQ ID NO: 11707 - protein, 222 aa, Streptomyces avermitilis
MTEAPNGSPRGPQYDDRRVHAAARDPLADRSGRDAVEGPLHVLSRTAWHSLLVAGIAALVLGVMVLAWPETTLVVAGVLFGLYLLFSGVLQLASAFGTHVATSLRVMAFISGTLSILLGLFCLRGAMQSILLLALWIGIGWLFRGVTLTLAAASDPEAPARGWQIVLGIVSFLAGIVLIVSPFTSVGVLALVGGCWLIAVGVTEIVTALRIRRITKQLPPAL

SEQ ID NO: 11708 - protein, 139 aa, Streptomyces avermitilis
VPRPYAKTRDLPARPVNHPGPAGRSRPMSPDRRPAHSPRRRPRLRVLLMLLLALLVAGAHTEALAGPAAAVSTESYGAEHDVLGTALRPPARPGHPRTAPLRPAPRAVGCPQPSAPLPFAVRPPHSPVLHALRTVVLRC

SEQ ID NO: 11709 - protein, 524 aa, Streptomyces avermitilis
VPQAETPEVAGSAPALPQEALKIASGYAFAGPALDLGALLWDGRCLPDAQIRIPLPMLNRHGLVAGATGTGKTKTLQLIAEQLSAQGVPVFLADVKGDVSGISAPGRENDRVHGRAAEVHQEWAPAGFPSEFYALGGMGHGIPVRATITSFGPVLLSKVLQLNQTQEQSLGLIFHYADQKGLELVDLKDLRAVVAFLTSDEGKQELKALGGISTATAGVILRSFTAFEAQGMSPFFGEPEFDTSELLRTASDGRGTVSVLELPAVQDKPQLFSTFLMWLLADLFHDLPEVGDADQPKLVFFFDEAHLLFNDASKAFLDSITQTVRLIRSKGVGVFFVTQTPKDVPADVLAQLGNRVQHALRAFTPDDQKALKSTVKTFPNSAYDLEEVLTGLGTGEAVVTVLSEKGAPTPVAVTRLRAPESLMGPVDAAVLDQAVKSSPLYGRYARAVDRESAYEKLTAREAEAAGRREEEPAARGRTAAPAEEPSVVEQVVGSGVFKSLARSLGTQLGREITRSIFGTAKRRR

SEQ ID NO: 11710 - protein, 98 aa, Streptomyces avermitilis
VIFKRIGNGRPYPDHGRESTRQWADVAPRPVRLDQLVTTKGQLDLETLLAEDSTFYGDLFAHVVKWQGDLYLEDGLHRAVRAALQQRQVLHARVLELD

SEQ ID NO: 11711 - protein, 209 aa, Streptomyces avermitilis
MGGEYRITGDKYPRMRRPRGRRRLVFAVIASAAALGLIGWGTLQLIDVFTGGGDRATAASSKAHCATGASPSATPTTAAAKALPEPGKITVNVFNATPRSGLAKKTADELKKRGFRIGDVGNATSEYDKKVKGVGILFGPEASLDTSLPVLGTQLADAERRTDAGRKGTAVDLIIGTGFKALTSKADADKALAELTGPAPTSTATKKNC

SEQ ID NO: 11712 - protein, 211 aa, Streptomyces avermitilis
MRLHVVDHPLVAHKLTTLRDQRTDSPTFRRLADELVTLLAYEATRDVRTEQVDIVTPVAPTTGVRLSHPRPLVVPILRAGLGMLDGMVRLLPTAEVGFLGMVRDEETLQASTYATRMPDDLSGRQVYVLDPMLATGGTLVAAIQELIKRGADDVTAVVLLAAPEGVEIMERDLAGTPVTVVTASVDERLNEHGYIVPGLGDAGDRMYGAAE

SEQ ID NO: 11713 - protein, 183 aa, Streptomyces avermitilis
VYFAALLARTEDGWEASDTELDDVETLSDLTDLAREASDEDTVLLLIEQEDAWFGVLRVDGEEDPRIYVSDAAAAARSSYGEILLTDELLGREPGDDDVADLDSLDLDGTEDGEPDSDTDTADDDDDDGATGEAAVSHSPVGDSQILDDLGVGEKELRALDADDALSSIAEALGAAEVLETVR

SEQ ID NO: 11714 - protein, 142 aa, Streptomyces avermitilis
MRLALTEAVRAAESADVPVGAVVLAPDGSVIARGHNEREATGDPTAHAEVLAVRRAAERLGRWRLSGCTLVVTLEPCTMCAGALVQSRVDRVVYGARDEKAGAAGSLWDVVRDRRLNHRPEVIEGVLADECAGLLTEFFRER

SEQ ID NO: 11715 - protein, 307 aa, Streptomyces avermitilis
MVGYGVAVRKHLIPALGAHRLDKLKPEYIEAFYGRMVADGRKAGTIHQIHRTFRTALNEAVRRGHLARNPVQLAKSPRVSEEEIEPYTVEEVQRLLRAADYRRNSARWAVALALGLRQGEALGLKWADVDLDRGVLMVRRSRRRPRYAHGCGDTCGRKAGYCSQRQRTNPETADTKSRAGRRAVGLPSQLVDLLRTHQAKQQAERAAAGADWTDEGWLFATPTGRGTSPRTDYDDWKELLDDAKVRDGRLHDARHTAATVLLILGVSERAVMGLMGWSTTAMAARYQHMVDSVRSDVARQLDGLIWE

SEQ ID NO: 11716 - protein, 77 aa, Streptomyces avermitilis
VLVYLAASHDELWARISKRNEFHAKDPNSIYFSESDLQRYRTRFIPPQADEPHLVYDGDTAAVIAALDASGPGCAEG

SEQ ID NO: 11717 - protein, 59 aa, Streptomyces avermitilis
VAVQSKKIALYVLVVFVLYVIITDPAKAADYVQIGFEGISNAAQAIGDFMSWIADGAKN

SEQ ID NO: 11718 - protein, 97 aa, Streptomyces avermitilis
VIRHLVLFKLNEGVERDDPRVVEGVRAFRALGGQIDELRFWECDWNITDRPIAYDFAINSAVEDTDALKRYLEHPAHQAGVALWREFATWVIADYEF

SEQ ID NO: 11719 - protein, 309 aa, Streptomyces avermitilis
LSASTAPPQEGAPAPAPAPSVLPATAPAQAATPVQTPVQTPAPTQFQDTAAAPEKRRGADTRALTQVLFAQLKDLRPGSPEHSRVRGALIEANLPLVRYAAARFRSRNEPMEDVVQVGTIGLINAIDRFDPDRGVQFPTFAMPTVVGEIKRYFRDNVRTVHVPRRLHELWVQVNSATEDLTTAFGRSPTTAEIAERLRITEEEVLSCIEAGRSYHATSLEAAQEGDGLPGLLDRLGYEDPALDGVEHRDLVRHLLVQLPEREQRILLLRYYSNLTQSQISAELGVSQMHVSRLLARSFARLRSANRIEA

SEQ ID NO: 11720 - protein, 307 aa, Streptomyces avermitilis
MSADQGSSKVLTLTKSESAPDVLHDVPAVPASEAPTLPAPDLPATEVPAPQTSGAIDTRTLSRSLFLRLAALDESSPERAYVRDTLIELNLPLVRYAAARFRSRNEPMEDIVQVGTIGLIKAIDRFDCERGVEFPTFAMPTVVGEIKRFFRDTSWSVRVPRRLQELRLALTKASDELSQKLDRSPTVAELAAVLGVSEEDVVDGLAVGNAYTASSLDSPAPEDDGGEGSLADRLGYEDTALEGVEYRESLKPLLAKLPPRERRIIMLRFFANMTQSQIGEEVGISQMHVSRLLTRTLAQLREGLISD

SEQ ID NO: 11721 - protein, 271 aa, Streptomyces avermitilis
MRRGPSQRLSRGLSGGPGRRPGAAPTHGRRGALAGASAALVCLGAVLAACGNGGGGGGYAAVGPGDTPRASGAAAPTGDVTLVPLDGASVSGSPGRKSSAADGNSPGGEGGSGPSASGAPEGSGSAPSGGRADPGRAHGGSPTPSVSSGGGGGGGGGGGTSTGGSATLGGPAALSVSTPVREASDKRWCEKVTVSFHNTGGGAARSGTVTFGTHIIGALGIDWATIESTEDLPVPIAAGATRKKTWTVCVDAWRVPLGMHIETRDVSVQGE

SEQ ID NO: 11722 - protein, 92 aa, Streptomyces avermitilis
VAEGEDVRPGRGPTWVVPAYSLGSWAMANTQGPEGNYDPAGSTQMFRAFVDEGPQGRQQPQAPAPAGPRLGLIVGIVVAVVVVAAVAWLALK

SEQ ID NO: 11723 - protein, 171 aa, Streptomyces avermitilis
MAEQTQYEELARQLSAFGAVKRDMTRILPHDCPGGSAAVLTLLGRHGDMRMSRLAELLAVDMSVTSRHVTHVADRGWIERSPDPADKRSRILHLTAAGKEQLGELSRRSSQLLAERLSDWSDDEVGLLIQLMARLRESFGDCRSTLRPPHPYSTEADDVVGPPVPTTRTPA

SEQ ID NO: 11724 - protein, 853 aa, Streptomyces avermitilis
MATTTPAGVRGSHAKHGGGPDGAPMTHRQIMEALSGLLLGMFVAILSSTIVSNALPEIIGDLGGGQSAYTWVVTAALLSMTATTPLWGKLADLYSKKALVQIALVIYVLGSAAAGLSQNAGTLIACRVVQGVGVGGLSALAQIVMAAMISPRERGRYSGYLGATFAVATVGGPLLGGVITDTSWLGWRWCFYVGVPFAVIALIVLQKTLHLPVVKRDVKVDWGGAFFISAAVSLLLVWVTFAGDKYDWISWQTYAMVGGAIVLGLLFVLVEAKASEPIIPLRLFRNRTITLSSIASLFVGVAMFTGTVFFSQYFQLARDKSPTMSGVMTIPMIGGLFISSTVSGQVITKTGKWKAWLVSGGVLVTAGLGLLGTIRYDTDYWKIAIFMAVMGLGIGMMMQNLVLSTQNQVAPEDLGSASSTVTFFRSLGGAIGVSALGAVMANRITDYVKDGLTDLGPKYAAAAAGSSSSSSIPDMDKLPAPLRTVMESAYGHGIADVFLIASCLALLAFVVTLFIKEVPLRTSGGLAQAAQANAEAATPTGVTGTPEVAEATEAATASGAAQEQEKVPSWAVATTEAGPEGTQPLSAVATMAAGPGEQAFGGIPVRGYVRGTESAPVPQAAVTLISLAGRQLGRSVAQFDGSYAVDAPGTGSYVLIASADGFQPQASTIVVNDEPVAYDILLSGTSGLSGVVRAVETGTPVKDAMVIVTDVRGDVLATGTTGEQGEFSFAELVPGAVTVAVNAAGHRPLALPVEVGGTGVTRVEVELSSGAQVQGVVRAPGGPLGDARVTLVDAAGNVVGTARTGADGAYAFTDLDSGEYTVIATGYPPVATALTVGGRGVDDHDIALSHPGE

SEQ ID NO: 11725 - protein, 273 aa, Streptomyces avermitilis
MGLTARIRTRDGWAVSHAVVTVTDMTGAQVVRAEADGEGVVRDGTALAPGAHTVIVTAVGYAPAASSAIVTASGRAEVGTVTLARQGGTELPPPGAWTIDPAHSSVGAVAQHLGISSVHGRFTEFAGRIEIAPDDVAKSRVEAVIGAASIDTGNAMRDGHLKSPDFLDVETYPQITYRSTGIGAAGSDRWTVHGELTMHGVVRPVDLDLAYLGTGSDPWGGTRAAFRATAELRREDFAMNYNQVIQAGITAIGTTLKVELDIQAVQGDTLPQA

SEQ ID NO: 11726 - protein, 156 aa, Streptomyces avermitilis
MAPNIATNTSVSLDELLEFVRPRHRAILLTRRTDGSPQGSPLTCGVDDSGRIVVSTYPERAKTRNARRDEQVSLIVLSDDWNGPWVQIDGTAEVLDTPDSVEPLVEYYRNIAGEHPDWDEYREAMIKQGKSIIRITPERWGPVATGGFPARLASQE

SEQ ID NO: 11727 - protein, 256 aa, Streptomyces avermitilis
MVRAADRAERPARTSVWLEGKVPRGGGARGGQPSGLDRERITRATMRLLDAEGLAKFSMRRLAAELNVTAMSVYWYVDTKDDLLELALDAAFGELRLPAADADEDWREQLRALATEYRGLLVRHPWLSPLAGTYLNIGPHSLDFSLTVQRVIRRTGLPAHGQMGAISAVFQFVYGFGTIEGHFIERCSAAGMSQDDYFRQAMSAVTEAPEVGEAVHQSADLMEARGGDTVEEMRERDFTFALETLIAGIEAMVERG

SEQ ID NO: 11728 - protein, 498 aa, Streptomyces avermitilis
MSTSPAPEVPQGHPQRWLILGVICLAQLTVLLDNTVLNVAIPSLTRELGAATSDIQWMINAYSLVQSGLLLTAGSAADRYGRKKMLIAGLALFGVGSLIAGLADSTGQLIAARAGMGVGGALLLTTTLAVAMQIFSPEETPKAIGIWSAVNALGFAVGPLLGGFMLNHFWWGAIFLINLPVAALGLVAVIALVPESKNPSGDRPDALGAVLSTIGMTSLVYAIISGPEHGWTSGRVLLTAAVAVAVLGAFAYWESRIPYPMLDLHFFRDRRFTGAVAGAVLITFGMGGALFLLTQHLQFVLGYGALEAGLRTAPLALSVVALNFSGLSAKWTAKLGAPVSIALGMALMSGGLVSIATLAADGYGGTLVGLLLIGAGCALANPAMAYAIMSAIPPAKAGVGAGINGTLAEFGNGLGVAVLGAVLNSRFAALIPVAASSLPAALASAGSAEERGRITDAFSSGLETSQLVGAVAVLLGGLLAAALLRRAERADSAVAASA

SEQ ID NO: 11729 - protein, 749 aa, Streptomyces avermitilis
MTTQPDTTYQGDASPSWGPPPNSTAVREPALPGAPAPGSGDPEQPFLRRLWRGRPEDPRWTRPAFLGLLAATGLLYLYNLSSSGYANSFYSAAVQAGSKSWKAFFFGSLDSANAITVDKPPASLWPMELSVRIFGLNSWAILVPEVLMAIATVAVLYAAIRRRFSPAAGLIAGAVLALTPVAALMFRFNNPDAILALLMTVSVYFVIRALEDGRTKWLLWAGAAVGFAFLTKTLQAFLILPALAALYAVCAPVKLKKRLGQLALAGVAMVVAGGWWVAIVELWPASSRPYIGGSQNNSFLELTFGYNGLGRINGEETGSVGGGGGGGGGGTGQWGETGWNRMFNSEIGGQISWLLPAALILFVAGLWLTRKAKRTDLVRGSFLAWGGALLMTGLIFSFMAGIFHQYYTVALAPYIAALIGMGATVLWEERTKVWASLTLAGAVVASAVWGYVLLNRTSDYLPWLKWFVLVGGLAGALGLVFAAKLGRRLALAAVGLSFVASVAGPTAYTLSTVNTGHTGSIVTAGPAGAGMGGRGGGPGGGGGGMRGGFPGAGQNQQGGTGNTQQGGGPQGGGQQGGGMGQPPTGGFGGNQQNGNGNGNAQGQNQQGGMPGGGQTGERGGMGGGMGGLLSGASVSSAAKKLLETDADSYTWAAAAIGAQNAASYQLSTGDPVMAIGGFNGSDPSPTLAQFKEYVADGKIHYFISSGTGGGMGGSSSGTSSGISSWVEKNFTKVTVGSSTFYDLTKKSGS

SEQ ID NO: 11730 - protein, 513 aa, Streptomyces avermitilis
MRTDSSPGNLPAREHLPAGNAGTPVLDVVIPVYNEEKDLQPCVLRLHEHLARTFPYAFRITIADNASTDTTPQVAARLEAEIPEVKSFRLEQKGRGRALRTVWSASDAPILAYMDVDLSTDLNALLPLVAPLISGHSDLAIGSRLSRSSRVVRGAKREFISRTYNLILRGSLQARFSDAQCGFKAIRRDVAQVLLPLVEDSGWFFDTEMLVLAERAGLRIHEVPVDWVDDPDSTVHIVKTATDDLKGVWRVGRALATGSLSLDRLARPFGDDPRDRELADVPKGLARQLVGFCVVGGLSTLFYLLLYSGFRSFTGSQIANALALLVSAVANTAANRRLTFGVRGRGGAVRHQAQGLVVFGIGLALTSGSLAALNAATSSPAHATELAVLIAANLAATVLRFLLFRAWVFPDRRDADAESTVVASHAPSSPTYSTALPHHQGHHQGHHPGQYQGQYEGQYQGQHSPQPQRPPAPAAPYDTAQFRAGEAADRTWGDSTMQMQAVRPHDHDPRNAR

SEQ ID NO: 11731 - protein, 539 aa, Streptomyces avermitilis
MSGRRRPRTQRRGRGRQPRTLRTRLVVSAVALIAVVCAVIGTVTTIALDQHLDEQLNGKLHETAMRASGGAKPPGGKVPDHGPAGDAVEQQSPSARLTSFVQRGGPQVKTMAAYQDSGGTVVKAVVAEFKSSDTAGQKMDAGTLDDAQTAALTSVPKSGTHDVNIPSFGEYRVEYVASPDGKGGYYVALPTQDVTNTINTLILVEVSVTAAGLVAAAIAGSVLVGVALRPLRKVAATATRVSELPLHTGEVTLNERVSESETDPHTEVGQVGAALNRMLDHVHGALQSRQQSEMRVRQFVADASHELRTPLASIRGYAELTRRGREQTGPDTRHALGRIESEAGRMTLLVEDLLLLARLDAGRPLQYEQTDLVPLVIDAVSDARAAGRDHNWRLELPDEPALVSADAARLQQVLVNLFANARTHTPPGTTVTARVHRHGPWLCVDVQDDGQGIPPDLLPHVFERFARGDSSRSRSSGSTGLGLAIVQAVAAAHGGAVTVDSVPGRTVFTVHLPALAPETNWQSHSQAQHSATTWVQQAV

SEQ ID NO: 11732 - protein, 269 aa, Streptomyces avermitilis
VRFLGKSQVPESVLSGGPDMVSTMTTTSPQGRTELLRPDGSPVRVLVVDDELSITELLSMALRYEGWQIRSAGDGQGAVQTAREFRPDAVVLDMMLPDMDGLTVLGRLRRELPDVPVLFLTAKDAVEDRIAGLTAGGDDYVTKPFSLEEVVARLRGLIRRSGAADRRSDSMLVVGDLTLDEDSHEVSRSGENIHLTATEFELLRFLMRNPRRVLSKAQILDRVWSYDFGGQANVVELYISYLRRKIDAGREPMIHTRRGAGYLIKPAVS

SEQ ID NO: 11733 - protein, 309 aa, Streptomyces avermitilis
VRGSGSGTDGTGEEILAVRRFWERLGLPGLVDVHTHFMPERVLRKVWDYFDGLGPLTGGLEWPITYRSDEDQRLATIREFGVRAFTAMLYPHKAGMARWLNSWAVDFARRTPDCLHTATLFPEPGVEAYVLEAVEQGARVFKAHVQVGAYDPADELLDPVWGLLAEAGVPVVMHCGSGPAPGKHTGPGPVAQVLARHPRLRLVVAHLGMPEYEDFLDLAERYGEVRLDTTMAFTDFSERLAPFPRGARPRLAGLGDRILLGTDFPNIPYRYVDQLYALERLGLGDDWLRSVCHGNGARLFGLAQPQELS

SEQ ID NO: 11734 - protein, 148 aa, Streptomyces avermitilis
MSDHRVAPVGGASPGGTPAAPAPVPSPASAPSPASAPTPTPAHEPPYYSVIFTSVRTEGDNGYGETAERMEELVKEIPGFLGADMARTPGGLGITVAYFRDLDAVEEWRSHLEHRAAQQYGRAHWYESYTLHVAKVERSHSFERARER

SEQ ID NO: 11735 - protein, 287 aa, Streptomyces avermitilis
MAQAWRCTGLRWSGDGAVLVWEGGVRSALPRGKRVAFGVVTGGARTCVGARGHACPVRAAVSGRSAGARCEECARLDRAHSVAADTLADDPRPYHVYLAWFGTGMVKVGITAVERGSARLLEQGAVCFSWLGRGPLMAARRAEELLRAALKVPDRIPYADKRAVRAALPGAGERGAEIAGLHARAVVLDGWPESLEREPFQVVDHEEAFGLEGLPPADGVVSELVAGGAVGGEVLAVAGPDLHLATERGVIVLDTRLMTGWELTAGDTGFTVPVREFREATVQDGLF

SEQ ID NO: 11736 - protein, 162 aa, Streptomyces avermitilis
VPRWGVTWTRFTPLLGVVLGVVVSSLAQYSLGRASERAEVRRSARERAEARRNERVTHLIDFLAVVQEAERVAVDRYHHHLADEQWQARQMQAVDRMWVAQKTIHMLCASEVNAAARRLAYDVQDVIRKGPEDPGEPQDEKVWAYIRPSRKAFLDVVRDHLK

SEQ ID NO: 11737 - protein, 134 aa, Streptomyces avermitilis
MPNQITRAAAALVLLTSALGGVSVVGATAANAAGTCDRAKNYQHAFVPASESGVDCQLALGNRGDGVLALQRTLRRCYGSTIVADGIFGPSTRDALKYAQHQAGTQDDGVYGPNTRRAIKHRPSSWPYGCQRVR

SEQ ID NO: 11738 - protein, 155 aa, Streptomyces avermitilis
MFQLSTHTPRGVLLTVAALAAYAAPTTAYAQGLPLPPAPVRGDEVGDHLTVTVSHAGRADGTYRLRCHPGGGSHPDPGGACGTLDRRTIWGRDPFSPVAPDGLCTMQYGGPATAYVTGTWAGRPVNATYDRSDGCQIARWNDLVPLLPDLRSPRS

SEQ ID NO: 11739 - protein, 1479 aa, Streptomyces avermitilis
VSSRPSRGAARLAAILDALPDALVLVNANGTVVNANTIALEAFETPGTALVGRGLLDLLPEFDSRLIPGSMRRPDSMDPRGRTKPTRMVARRTDGSEFPVEVTSANLENGQQAYDGYGYTGDELLMLVVRDLSGTVDTEAELARSQRQTEMILRAAAEGVVGTDTDGRIVLVNPAAAQILGFRASDLGGQELHPLMLHSREDGEPFPYEESPLADTLRSGRKHRVRGQVLWSKSGDKVPVDLTTAPVRDGDQLVGAVMTFTDRRPYDTLAEEKDKAEEQHEQELARIAEEHDEELKRLREEHTAELTELRELHEEELAAGDERYAALGEREKDRHEVLTARHEQLLAVLGQSLRGPLDQLRGELSKLAADDAGQLWPEANQVLHHLAAGYSRITTLVDNVLGYQRLDSGEDDLVRTTTMLDAVVAAGVDGAVELIGPGRVQFAVHAPPIEAEVDPQRLATALAHLIADVAGVDSTGNSPVSAGGYMDNTVVVAAAQRGEVVRIEVRGPYAGGDLVHQPIVRGIVRSHGGVLQTHEVPGMSGNAYVLEVPIGGGAGTVAPGAVPALAPPVAADASAGVVTGAEVALPEQASQQGGGRRRARRSSVDAFLESEVGGDSPSGAVPATSSDTGAAAPTGRRRRRAADGPAADEVSVPVQGSEAENDKDAGPSGGTGRRRGRPSPVEGAASDAADGLGQSVAQGVAEGAVVTAAEHAAGTAATGLGQTVPPQGVPTPSGRRARRGDERQALPAALPAAPSGAGTGAGAGSGAGVPEDANGAAQPTGRRRRALAAANERAASPDLGPRQVFALPPAEADRGPEYDAGLPHAETGVGVGVGVGVGVQAVGAEAAPADGHDQADEGRHDAMAHDPADDHTPPQPHPVATPSGRRRARPAATPAQGQPTPAQAAPGQPVPGQGQGQVPGGADAPAGMPVPGQTGPRQPGPGQAIPHQVAPGQVAAAQGLPAQAAPGQPVPSQSGQAAQAQLAPAPQAQPAPGQPVPGQPVPAQVPPAADGSVSGVPSGADPALGPTPAPQAPQPAAAPQPQPWPAGAHATSGAGTPLVAGQQPPAAPQPTATPAPGTPLPPERAAQPRAAQPLPAEAAAPIDPNSTQGRAISVRTLGQGVPFARQAAAQNKPGAQAQPRPQSQTPTPPPHQTNGSGRRRKLGTPPEPAAERPENAARPQPQAGQSPQARPAGATDGAGRSYAIGAPDKNADEGPEPLDGPGGAVEIADQPHPRPVDDELPPEPLDNPRRLLVWPAPDVTTQQALSDRGYRPVIVHSREEVDAQIAAFPAALFVDPLTGPITRTALQSLRQAAVAAEVPVLVTAGLGQATREAAYGADPAVLLKALAPRDSEQHPPRVLLIEEHAEISLALTSTLERRGMQVARAASDEDAVTLAGQMRPNLVVMDLMQVRRRRAGIVDWLRANGQLNRTPLVVYTAAVDQAELPRLASGETVLFLAERSTSTEVQERIVDLLARIGTN

SEQ ID NO: 11740 - protein, 558 aa, Streptomyces avermitilis
MSPREDTVLSTMQDVPLLISRILTHGSTIHGSSQVITWTGEGEPQRRSYAEIGARAAQLAHALREDFGIVDDDRVATLMWNNAEHVEAYYAIPAMGAILHTLNLRLPAEQLVWIANHAADRVVIANGSLLPLLAPLLPHLKTVEHVVVSGPGDRSLLDGASVQVHEYEELIAGKPVSYDWPELDERSAAAMCYTSGTTGDPKGVVYSHRSIYLHSMQVNMTQSMGLTDQDTSLVVVPQFHVNAWGLPHATFMTGVNLLMPDRFLQPAPLAEMIESERPTHAAAVPTIWQGLLAELHAKPRDVSSLTQVTIGGSACPPALMAAFDKLGMRVCHAWGMTETSPLGTVARPPAHAVGTDEEFAYRLTQGRFPSGVQARLSGPGGERLPWDGESAGELEVRGPWIAGAYYNGPDAEPLRPADKFSEDGWLKTGDVGTISPDGFLTLTDRAKDVIKSGGEWISSVDLENALMAHPDIAEAAVVAVPDDKWGERPLATVVLKEGATADFATLRTFLADEAKIAKWQLPERWTIIESVPKTSVGKFDKKVLRRQYAEGELDITQI

SEQ ID NO: 11741 - protein, 156 aa, Streptomyces avermitilis
VKARQPVLLRTARSLTANPSDAEDLLQTALAKTYVAWERIEDHRALDGYVRRALLNTRTSQWRKRKVDEFACEELPEPEGVTAGDPAEQQALHDAMWRAITKLPARQRAMVVLRYYEDLSEAQTAEVLGVSVGTVKSAVSRALGKLREDPELEPVR

SEQ ID NO: 11742 - protein, 388 aa, Streptomyces avermitilis
MSVRTRDSLGGRAAIVGIGATEFSKDSGRSELRLAVEAVRTALDDAGLRPADVDGMVTFTMDTSPEITVAQAAGMGELSFFSRIHYGGGAACATVQQAVLAVATGVAEVVVCYRAFNERSGRRFGSGVRHREPSAEGAALGWSLPFGLLTPASWVAMAAQRYLHTYGLTPEAFGQVAVVDRKHAATNPAAYFHGRPITLAEHAASRWIVEPLRLLDCCQETDGGQALVVTSVERARDLPRPPVVITAAAQGAGRAQEQMTSFYRDDLTGLPEMGVVARQLWRTSGLAPADIDVGILYDHFTPFVLMQLEEFGFCGPGEAADFVAAERLPLNTHGGQLGEAYLHGMNGIAEGVRQLRGTAVNQLPGAARALVTAGTGVPTSGLILGVDG

SEQ ID NO: 11743 - protein, 131 aa, Streptomyces avermitilis
MKRGEELPPLEIEVTRTLIVAGAIASRDYQDVHHDAESARRRGSPDIFMNILTTNGLVGRYITDHFGPGAVLRKVAIRLGAPNYPGDTMVLTGTVVEVEGDTATVKVIGANGIGTHVRGTVTVTVPPGSAS

SEQ ID NO: 11744 - protein, 378 aa, Streptomyces avermitilis
MDFTPTEDQAAARDLAARIFGDLSTHDRLSAAGTGSDATLWKTLCSAGLVAAVTDVGLLGLVLLLEEQGRTTAQVPFAASCVYGLLAVAAHGSPEQRERLLPGIGDGSVVVSGALPAQGGVGAGARGGLSGTAPVVPWLQDATHVLVADDRRRLWLVRTADARCEPVELTAPWSAGRLTLDGTPAERLGGDHDGAGHERVDHERVDHERVDHDRIDHDLIDNDHIDQVYADVVATARTAFAGLQAGVCAGSLARAVAHTNTREQFGRPLAAKQAVQLRAADAYMDTEAIRLTAYEAAWRRDEGLPYAAQALTAAWWASEAGQRVVHTGQHLHGGAGADLEHPVHRHFLWGRQLDAYLGCGSEVLQELGELIAYGEVER

SEQ ID NO: 11745 - protein, 316 aa, Streptomyces avermitilis
VTEELYARLKAYEGRPAAVGGVGKDRVNEPMIRHWCEAMGDTGSAYAGPAAVAPPTMLQVWTMGGLSGHEGRTDAYDDLLGLLDDAGCASVVATDCEQEYLRPLRPGDEITFDAVIESVSERKRTKLGTGYFVTTRMDVRADGELAGTHRFRILKYAPNAQRSPDRTPDTRKAPADEGTRRPRPVVNRDNAGFWAGVEHHQLLIQRCAGCGTLRFPWLPGCNACGCAEWDTVEASGEGTVYSYVVMHHPSFPAFDPPYAVGLIELAEGVRIVSNVIGVPYDKVRIGLPVRLEFVRYDDDLELPVFRAGEGAGGGGG

SEQ ID NO: 11746 - protein, 429 aa, Streptomyces avermitilis
VHLAPTERQQRLRAELRTYFRDLMPDGPPPADDPGRQRALLRRIGADGLLGLGWPVAYGGQGRGADEQFVFFDEAYRAGAPLSMVTLNTVGPTLMRYGSEAQKAFFLPRILSGDLVFAIGYSEPSAGTDLASLRTRAVRDDGAGDGTGDGGGDGTGDGGGDGGGDGIGDGIGDGGGDAGGGLDGDWLIDGQKIFTSNAQHADWIWLACRTDPDAPKHHGISILLVPTDAPGFSWTPIETVGGLTTTATYYDGVRVPFSNLVGEVNGGWGLITSQLNHERVALAAIGMQAEDFCTAALKAARTPDPVTGRRRVDEPWVRSRLAEAHARLAATRLLNWRLVGDAGAGGPAPGDASGVKFAGTESTVATYRMCQEIVGEAGLIRSGSPGVLGDGELERMNRAAQINTFGGGVSEVQREIVATMRLGMTRGRR

SEQ ID NO: 11747 - protein, 78 aa, Streptomyces avermitilis
MASIRTARVLAAVAALPLAAALFTGVAAADNGNSAITYQQAVGFGASNQSNTAQVNGSPFTTINQKNENVAVNFGNLW

SEQ ID NO: 11748 - protein, 305 aa, Streptomyces avermitilis
MATTDRQATTLALAHALSAAERGLAVIPLSRTKLPALRSPHRATSDRTPSDRGTPRHDVPGPTAPVCHGECGRFGHGVYDASTDPRRIRRLFAAAPWATGYGIACGLHPHFLIGIDLDTKSGTDSSAALRELALRHLFTIPDTVVVLTPSGGRHVWLSGPPDVVVPNSAGRLAPGIDIRGAGGYLVGPGSRTRHGVYSTAPGTARLAPAPCPTALLRLLTPPPRTHHPTPPATGEHGQGLVQFVLAAHEGQRNTRLFWAACRAYENGIGPDLSPALIDAAVHTGLSEREARSTLASAARMTGRRP

SEQ ID NO: 11749 - protein, 147 aa, Streptomyces avermitilis
VDRGKPGSKMHVLSDANGLPLVVGVSAANVHDSEGLKPMVAGHQTRHDPHRGRCFKPQRLHADKAYDIPHLRKWLRGKRIGVRIARKGIESSERLGRRRWVIERTISWLSGYRRISPRYERNLRNYLAFLGLAAALCCYKRLVRLTT

SEQ ID NO: 11750 - protein, 60 aa, Streptomyces avermitilis
VLPYGPGPKRLGRHRWVVERTVSWLAGCRRLHRRYERKAEHCLAFAGIAAALICQRRLTK

SEQ ID NO: 11751 - protein, 205 aa, Streptomyces avermitilis
VLGCLTTWIGRKFDIPSLIHPGRRLYRRMVQTAGDQRAARDEAARQTLREQEAAADAEAAQDGTDGIADGVERPAAKVPASTNPEVSEGEHVSGFQFEEVASEMEQAANQYDPENAMEILAMVEGLPAALTSVANVMKILAERSDSEFPLEKEVADGFNDIFGALMSAVAVAEDMGPLFRQAHEQDIARHEDPRNGTEAEKGWNV

SEQ ID NO: 11752 - protein, 172 aa, Streptomyces avermitilis
VAPPGGSSASMENPAPVSHISTPSTRTVMEQTRWMRSTHSAAIARRSVDNSAAICRCSAAMASSSRASSYSAAERAAAPMPTPIVASEPRAAQVSGPFVMAHVVQPAPTSQEAARVARVRPALRTRRPTTVCPSAPAAPTARAQPGGMAVAAPVVATAKAPVVADRAPVTGP

SEQ ID NO: 11753 - protein, 467 aa, Streptomyces avermitilis
VTTVNVLEQERTYPTDYSTLSLHTGIPWGYRTNAQQILAYLREQCALIVGPTGSGKTNMVHAILAGFARAEDVLTWVIDLNAGSAGLPWVLPALNGQIVREDGKPVRPGIDWLAGTFDEAMTMLDAAVRVAKQRKMGYQALLSKANTDLLPISAKIPQIMLVIDEGAEILVSPDRQVRKLGEKILEVIRIARAMGVRTVLTALGATGSVLSNLMIRREAKVRVALTGSETEGMDLSKMFPGSRGLRVDQAPYKGAGFMGTPESPAALFKAWRILPNQIREITAATSDRHPRLDDVSAKAAGPAYARRWDADRTAWMRDQAVSDDAGDDSPVTPGALRLSALNEQQESPEDALARRFREEIDAQFGTAPEPHTTEQDDVAERPVGLNLSALRDEQDSPAQQAALAALIAAGPAGTGASAIARTLADGFGTTRQTVVGWLKTWLTDGTAVRVGEGTKARYVHRSHTPNG

SEQ ID NO: 11754 - protein, 107 aa, Streptomyces avermitilis
LRESEMRQPTPPGQIAPHIPADVFQRSQATGQPVVFVVNDTPPAVPWARLLIPFAIAGAAALGTWGVVAALCWLMDVAAHTATVIGGAAGPIGAGGITLKLARGKNT

SEQ ID NO: 11755 - protein, 118 aa, Streptomyces avermitilis
MTQPANVRRDPALPISTDLTRLGLLAWATQTAQRGRHVIPLRPNDKRPAGHAEQYCPATGRCADGHKTPEQRATTDVELLIAAWAQAPYNVRIATGPSGLRVIDLDGSIRTARPREAA

SEQ ID NO: 11756 - protein, 70 aa, Streptomyces avermitilis
MTARNSPHLEGLPRPARPAGSQATVGEPKVAARAGHSIAVLYRFYAKILKGGQQQSNSLIARALDEGEWP

SEQ ID NO: 11757 - protein, 472 aa, Streptomyces avermitilis
VSTENEGTAVPPAPSAPPVPVETPAPVQSAAPVGAAPSASAPGQGFGEPPAHQGFAQHAPGAAEAGWPPPPPATPAYADGGGAGAEWGSSYQQPAPKPKAGRGGLLAAILVAALVAGGVGGGIGYTLAKDNDGSSGSTTVSASDSGGSVKRDAGTVAGVAAKALPSTVTIEAQSSSGEGGTGTGFVFDKQGHIVTNNHVVAEAVDGGKLTATFPDGKKYNAEVVGHAQGYDVAVVKLKNAPSDLQPLTLGDSDKVAVGDSTIAIGAPFGLSNTVTTGIISAKNRPVASSDGSSSSKASYMSALQTDASINPGNSGGPLLDAQGSVIGINSAIQSSSSGGLGSSGQSGSIGLGFAIPINQAKYVAQELIKTGKPVYPVIGASVSLEEGTGGAKITEQGASGSDAITPNGPAAKAGLKPGDVITKLDDMVIDSGPTLIGEIWTHRPGATVKLTYTRDGKARTTDVTLGERVGDS

SEQ ID NO: 11758 - protein, 269 aa, Streptomyces avermitilis
VTHARQHPIQVVAHRGASEEAPEHTLAAYKKAIEDGADALECDVRLTADGHLVCVHDRRVNRTSNGRGAVSALELAELAALDFGSWKNGDEAPDWEHRPEDRENTSVLTLERLLELVADAGRPVELAIETKHPTRWAGQVEERLLHLLKRFGLDAPESAATSPARVMSFSARSLHRVRTASPMLPTVYLMQFVSPRLRDGRLPAGVRIAGPSMRIVRGHPGYIERLKRAGHQVHVWTVNEPEDVDLCVELGVDAIITNRPRAVLHQLGR

SEQ ID NO: 11759 - protein, 217 aa, Streptomyces avermitilis
VRQRTWTGRFPVQSKGAFTPWRGAKEVSGVALVVAQEVPTSSSMAVPHGPAGVGKARHRMRDQLRTGGVADSVIDDAVLILSELLSNACRHGRPLGDALAGDGDVRAAWRVDDCGRLTVEVTDGGGPTRPVPATPSVTARGGRGLNIITALAEDWGVRDDARGEVTVWVVMHGDVDAGHRRDDFATRVTAPSPLRQPLLSDSGISDLDFADAFDDVD

SEQ ID NO: 11760 - protein, 321 aa, Streptomyces avermitilis
MAKKRPQTKSKQPQLKDGEIPVVGAREPCPCGSGRRYKACHGRSAAHAVTELVQRPFEGLPGEGDWIALRELVPAATVELKLREDLPEGVPSVTLATVLPMAWPALRRDDGSVLIGLQNDTASGDISRDLADTLQRALTAEPGTPVQGRRAPADGPRLQDLLDPEGAFEPVVHSGFEFWVPDAENATPEVAASLERANAAAIATVKLSGVDAAYWCETPDKNHLRWVMPYPEEQLLDALARLHAAGQSGLGEGTRLVGSFRAHGLTVPVWDLPSGVGAEDVEKPAAEFAERLAAALATDAPLTADERRARGGLTNRQVTLS

SEQ ID NO: 11761 - protein, 191 aa, Streptomyces avermitilis
MQRHSGEQRTSSPRRRGLDPRRVRLFALAAVAAATVALPLAVASAGPVGDEGRAALRASEADDKVPVPSRSPLVLGLGLATAARCGPELFSADGIEAQTCVMTQGRDTWARTYYRNATGEDLHSVLSLMEPGGRTVQMRCVVGAEDDPGACETPRERTVGDVGAYTAIAEFAKGAGSGPLLLRSGSDSGGS

SEQ ID NO: 11762 - protein, 221 aa, Streptomyces avermitilis
MREILGRRRRLLSKRNDGRPELISAALTFAAEWKWPVLPGVAPDPQGRARCGCPDPECTVPGAHPFDPGLLAATTDERMVRWWWTNRPTAPIVLATGGKAPCAVSLPALAASRALTALDQMGMRLGPVVATPHRWAILVAPYSMEQLGELLYAKDYVPGSLRFHGEGGYITLPPSETGHGRIGWERAPLPGSAAPWVPDVEAVVDAVVEALTRTGVSAPEL

SEQ ID NO: 11763 - protein, 464 aa, Streptomyces avermitilis
MNAPHLPKVAGIDSTVPSPAHTVAPTSAATGTPSATSATGPGAVLQDRLASWVSDLTTLHELTERLARTDSLADALQELLRAGAALVGARRGLVVLEPRDGLGPDTTIGLGLARADLGHIETVPRSSMSYGKILDGLPGGEREITQPDLFSEDGLDPRHREVAARLGYAASYALPLSTQAAGRLGAAVWLYDEPAEPVERQRHLIGLYARYATEHLARLVEMERTRACMTTISEELLPSRLPRVTGVQLAARRRTGPRGGGDWYDALPLPDAALGLAVGSVTGSGPSAIAAMGRLRASLRAYAVMEGEDPVAVLSDLELLLRLTEPARSATALFAYCEPALRKITLAGAGHSPPLVIGERRTEFVETSLSAPLGMLACWEAPSVEVTAAPGETVLLYTDGLLHRTGDPMDRAFARLHAAAASVPRAVRTDPGAVADHVLRSVLPDGLDAADSEEDVVLLAARFE

SEQ ID NO: 11764 - protein, 487 aa, Streptomyces avermitilis
MTVAEELPETPETAEEEPLKQRKNSLYPGVSDELAENMKSGWADTELRDLQPIAQATETAARRTALSARFPGERLVVPAGNLKTRSNDTEYPFRASVEYAYLTGNQTEDGVLVLEPTAEGHKATIYLLPRSDRENGEFWLSGQGELWVGRRHSLTEAEQLYGIPASDVRELADKLREATGPVRVVRGYDAGVEAALTDKVTAERDEELRVFLSEARLVKDEFEIGELQKAVDSTVRGFEDVVKVLDKAEATSERYIEGTFFLRARVEGNDVGYGSICAAGPHACTLHWVRNDGPVRSGDLLLLDAGVETHTYYTADVTRTLPINGTYTEIQKKVYDAVYEAQEAGIAAVQPGAKHRDFHDAAQRVLTEKLVEWGLVEGPVERVLELGLQRRWTLHGTGHMLGMDVHDCAAARTETYVEGVLEAGMCLTVEPGLYFQADDQTVPEEYRGIGVRIEDDILVTADGNRNLSAGLPRRSDEVEAWMASLKG

SEQ ID NO: 11765 - protein, 471 aa, Streptomyces avermitilis
VDDFWSGVGVDLHLEPDAAAGRRAGLERALRDAVRDGRLAPGTRLPATRRLAAELGISRGTAKAAYDQLVAEGYLTARQGAGTEVAALPSASLETRDGDARTRAPRFDLRPGSPDVGAFPAAAWLRALRRAIATAPSLAYDYGDPRGRIELRTALSGYLGRARGVIAPPERIVITSGYVQGLALLTRVLDGGTVAMEDPGLPFHRNVVRRGGASVVPLPVDERGACTEGLGTESAVVVTPAHQYPTGVTLHPERRRALTDWARARGGLIVEDDYDGEFRYDRQPVGALQGMAPGHVAYLGTASKTLGPALRLGWMVLPPHLVDAVADAKLHSDHHTESIGQLALAEMINSHAYDRHVRTCRLRYRRRRDQLLDRLGPRWYVRGIAAGLHALVEVPDESAVLARAEAEGLAVGRLGNHWHASAGDGRAERDGHATGDERAAGRPQGIVVGYGTPRERVYPEALEVLGRVLDT

SEQ ID NO: 11766 - protein, 489 aa, Streptomyces avermitilis
MTNDAAAVEPGTPGTGTSGTGTPDAALVGASRAVGDGSPGRAGRTASPGRVGHLVPPAGPRRVLALAQLSNSVGDGAYYVTSALYFTHVVGLPAGRVGLGLTVAWAIGSLVGVPLGRLADRRGPRGTAVLLALATGLAVASFLVVRGFLPFVLAACAYASAQSGLAAARQALLAGLIPAGERTGLLAHLQSTLNAGLAVGAGLGGLALHAGSRAAYLGVFAVDAVSFLLCAALLLRLPSVAPTATGVRRGHGLGVLRDRPYALVTLLNTVLLLRMPLLSLGIPLWITERTDAPAWLVSALFVLNTGAVMLFQVRMARGVTGLTTATRAIRVSGVVMLASCAVFALSSGLSPWGAAGILVLGAVLQVVAEMKQSAGSWQLAFDLAPADRTGEYQGFFGTGVTVARTLGPLVLTALLVDWGTPGWLLLGGLMLAASYGMGPATKWAATRGAVTAQDDQDQQDPHNPQGQQGDPNRSGRQGAAEVRQPAPVS

SEQ ID NO: 11767 - protein, 279 aa, Streptomyces avermitilis
MSSRENEALAQAAVSALTRQLELAPKPGLPDPRDLGARATRQDHCLLRWSAKALTPGLAAMAAAARRTGTATPELRTELGAIGRSTEHSVRLAGGGHRGALWVLGLLVAAAALEPRATGPDVAATAKKIAAHTDRRAPRRPSRGSSVSAKYGAAGARGEARAGFPHVRRALTTLATARSAGAAESEAWLDALLTVMSTLQDTELLYTAGPHGLRHVQAGARGVLEAGGTATEAGREALSAFDADLQARGWSPRGSGSLLAGALFVDALPVVVSSPAQAA

SEQ ID NO: 11768 - protein, 344 aa, Streptomyces avermitilis
LPAFSGCSQRDPMSLRGGVPSVPSMTGNHTDKNITRRRAIAVTGGTVAAGGLAVAGYQSAFADETTADTEATAADASASASSGSGTCVLMSSVTEGPYYLDGALVRKDITEGKNGVPLTLRITVQDTTESCAPVAGAAVEIWHCDAWGYYSGYTTANPGGSAPAESEDGSTADDQTYLRGYQIANANGVVKFKTIFPGWYTPRTCHIHVKVHTGGEKEDGTYEGGKVNHTGQLFFADDAAEEIFALEPYSKHTGSYTKLDDDMVYDGGGAASGLLTLEPVHTADPSKGYKGYIILGIDPDAENTGAGSGGGGTPPSGAPSDAPTGTPPSGAPSDSTSPSASASS

SEQ ID NO: 11769 - protein, 1068 aa, Streptomyces avermitilis
VTARFTPLDMAQRLGRTEQRQIRPSIPPQVHSRSDSHPRRTASPSPAPSEPTLTALLEQRFPEVVQLLRWVGCESLDDWMSVWVQHRGAGWVYEVLDAERDPGGVITAWKAVLDARDQAILVLESLVFESNLCRFAAEASAKMPSRLRYDKTLHVVRQRVALSLWDHALSINWWRPFVFCRALRLARTYLVHVVRDNALTEGSSRFQFSGRLGQATVLLARFEQVGAADLESSAAHIRASITEGNPAEDAVPYLLECYLRLHDHTGNREYLGRAVKTDKDFPGERRGTSWMLHMAEIWLRLADGLPKGDAFGTYLERAEKALLAAGEPGGEDAVRHALLDCVAAAARRTPELVPHIRLGLRRLNNPFGLGEHLRRFAEDGYPAVTLPATLVHHLQRRFESSTEPLHRRLLSDCLRAYIQLDDVSEMERARLLRKALDLQERSLVRAAPLTDELSRMRYADDLLATAELQGNRKFWMVGISLLIRETAANSTSCVPLVRLGRELEKGGTLNRSEQADMRRRLGDVPQADRWIRAVAEGDSGLFYEEAADRAISSPDLVRRNLGGRSNVVTVDDYLGFTSSTLVFKPTTRLCFDRDTEKSAAVARTLRRMDAEDEFATIDLITTISATDLSHSEEQFQIGTEIITVRRFEHGTVLAECLSPASPDTSCELLKRAAKFLAYVHGSDDPASGRIGGVRKEVRNEVRMWLRAVLPDEPSDGANELFEEWWALLEGIGLPPQPRRDAHAFNWLVTDNDRIIAVDLEAARWRPMGYELAQLTDDVPALPVDRWDLRRDVVTCYVEALTRCAGPSRPIDVEKVWAAYRASLLARAVRCLSDRTNEPGIREHGEALLDELSSQPKGDLTRDLAIRLRDAWAKRRGTPGDAPLRELKDGRRRRISRSLSYHLRHGRELTQNPQGWVPIDSLVRALDPKLRVSADELISVARAVSEERFEVRGDLVRARYGHSRPTAIEYEIRAPEGRLYHCTPTTALHNIFERGEGLRPMTRQWVHLTTDRAAALSAGRRHGPCTLLCVPDPSALECRHAGGATWLVAQVPPSALTVVPLHRLFSTHG

SEQ ID NO: 11770 - protein, 152 aa, Streptomyces avermitilis
MSIWWSLHLRRDAASVPLARRLLLGTMETAGVDPDISYDLSVALSEACANAVEHGGDAALGGTSEAYRVTAYLDGEKCRIEVADSGPGFPSGRSRPVIRAAHMDAEHGRGLGLIQELADHVHIGNKPGRGGAVVSFDKILKWRKGAPLVTAS

SEQ ID NO: 11771 - protein, 297 aa, Streptomyces avermitilis
MTAPRQRAARSGCDLRVLRAAVFAAVCVVLAAAGHGLASCTAVPLWTLGAGFLAVFTVAAALAGRERALPGIAAALAVGQSVLHTLFGLGQVSGTSMTSGGMSMGSMGSMSSMASMASMGDGSLVERAARLACGSSVAAISPAQAQRILAEARLDTGTSTGTGTGTGMVSASMHHAADAVPTAAGSSMAMLPSLPMLLGHVLAAVAAGWVLRRGDMALLRLIRLSAHGVAEGALVRSLRGALTLVRALLAGLPGTPDTAPRAPRTALLVPPKPPTTALQHTVIRRGPPPAAALVLAA

SEQ ID NO: 11772 - protein, 244 aa, Streptomyces avermitilis
MKATRIAAAGVAAASAVLVLSAPAFAHVSVQPEGEAAKGGYATVNFKVPNERDDASTTKLEVSFPADHPLASVMPQPIDGWSVKVTKSKLAKPLTLHGEKIDEAVSKVTWTATGKGVEPGFFQKFPLSIGALPEDTDELVFKALQTYDNKEVVRWIEPQKEGQEEPENPAPVLALSAASTDGHHGSSTAEDASDTSKSAADSSTEASSADSSDTTARVLGVVGIVVGVAGVAYGVLAGRRRTSA

SEQ ID NO: 11773 - protein, 217 aa, Streptomyces avermitilis
MRKKTYAAAALFAAAALSLSACGTGDDSNKPIADVSAETGSDKAAVVLDSPFEKPDLVLTDTHGKKYDLRAETKGRPTLIYFGYTNCPDVCPLTMNNLAVAKKQLPKATQDKLRIVFVTTDPKRDTPAELGKWLKGIDPDVVGLTGDFDTIQAGARTLGISIEAPHKDKNGKIVSTHGTQVIAFSPKTDGGYVLYDDQTTVDDYTKDLPKLAKGENP

SEQ ID NO: 11774 - protein, 155 aa, Streptomyces avermitilis
VRRPAGAAVGLAVALALAGCGSDDEAASASSAKPELKVTGAYMPAPSMGTMAAGFFTVANSGGADTLTSVSSDLSADVTLHSTKGGAMEEETSFPVPAKGQLDFASGGNHLMFEKLTHKPEQGEKVSVKLHFAKSGTVAVEMPVKAATYNPKTGH

SEQ ID NO: 11775 - protein, 694 aa, Streptomyces avermitilis
VGTLLLLFLAVAGALLAGAAPVSAHAALTGSDPAQGAVVDKAPTQVSLTFSEKVALSDGSVRVLDPSGKRVDTGKASNPSGTTYGVKLHSGLPDGTFTVSYQVVSADSHPVSGAFTFSIGAPSTTSVSLSDQTAGGGVVGGLYGFGRYVSYAGFILMVGGGAFVLACWQRGAAVRAVQRLVVSGWVALTSATLALLLLRGSYTGSGKVGDIFDLTLLGQVLQTKAGAALVSRLLLLAAAALFIAVLFGAYVKRDAENADAEGEDEDGETEKSGSDADRAAEKKDLTFGLAIGGTVVAAGLAASWAMAEHASTGIQAGLAMPVDVLHLLAVALWLGGLTTLLVALYRAPSIEVAAVRRFSRVAFASVVALTVTGLYQSWRQVGSWSALTDTTYGQLLLVKVGLVAVLVGIAWISRRWTARLPETPEATATAETAVTADATDATDATDATDTTETADAEEKQRAEVAAGASPAVGASSMAAASPGSHSSEASDASDASDKGPEDAGDSRRAAQLARQRVAVATARQKRIRDADPLRSGLRRSVLAEAGVAVVLLAVTTALTSTEPGRTEEAAKAVTASASQRSGPLSLTIPFDTGGQDGKGTARLTLDPARVGGNEMHVFVTRPNGKAFDVPEVKVAFTLDAKDIGPLPVVPDRIATGHWTASGVQIPMAGDWKITVTVRTSDIDQATVNKNAKIG

SEQ ID NO: 11776 - protein, 453 aa, Streptomyces avermitilis
MADHSTPEASSAGVPSPQGAVSAKGSPKNAVSENSTPGDAVSENTLSRGVFSRRRLLGTAGATGLALGAVGGAAGYAAAPSAEKTALLASLGADRVMFHGKHQPGITTALQARGHVVAFDLAAGAGRKEAAALLRRWSATAQRLMAGEAAALDDTDVARDAGPSSLTVTFGFGHSFFARTGLEKQRPVALDPLPDFSSDHLDKTRSNGDLWVQIGANDALVAFHALRAIQKDTGSAARVRWQMNGFNRSPGATAQPMTARNLMGQIDGTRNPKPAEADFDQRIFVPASGHPEWMANGSYAVVRRIRMLLDDWEKLSVTAQEQVIGRRKSDGAPLSGGTETTAMKLQKTDADGNLVVPLNAHARITRPDQNGGAAMLRRPFSFHDGFDPDGVPDAGLLFICWQADPLRGFVPVQRKLDRGDALSHFIRHEASGLFAVPGGAADGEYVGQRLLEG

SEQ ID NO: 11777 - protein, 310 aa, Streptomyces avermitilis
MPASYAYLGPEGTFTEVALRTLPEAATRELVPMVSVPAALDAVRNGEAEAAFVPIENSVEGGITTTLDELVAGEPLMIYREVLLSITFALLVRPDTKLSEIKTVTAHPAAQPQVRNWMKANLPDVVWESAASNADGARLVQEGRYDAAFAGEFAAAKYGLVPLETGIHDAENAQTRFVLVGRPARPAAPTGADKTSIVLWQRDDHPGGLRDLLGEFAVRGVNLMLLQSRPTGAGIGNYCFCIDAEGHISDRRVAETLMGLKRICLQVRFLGSYPRAGVRAEDVPTALPGTSDDEFVKASDWVARCQDGRF

SEQ ID NO: 11778 - protein, 425 aa, Streptomyces avermitilis
VIDLRLLREDPDRVRASQRARGEDVALVDSLLSADERRRSSGVRFDELRSEQKALGKLIPKASPEERAELLKKAEQLKADVKAADVEQHEADEEAKRLLLQLGNLVHPDVPVGGEEDFVVLETHGTIRDFGAEGFEPKDHLELGEALGAIDVERGAKVSGSRFYYLTGVGALLELALVNAAIAQATEAGFIPMLTPALVRPRAMEGTGFLGQASENVYHLEKDDYYLVGTSEVPLAAYHMDEILDADKLPMRYAGFSPCFRREAGTYGKDTRGIFRVHQFDKVEMFSYVAPEDAENEHKRLLEWEKQWLTGLELPFQVIDVASGDLGASATRKFDCEAWIPTQGKYRELTSASNCDSFQARRLSVRMRDGKKVQPLATLNGTLCAVPRTIVAILENHQLPDGSVRVPEMLRPYLGGRELLEPVAK

SEQ ID NO: 11779 - protein, 276 aa, Streptomyces avermitilis
VSSPAPGSSAEGFPYKLVATDLDGTLLRSDGTVSARTRAALAAVTAAGAAHIVVTGRAVPWTRHILDDLGYQGLAVCGQGAQVYDAGEHRLLTSVTLDRQLAGLALAKIEAEVGPLLLAASRDGLDGEVLVGPGYRVQGGPLPVQPIRDAADLWSAPLNKVYVQHPTLTDDELAAVATQVAGGLVGVTMAGEGIVELLPLGLSKATGLSLAARRLRLKAADTIAFGDMPNDIPMFAWAAHGVAMSNAHEELLAVADEVTLSHEEDGIAVVLERLLG

SEQ ID NO: 11780 - protein, 79 aa, Streptomyces avermitilis
MTAEAPRDDGQGKFQDVWDDLVLDEDFIRSAEAAEPSARARMLAARWRDEAPDPQPWRSDEPPAGWFFSKARRRRWRRR

SEQ ID NO: 11781 - protein, 239 aa, Streptomyces avermitilis
MYDPTVARLTYRGLLGRRRALILGALPVLLIVLSAVVRALTGADDQVAADVLGGFALATMVPIIGVIAGTGAIGPEIDDGSVVYLLAKPLKRPTIIFTKLIVAIAVTMAFSALPTFIAGMILNGNGQQIAVAYTVAALVASIAYAAIFLLLGTVTRHAVVFGLVYALVWEALFGSLVSGARTLSVQQWALAVGHKVSGNSLVTSDVSLTTATVLLAAVTVAATWYAGQKLRTLKLAGEE

SEQ ID NO: 11782 - protein, 303 aa, Streptomyces avermitilis
VTTLNIDHVSRWFGNVVAVNDITMTIGPGVTGLLGPNGAGKSTLINMMGGFLAPSTGSVTLDGQPVWRNEQIYQHIGIVPEREAMYDFLTGREFVVANAELHGLGKKAAQRALATVEMEYAQDRKISTYSKGMRQRVKMASALVHDPSLLLLDEPFNGMDPRQRMQLMDLLRRMGDEGRTVLFSSHILEEVEQLASHIEVIVAGRHAASGDFRRIRRLMTDRPHRYLVRSSDDRVLAAALIADPSTSGIEVDLAEGALRIQAVDFGRFTTLLPRVAREHGIRLLTVSPSDESLESVFSYLVAA

SEQ ID NO: 11783 - protein, 309 aa, Streptomyces avermitilis
MAVEQPTAHAGGQSPAHAGEQSRIHNIGYRNYDGPRLGRAYARRSLYSQSLRGAYGLGRSVKSKVLPMLLFVVMCVPALIMVAVAVATKAKDLPVDYTRYAIIMQAVIGLYVASQAPQSVSRDLRFKTVPLYFSRPIETADYVRAKYAALASAMFILTAAPLLVLYVGALLAKLDFTDQTKGFAQGLVSVALLSLLFAGIGLVISAVTPRRGFGIAAVIAVLTISYGAVSTVQAIADAQNSTSAVPWLGLFSPVTLIDGMQTAFLGASSSFPGEAGPSSAQGVVFLIVVLGLIAGCYGLLMRRYRKVGL

SEQ ID NO: 11784 - protein, 320 aa, Streptomyces avermitilis
VIATESLSKRYPRVTALDRLSVDVGPGVTGLVGANGAGKSTLIKILLGLSPATEGRAEVLGLDVATKGGDIRERVGYMPEHDCLPPDVSATEFVVHMARMSGLPPTAARERTADTLRHVGLYEERYRPIGGYSTGMKQRVKLAQALVHDPQLVFLDEPTNGLDPVGRDEMLGLIRRIHTDFGISVLVTSHLLGELERTCDHVVVVDGGKLLRSSSTTDFTQTTTTLAIEVTDSDEHPDGTRAVRDVLHARGVDTHDGSGLPGAGHVLLLTASGEETYDLVRDVVADLGLGLVRMEQRRHQIAEVFTNSDEQRKEAVGHGG

SEQ ID NO: 11785 - protein, 292 aa, Streptomyces avermitilis
MTGMTGMTRMVGMTKGAAAELSAELRGFKEVQRLAYACAEAVAAQLKPGVTEREAARMQRVWLRERGVRDWFHLPFAWFGDRTAFVNFRVPLQFFPTDRRLEPGMPFILDMAPVHKGCTADIGYSGSLGLNPVQDKLLADLEAHRELILREVRERRPLREIYEDVDRLMVRQGYANRHRAYPFGVIAHKVDRVKERAWSPHLFGFGTQSLKGLAGDALRGHRDGWSPLWSPYRFSDHPPRPGLWAVEPHLGFRGTGAKFEEILVVTDSRDPEQSAFWLDDDLPHVRRWAEDR

SEQ ID NO: 11786 - protein, 584 aa, Streptomyces avermitilis
MSLEGARERWVRTGGIELCVAELGDETQPTVVLVHGYPDSKEVWSEVAGRLSERFHVVLYDVRGHGRSTAPQPLRGGFTLEKLTDDFLAVADAVSPDRPVHLVGHDWGSVQSWEFVTVKRTEGRIASFTSMSGPSLDHFGHWIKRRVKRPTPRRVGQLLGQGAKSWYVYLLHTPVLPELAWRGPLGRRWPKILQRVEKVPADGYPTPSLPSDAAHGAWLYRDNVRARLSRPRTDAYAHAPVQLVTPLGDAFLSEKLYDELELWAPQLVRRTLPAKHWIPRTRPDQLASWITEFVIASEGGRPAPVASGPYADRFGGQLVLVTGAGSGIGRATAYAFAEAGARVVAVDRNAEGAARTAEMSRLIGAPDAWAETVDVSDEQAMEKLAEKVATEYGVVDVLVNNAGIGLSGSFFDTTAEDWRKVLDVNLWGVIHGCRLFGKQMAERGQGGHIVNTASAAAYQPSKALPAYSTSKAAVLMLSECLRAELAGQGIGVSAICPGFVHTNITSTARFAGVAAEEEKRRQKRAARLYRLRGYPPEKVADAVLRAVVRNQAVVPVTPEARGAHLMSRFAPRALRAIARLEPPL

SEQ ID NO: 11787 - protein, 309 aa, Streptomyces avermitilis
VSGTASHPPSEGHHVIAPRRVSFDWGRTPLHWIPDEPVATHVINVLHLLLPAGERWFVKVFKEGLPLITDPGLLDDVKGFMGQEATHSVQHAYVLEHLAAQRLDAADFTKYVDFLFERLLGERPPLSAPIPAREWLRFRLSVIAAIEQFTAVLGDWVLAADGLDRAGADEVMTDLLRWHGAEEVEHRAVAFDMYQHCGGQGLPRYARRVAGMAVTAPVMLYLWAWGAAHLLRHDPQLAGRLRYSLAAHNRAVRRGLLPGWKELGTAIPRYLRRSYHPSQEGSLRRAVTYLAQSPAARAAAGAARRAGTA

SEQ ID NO: 11788 - protein, 307 aa, Streptomyces avermitilis
VTYRIEDLAHRSGATVRTIRAYQDRGLLPRPERRGRANVYADAHLARLRQIAGLLDRGYTLASIKELLEAWDSGRGLGGVLGLVAEVDGPWSDEEAGRISRAELSERFGGSPDDAAVADALELGVLEPVPGHEDLFLVPSPQELAVAVELHEAGVPLSAIAGHLRELRGQVEHIASRFLEFTTEHVFARYLGEHPPNEVDATEAASLVRRLRPLAQQTVDAELARAMRLFATRHLRLHLGADQPAPPEEETRSVSIPADTMRAVERLVGSDQAASFVALAAERELRARALDQLAAKHMHKHIVDEES

SEQ ID NO: 11789 - protein, 356 aa, Streptomyces avermitilis
MNAGETHVTRAIGAGPGLRRRTVHTAPSRTAHALSSPHRPPPHRAWAFRGCAYARCMSLRLSTVILPYVRWHEGGRSAWQRAEQLGFHTAFTYDHLSWRSFRDGPWFGAVPTLTAAAAVTDRLRLGTLVTSPNFRHPVTLAKELISLDDISGGRVALGIGAGGTGFDATALGQEPWTPRERADRFGEFVPLLDRLLTEDSVSYEGDYYSAHEARNIPGCVQRPRLPFAVAATGPRGLKLAARHGQAWVTTGDPRLYENGTPEQSVQAIRGQAEKLADACAAIGRDVKELDKVLLTGFTPDRGRPLESLDAFVDFAGRHMELGITDIAIHWPIPDSDFAADEKVFEQIAMEAPAQLR

SEQ ID NO: 11790 - protein, 305 aa, Streptomyces avermitilis
VRTTARPCAHMRENGPVTSATRRPETPASTVPPRLIATDLDGTLLRDDKSVSERTVAALAAAEEAGIEVFFVTGRPARWMDVVSDHVHGHGLAICGNGAAVVDLHGGPGAHRFVKVRELERENALDAVRLLRDAAPGTVYAVEQTYGFYQEPAYPKLHMEVPDSLAPAEKLLAPDALGADEPVLKILAYHPEIDPDAFLTLARLAVGDRANITRSSPSALLEISGPGVSKASTLALCCAERGISHEEVVAFGDMPNDVEMLTWAGRSYAMGNAHPDVLAAASGRTVANNEDGVAVVIERILAERL

SEQ ID NO: 11791 - protein, 568 aa, Streptomyces avermitilis
MPAAPVSPGDAPEPEAGRGDDADSRGLTARVPQLLKAMRSVGSGLELHSTLVRICETAAELANARYAAIGVVAEDGDGLADFVHHGVDAETARLIGRLPDGHKGLLGALIHDPAPVRLAELTEDPRSCGFPEHHPPMRSFLGVPLCVQGKTFGNLYLAEKRGGGLFDDYDLDMVRVLAIEAGIAIGNARLYEAAKQRERWIDGSVAVTTALLSGGDPEDALQVVAEQARRLSGSTAGIVLLPADEGGLEIVAVAADQRPKALGAVIPPESELASELLDGRAVFLADAAGDPRTITHLFRDYGPVMMLPLRSDGRVHGALVTPRARGGRPFTETERTLAAQFASQAALALMMAEAQRDRERLAVYEDRDRIARDLHDLVIQRLYATGMMLESAQRRSGVPEVRRGVGKAVDELDVTIQEIRTAIFALQQGPAEVPSGLRAQVLREIKTAAIPLGFTPSYRFLGPVDTAVGELTRNNLIAALREALSNAFRHAGASRIDVVVDATVTLPDGRPGVRLTVTDDGVGIPDIGRRSGLTNLERRAGSLGGDSWFGPGTGENGAGTTVTWQAPY

SEQ ID NO: 11792 - protein, 1184 aa, Streptomyces avermitilis
VKPIDPRLLRYARATRVFLAAVVVLGAVGAVLVIAQAMLIAEIVVGAFQHGHSVAELRTPLVLLAAVAAGRGLVAWLTELAAHRASAAVKSELRRRLLERAASLGPGWLSGQRTGSLVALATRGIDALDDYFSRYLPQLGLAVVVPVAVLARIVTEDWVSAAIIVGTLPLIPFFMILIGWATRTQMDRQWRLLSQLSGHFLDVVAGLPTLKVFGRAKAQAESIRRITGEYRQATMRTLRIAFLSSFALELLATISVALVAVTIGMRLVHGEMDLYIGLVILVLAPEAYLPLRQVGAQYHAAAEGLAAAEEIFAVLETPAPVSGSLRAPEGEIAFEDVTVRYPGRSADAVSKVSFTVAAGETVALVGPSGVGKSTLLNVLLGFVSPTEGRVRAGGADLASADLEEWRSRIAWVPQRPHVYAGTIAENVRLARPGADDTEVRRALADAGALEFVDALPEGAETLLGEDGTGLSAGQRQRLALARAFLADRPVLLLDEPTAALDGATEAEVVAAVRRLAVGRTVLLVVHRPALLGVADRVVRCEPVESAAMELAEPAAAVESAESARAAGAVSGGGDQTSGREAADAVPSAAEDDVRRSPLRHGRVLSRVRAMAGPRRGRLTFALLLGAAALGSAVGLMATSGWLISRASQQPPVLYLMVAVTATRAFGIGRAVFRYAERLVSHDAVLRMLADTRVAVYRRLERLAPAGLRTTRRGDLLSRLVADVDALQDYWLRWLLPAGAALVVSAASVGFTAWLLPEAGAALAVGLLAAGVGVPLVTAAVARRAERRLAPARGVLATRVTDLLTGTAELTVAGALPARIAGARRADATLTRIASRAAAATALGDGLTALLSGLTVVAAALVGAQAVVDGRLSGVAMAVVVLTPLAAFEAVLGLPPAVQYRQRVRRSAERVYEVLDAPEPVREPERPRTAPASPFPLVVTGLTARHEGQHRDALAGLDLTLEKGRRIAVVGPSGSGKTTLAQVMLRFLDAGAGTYTLGGTDAYALDGDDVRRLVGLCAQDAHLFDSSVRENLLLARRDATEGDLRDALARARLLNWVDGLPDGLDTLIGEHGARLSGGQRQRLALARALVADFPVLVLDEPAEHLDLPTADALTADLLAATEGRTTLLITHRLAGLEAVDEVIVLADGRAVQRGAYAELAAVNGPLREMVGRETEDGLLVGAVAR

SEQ ID NO: 11793 - protein, 334 aa, Streptomyces avermitilis
MHLHDVWFVLIAVLWTGYFFLEGFDFGVGVLTKLLARDRTEKRVLINTIGPVWDGNEVWLISAGAATFAAFPEWYATLFSGFYLPLLIILVCLIVRGVAFEYRAKRPEEGWQRNWETAIFWTSLIPAFLWGVAFGNIVHGVKIDSKFEYVGSFGDLLNPYALLGGLVTLTLFTFHGTVFVGLKTVGDIRERARKLALKVGLVAAVLALVFLLWTQADSGDGKSMAAMIVAVLALVAALVAAQVRREGWAFALSGLTIVAAVVMLFLTLFPNVMPSSLNADWSLTVTNASSSPYTLKIMTWCAGIATPFVLLYQSWTYWVFRKRIGTQHIADAAH

SEQ ID NO: 11794 - protein, 502 aa, Streptomyces avermitilis
VELALAPETLARWQFGITTVYHFLFIPLTISLAALTAGLQTAWVRTENEKYLRATKFWGKLFLINIAMGVVTGIVQEFQFGMNWSDYSRFVGDVFGAPLAFESLIAFFFESTFIGLWIFGWDKLPKKIHLACLWMVSLGTILSAYFILAANSWMQHPVGYRINREKGRAELTDFWQVLTQNTTLTQVFHTLSASFLTGGAFMVGIAAYHLSRKKHIPVMKTSLRLGLVTVVIAGLLTAVSGDFLGKVMFKQQPMKMAAAEALWDGQDSAPFSIFAYGDVDKGHNTVAIEVPGILSFLSSDSFTSYVPGINDTNKAEQEQYGPGDYRPNIPVAFWGFRWMIGFGMASFAIGLAGLWLTRKKFMLPQQLRVGDDEVPHLVLFKNKALGPTLTKWYWRIAILTLGFPLIANSWGWIFTETGRQPWAVYGVLRTRDAVSPGVSQGEVLTSMIIFTSLYAILAVIEVKLLAKYVKAGPPELTESDLNPPTRIGGDSHDADKPMAFSY

SEQ ID NO: 11795 - protein, 359 aa, Streptomyces avermitilis
VSETSPKLRAELEGIPTYKPGKPAAAAGPVAYKLSSNENPYPPLPGVLESVASSVGSFNRYPDMACSGLMSELSERFGVPLSHLATGTGSVGVAQQLLQATSGPGDEVIYAWRSFEAYPIITQVSGATSVQVPLTPGDVHDLDAMADAITDRTRLIFVCNPNNPTGTVVRRAELERFLDRVPSDVLVVLDEAYREFIRDPEVPDGVAIYRERPNVCVLRTFSKAYGLAGLRVGFAIAHEPVAAALRKTAVPFGVSQLAQDAAVASLRAEDELLGRVGALVCERQRVVASLREQGWTVPETQANFVWLRLGERTLDFAAACEQAGVVVRPFAGEGVRVTVGENEANDIFLKVTERFRKEL

SEQ ID NO: 11796 - protein, 370 aa, Streptomyces avermitilis
MTAAGKHQVSRAETSRRGGRPGRAGIRDVAAAAGVSITTVSDALNGKGRLPDATRRHVREVADRLGYRPSAAARTLRTGKSGLIGLTVTTYGDEPFTFTEFAYFAEMARAATSAALARGYALVILPATSRHDVWSNVALDGTVVIDPSDQDPVVSELVRQGLPVVSDGRPAGTLPVTAWVDNDHEAAVLGILDHLADAGARRIGLLTGTTTDTYTHLSTTAYLHWCERVGQDPVYEAYPAHDPCAGAVAADRLLARPDRPDAVYGLFDPNGTDLLAAARRYGLRVPDDLLLVCCSESTVYANTEPPITTLSLKPRRIGTAVVQLLIDAIEGLESDQPVEQVIPTELIVRTSSERRPPRTTVSPPRSPEQG

SEQ ID NO: 11797 - protein, 369 aa, Streptomyces avermitilis
MVEGSMTQGAGQGPEVVRTETLRDFRVPAYVHETGPYAQSTPPDEVTGPVAEPRGYPESYPEGYTPTQRDLPVINRGDTLQVTIDPTPQSVPQSADGPGPLYVVGDVHGYLDQLVAALQEQGLVDAAGSWSAGTARLWFLGDFTDRGPDGIGVIDLVMRLSAEAAAAGGYCKALMGNHELLLLGAKRFGDTPVNSGAGTATFQAAWLLNGGQKTDMDRLQDHHLQWMARLDAMEQADGHLLVHSDTTAYLDYGDSIEAVNDTIRETLTRNDADECWDLFRKFTKRFAFRDDGGAEAARSLLDAYGGTRIVHGHSPIPYLLGEVGSEDDEDGTGPVVEGPHVYADGLAIAMDGGVTMAGKLLVQQLPLDS

SEQ ID NO: 11798 - protein, 285 aa, Streptomyces avermitilis
MNSVPQHLLSEDRQEYERILGEVLRSAPHRPELAAVDRRLNTEQLRTMALNATALITAAAATEYQHYVKVREELRQPAPSTPPVREEAGAMEPGAAAVGLATTLGEAAETAGAGAVAVVLAPVLAGTAAAIFLLVGYILKMLNPEQAFTQTLLTTGWVFGAVTAAAILVAAVGLLLTALRNSPSALETSAQSELTDEVARAREAWHEALLERGLLPFLREALADPGTAALGSPAPSEAPSRIPHLGYHRPGFTSPDGGPAAGPRPSFTSPDFTSPDFGGPEHQPE

SEQ ID NO: 11799 - protein, 601 aa, Streptomyces avermitilis
MTNKDARTPASSQTGEALASPQGDQEAGKSIGWHKAYVAGSRPDLRVPVRQVHLTNGESVTLYDTSGPYTDPSVDTDVRRGLAPLRENWIIARGDTEEYAGRPVRPEDDGIKHTSPRGGLRNLDAVFPGRPRQPRRGRDGQAVTQLAYARRGEITPEMEFVAVRENVSAEVVREEIAAGRAVMPVNVNHPEIEPMIIGKRFLVKVNANIGNSAVTSSIEEEVEKMTWATRWGADTVMDLSTGRNIHTTREWVLRNSPVPIGTVPLYQALEKVDGRAEELTWEIYKDTVIEQAEQGVDYMTVHAGVRLPYVPLTANRKTGIVSRGGSIMAAWCLAHHKESFLYENFEELCEILAAYDVTYSLGDGLRPGSIADANDEAQFAELRTLGELNRIAKRFNVQTMIEGPGHVPMHKIKENIDLQQEICDEAPFYTLGPLTTDVAPAYDHITSGIGAAMIAWWGTAMLCYVTPKEHLGLPNRDDVKTGVITYKIAAHAADLAKGHPGAQEWDDALSDARFEFRWEDQFNLALDPDTAREFHDETLPAEPAKTAHFCSMCGPKFCSMKISQDIRREHGGTRTEVEEGMAQKSKEFAAAGNRVYLPLAD

SEQ ID NO: 11800 - protein, 480 aa, Streptomyces avermitilis
VTTTQQPPFPPSEPPRGQGPGGGRGQSDGPGGHSPGDGHDHGQGSGGGNGPGHSHSHSHGPAAPVSQHLRKVIAAILIPFAVAVVVGLAVLWPGGVPGHERSGVGFDRQTQQATVTKVDEVDCKSVNASGDTPTGDTSTAEGSSAQQQASGTCKKATIRVDTGKDKGRTFTEIVQPDQTRQLHQGEKVVVAYEPSAPKNLQYSVTDVERKFPMALLAGIFALAVVVVGRMRGVMALVALAISFMVLTLFILPAILEGSNPLIVAVVGASAIMLIALYMCHGLSARTSVAVLGTLLSLVLIGLLGSQFIGWAALTGNTDDNTGLIHGLYPHIDMSGLLLAGVIIGSLGVLDDVTVTQTSAVWELHEANPTMGWRGLYRAGIRIGRDHIASVVNTLVLAYAGAALPLLLLFSIAQSSVGTVANSELVAEEIVRTLVGSIGLVASVPVTTALAALVVSADRPGTPAPAAAAPLRSGRGRRRKR

SEQ ID NO: 11801 - protein, 135 aa, Streptomyces avermitilis
MSFLVSEELSFRIPVELRYETCDPFAVQLTFHLPGDAPVTWTFGRELLIDGVGRPCGDGDVHIAPADREAFGEVLIRLQVGGDHALFRSGAVPLVTFLDRTDKLVPLGQECSLADFDAHLDEALDRILAEEQSAG

SEQ ID NO: 11802 - protein, 241 aa, Streptomyces avermitilis
VQRAMRLLEAVAAREYGAPAKQLAREAGLALPTAYHLLRTLAHEGYLRREKGLFFLGEAAERLGSSGAQEKRRSAVNDVLAHWHDSIGVPVYFAVYRDGEIEVVCVADTPGNPAVEEWADFRETGHAHAIGQCLLSQLDEGARRDHLDRYPVQSITPYTVRDEHTLLRRLERVGRMEPVVERQEYALGTVCAAIPITAGTTAAAMALSLPLSQADRLLPAARQLQGEIGRLLGTLSISISI

SEQ ID NO: 11803 - protein, 70 aa, Streptomyces avermitilis
MREIFAGMPWWVKWVAVPVIALVVFGGLIASVVGFVIGLLFKLLVFVALVGGLIFVVRKFMSSSSSHSDW

SEQ ID NO: 11804 - protein, 105 aa, Streptomyces avermitilis
MKAFRLDELEAERAANDGAYLQFLRERNMSVGLYALDAGELDPQKPHQQDEVYLVVSGRASITVGMETTQVARGSVVYVPAGVAHKFHHITEDLRVVVVFSPPES

SEQ ID NO: 11805 - protein, 126 aa, Streptomyces avermitilis
MKNFVVKTIANAGALAVAVWLLDKITLTGDSTGKKIGTLIVVALVFGLVNFLVKPIVKVLTFPLFILTLGLITLVVNALMLLLTSWLADKLDLSFHVEGFWTAVVGGLIISVVSWALNVVLPDDKD

SEQ ID NO: 11806 - protein, 163 aa, Streptomyces avermitilis
MTYRVCFVCTGNICRSPMAESVFRARIAEAGLDGLVEVSSAGTGGWHEGDGADPRTVAVLEANGYESGHTARQFQASWFSHLDLVIALDSGHLKALRRLAPAPADTEKVRLLRSYDPAADADPDVPDPYYGQMDGFEECLEMVEAASPGLLAAVRQQLEGRAA

SEQ ID NO: 11807 - protein, 381 aa, Streptomyces avermitilis
MTSGDFVAETGDGTRAVRAGLPDPVKHEPTLPGPVFAAHFHLPGEPTGPYTYGRDENPTWTHLERAIGELEAPGQDGVETLTFASGMAAISAVLFSQLRAGDTVVLPDDGYQVLPLVREQLTAYGIEVRTAPTGGDAQLDILDGAKLLWIETPSNPGLDVCDVRRLVAAAHAQGTLVAVDNTLATPLGQRPLELGADFAVASGTKMLTGHGDILLGYVTGRDAAPMAAVRRWRKIVGAIPGPMEAWLAHRSLATLQLRADRQNANALAVAEALRGRSEVSGLRYPGLPDDPSHKIASQQMRRYGCVVSFSLPTRGRAERFLDALTLVDDATSFGGVRSTAERRGRWGGDAVAEGFIRFSAGAEDPEDLVADVLRALDESAH

SEQ ID NO: 11808 - protein, 301 aa, Streptomyces avermitilis
VDLALLRTFVTVHRAGSFTRAAALLGLSQPAVTSQIRTLERQLGRPLFLRQARGVTPTTIGDELAHKAAPHLDALVEIAETGLDEESSLRTLHLAGPPEFTAERALPALTELTGDDGQGFALRASFGNAEETLEGLAAGHHDLAITTAQPRGALLTATPLCDEEHVLVAAPRWAVRIGHGKLRRKGAPALENIPLVEVHESLPFVARYWASVFDSRPAASGTVIVPDLRAVLACATTGAGLAVLPRYLCAPALERGDVVPLLDPAVPPLRTYFLVVRTGTLAMPHIARAHEWLLRAAADWV

SEQ ID NO: 11809 - protein, 160 aa, Streptomyces avermitilis
MTVRPVVKRTARAILLDGDDLILIKRTKPGVDPYWLTPGGGVEPEDTTVVDALHREVHEELGAKITDVVPCFVDTVEHIGEDGGATGVKVQHFFVCHLESMDPAQRHGPEVEDPCGEYEIVRIPFTRVGIASVHLVPLSLRHYLDGNIEGVRAMHAPDLG

SEQ ID NO: 11810 - protein, 565 aa, Streptomyces avermitilis
MFEARHTMDAPTTTSADNGTSGGTGGAGWFTPRKQPETPQGGGQEAPEGSRLAAMRPVGRPSAGEGTEQQRIPPTEEAVVAPTQPMSGEPLRSLPDPAAPAPARHLGATLTEETRPAPAPIAASQPESAHEALRPLAGQPQFGQPQSGPVQPQPAAALPERGIPQREPGPPEPGSPRPGPDPQVPTPGPAPGPEASPDAVLIRRTMAEVGPVAGKVTSYFYALLFVRHPDLRSLFPAAMDTQRDRLLKALLTAAEHIDNTEVLVAYLQNLGRGHRKYGTRPEHYPAVGECLIGALSRYASGIWDEETEAAWVRAYTTISQVMIDAAAADELRAPAWWYAEVVSHDLRTPDIAVITVRPDQPYPFLAGQYTSLETPWWPRIWRHYSFASAPRSDGLLSFHVKAVPAGWVSNALVHRARPGDIIRLGPPAGSMTVDHTTESGLLCLGGGTGIAPIKALVEDVAEHGERRPVEVFYGARRDHDLYDIDTMLRLQQSHPWLSVRPVVDQRAHLQLPDVIREYGPWNEYDAYLSGPPGMIRSGVDALRGIGIPPDRIRHDSVEELVAAGD

SEQ ID NO: 11811 - protein, 219 aa, Streptomyces avermitilis
VPVSLISPSMTRLHLFDLDGTLLHGTAAPVEISRQLGIDAEIADLERDFVARRIDSHGYARRVHALWGDLTEAHVAAAFQEAPWLRRIRYTWADIRSRGEYCAVVSLSPSFFVERLIGWGAHAAYGSRFPAVPFSEPVDPAGILTPAAKVEIADRLCEEFGVTRADCVAYGDSLSDAELFGSVPVSVAVNADRHLLGLATYTYAGRDLWDAYELVRRAR

SEQ ID NO: 11812 - protein, 288 aa, Streptomyces avermitilis
VSTPSSASLPIRHLTPRDLTACADLSEDRGWPREEHKWGLLLAAGKGYGIDDPEGGLVSACVVTEYGPQDRPDLGAIGMVLVAERHARQGIGRRLMRHVMAEMATTPLTLCATPFGRPLYEELGFKVVGHSEMVRGYFAPGGAEPAVVTRPATAEDLIPILRLDAEVFGADRTHVLTRLPAFADQLRVAEENGRIIGYTAAWPNMDTHVVGPLTARDTETAKALVASLAAHTDRPLRTDIDVRHEELLAWLKERGLAPVGLNAVMTYGIPDLPGDGTRRFAPLTVAAG

SEQ ID NO: 11813 - protein, 139 aa, Streptomyces avermitilis
MSTTAVTPLSTEDAEVLVSAARRAAEAAGVTVSITVLDAGGHLLAFRRDDRAVLISGETSTRKAYTALQLNASTADLVEAVQPGGLFHTLPTALDRPLLFIAGGVPVHRDGRLIGALGVGGGAPEQDHGFAAAAVKALS

SEQ ID NO: 11814 - protein, 402 aa, Streptomyces avermitilis
MPLALLALAIGAFGIGTTEFVIMGVLPEVAGDFGVSIPTAGLLVTGYALGVVFGAPIMTALGTKVPRKRMLMLLMGLFVLGNLLSAVAPVFGLMLVGRVVASLAHGAFFGIGSVVAAELVAPEKKAGAISMMFSGLTVANVVGVPLGTLIGQSIGWRVTFAVVAALGVVGLLGVAKLVPEMPKPPGVRLRHELAAFKNVQVLLAMAMTVLGFGGVFAAITYIAPMMTHVAGFADGSVTWLLVLFGLGMVGGNLIGGKFADRALMPMLYVSLGGLAVVLALFTVTAHNKVLAAVTIMLIGALGFATVPPLQKRVLDHAHGAPTLASAVNIGAFNLGNALSAWLGGIVIAAGLGYTAPNWVGAVLAAAALVLAVLSAALERRDTGRSAVVADAAPAERQTPVHH

SEQ ID NO: 11815 - protein, 152 aa, Streptomyces avermitilis
MTATDPALTALAQGWCALSLLHGRIEGHIERALQAKHGLSVREYSLLDVLSRQHDGEGGHLQMKQVADAVVLSQSATTRLVTRLEDRGLLSRYLCPTDRRGIYTNVSEAGLKLLEEARPTNDAALRQALDEAARSPELAPLVRVVESVNAPA

SEQ ID NO: 11816 - protein, 150 aa, Streptomyces avermitilis
MEDLEIRPAVAGDIPAIVAMLADDPLGAQRESPDDLAPYLTALERLAKDPNQHLVVAVREDRVIGTLQLTIIPGLSRRGSTRSIIEGVRIHADERGSGLGTRLIEWAVDESRRQGCQLVQLTSDATRTAAHRFYERLGFEASHVGFKLPL

SEQ ID NO: 11817 - protein, 461 aa, Streptomyces avermitilis
MKTSQEELLPATRRALLHRIAVAQAEGRAPSLAAAVVRGGQTVWYGSRTSVDGHAPDENVQYRIGSITKTFTAVLVLRLRDEGVLDLGDPLEKHLPGTGAGEATIAELLAHTGGLAAESPAPWWERTPGSLRPELADVLGELPLRHPVGRRHHYSNPGYTLLGALVEELRGAPWEEVLRREVLEPLGMRRTSGDPRAPHAGGWAVHPWADVMLPEPAEDLGRMAPAGQLWSTTGDLARFAVFLAQGDERVLSADSVREMRTPAAPAEAADVMSGSAYGLGMQLQYRDGRLLVGHSGSLPGFLANLTVSVEDDLAAVVLVNCTSGPMPSAVAADLVRIVAEAEPRIPEPWRPLPDVDEGVLELAGQWYWGTQAFVLRLTVDGGVSLEPLSGVGRRARLRANGDGTWTGLDGYYAGELLKAVRRPDGSVSHLDLGSFVFTRQPYDEGAPVPGGVDPEGWRGIP

SEQ ID NO: 11818 - protein, 491 aa, Streptomyces avermitilis
VSLSEPLDDPWADSGPSDRLPASRQRREGGRGRDEQHDRGRDSDAWEGAGSSFERVPPQDLDAEQSVLGGMLLSKDAIADVVEVLKGHDFYKPAHETIYQAILDIYAKGEPADPITIAAELTKRGEITKVGGASYLHTLVQTVPTAANAEYYAEIVHERAVLRRLVEAGTRITQMGYAADDDVDEIVNRAQAEIFAVTEQRTTEDYLPLGDIMEGALDEIEAIGSRSGEMTGVPTGFTDLDQLTNGMHPGQMIIIAARPAMGKSTLALDFARAASIKNNLPSVIFSLEMGRNEIAMRLLSAEARVALHHMRSGTMTDEDWTRLARRMPDVSAAPLYIDDSPNLSMMEIRAKCRRLKQRNDLKLVIIDYLQLMQSGGKRSESRQQEVSDMSRNLKLLAKELELPVIALSQLNRGPEQRTDKKPMVSDLRESGSIEQDADMVILLHREDAYEKESPRAGEADIIVGKHRNGPTATITVAFQGHYSRFVDMAQT

SEQ ID NO: 11819 - protein, 448 aa, Streptomyces avermitilis
LVAMTQAPARPSAARRRHDREIVALAVPAFGALVAEPLFVMADSAIVGHLGTAQLAGLGVASALLTTAVSVFVFLAYATTAAVARRVGAGDLRAAIRQGMDGIWLALLLGAVVIAVFLPTAPAVVDLFGASETAAPYAITYLRISALGIPAMLVVLAATGVLRGLQDTKTPLYVAVAGFVANAVLNVVLVYGAGLGIAGSAWGTVIAQYGMAVAYLYVVVRGARKLGAPLRPDIAGIRACAQAGAPLLVRTLSLRAVLMIATAVAARLGDADIAAHQIILSLWSLLAFALDAIAIAGQAIIGRYLGAGDTEGARAACRRMVEWGIAAGVVLGLLVVVARPLFLPLFTGDSAVKDAALPALLLVALSQPICGVVFVLDGVLMGAGDGLYLAWAMLLTLAVFTPVALLVPMLGGGLTALWGAMTLMMTVRMLTLWLRSRSGRWIVTGASR

SEQ ID NO: 11820 - protein, 148 aa, Streptomyces avermitilis
MKIILTHEVSGLGAAGDVVDVKDGYARNYLIPRNFAIRWTKGGEKDVEQIRRARKIHEIQTIEQANEIKARLEGVKVRLAVRSGDAGRLFGSVTPADVASAIKASGGPEVDKRRIELGSPIKTLGAHETSVRLHPEVAAKVNIEVVAA

SEQ ID NO: 11821 - protein, 78 aa, Streptomyces avermitilis
MAKPPVRKPKKKVCAFCKDKVTYVDYKDTNMLRKFISDRGKIRARRVTGNCTQHQRDVATAVKNSREMALLPYTSTAR

SEQ ID NO: 11822 - protein, 202 aa, Streptomyces avermitilis
MAGETVITVVGNLVDDPELRFTPSGAAVAKFRVASTPRTFDRQTNEWKDGESLFLTCSVWRQAAENVAESLQRGMRVIVQGRLKQRSYEDREGVKRTVYELDVEEVGASLKNATAKVTKTTGRSGQGGQGGYGGGGGGQQGGGWGGGSGGAPQGGGAPADDPWATGTPAGGNQGGGGGGGWGGSSGGSSGGSGGGYSDEPPF

SEQ ID NO: 11823 - protein, 96 aa, Streptomyces avermitilis
MRHYEVMVILDPDLEERAVSPLIENFLSVVREGNGKVEKVDTWGRRRLSYEIKKKPEGIYSVIDLQAEPAVVKELDRQMNLNESVLRTKVLRPETH

SEQ ID NO: 11824 - protein, 104 aa, Streptomyces avermitilis
MAQAFRPNTAGSLFATDGKAHPLQDTLLAVTLVLGVIAFVTAMFHGLHLISSWAGLVGIATGAYGQFISVTTRERFGLILGLGASAVGFFLGMAHGGLFGGVFG

SEQ ID NO: 11825 - protein, 373 aa, Streptomyces avermitilis
MSLTLRTISREQHLAYIQSLPAASHMQVPAWADVKAEWRSESLGWFDDRTGEMVGAGLVLYRQLPKIKRYLAYLPEGPVINWFAPNLDDWLQPMLAHLKQQGAFSVKMGPPVIIRRWEAASIKGGIQNPDVKRLRDIEADFIEPRAFEVADKLRRMGWQQGEDGGAGFGDVQPRYVFQVPLANRSLEEVHKNFNQLWRRNIKKAEKAGVEVVQGGYHDLEEWQRLYEITAVRDHFRPRPLSYFQRMWTALNTEDPNRMRLYFARHNGVNLSAATMLVVGGHVWYSYGASDNIGREVRPSNAMQWRMLRDSYALGATVYDLRGISDSLDETDHLFGLIQFKVGTGGEAAEYLGEWDFPLNKLLHKALDIYMSRR

SEQ ID NO: 11826 - protein, 343 aa, Streptomyces avermitilis
MALTLYVDTARWRAHHKHVQEQFPGLVPVCKGNGYGFGHERLADEATRLGSDVLAVGTTYEAARIKDWFGGDLLVLTPFRRGEEPVPLPDRVIRSVSSIDGVYGLVGARVVIEVMSSMKRHGVSEQDLPHLHSAIENVRLEGFAIHLPLDRTDGSDAVEEVIGWMDRLRAARLPLHTMFVSHLKAEELARLQQQFPQTRFRARIGTRLWLGDHEATEYRGAVLDVTRVSKGDRFGYRQQKAASDGYLVVVAGGTSHGVGLEAPKALHGVMPRAKGVARAGLATVNRNLSPFVWAGKQRWFAEPPHMQVSILFVPSDATEPKVGDELVAHLRHTTTQFDRILDR

SEQ ID NO: 11827 - protein, 505 aa, Streptomyces avermitilis
MCGMPSAETTRASVHQPEPVRPTREDEVAAAGSELIGGPIGRRALFGTSWWTPVRIVALVAIGMFALGMVQKLPCYDSAWFFGASSQYTHACYSDIPHLYQGRGFADGLVPYFDKLPGDMDYLEYPVLTGVFMEVASWLTPGSGTIQHQEQAYWMANAGMLMVCTAIIAVCTSRTHRRRPWDGLLVALAPAFALTATINWDLLAVALLAAAMLMWSRGRALAFGILLGLATAAKFYPFLVLGPLFLLCWRAGKWREFATALLGAVGAWLVVNLPVMFLAPEGWAKFYRFSHDRGVDFGSVFLVLSQRWNIQITADAANTWAMVMMLAVCAGLAALTLTAPRRPRLAQLAFLIVAAFILTNKVYSPQYVLWLVPLAALARPRWRDFLIWQACEVAYFLGIWMYLAYTTSGDAHKGLPTEGYQLAVVLHLLGTLYLCAVVVRDILMPERDVVRRAGDDDPSGGVLDGAPDVFVLGAAAHPPRHAVHFEGPQVEWGSRGPMSVGDSSP

SEQ ID NO: 11828 - protein, 929 aa, Streptomyces avermitilis
MRKRPHPYLGGTGNQPPFPGAQRCACPRSNRSMSEHRRKLPQPQEGGRAAARRGQSAPSGRRAAPRAATGSPSDSYGAGDEERPYGGRAEARRASQRSEPGRRRAADGAGRGSGGGGGRRGGPGGPGGPNGPGRGRGRSVPERKRFIDYPRAGKYGAARWLPSWRLVTGLCIAFFGSMVAVAGVAYALVGVPKVALTAKAQNNVYYWKDGSQMVATGGETNRQIVNISQIPKAMRYAVISQENKTFETDSGVDPKGIARAFFNMARGGETQGGSTITQQYVKNAMLDDQSQTISRKFKEIFVAIKVGAKVPKDEIMAGYLNSAYYGRGAYGIQAGARAYFDEDAKNLNPGQCAFLAAMLKGATYYDPAGATSLDPAATSEANSRRAKLQMQDTLDKEVEYGHLDEATRNKYTELPKVENPRSNARLSGQVGYLVDLAKAYLVNNSEISADDLQRGGYSIYTTFDKKKVTELEDAVKAVRKKNIKPKQRPDTDTYVQFGGASVDPTTGAIKAIYGGEDATKHFTNNADQTGAQVGSTFKPFVLAAAMSWGKKDPDLDDSQSQDERTVVSPKSLYSGKNKLKIEDYKGNVWTDNKGKEWLQTNDGGESYNAPSYKIDLREAMRVSANSAFVQLGMDVGLDKVRDAALSAGILKTSLASANYPSFSIGTSDPSAIRMAGAYATFAASGKQRDPYSVEKVTSKDGPVFQHSDIAKVDDAFTAKVADNVTDVLKTVVDQGTGTAAQLTGREVAGKTGTTDGNKSAWFVGYTPQLSTSITMYRMDDNESSKKRQFLEMYGTGGQDKIHGASFPAEIWHDYMEQALKDTAPKDFPTPQPIGVVVDDNPTPTVIPSPTKSVEESPTPTPTPSKTTTSPTPTPTDSCFGFGCTDTGGTDTGGNTSGTDGGVTATPTESTGNGNTRGNGNGGIFGGPNG

SEQ ID NO: 11829 - protein, 227 aa, Streptomyces avermitilis
MSRRSGILEFAVLGLLRESPMHGYELRKRLNTSLGVFRAFSYGTLYPCLKTLVANGWLIEESGSAPEDALAASLAGRRAKIVYRLTAEGKEHFEELLSQTGPDAYEDEHFAARFAFFGQTSRDVRVRVLEGRRSRLEERLEKMRASLTRTRERLDDYTLELQRHGMESVEREVRWLNELIESERAGRDLKGSASAGSAQQNSTSGETGGLPRHRDESRPDPSDDTTT

SEQ ID NO: 11830 - protein, 360 aa, Streptomyces avermitilis
MGSVRVAIVGVGNCAASLVQGVEYYKDADPASKVPGLMHVQFGEYHVGDVEFVAAFDVDAKKVGLDLSDAIGASENNTIKICDVPNKGITVQRGHTLDGLGKYYRQTIEESAEAPVDVVQILKDKQVDVLVCYLPVGSEDAAKFYAQCAIDAKVAFVNALPVFIAGTKEWADKFTEAGVPIVGDDIKSQVGATITHRVMAKLFEDRGVRLERTMQLNVGGNMDFKNMLERDRLESKKISKTQAVTSQIPDRDLGEKNVHIGPSDYVAWLDDRKWAYVRLEGRAFGDVPLNLEYKLEVWDSPNSAGVIIDALRAAKIAKDRGIGGPILSASSYFMKSPPVQYFDDEAYANVEKFIKGEVER

SEQ ID NO: 11831 - protein, 420 aa, Streptomyces avermitilis
MAVVRDLRILLRFQGFRRLLAVRLFSQTADGVYQVALATYVVFSPEKQTSAAAIASAMAVLLLPYSVIGPFAGVLLDRWRRRQVFLYGNLLRALLACVTAVLMLGHVPDWLFYVSALSVTAVNRFVLAGLSAALPRVVDDKRLVMANSLSPTAGTLGATAGGGLAFAVRLVAADSDAVVVLLGAALYLCAALASLRIAPDLLGPDQRPVRPRLGAALVGTARGLVLGVRHLAEAPRREAAWALIAMTLMRFCYGALTVMVLMLCRYALSSDSDDGLALLGLAVGVSGAGFFTAAVLTPWAAGKLGPGRWIVVCAAAAALLEPALGLPFTTVPMLVASFVLGVTTQGAKIATDTIVQSSVDDSFRGRIFSVYDVLFNVAFVGAAAVAALMLPPDGRSATLVVTVAVIYGAIAGAMARFDLQ

SEQ ID NO: 11832 - protein, 163 aa, Streptomyces avermitilis
VTVPPQPQGQNPYAQQPAPPEGQQPGQPGVPPQQPYAPFPNQGGPVPPPPAPAGRAGKKVMRVLGIIVVGIIVIAVKFGAGWFFSRSDAETTSVGACMHNDGTDTNADLNEVDCSSGDSQYKVVEKFDDTSDDSKCKAVKSSTVYYVQSGGGHNVVLCLKETK

SEQ ID NO: 11833 - protein, 480 aa, Streptomyces avermitilis
VPNANEDNPSALSQVQRRAVSELLRVSPVADELARRFQEAGFSLALVGGSVRDALLGRLGNDLDFTTDARPEDVLKIVRPWADAMWEVGIAFGTVGAQKEGYQIEVTTYRSEAYDRTSRKPEVSYGDSIEEDLVRRDFTVNAMAVALPEKEFIDPHGGLDDLAARILRTPGTPEESFSDDPLRMMRAARFAAQLDFEVAPDVVTAMTEMAGRIDIVSAERVRDELNKLVLSAHPRKGLTLLVDTGLADHVLPELPALRLERDEHHRHKDVYDHSLIVLEQAIALEENGPDLTLRLAALLHDIGKPRTRRFEKDGRVSFHHHEVVGAKMTKKRMTALKYSNDLVKDVSRLVELHLRFHGYGTGEWTDSAVRRYVRDAGPLLDRLHKLTRSDCTTRNKRRAAALSRAYDGLEERIAQLQEQEELDAIRPDLDGNQIMEVLGVGPGPVIGQAYKFLLELRLENGPMEYDAAVAALKEWWAEQN

SEQ ID NO: 11834 - protein, 805 aa, Streptomyces avermitilis
VAEAADFQGMSPSPARRWLKRTGALLAGAPLLAGLLQLPVAPSAYAAEKASPADASGSRTVDVSLDSLSPSVPTDGDTVTVSGTVTNHGKQTITGAHVGLRVNAPLSDRTAITDAAERRGYQPGVDGAEIGGKYVEKFPQLAAGVSQHFDISVPVKELDLGSDGVYQLGVSLSGQTAAQPWDQVLGIQRTFLPWQPDGADPKTKTTYLWPLISTVHQTAETGSNEQQTPVFRNDDLAKEISPGGRLDQLLSLGKELDVTWVIDPDLLASVDAMAGSYSIQNGNGSKTAGKNQAVAKQWLAELEKTVEDKEIVALPFADPDLASLAHNGKNVTGSLSHLKDATDVAASTVETVLHVKPSTDFAWPADGAVDPSIVKVATSAGADKVIARSDSLKETGGLSYTPSAARPVGGGTTAVVADAPLSTAFQGDMTKADTSTLAVQRFLAQSLMISLQDPDKQRSIVVAPQRMPSASQAQTMAQALTALQEGNWAQPQDLSAAAKAKPDPGATTRIPSASAYPSSLRKQELPQSAFEKIEAIQSKLDNFKVILTAPPRVVTPFGRAIDRGISASWRGRASEAETFREEVESYLDVLTEQVKLIEKSDANLSGRSATIPVTVQNNLLQGVEHLVLRLKSSNPTRLKIGDGPYDEKPIAVAGGHSQSVKFTTSANANGPVTVVAQLFTEDGQPYGPEVAFDVKVTEVTPTVMLVIAGGVLLLVLAGFRMYTQRKRAAARRTAEEQEAGPGDEGLNEEPEGTVDTEDTEGSTDGPRDESGTEPEADDPEHPSDPTPDTAPESADPSGTGERVDR

SEQ ID NO: 11835 - protein, 755 aa, Streptomyces avermitilis
MNAPYDGDRGQGAAGSSGHPEGPTPEPGQVSPQPPADMYLQDAYDQDPYRAQDLSAQDPVAEALYDRAAHPPPPPGAYQPQQPLYTQPPTSQYAPDPRVWAQTPAPEPEGPTQYLPYGDDPRTTQFVGVDDLVTQAGEERHEPDAFAHLFRDQQQGGGHPRTESPAVPGPSPEPSAAGQGPVAQAQAPASEQTMQLTPTAAPTAAPAAAPKKGGRASGLLKSSAVMAAGTLVSRLTGFVRSALIVSALGVGLLGDTFQVAYQLPTMIYILTVGGGLNSVFVPQLVRAMKEDDDGGEAFANRLLTLVMVALGALTALAVFAAPLLIRLLSDSVASDPAANQVGITFVRYFLPSIFFMGIHVVMGQVLNARGKFGAMMWTPVLNNIVIIITLGMFIGVYGSAASSGMKVTTIPPEGERLLGVGVLLGLVVQALAMIPYLRETGFRLRLRFDWKGHGLGKAAMLAKWTVLFVLANQAGALVVTQLSTAAGKDSPVDGTGFAAYANAQLIWGLPQAIITVSLMAALLPRLSRSAHEGDAGAVRDDISQGLRTTAVAIVPVSFGFVALGIPMCTLIFGSSGTSEATNMGYMLMAFGLGLIPYSVQYVVLRAFYAYEDTRTPFYNTVIVAAVNAGASALCFFLLPGRWAVVGMAASYGLAYAIGVGVAWNRLGKRLGGDLDGARVLRTYARLGIASLPAALLSGAACYGVGQTLGQGVGGSFVALLGGGAVLLGVFYVAARKMRIEELNSMVGMVRGRLGR

SEQ ID NO: 11836 - protein, 573 aa, Streptomyces avermitilis
VAERSTAAVDVADNSGDEPLTAKADQSTSDGVAQNRERDTDSKEAQGSGGTESPGKASPPELHSGHKLARRYRLEECVTRLDGFSSWRAVDEKLRRAVGVHLLPADHTRARSVLAAARSSALLGDPRFVQVLDAVDENDLVYVVHEWLPDATELTTLLASGPLEVHEAYQMVTQVSQAMAAAHREGLSHLRLNPGAVLRTSSGQWRIRGLAVNAALRGISSDTPQRTDTEAIGALLYAALTQRWPYESDAYGLSGLPKGVGLIAPDQVRAGVHRGLSELAMRALVNDGATASRQEPPCTTPEELVKAISEMPRIRPPEPAFTAPPEYQRTTYQQGTYGRQMPRPGVTQAIPAPPPPLQSRTGKALKWAVSGLLIAALGLGSWQLAEVLMDHRKSDDTGPTHTTDGNDKGGSKTTPLKPITIQDAQEYYPDGKPQHAKDVGLTYDGDSSTYWRTYSYNGGPVLAPFKQGVGIVYDLGSARSLSAASIGLNYGGNHTTVSLYAADSLSSSAPLSSMKKIDGADATTSGRQLKISAAKAVKTRYVLVWITAAPYSGKDEYSGAGYKQAITDVKFTG

SEQ ID NO: 11837 - protein, 237 aa, Streptomyces avermitilis
MADEAAYGTASDQDLLSRHVAGDPEAFGELVRRHRDRLWAVALRTLGDREEAADAVQDALVSAYRAAHTFRGQSAVTTWLHRITVNACLDRARKAASRKTSPVDDTERLEQLLEPHESASAPAERNDLHRELMEALGTLPADQRAALVLVDMQGYPVAEAARILDVPTGTVKSRCARGRARLLPLLTHLRAESGGEAGKKSAGGRNRTQGASVPPAAGPHDAGPSDSAAVKGGGGRA

SEQ ID NO: 11838 - protein, 307 aa, Streptomyces avermitilis
VTSTTDTAGHPEVEEISDLTEGLLPPSRTADVRRHLDDCVLCADVYDSLEEIRGLLGTLPTPARMPDDVAGRIDAALAAEALLDSSAPALDSGVAAPAESATAHVSRETSAATPADRPTGRPRAATGPGRTNVRRRGRRRIALGAVFTAAALGLGTLWVQTLNDDTGKTSGPSALHTDAAHTYSDGKLGSQVADLLSTKKAGGRTGSGKPSMGIESDSTGATGMKPNNTFGTATVKVPTCIERAIPDDHVLLAADKGVYEGVGVYLLVTPDSSDSTRVAAYVVDAACTKQASPAPGKVLLKRSYARS

SEQ ID NO: 11839 - protein, 323 aa, Streptomyces avermitilis
VSDVRNVIIIGSGPAGYTAALYTARASLKPLVFEGAVTAGGALMNTTEVENFPGFQDGIMGPELMDNMRAQAERFGAELVPDDVVAVDLTGEIKTVTDTAGTVHQAKAVIVTTGSQHRKLALPNEDALSGRGVSWCATCDGFFFKGQDIAVIGGGDTAMEEATFLSRFAKSVTIVHRRDTLRASKAMQERAFADPKIKFVWDSEVAEIKGDPKLAGLSLRNLKTGEISELPVTGLFIAIGHDPRTELFKGQLDLDEEGYLKVDAPSTRTNLSGVFGAGDVVDHTYRQAITAAGTGCSAALDAERFLSALAAAEDAAEPEKTTV

SEQ ID NO: 11840 - protein, 110 aa, Streptomyces avermitilis
VAGTLKNVTDDSFEQDVLKSDKPVLVDFWAAWCGPCRQIAPSLEAIASEYGDKIEIVKLNIDENPGTAAKYGVMSIPTLNVYQGGEVAKTIVGAKPKAAIVRDLEDFIAE

SEQ ID NO: 11841 - protein, 205 aa, Streptomyces avermitilis
MGRRLVPLTLDNLPDLPKRCRACVFWELDPVSGEAAVKAGTSALEKEAWISAVLLDWGSCGRVVYVDDVPVGFVLYAPPAYVPRSTAFPTSPVSPDAVQLMTAFIMPGYQGQGLGRVMVQTVAKDLLRRGFKAIEAFGDAHWKETACVLPADHLLAVGFKTVRPHPTYPRLRLELRTTLSWKEDVELALDRLLGAVQKEPALRPL

SEQ ID NO: 11842 - protein, 367 aa, Streptomyces avermitilis
VSERRRGLGRGLGALIPAAPTGEKAAVPAAASGGGSTSPAAVPVLTAERGVAAAKVATLPPVSHETDELSSNGFGEAPAAPVGAHFAELPLDAITPNSRQPREVFDEDALAELVTSIKEVGLLQPVVVRQVGPARYELIMGERRWRACREAGLDAIPAIVRATDDEKLLLDALLENLHRAQLNPLEEAAAYDQLLKDFNCTHDQLADRIGRSRPQVSNTLRLLKLSPAVQRRVAAGVLSAGHARALLSVEDSEEQDRLAHRIVAEGLSVRAVEEIVTLMGSRPQTAPRSKGPRAGTRLSPALSELATRLSDRFETRVKVDLGQKKGKIVVEFASMDDLQRILSSLAPGEGPVLQQVLSEDDSEETES

SEQ ID NO: 11843 - protein, 357 aa, Streptomyces avermitilis
MGGSVHCEPEVEESESLRSDANIAGPMTDPVPGPRTESMGEDVSRETPPPMDDTPIGRAAQLAVEALGRAGEGLPRPEQTRVMVVANQKGGVGKTTTTVNLAASLALHGGRVLVIDLDPQGNASTALGIDHHAEVPSIYDVLIDSKPLSEVVQPVPDVEGLFCAPATIDLAGAEIELVSLVARESRLERAIQAYEQPLDYILIDCPPSLGLLTVNALVAGAEVLIPIQCEYYALEGLGQLLRNVDLVRGHLNPDLHVSTILLTMYDGRTRLASQVADEVRSHFGEEVLRTSIPRSVRISEAPSYGQTVLTYDPGSSGALSYLEAAREIALRGVGVAYDAQHAHLGAENEQSMVEGIQ

SEQ ID NO: 11844 - protein, 246 aa, Streptomyces avermitilis
MRYGRTVPVTEAAELPPAPEQAREVFGDRFADAVRYAELLAEAGVQRGLIGPREVPRLWERHLLNCAVLSEVVPEGVTVCDVGSGAGLPGIPLALVREDLKITLLEPLLRRTNFLTEVVELLGLDHVTVIRGRAEEVMGKIPPVHVVTARAVAPLDRLATWGIPLLRPYGEMLALKGDTAEEELKSAATALSKLGAVETSVLHVGEGVVDPLSTVVRVEVGESPGGVRFAAKRAKAARTGRTRRRR

SEQ ID NO: 11845 - protein, 170 aa, Streptomyces avermitilis
VTEGTTSAATEGGDTLTRLEQEGEIAADYLEGLLDIADLDGDIDMDVEADRAAVSIISDTGGRDLQKLVGRDGEVLEALQELTRLAVNRETGDRSRLMLDIAGYRAKKREELSELGAKAAAEVKSSGEPVKLKPMTPFERKVVHDAVKAAGLRSESEGEEPQRFVVVLPA

SEQ ID NO: 11846 - protein, 428 aa, Streptomyces avermitilis
VDTIASLFSFITIPVSWVIVQFHSVYGKVFGADTGWAWGLSIVSLVILIRICLIPLFVKQIKATRAMQTLQPEMKKIQERYKNDKQRQSEEMMKLYKESGTNPLSSCLPILAQSPFFFALYHVLNGIATGKTIGVIDDQLLASARKAHIFGAPLAAKFTDSADKVTQLGATLMDVRVVTAIMIVLMSASQFYTQRQLMTKNVDTTVKTPFMQQQKMLMYVFPVMFAIFGINFPVGVLVYWLTTNVWTMGQQMYVIRNNPTPGSKAQAAFLERLQKHVLHHGKTRSRGQRAVVKAIVAKGRDRNEFERKFINALTKAGLAAQSDGTIGKGEATAVAETEDGTQTTGGAPRRQQPKRQSKSQRQSGSAKAAGESEPKSTPLSLSKSDEPDDAKPAAKPAGGANKPSTGTRSKAQSGQRKGPQRPKSPSKK

SEQ ID NO: 11847 - protein, 117 aa, Streptomyces avermitilis
MKYPLLALIKLYQWTISPLLGPVCKYYPSCSHYGYQAIDRHGAIKGTALTAWRILRCNPWSLGGVDHVPPRKRPRWHEMLRNAWRARKGGPSAAEPAIEGHIPSSPAAETPSHVQGA

SEQ ID NO: 11848 - protein, 123 aa, Streptomyces avermitilis
VLPTENRLRRREDFATAVRRGRRAGRPLLVVHLRSGATDPHAPGESAPPTRAGFVVSKAVGGAVVRNKVKRRLRHLMRDRVALLPPGSLVVVRALPGAGDADHAQLAQDLDAALQRLLGGGAR

SEQ ID NO: 11849 - protein, 45 aa, Streptomyces avermitilis
VSKRTFQPNNRRRAKTHGFRLRMRTRAGRAILASRRGKGRASLSA

SEQ ID NO: 11850 - protein, 653 aa, Streptomyces avermitilis
VADVPADLAAVWPRVLEQLLGEGRGQGVEVKDEHWIKRCQPLALVADTALLAVPNEFAKGVLEGRLAPIVSETLSRECGRPIRIAITVDDSAGEPPASASPAPPRYEEPELPSGPGQGRDPYESRGREGYEGYGRHRADDHRQGHNDRHQGGPGDQLPPSRGDQLPTARPAYPDYQRPEPGAWPRPSQDDYGWQQQRLGFPERDPYASPSQDYRPQSMDRPSYDQDRPSYDHDRPSYDHDRPSYEQQRADYDQQRSDYDKRPDRRNIPDSSPGSGHVHRGGPVGSALPASSGAPGPLAAQPAPATGPGEPTARLNPKYLFDTFVIGASNRFAHAAAVAVAEAPAKAYNPLFIYGESGLGKTHLLHAIGHYARSLYPGTRVRYVSSEEFTNEFINSIRDGKGDSFRKRYREMDILLVDDIQFLADKESTQEEFFHTFNTLHNANKQIVLSSDRPPKQLVTLEDRLRNRFEWGLITDVQPPELETRIAILRKKAVQEQLNAPPEVLEFIASRISRNIRELEGALIRVTAFASLNRQPVDLGLTEIVLKDLIPGGEDSAPEITAPAIMAATADYFGLTVEDLCGTSRGRALVTARQIAMYLCRELTDLSLPKIGAQFGGRDHTTVMHADRKIRALMAERRSIYNQVTELTNRIKNG

SEQ ID NO: 11851 - protein, 376 aa, Streptomyces avermitilis
VKIRVERDVLAEAVAWAARSLPARPPAPVLAGLLLRAEDGALSLSSFDYEVSARVSVEAEVEEDGTVLVSGRLLADICRALPNRPVEISTDGVRATVVCGSSRFTLHTLPVEEYPALPQMPNATGTVPGEVFASAAAQVAIAAGRDDTLPVLTGVRIEIEGDTVTLASTDRYRFAVREFLWKPENPDASAVALVPAKTLLDTAKALTSGDSVTLALSGSGSGEGLIGFEGAGRRTTTRLLEGDLPKYRTLFPTEFNSIAVIETAPFVEAVKRVALVAERNTPVRLSFEQGVLILEAGSSDDAQAVERVDAQLDGDDISIAFNPTFLLDGLSAIDSPVAQLSFTTSTKPALLSGKPAVDAEADEAYKYLIMPVRLSG

SEQ ID NO: 11852 - protein, 291 aa, Streptomyces avermitilis
MELGLVGLGKMGGNMRERIRRAGHTVIGYDRNPDVADVHSLEELVGKLKGPRVVWVMVPAGAATQSTVDELGELLEPGDIVVDGGNSRWTDDEKHAEELAAKGIGFVDCGVSGGVWGLQNGYALMYGGDAENIAKVQPIFDALKPEGDFGAVHAGKVGAGHFSKMVHNGIEYAMMQAYAEGWELLEKVDSVTDVREVFRSWQEGTVIRSWLLDLAVNALDGDEHLEKLRGYAEDSGEGRWTVEAAIDNAVPLPAITASLFARFASRQDDSPQMKMIAALRNQFGGHAVEKK

SEQ ID NO: 11853 - protein, 373 aa, Streptomyces avermitilis
MHVTHLSLADFRSYARVEVPLDPGVTAFVGPNGQGKTNLVEAVGYLATLGSHRVSSDAPLVRMGAERAIIRAQVRQDERRQLVELELNPGKANRARINRSSQVRPRDVLGIVRTVLFAPEDLALIKGDPGERRRFLDELITARSPRMAGVRSDYERVLKQRNTLLKTAALARRHGGRSMDLSTLDVWDQHLARAGAELLAQRLDLIAALQPLADKAYEQLAPGGGPIALEYKPSAPGEAHTRDALYEQLMAALAEARKQEIERGVTLVGPQRDELLLKLGQLPAKGYASHGESWSYALALRLASYDLLRAEGNEPVLVLDDVFAELDTRRRERLAELVAPGEQVLVTAAVDDDVPGVLAGTRYTVSEGTVERV

SEQ ID NO: 11854 - protein, 181 aa, Streptomyces avermitilis
MSDTPAQTPEPSKKTPEPSGVDLARVALRAAKEQARARGDAAQQKRQARRGGLRSGARADGRDPMALGAAINRLLTERGWETPAAVGGVMGRWPQIVGEDLAKHCVPQRYDEDERVLTVQCDSTAWATQLRLLAPQLVARLNEDLGHGTVRLLKVQGPGGPARRYGPLRAPGSTGPGDTYG

SEQ ID NO: 11855 - protein, 692 aa, Streptomyces avermitilis
VADSGNPNENIPSTDAGNGEANTSIGEVAASNGEVTASYDASAITVLEGLDAVRKRPGMYIGSTGERGLHHLVYEVVDNSVDEALAGHADTIDITILADGGVRVIDNGRGIPVGIVPSEGKPALEVVLTVLHAGGKFGGGGYAVSGGLHGVGVSVVNALSSKVSVEVKTDGFRWTQEYKMGVPTAPLSQNEATDETGTSVTFWADADIFETTEYSFETLSRRFQEMAFLNKGLTIKLTDERESAKATAGADEAGADEKDEVKTVTYHYEGGIVDFVKYLNSRKGDAVHPTVIDLEAEDRDKSLSLEVAMQWNSGYTEGVYSFANIIHTHEGGTHEEGFRAALTSLINKYARDKKLLREKDDNLTGDDIREGLTAIISVKLSEPQFEGQTKTKLGNTEAKTFVQKAVYEHLNDWLDRNPNEAADIIRKSIQAATARVAARKARDLTRRKGLLESASLPGKLSDCQSNDPTKCEIFIVEGDSAGGSAKSGRNPQYQAILPIRGKILNVEKARIDKILQNQEIQALISAFGTGVHEDFDIEKLRYHKIILMADADVDGQHINTLLLTFLFRFMRPLVEAGHVFLSRPPLYKLKWGRDDFEYAYSDRERDALIELGRQAGKRVREDSIQRFKGLGEMNAEELRITTMDQEHRVLGQVTLDDAAQADDLFSVLMGEDVEARRAFIQRNAKDVRFLDI

SEQ ID NO: 11856 - protein, 864 aa, Streptomyces avermitilis
MTDENTPSTPEEEGEIALRVEPVGLETEMQRSYLDYAMSVIVSRALPDVRDGLKPVHRRVLYAMYDGGYRPEKGFYKCARVVGDVMGNYHPHGDSSIYDALVRLAQPWSMRMPLVDSNGNFGSPGNDPAAAMRYTECKMMPLSMEMVRDIDEETVDFTDNYDGRSQEPTVLPARFPNLLINGSAGIAVGMATNIPPHNLREVASGAQWYLENPEASHEELLDALIERIKGPDFPSGALVVGRKGIEEAYRTGRGSITMRAVVEVEEIQNRQCLVVTELPYQVNPDNLAQKIADLVKDGKVGGIADVRDETSSRTGQRLVIVLKRDAVAKVVLNNLYKHTDLQTNFGANMLALVDGVPRTLSLDAFIRHWVTHQIEVIVRRTKFRLRKAEERAHILRGLLKALDAIDEVIALIRRSDTVEIAREGLMGLLEIDEIQANAILEMQLRRLAALERQKIIQEHDELQAKITEYNAILASPVRQRGIISEELAAIVEKYGDDRRSKLVPFDGDMSIEDLIAEEDIVVTITRGGYIKRTKTEDYRSQKRGGKGVRGTKLKQDDIVDHFFVSTTHHWLLFFTNKGRVYRAKAYELPDAGRDARGQHVANLLAFQPDEAIAEILAIRDYEAVPYLVLATKGGLVKKTPLKDYDSPRSGGVIAINLRETEDGSDDELIGAELVSAEDDLLLISKKAQSIRFTATDEALRPMGRATSGVKGMSFREGDELLSMNVVRPGTFVFTATDGGYAKRTAVDEYRVQGRGGLGIKAAKIVEDRGSLVGALVVEETDEILAITLSGGVIRTRVNEVRETGRDTMGVQLINLGKRDAVVGIARNAEAGREAEEVDGGDAVDETTEGIEAAGTDEGEQSSDE

SEQ ID NO: 11857 - protein, 204 aa, Streptomyces avermitilis
VTDTRGPQAQQPKAGAGPAAPGAASAGAPAQAPASAATAAGSPLPGERQPQPAGPYHPPQAYQPAPAGAVRRPRTGARTAPRTRKARLRVAKADPWSVMKVSFLLSIALGICTIVASAVLWMVMNAMGVFSTVGGTISEATGSNEANGFDLQAYLSLPHVLTFTTIIAVIDVVLATALATLGAFIYNLSAATVGGIELTLAEDE

SEQ ID NO: 11858 - protein, 115 aa, Streptomyces avermitilis
MAQNKVMKLWTAIVTAFLALCTTLGLITTTAAAAVPQSGTTRNGNATVTAPAMLSHGMWSYARSLPPTMKQRIRAEAHGSSPSCRHRPTSDDTATDTAALRAQETPAEPDAPLRH

SEQ ID NO: 11859 - protein, 501 aa, Streptomyces avermitilis
MGRRTGWWRTEARRAAGWHGVLRRGRALAAAAGAALCVTVALPQTATAAGTPTPYAFAEDARTVKGATGTTDAVRLEPGGTYRSAVRDGGKLYYRLELDATADAYVSVTAVPGTAATVTSSDGLKVSVQDADSHTCSTGAAHFGATQSPHPIAAWASREVGPDTYLCKQAGTYYVVVERRTTPGSAPGDWDLELDYVSEPALKKAAGSGATSAPEAWNSASPQALVGDATRRAGGAGFASAAALGQGVWKDAVRPGQTLFYKVPVDWGQQLYATAETGSSTGGDGFVGTALTMSLYNPVRGYVDDVGSGYSGDQTSAALDPLPPVAYDNRHAVQNRVSGMRFAGWYYLAVHLGAPVADKFGKGPFGLTLRVRVSGTAGSGPSYAGQAEPSGVFEVTRQDREEAAAGAGGSTANVPGGTTGSASGGATGGGTGAAETGADGARTGDDGTMTLVAVGGIGTGSLLVLALVVWTAVARRRAVSDGAAMGAAPVVRGEYGPPRAW

SEQ ID NO: 11860 - protein, 564 aa, Streptomyces avermitilis
MGEVFAGRYELVDPIGRGGVGAVWRAWDHRRRRYVAAKVLQQSDAHALLRFVREQAMRIDHPHVLAPASWAADDDKVLFTMDLVAGGSLVHLIGDYGPLPPSFVCTLLDQLLSGLTAVHAEGVVHRDIKPANVLLEATGTGRPRLRLSDFGIAMRLGEPRLTETNYVVGTPGYLAPEQLMGDEPDFPADLFAVGLVALYLLEGAKPDARALIEYFLANGTPAAPRGIPEPLWQVVAVLLQPDPAARFRTATGARKALAAAAELLPEPGPDDELVEIFDQLGPLPPGFGTDGPLKRAPGVTAAHAVPQRPGRDATGSTPSGDDSSSGPRPERPNQRPNRRHHDPGAASGAASGAAPGTGSTGAVRPAEDCGEVRPTTGSSHIPPEPDSGPPQPGPPTPLPPPPNSAPLPPQPASAPGSAPGPVQMPPLPDATPSRSFTMSDTGSFHLPPPRPSTPVRPQPLPERPPTPPASVALPSPAYAPHLEPTRVPSPRPSAAPAASVQHHAYASAGAHTAPAAQVHTRPQAISRRRRRRPKRPGPPAKVAVPVLLLALACFAVGFWALAQL

SEQ ID NO: 11861 - protein, 182 aa, Streptomyces avermitilis
MDAAQQEATARARELQRNWYGEPLGALFRRLIEDLGLNQARLAGVLGLSAPMLSQLMSGQRAKIGNPAVVQRVQLLQDLAGQVADGSVSAAEATERMDEIKKSQGGSVLSNTTQSTSSSGAPTVKRVVREIQSLLRSVAAAGDIIDAADTLAPSHPELAEFLRVYGAGRTSDAVAHYQSHQN

SEQ ID NO: 11862 - protein, 233 aa, Streptomyces avermitilis
VTRIESVRAATGSAKDSVLHAAEVVAPYADTAKDRASHYAQEARVRLAPKVSQAADQARVQYDVHLAPRLEQARAHVPPKVDQAAHDAAVLTRKAARQAADYSRPKIEQAVAAAGPVREEAAARSVAALAALRGQVSPQEIQKLVRKHERRARVGRVAKGLAILGILAGGAFAAWKWWDKQANPDWLVEPPAATEVPASDRLASVDGTGQSVLDPEVQVKEAEEDAADRDEHR

SEQ ID NO: 11863 - protein, 186 aa, Streptomyces avermitilis
VAEQLYATLKTSQGDIAVRLLPNHAPKTVRNFVELATGEREWTNPATGEKSKDKLYDGTVFHRVISGFMIQGGDPLGNGTGDPGYQFQDEFHPDLRFDKPYLLAMANAGPGTNGSQFFITVAPTAWLNRKHTIFGEVTDVASQKVVDAIAGTRTNPGTKRPVSDIVIESVVIETREGRGAVEFRKG

SEQ ID NO: 11864 - protein, 298 aa, Streptomyces avermitilis
MDDPMNQKPQNAQGVPTCYRHPDREAGVRCTRCERPICPECMVDASVGFQCPECVRGGSGTGHAPTATQPRTIAGGTVAADPRLITKILIGLNLAVFLVQLSVGDRFTERFELLGRAYVPLLGSLQGVAEGQSYRLLTAMFLHDPHSYVHILFNMLSLWWIGGPLEAALGRIRYLTLYFVSGLAGSGLTYLIAAPNQPSLGASGAIFGLFGATAVLMRRLNYDMRPVIALLVINLIFTFGWSNIAWQAHIGGLVGGVVVGYAMVHAPRDRRTLIQFGVSGLVLAAVVLMTVLRTIQLT

SEQ ID NO: 11865 - protein, 84 aa, Streptomyces avermitilis
VPKSRIRKKADYTPPPSKQATNIKLGSRGWVAPVMLAMFLIGLAWIVVFYVTDGSLPIDALDNWNIVVGFGFIAAGFGVSTQWK

SEQ ID NO: 11866 - protein, 270 aa, Streptomyces avermitilis
LSNTADSHGTGSGSPETGSGSDSEAARPRRFPPVRVLTVAVFALAGLIFFTSFNTAKGTNIRTDASMLKLSDLIQERSHKNGRLDESNAALRDDVEALAQRGGGNTKAEEEKLAALEKSAGTQKLKGKAVTVTLNDAPPNATAKLPGYPEPQPDYLVIHQQDLQAVVNALWQGGAEGIKVMDQRLISTSAVRCVGNTLILQGRVYSPPYKITAIGDPDKLQESLAASQAIQNYMVYVNVYGLGWKVTENGTVTLPGYSGTVDLHYAKPVE

SEQ ID NO: 11867 - protein, 230 aa, Streptomyces avermitilis
VRVIVRTVSELCITLGTLIVLFVVYVLFWTGVKADSAMGHQVDVLQEQWSKGTVRPTAAPGASARTSPEKPAPYTYGKPFAVMYIPRLGFTWNKPVLEGTGTEVLKKGLGHYANTARLGQKGNFAVAGHRRTYGDPFKDFPKLRHGDEVVLTDGTTWFTYVIDTGPYKTVPTDVEVIDPVPRKSGYEREGRYLTLTTCEPEWGHSHRLIVWAHLDSTQPVEAGKPEALRR

SEQ ID NO: 11868 - protein, 62 aa, Streptomyces avermitilis
VRYGDGRDGMYGWIWRHLPGNLWVRALTSLVLVLAVVYVLFQYVFPWAEPLLPFNDVTVDGQ

SEQ ID NO: 11869 - protein, 212 aa, Streptomyces avermitilis
VSTRILVVDNYDSFVFNLVQYLYQLGAECEVLRNDEVSTAHAQDGFAGVLLSPGPGAPEQAGVCIDMVRHCAATGVPVFGVCLGMQSMQVAYGGVVDRAPELLHGKTSLVEHTGKGVFSGLPSPFTATRYHSLAAEPRTVPDELEVTARTHDGIIMGLRHRELPVEGVQFHPESVLTEHGHRMLANWLVECGDTDAVARSAGLAPVVGRATA

SEQ ID NO: 11870 - protein, 449 aa, Streptomyces avermitilis
VTALRPERESGAYGDAGEHGSSYGQQPYEAAGAFEVPGAFEQRGAFAAAVEQLSDPLNDPLPGAGPAGHPAYEGGQGAYAAPAAPVQEAGYYPSYEEPVAPPPYTGQVPAPVPQPYPGPVAAPVPPPHDQPVAMAPPLDDRTVALRAADVAEARRMADGGASGAGSAPISAPGGRAARRKAARRQGRHGGAQEAPEGPSGASDAPGAADGAPRSRMEARRAARASKPGAGVIASRMVGEVFITTGVLMLLFVTYQLWWSNVRAHQQAGSETNHLQQDWASGKRKPGAFEPGQGFAILDIPKLDVVAPIAEGTSKTKVLDRGMVGHYAEGATKTAMPDAKTGNFGLAGHRNTHGEPFRYINRLKPGDAIVVETQDTYFVYKMTSILPVTPPSNTSVLNPIPPGSGLTKPGRYITLTTCTPEFTSKYRMIVWGKMVEERPRSKGKPDALVE

SEQ ID NO: 11871 - protein, 246 aa, Streptomyces avermitilis
VAATTDQEERAEAGVPEPGHRLRGRIAMAVSVFGELLITAGLVLGLFVVYSLWWTNVLADRKANQQADKVRHEWETSDTGPGALDTKDGIGFLHVPAMNNGEVLVRKGTSTQVLNNGVAGYYTDPVKAMLPMTGKNGNFTLAAHRDGHGAKFHNIDKVRKGDPVVFETKDDWYVYKVFAILPETSKYNVKVVAGLPKQAGVTKPGRYITLTTCTPVYTSEYRYIVWGKLVRVDKVNAKRTPPRELG

SEQ ID NO: 11872 - protein, 667 aa, Streptomyces avermitilis
MEEPRRLGGRYELGHVLGRGGMAEVHLAHDTRLGRTVAVKTLRADLARDPSFQARFRREAQSAASLNHPAIVAVYDTGEDYIEGISIPYIVMEYVDGSTLRELLHSGRKLLPERTLEMTIGILQALEYSHRAGIVHRDIKPANVMLTRNGQVKVMDFGIARAMGDSGMTMTQTAAVIGTAQYLSPEQAKGEQVDARSDLYSTGCLLYELLTVRPPFVGDSPVAVAYQHVREEPQPPSVFDPEITPEMDAIVLKALTKDPDYRYQSADEMRIDIEACLDGQPVAATAAMGSVGYNGYGDDQATTALRADAGATTMLPPMNPDDGGFGFDDRPDRRRQRDQKKSNTSTILLVVAGALVLIGAILIGKWIFDGDRAANDTVPAPNFVGLTLADAKQQAVNGDVKLSITKKPCEDQAKGNVCSQSPDAKTKVKKNSLVNLVLSTGAPKIAVPDVTGLTFGKAKSQLEDKGFRVEKKTEVSDQTPGVVTAQDPSGDSERQKGTTITLTVAAEAQKVTVPDVTGKSCDEAKQQMQANNLTGNCTEVDTSDASQAGKVIQTSPTAGTEVKKNSAVDIQVGKAPQQVAVPNLGGQSLKDAKKALQDAGLNVGNITGSQDDNAIVIASDPQAGTQVAQGTAVNLTAAGGNNNNGGNNNGGTTFFGGATGTAFRTED

SEQ ID NO: 11873 - protein, 494 aa, Streptomyces avermitilis
VNKPLRRIAIFCGLLVLALLIRDNWIQYVQADTLKSDTKNRRVAIERYATPRGDIIVDGKSITGSAKGTGSGYNDFEYKRTYKDGAMWAPITGYASQAFGATQLESIEDGILTGNDDRLFFRNTLDMLTGKKKQGGNVVTTLNAAAQKAAYQGLKARGKGAAVAIDPETGAILALASTPSYDPSTFAGNSTKTDGEAWTKLQKKNNPNEPMLNRALRDTYPPGSTFKVVTAAAALENGLYNGADQKTDSPLPYTLPNTRTELKNEGNIPCKNATMRVALQYSCNTVFGKIGADLGKEKMLAQAKKFGFNEEQFTPVRASASNFPEKMDKPQTALSSIGQFETATTPLQMAMVASAVANDGTLMKPYMVDKLQAPSLDVLSQTDPQEMSKPLSEKNAQILQSMMETVVKQGTGTNAQISGVTVGGKTGTAQHGLNNSENPYAWFISYAKLSDGSSPVAVAVVVEDENANRDDISGGGLAAPIARSVMKAVIDSKK

SEQ ID NO: 11874 - protein, 482 aa, Streptomyces avermitilis
MSSSTNTPTHHTSTIGSIGAPSRRNTELALLVFAVVIPVFAYANVGLAIDDKMPAGLLSYGLGLGLLAGVGHLGVRKFAPYADPLLLPLATLLNGLGLVMIWRLDQSKLLQSLPNFAQAAPRQLMYTALGIGLFVAVLIFLKDHRVLQRYTYISMFGALLLLLLPLVPGLGANIYGAKIWISIPGLGTLQPGEFAKIILAVFFAGYLMVKRDALALASRRFMGLYLPRGRDLGPILVVWFVSILILVFETDLGTSLLFFGMFVIMLYVATERTSWIVFGLLMSAVGAVGVASFEPHIQTRVQAWLNPLHEYKLSQAGTHDGILHSEQAMQALWAFGSGGTLGTGWGQGHSELIRFAANSDFILASFGEELGLAGIMAILIIYGLIVERGIRTALAARDPFGKLLAVGLSGGFALQVFVVAGGVMGLIPLTGMTMPFVAYGGSSVIANWALMGILIRISDTARRPAPTPAPSPDAEMTQVVRP

SEQ ID NO: 11875 - protein, 514 aa, Streptomyces avermitilis
MSLSLRFAAGSHKGMIREGNEDSGYAGPRLLAIADGMGGQAAGEVASSEVISTIVALDDDVPGSDILTSLGTAVQRANDQLRMMVEEDPQLEGMGTTLTALLWTGQRLGLVHVGDSRAYLLRDGVLTQITQDHTWVQRLVDEGRITEEEATTHPQRSLLMRALGSGDHVEPDLSIREVRAGDRYLICSDGLSGVVSHQTMEDTLASYQGPQETVQELIQLALRGGGPDNITVIVADVLDIDAGDTLAVQLSDTPVVVGAVAENQNQLHDNGAMQTPAGRASHLGRQLPGQGGGGGEFGPPGSGDTTGYVPAGSFGSYSDEDFVKPRTGLKWLKRSFYIVLALAVIGGGTYGGYRWTQTQYYVGASGEHVALYRGISQDLAWVSLSKVQKDHPEIELKYLPPYQQKQVKATIAEGGLKDAESKVSELAVQASACKKDALRRASESQNNAKTGEGEAGGTTGTTKTSLTSKATSSPTPNPSTSAPSSSKSKTAPTPTPGPSLSDEEQKLVSLCGKQ

SEQ ID NO: 11876 - protein, 175 aa, Streptomyces avermitilis
MSELTLTVMRLGFLAVLWLFVIVAVQVIRSDLFGTRVTQRGSRRDANRQQPAAARQAAPPQQRQQAAPPSGGGRQRRGAPTKLVVSEGTLTGTTVALQGQTITLGRAHDSTIVLDDDYASSRHARIYPDRDGQWIVEDLGSTNGTYLDRTRLTTPTPISPGAPIRIGKTVIELRK

SEQ ID NO: 11877 - protein, 285 aa, Streptomyces avermitilis
MGVLKKFEQRLEGLVNGTFAKVFKSEVQPVEIAGALQRECDNNATIWNRDRTVVPNDFIVELSTPDFERLSPYSGQLGDELAGMVRDYAKQQRYTFMGPIKVHLEKADDLDTGLYRVRSRTLASTSNQQAPERAPAGPPAGRGGAMAGGYGYPPAAPAGAPPMPSAPPPGGRPGPAPTAHRPGAPAAPQSGGRIRHWIEVNGTRHQISGPTLVLGRSTEADVRIDDPGVSRRHCEIRTGTPSTIQDLGSTNGIVVDGQHTTRATLRDGSRIVVGSTTIIYRQAEG

SEQ ID NO: 11878 - protein, 217 aa, Streptomyces avermitilis
MATLLHIDSSVFPSAASASRAVAETFRTAWQEQHPDGTVIYRDLSANPVPHITADAHTAGFADPATHTPGQAAAFAEREKLIAELEQADAVLIGAPMYNYAIPSTLKAWLDNVILMGRTAANENSKVTGTPVTVIASRGGSYAPGTPREPYEYVQNYLKAVLSDALGLELEFIVPELTMAAHNPAMSELVPLAEASRAKAHEDAAAKAKELADRFAA

SEQ ID NO: 11879 - protein, 135 aa, Streptomyces avermitilis
VGRQYAGGMAVQESHEQQAHQQPCARVDDGITRVFQLLGKRWTGLIVAVLLERPVHFAELRRAIPGISERMLSDRLTELATAGLVVREVDEGPPLRVAYRLTTAGAALEASLGELRTWAGVYLAEDGRCPEEFRT

SEQ ID NO: 11880 - protein, 488 aa, Streptomyces avermitilis
VTEVGSEAVGSETVGSEAGAAAVAARAARIPPVRGFASRTAQSGSPKEEGKALRRRVPRAAHAELALDVDRPDAVTAVEESNRGRLPELTPIRVGRMAATPFAFLRGAAGLMAYDLARTPMTGIAAQICGDAHAANFGLYGDARGELVIDLNDFDETAHGPWEWDLKRLATSLVLAGRAAGADEDSCRKAAHDTAGAYRRTMRLLAKLPVLEAWNAIADEELVSHADAHDLLGTLERVSEKARANTSGRFAAKSTEPVEGGGRRFVDASPVLRRVPDAEAAAVATALEEYLTTVSEDRLPLLARYAVHDVAFRVVGTGSVGTRSYVVLLLDHRGEPLVLQVKEARPSALVPHLSTAGHAVADVAHEGRRVVLGQKRMQVVSDILLGWTTVDGRHFQVRQFRNRKGSVDPGALAADQIDDYGRMTGALLARAHAHSADPRLIAGYCGKNEELDEAMAAFAVAYADCTEKDHAKLVEAVRGGRIAAEMGV

SEQ ID NO: 11881 - protein, 279 aa, Streptomyces avermitilis
VAGDGAGEGAPGGAAQGEPRPEERLERAVRVAEQALIEFEIAVETFRVEVENFSRLHHQKLGPMYARLDELDAQIAEARAARTGDPEDIRKADEARARVMPMPGVEELFHGWMDSDGLFPEAAAMLTEQPVRPPQRVRPSEEARKLYRELVRKAHPDLAQDDAERERRDEFISRVNAAYGRGDEALLRELSDEWAAGPVPAEWKPSRSEELYARLEWLAQRKEMLTFVARELEESAIGAMLKIAPDDPDRLLEEIAEQLLAQVAARETELAELAELEEG

SEQ ID NO: 11882 - protein, 109 aa, Streptomyces avermitilis
VPTVGVADLADGDFLLDVREDDEWEAGHAEGALHIPISDFVARYGELTEAAPQDGRVHVICRSGGRSAQVTMYLAQQGIDAVNVDGGMQVWAAAGRPVVDDKGQPGFVL

SEQ ID NO: 11883 - protein, 379 aa, Streptomyces avermitilis
VDFTFSEEQQAAVEAAKAVFAGVAPDGVPSPSLTAGSVADDFDRALWARLADADLLSLPLDAEYGGVGLDAIALCLVLRESAKVLARVPLLESTAAAMAVQSYGSPELKGQLLAQAGRGELVLTVAANGRTGHDPAELAVTARQDGAASWVLDGVQTAVPWAHNADFVVVPAHTHDTGRAVLALVPRVHEGVVLAEQISTTGERLGELRLESVRVSERYVLGADGAWEWLRELLATGTCALALGLGEGVLGMTSAYTSKREQFGFPVATFQAVAVQAADRYIDLRAMEATLWQAAWRISTGAGGALPAAGDVAVAKIWASEGVRRVVQTAQHLHGGFGADTDYPLHRYHAWAKHLELSLGPAPAHEEALGDLLAAHPLG

SEQ ID NO: 11884 - protein, 354 aa, Streptomyces avermitilis
MARFHPLPVAAVDRLTDDSVALTFAVPPALREEYRHAAGQHLALRRTADGTEIRRTYSICSPAPAAADEGPRTLRVGVRLVEGGSFSTYALKEIAAGDEVEVMTPAGRFTLEPAPGLYAAVVGGSGITPVLSIVTTLLAREPGARFCLIRSDRTSASTMFLEEVADLKDRFPERFQLVTVLSREEQQAGLPSGRLDQERLTELLPALLPVNRVAGWFLCGPFGLVQGAERALRGLGVARSRVHEEIFHVDGGAATVPAGPAPTHSTVTARLDGRGGTWPVQDGESLLEAVLRNRPDAPYACKGGVCGTCRAFLVSGEIRMDRNFALEPEETEAGYVLACQSHPATEKVELDFDR

SEQ ID NO: 11885 - protein, 170 aa, Streptomyces avermitilis
VPDPELPVITLEELGVLRAVHVRGTDSVEVELTPTYTGCPAIEAMSTDIERVLREHGMRKVSVHTVLSPAWSTDDISAEGRRKLREFGIAPPRVRQASGPKEPVAVELGPTRTSRPVAGPPELAPVPDPVCCPHCGSADTELLSRFSSTACKALRRCLACREPFDHFKEL

SEQ ID NO: 11886 - protein, 239 aa, Streptomyces avermitilis
VTVTVHTAAALALGDDALVLSHRLGEWAGHAPVLEEEVALANIALDLLGQARVLLSMAGDEDELAYLREERAFRNLQLVEQPNGDFAHTIARQLYFSTYQRLLYGQLAAGSGEFAGLAAKAVKEVAYHQDHAEQWTLRLGDGTEVSHERMRQACGALWRFTGEMLQPVEGVDVDWDGMKSAWLESVGDVLRRATLELPEGPQYGAWTAGAGRQGLHTEPFGRMLAEMQHLHRSHPGASW

SEQ ID NO: 11887 - protein, 95 aa, Streptomyces avermitilis
MTTNEWPLWEVFVRSRRGLSHTHAGSLHAPDAELALRNARDLYTRRGEGVSIWVVPSTAVTASSPDEKDPFFEPSADKPYRHPTFYEIPEGVKHL

SEQ ID NO: 11888 - protein, 339 aa, Streptomyces avermitilis
MATAAAHQTARAQADGTAGAGAPLEESARATAYEAAFDAAVAADERIEPRDWMPDAYRSTLVRQIAQHAHSEIIGMQPEANWITRAPSLRRKAILMAKVQDEAGHGLYLYSAAETLGTGRDELLDKLHSGRQKYSSIFNYPTLTWADVGAIGWLVDGAAITNQVPLCRCSYGPYARAMVRVCKEESFHQRQGYELLLALSRGTAEQHAMAQDAVDRWWWPSLMMFGPPDDESAHSAQSMAWKIKRHSNDELRQRFVDICVPQAQSLGLTLPDPEPRWNEEREHHDFGPIDWTEFREVLKGNGPCNEQRITQRKRAHDEGAWVRDAAAAYAGKHTTAGKA

SEQ ID NO: 11889 - protein, 343 aa, Streptomyces avermitilis
VLRVGDVPPRGRRRKREAGRGPRPSASDVTGIGKLGRRGGMDVYDEGSDPRQESGGPDGPVPDRPDGSAQNAPDDPSPSGPSGPGGREPASADRGAPVMPATSVAPVTPAGEPGPHQVTALPDAYAVPRTGIAALSLRYQIAAALALAVVAVAGCVHVAMVFLHVAPSNTVTKQHGRAIDDWIYPEFEQNWKLFAPNPLQQNIAVQVRAEVRTEDGSHRTTGWYDLSALDGAAIDGNLLPSHTQQNELRRAWDFYLATHDNENRPAGMRGDLSQRYLRSIVGLRLEREHAAGRGEAVERVQVRSSTTNVQPPRWSNEKVSDKPMYRVLPWWPVPTDSGTGANA

SEQ ID NO: 11890 - protein, 409 aa, Streptomyces avermitilis
MNRFALLISRGITRVTEAALGPYQSAVIRIGFAATWLLFLLREFPHRQEMYGPDAPWAWGLAQQLIANNHAFTALMWSDSQVWFEIVYALAVVSSALLLLGWRTRAMSVLFMIGVLSLQNRSIFMGDGGDNVIHLMSIYLVFTRCGQVWSLDARRARRTDDARARGELPRATGADRVGPVLWAVLGLALAVATGAGRLSGGWLAVFWGLWAVQGLWWLVGRRARSAEPRILLDIVANTVHNAAMFVIMAEACLIYSTAGWYKIQGSRWQDGTAVYYPLHLDYFSPWPALSDLLASHGIMVMLVTYGTVMAQVAFPFTLFNRRVKNVLLGVMMVEHAAIAVILGLPFFSLAMIAADAVFLPTPFLRRLGGWAARARRELSSRRGGTLPGPRKQEPRTEETTEHTHVGFTA

SEQ ID NO: 11891 - protein, 249 aa, Streptomyces avermitilis
MNDPVRAWHRLADGSVLLDGFHALKHAVRFQARVPVAVTTDRRAALALADELAPDVRETLDALLAEVPEETLKALVPRPHPTAVAALAVRPSRAANLEALARTPRSAPVVVLDNPRNLGNAGAVIRLAAGFGATGVVTTGTLDPWHPTVVRGGAGLHFATAVERLTVDELPPGPVFALDPEGDDIRGLKLPDDAVLAFGSERTGLSAELRARTDHLVALPMRPQVSSYNLATSVAMTLFHWSATGGAPA

SEQ ID NO: 11892 - protein, 563 aa, Streptomyces avermitilis
MAAELTAHELIAQHRPTLDQALEAIRTRAYWSPHPEHPKAYGESGSLGAAEGKAAFDALLGTRLDLGQPGTDDWVGAEVSPYGIDLGVTYPHADIDVLLPAMRAGQRAWRDAGAEIRAMVCLEILKRISDRTHEFAHAVMHTSGQAFMMAFQAGGPHAQDRGLEAVAYAYVEQVRTPDAAEWTKPQGKRDPLALTKQFTPVPRGIALVIGCNTFPTWNGYPGLFASLATGNAVLVKPHPRAVLPLALTVRVAREVLAEAGFDPNLVALAAERPDEGIAKALAVRPEIRIIDYTGSTAFGDWLETNARQAQVYTEKAGVNTVIVESTDNYKGMLSNLAFSLSLYSGQMCTTPQNLLIPRDGIRTEEGPKSYDEVVADLARSVGGLLGDDARANALLGAVVNPDVKARLEAAAGLGEVALASREIVNPEFPDATVRTPVIVKLDGAKPDDEAAYMSECFGPVSFAVAVDSAADAVELLRRTIRDKGAMTVGAYTTSDEVTEAVQETCLEECAQLSLNLTGGVYVNQTAAFSDFHGSGGNPAANAALCDGAFVANRFRVVEVRREA

SEQ ID NO: 11893 - protein, 504 aa, Streptomyces avermitilis
MTALDLSSPVAVVGTGTMGQGIAQVALVAGHPVRLYDAVPGRAQEAADAIGARLDRLVEKDRLAAADRDAARARLRPAADLADLADCFLVVEAVLERLDVKQQLLRELEDVVEDDCLLATNTSSLSVTAIGGALRNPGRFVGLHFFNPAPLLPLVEVVSGFATDVTSATRAYETARAWGKTPVACADTPGFIVNRIARPFYAEAFAVYEAQAADPATIDAILRESGGFRMGAFELTDLIGQDVNESVTHSVWQAFFQDVRFTPSLAQRRLVESGRHGRKTGQGWYDYGEAAERPEPHTAEKAQAPAYVVVEGDLGPASELLALIREAGIQIREDEEDHGTRLVLPSGGQLVLADGQTSVEFRDVVYFDLALDYRRATRIALSASQDTAPATVAEATGLFQALGKDVSVIGDVPGMIVARTVARIVDLAHDAVAKGVATEEDIDTAMRLGVNYPLGPFEWCRRLGRVWAHDLLEELSLREPSGRYAPSLALYRHGHAADKREGTS

SEQ ID NO: 11894 - protein, 196 aa, Streptomyces avermitilis
MTTAKRDTYTPETLLSVAVQVFIERGYDGTSMEHLSKAAGISKSSIYHHVAGKEELLSRAVSRALDGLFGILGEEHARVGRAVERLEYVVRRMVEVLTAELPYVTLLLRVRGNTDTERWALERRRDFDHRVAELLKAAADDGDVRGDVEVRLATRLVFGMINSIVEWYRPDGRGMGEREVADAVVRLVFSGLRSEA

SEQ ID NO: 11895 - protein, 135 aa, Streptomyces avermitilis
MLQADGRASIRSVAERAHVSRANAYARINRLIDDGVIRGFGARVDHERAGQGTSAYITLKIVQNSWRTVREQLRLLPGASHIALVGGDFDVLLLVHTPDNKALRELVLTRLQAIPEVLSTRTLLVFEEEDLEPEG

SEQ ID NO: 11896 - protein, 381 aa, Streptomyces avermitilis
MTVMEQRGAYRPTPPPAWQPRTDPAPLLPDALPHRVLGTEAAAEADPLLLRRLYAELVRGRRYNTQATALTKQGRLAVYPSSTGQEACEVAAALVLEERDWLFPSYRDTLAAVARGLDPVQALTLLRGDWHTGYDPREHRIAPLCTPLATQLPHAVGLAHAARLKGDDVVALALVGDGGTSEGDFHEALNFAAVWQAPVVFLVQNNGFAISVPLAKQTAAPSLAHKAVGYGMPGRLVDGNDAAAVHEVLSDAVAHARAGGGPTLVEAVTYRIDAHTNADDATRYRGDSEVEAWRAHDPIALLEHELTERGLLDEDGIRAAREDAEAMAADLRARMNQDPALDPMDLFAHVYAEPTPQLREQEAQLRAELAAEADGPQGVGR

SEQ ID NO: 11897 - protein, 334 aa, Streptomyces avermitilis
MTTVALKPATMAQALTRALRDAMAADPAVHVMGEDVGTLGGVFRVTDGLAKEFGEDRCTDTPLAEAGILGTAVGMAMYGLRPVVEMQFDAFAYPAFEQLISHVARMRNRTRGAMPLPITIRVPYGGGIGGVEHHSDSSEAYYMATPGLHVVTPATVADAYGLLRAAIASDDPVVFLEPKRLYWSKDSWNPDEPGTVEPIGRAVVRRSGRSATLITYGPSLPVCLEAAEAARAEGWDLEVVDLRSLVPFDDETVCASVRRTGRAVVVHESGGYGGPGGEIAARITERCFHHLEAPVLRVAGFDIPYPPPMLERHHLPGVDRILDAVGRLQWEAGS

SEQ ID NO: 11898 - protein, 455 aa, Streptomyces avermitilis
MAQVLEFKLPDLGEGLTEAEIVRWLVQVGDVVAIDQPVVEVETAKAMVEVPCPYGGVVTARFGEEGTELPVGSPLLTVAVGAPSSVPAASSLSGATSASSASSVSSDDGESSGNVLVGYGTSAAPARRRRVRPGQAAPVVTATAAAAATRVAAPERSDGPVPVISPLVRRLARENGLDLRALAGSGPDGLILRSDVEQALRAAPTPAPTPTMPPAPTPAPTPAAAPRGTRIPLRGVRGAVADKLSRSRREIPDATCWVDADATALMHARVAMNATGGPKISLIALLARICTAALARFPELNSTVDMDAREVVRLDQVHLGFAAQTERGLVVPVVRDAHARDAESLSAEFARLTEAARTGTLTPGELTGGTFTLNNYGVFGVDGSTPIINHPEAAMLGVGRIIPKPWVHEGELAVRQVVQLSLTFDHRVCDGGTAGGFLRYVADCVEQPAVLLRTL

SEQ ID NO: 11899 - protein, 295 aa, Streptomyces avermitilis
MTEYERPQTPGVVTHDAVVLAGGAARRLGGADKPGVRVGGRALLDRVLAACAGAATTVVVADPRATARPVVWAREEPPGAGPVAALDAGLRRTTAAYVVVLSADLPFLDEETVRRLLSTLQASGTEGVLLTDPGGRDQPLVAAYRSAALRRELAELAAGHGTLAGLPLRVLVAALDLTRVSDPVASFDCDTWDDIAAARSRIREHGNVLDEWISAVKDELGIDLAVDTGILLDLARDAAHGVARPAAPLTTFLVGYAAAQAGGGPEAVAEAARKAAALALRWADEAAAEAGPDAG

SEQ ID NO: 11900 - protein, 464 aa, Streptomyces avermitilis
VVNDSGDRGRPREARPAGRHQEEHDLDVEEALALVREPGSREPEPARDTPSAPAPSPRTTSHAQHQATPWPEARVTAERAARSVPRRAPVSVPLDAALGLVLAAPLTALTDLPSFDTSAMDGWAVAGPGPWDVRDEGVLAGHAGPRSLGDGEAVRIATGARVPQDTTAVLRSEHGTTDDKERLHATREVVHGQDIRPRGQECRSGDQLLPAGALATPAVLGLAAAAGYDTLSAMPRPRVEILVLGDELLTAGLPEDGLIRDALGPMLPPWLRALGTEVVAVRRLGDDAEALYQAVKGSDAELIVTTGGTAAGPVDHVHPVLRRLGAELLVDGVKVRPGHPMLLARTRENQHLVGLPGNPLAAVSGLLTLAEPLLRVLAGRAAPEPYTLPLRDTVHGHPYDTRLVPVVVRADRAVPLHYNGPAMLRGIAAADALVVVPPGGAHPGQELELLDLPWAWAGIGECFT

SEQ ID NO: 11901 - protein, 344 aa, Streptomyces avermitilis
VNLPRKVVDRPIRQVGKRLAMALLVLAATAFIVWIDRDGYNDNAGDGVDLLDSFYYATVTLSTTGYGDITPVSDGARLTNIFVITPLRVLFLIILVGTTLEVLTERTREEWRLNRWRAALRDHTVVVGFGTKGRSAIQTVCATGLKKEQVVVVDPSSRVVDAATAEGYAGVVGDATRSDVLLRAEVQRARQIIIATQRDDTAVLVTLTARQLNRGAKIVAAVREEENAPLLRQSGADAVITSASAAGRLLGLSVLSPSAGMVMEDLIQQGSGLDMVERPVIKAEVGKGVRETGDLVVSVVRGHRVLGYDDPAIGTLQLTDRLITIVRASPATKATPDTRPLPRD

SEQ ID NO: 11902 - protein, 326 aa, Streptomyces avermitilis
MYAITIPEPGGPEALVWTEVPDPEPGEGEVLVEVVASAVNRADLLQRQGFYAPPPGASPYPGLECSGRIAALGPGVSGWAVGDEVCALLAGGGYAEKVAVPAGQLLPVPEGIGLRQAAALPEVTCTVWSNVFMVAHLRPGETLLVHGGSSGIGTMAIQLAKAVGAKVAVTAGTKEKLDFCAELGADVLVNYREQDFVEEVRRATDGAGADVILDNMGAKYLGRNVDALAVNGRLAIIGMQGGAKGELNIGALLHKRGAVTATSLRARPLGEKAAIVAAAREHVWPLIASGRVRPIVDRELPMSDAATAHRVLEESGHIGKVLLVVP

SEQ ID NO: 11903 - protein, 320 aa, Streptomyces avermitilis
VHGEAARVRRRTRPGHPGRRPDRRDAGGGGPCDPGGVDLGARVREGVTHVTPRTRTTRTLRTAVRPLLLSTGAALAVYATTTAYVTPPAYAAAVRYALTPASPAAVRYAPAHPSAAAVPYAPAQPSTAAAPSPLPPSSLAVATASSPPAAPTAAAPSRLAPAEQADQADPAEPADPAAAATRPVPSRDAATPSRGAVGAPGRPTPDPSRAGSQAGEGRMRPGRADDGSESEDAEPTYTDRDPADGDAEESGVDPGASVRPEVTDAPQPSQHAAATPPQSVVRPGERTPKPVLEVLPLGSGLILMGLGLGLAFLALRVRRG

SEQ ID NO: 11904 - protein, 181 aa, Streptomyces avermitilis
MEMPRNERSPENPQILVVGQDGMALGGAGDEGSREVPVTEMVEQPAKVMRIGSMIKQLLEEVRAAPLDEASRQRLKEIHSSSVKELEDGLAPELVEELERLSLPFTDEATPSDAELRIAQAQLVGWLEGLFHGIQTTLFAQQMAARAQLEQMRRALPPGVGGPEGDGDDLRAGGRSGGPYL

SEQ ID NO: 11905 - protein, 550 aa, Streptomyces avermitilis
MSQDGAQGRYAGRAVAGGRYQLRDLLGEGGMASVHLAYDSVLDRQVAIKTLHTELGREQAFRERFRREAQSVAKLTHTNIVSVFDTGEDSLDGLTTPYIVMEYIEGKPLGSVLDADIQQHGAMPADKALKITADVLAALEISHEMGLVHRDIKPGNVMMTKRNVVKVMDFGIARAMQSGVTSMTQTGMVVGTPQYLSPEQALGRGVDARSDLYSVGIMLFQLVTGRLPFEADSPLAIAYAHVQEEPVAPSSVNRSLPPAVDALVARALKKNPNERFPSAEIMRDECLRVAQSFQAAAPSIVPGAQTPSGAGVGSAVFPPIDQSTPAPTGPVQTPYQPGPYGPATPAPAPSYGYPQQGGYQTPPQTSAYAPQQSTAYSAQQGTSTPPPYNLSPHSTASASGGSGGGKSNKAVIIGSIVVALLAIGGLTTALTLNGDDDKGGGDAGSSASPTVVEGHKDPDTTKTMETTECTEPDESYNDPDKIKIPDFTFKNIDSVKKCLQAAGWPYDPKKVDENTFGEGTVMEQYPAAGDDVDPKDMPDIVLKISTGDPA

SEQ ID NO: 11906 - protein, 499 aa, Streptomyces avermitilis
MSDAPEMWGNGGLVGDGRYRLTGRLGRGGMAEVFAAEDVRLGRTVAVKLLRSDLAEDPVSKARFTREAQSVAGLNHHAVVAVYDSGEDVVGHSTVPYIVMELVEGRTIRDLLLNAEAPGPEQALIIVSGVLEALAYSHQHGIVHRDIKPANVIITHNGAVKVMDFGIARALHGAQSTMTQTGMVMGTPQYLSPEQALGKAVDHRSDLYATGCLLYELLALRPPFTGETPLSVVYQHVQDIPVPPSEVAEGAPPELDGLVMRSLAKDPDDRFQTAEEMRGLVQYGLQMLYDQGGHTGTWNTGPVAVHEGRHTPAAGFANTTVLPHPSDSGTSQIPQPILPAYGGGDDGGFEGHGNRGTGRGKLWILAVLAVIAVAAGVALALNNTGGSGTGTDTTKSPTASHSSKDKESSKAPSDEASDDSTDDNTGTGSDPDYPTPSYEQSHSYSSQPSDEPTEPSNEPTDTTPTKPTPSTDPVTPSGDASDPAETDGGGDGEGDTAGP

SEQ ID NO: 11907 - protein, 349 aa, Streptomyces avermitilis
VPRPSVPLPVLHAPPVSHAPPLGTLLRQYAAGSALTCVPVDQGLLNRGYRVATTRGRYFLKHHFDPETADPAAIARQHRATQRLADLGVPVAPPLAGNDGRTVAVVGGHAYALHPWIDGRHRHGGQLTAEQCGRLGALLGVVHASLERVMPAQGRAPAEPAESADPADTFTLIDDLLGRVRRHRPSDAFDELARHRLLERRALLEQHADRRPPRGGSVGWVHGDFHPFNLLYKGDAPAAIVDWDRLGVQPRAEEAVRAAVIFFVRPVGTLDLPKARAYARAYRRTADAKPSELAAAVHRVWWERLNDFWMLRWHYERGDTRADSQFPAASALAVWWTREYDAVCEAFSG

SEQ ID NO: 11908 - protein, 164 aa, Streptomyces avermitilis
MPTNEHLAVELIGRADHGRVATSMRALPFLVCVRHIVLAGRVLLRLHRGWGYHRACVGSVVAYGSDNLGRPGPGGNLWSAQIVGRCEAIEPTAAQIALFGPAPGRVDGEPFDPVYLRIEPQLGTVHFMDDHTMDDRSMNDHSVEGLSMDDRPVPVAGTPLRSRP

SEQ ID NO: 11909 - protein, 219 aa, Streptomyces avermitilis
VSESGKITVFLLDDHEVVRRGVHDLLSGEDDIEVVGEAGTAADALARIPATHPDVAVLDVRLPDGSGVEVCREIRSQNDAVKCLMLTSYADDEALFDAIMAGASGYVLKDIRGSELLAAVRDVAAGKSLLDPVATARVLERLREGGGPKEDDRLAHLTDQERRILDLIGEGLTNREIGERLHLAEKTIKNYVSSLLSKLGMQRRSQAAAYVARIQAEKS

SEQ ID NO: 11910 - protein, 406 aa, Streptomyces avermitilis
VTVESTAARKPRRSAGTKSAAAKRTSPGAKKSPSTTGAEHELIQLLTPDGRRVKNPEYDAYVADITPEELRGLYRDMVLSRRFDAEATSLQRQGELGLWASMLGQEAAQIGSGRATRDDDYVFPTYREHGVAWCRGVDPTNLLGMFRGVNNGGWDPNSNNFHLYTIVIGSQTLHATGYAMGIAKDGADSAVIAYFGDGASSQGDVAESFTFSAVYNAPVVFFCQNNQWAISEPTEKQTRVPLYQRAQGYGFPGVRVDGNDVLACLAVTKWALERARRGEGPTLVEAFTYRMGAHTTSDDPTKYRADEEREAWEAKDPILRLRTYLEASNHADEGFFAELEVESEALGRRVREVVRAMPDPDHFAIFENVYADGHALVDEERAQFAAYQASFTTEPDGGSAAGQGGN

SEQ ID NO: 11911 - protein, 325 aa, Streptomyces avermitilis
MAEKMAIAKAINESLRKALESDPKVLIMGEDVGKLGGVFRVTDGLQKDFGEERVIDTPLAESGIVGTAIGLALRGYRPVVEIQFDGFVFPAYDQIVTQLAKMHARALGKIKLPVVVRIPYGGGIGAVEHHSESPEALFAHVAGLKVVSPSNASDAYWMMQQAIQSDDPVIFFEPKRRYWDKGEVNVEAIPDPLHKARVVREGTDLTLAAYGPMVKVCQEAAAAAEEEGKSLEVVDLRSMSPIDFDAVQASVEKTRRLVVVHEAPVFLGTGAEIAARITERCFYHLEAPVLRVGGYHAPYPPARLEEEYLPGLDRVLDAVDRSLAY

SEQ ID NO: 11912 - protein, 462 aa, Streptomyces avermitilis
MTEASVREFKMPDVGEGLTEAEILKWYVQPGDTVTDGQVVCEVETAKAAVELPIPYDGVVRELRFPEGTTVDVGQVIIAVDVAGDAPVAEIPVPAQEAPVQEEPKPEGRKPVLVGYGVAESSTKRRPRKSAPASEPAAEGTYFAATVLQGIQGELNGHGAVKQRPLAKPPVRKLAKDLGVDLATITPSGPDGVITREDVHAAVAPPPPAPQPVQTPAAPAPAPVAAYDTARETRVPVKGVRKATAAAMVGSAFTAPHVTEFVTVDVTRTMKLVEELKQDKEFTGLRVNPLLLIAKALLVAIKRNPDINASWDEANQEIVLKHYVNLGIAAATPRGLIVPNIKDAHAKTLPQLAESLGELVSTAREGKTSPTAMQGGTVTITNVGVFGVDTGTPILNPGESAILAVGAIKLQPWVHKGKVKPRQVTTLALSFDHRLVDGELGSKVLADVAAILEQPKRLITWA

SEQ ID NO: 11913 - protein, 276 aa, Streptomyces avermitilis
VLSTGALTAAPAQAVTKPTITAKGGYVMNNGTGKSLYTKAADTKLSTGSTTKIMTAKVVLSQSNLNLDAKVTVQKAYSDYIVDNNYASSAHLIVGDKVTVRQLLYGLMLPSGCDAAYALADKFGSGSTRAARVKSFLSKMNSTAKSLGMTNTHFDSFDGIGHGSNYSTPRDLTKLASSAMKSSTFRTVVKTKSTKQKATTKSGGYRYYNWDNTNPLLGTYTGTIGVKTGSGPEAKFCLVFAATRNGKTVIGTVLASTSVANRTADAKKLLNYGFAV

SEQ ID NO: 11914 - protein, 227 aa, Streptomyces avermitilis
MSSAPSAAPAPEQPTLKRPPAADRVYAHVKQGVLERRYEGGTLLTEGELAEEVGVSRTPVREALLRLEVEGLIRLYPKKGALVLPVSAQEIADVVETRQLVEEHSARKAVPASPQLIARLEELLAKQKEQAAAGDLAGAAVTDRCFHAEIVRSGGNEILSRLYDQLRDRQLRMGVAVMHAHPDRITKTLTEHEAILEALRSGDAEAVVGIIHQHVSWFSNLARGEVR

SEQ ID NO: 11915 - protein, 448 aa, Streptomyces avermitilis
MSAGRGPTGGGRGPMSSGGAVSLPGDPPGGRRAVAVWGIGVSVYFVAVIFRTSLGVAGLDAADRFHVNASALSTFSILQLLVYAGMQIPVGLLVDRLGTKKVLAIGVVLFTAGQLGFAFSSSYGMALASRALLGCGDAMTFISVLRLGTRWFPARRSPLVAQLAGLVGMAGNLVSTLVLARLLHGVGWTAAFAGSAAAGVVVLVLLLLFLKDHPEGHEPEPFPHHGSAYVRRQIAASWREPGTRLGMWVHFTTQFPAMVFLLLWGLPFLVQAQGLSRATAGELLTLVVLSNMVVGLVYGQVVARHHAARLPLALGTVASTAVVWALTLAYPADRAPMWMLIVLCTVLGACGPASMIGFDFARPANPPERQGTASGITNMGGFVASMTTLFAIGVLLDATGDDYGVAFSAVFVLQAVGISQILRLRKQAARRERERLVASRVETVHVPA

SEQ ID NO: 11916 - protein, 274 aa, Streptomyces avermitilis
VSLHPTLQPYADAWTHSIEAISELVTPLVEGEWNRRTPCPGWSVRDLVSHVIGLDCEMLGDPRPIHTLPRDLFHVTNEHQRYMEMQVDVRRHHTAPEMTSELEYTVIRRNRQLRNESRAPETKVRGPLGSEPTLEEAMRNRAFDVWVHEQDLRAALGRPGNLDSPGAYITRDELLAALPKVVAKNAGAPAGSAVVFDVHGPVEFLRTVRVDAEGRGSIDGTPSLGPAVTLTLDWETYYRLACGRVTADVVKDRIKAEGDPELTAAILLSFAVTP

SEQ ID NO: 11917 - protein, 268 aa, Streptomyces avermitilis
VRASLLQIRVDEGESVDSRRRRVTSLVREQAGVDLVVLPELWTTGAFAYESFDAEAESLEGPTSDAMANAASEAGVWLHAGSIPERAPDGTLYNTSLVFTPGGELAATYRKIHRFGFDKGEAVLMGAGSELVTVRLPETTVGVATCYDLRFPELFRGLVDAGAETLVIPAGWPERRRSHWTLLAQARAVENQAFVLACGTAGTHAGVPQAGHSIVVDPWGEVLAEAGTDEEILTVEFDPAKVAVTREQFPALKDRVLGSTSTARRQAP

SEQ ID NO: 11918 - protein, 164 aa, Streptomyces avermitilis
MRFLVRDRLLGFGDDYWIEDQHGNKVFLVDGKAMRLRDTFELKDTQGRVLIDIHQKMFALRDTMVIERDGEPLATIKRKRLSLLRNHYRVTLVDGTELDVSGKILDREFAIDYEDELLAQISRRWLHVRETYGVDVVRDDADPALLIAVAVCVIHLAEKERGED

SEQ ID NO: 11919 - protein, 77 aa, Streptomyces avermitilis
MPRNTKDSNMRDDDTRNRGPQRDRMRGEGEIVDREGMPPSRGSRREDDMRDREQGRERMRDEEELLGEENKRGEGYR

SEQ ID NO: 11920 - protein, 341 aa, Streptomyces avermitilis
MNDSAPRRVRVRAPELIGKGGWLNTGDKQYTLADLRGRIVVLDFWTFCCINCLHVLDELRELEEKHRDTVVIIGVHSPKFVHEAEHQAVVDAVERYGVEHPVLDDPELATWKQYAVRAWPTLVVIDPEGYVVAQHAGEGHAHAIAALVAELEAEHEAKGTLRRGDGPYVAPEPEPTVLRFPGKALLLPSGNFLVSDTTRHQLVELAADGESVVRRIGSGIRGFADGPADAASFSEPQGMTLLDEDVVVVADTVNHALRRLDLATGEVTTLAGTGRQWWQGSPASGPAREVDLSSPWDVAVFGGRVWIAMAGGAPAVDVRPGGGDGRGRGGHDERGAGRRTG

SEQ ID NO: 11921 - protein, 294 aa, Streptomyces avermitilis
VHQLWTYDPAAGTVEVGAGTTNEGLVDGPGEEAWFAQPSGLAATADRLWLADSETSALRWVDLDGAVHTAVGTGLFDFGHRDGDAEQALLQHPLGVTALPDGSVAVSDTYNHALRRYDPATGEVTTLATDLREPSDAVLVGDDIVVVESARHRLTRLRLPEEAVRVASVAHRTQRAATEVAPGRLQLDVIFQAPAGQKLDTRYGPSTRLLVSSTPPELLLNGEGADPDLSRTLELNPAIPEGVLHVSAMAASCDDDPANEYPACHVHQQDWGVPVRLTEGGADRLPLVLAGMDA

SEQ ID NO: 11922 - protein, 82 aa, Streptomyces avermitilis
MGLGGCIILIAVGAILTFATDWHMEGINLPLVGVIFMIVGLIGVATFSSIARRRRVVMPPSAPVIEEERHHHRDGYSDGYGV

SEQ ID NO: 11923 - protein, 432 aa, Streptomyces avermitilis
MSNPVRFDRGHTDDLMSFLAASPSPYHAVTNAAERLEKAGFRQVAETDAWDSTSGGKYVVRGGALIAWYVPEGADPHTPFRIVGAHTDSPNLRVKPRPDSGAHGWRQIAVEIYGGPLLNSWLDRDLGLAGRLSLRDGSTRLVNIDRPLLRVPQLAIHLDRSVSTDGLKLDKQRHLQPIWGLGGDVRDGDLIAFLEAELGLSAGEVTGWDLMTHSVEAPSYLGRDNELLAGPRMDNLLSVHAGTAALTAVAAADASLAYIPVLAAFDHEENGSQSDTGADGPLLGSVLERSVFARSGSYEDRARAFAGSVCLSSDTGHAVHPNYAERHDPTHHPRAGGGPILKVNVNNRYATDGSGRAIFAAACEKANVPFQTFVSNNSMPCGTTIGPITAARHGIRTVDIGAAILSMHSARELCATDDPFLLANSLVAFLEG

SEQ ID NO: 11924 - protein, 608 aa, Streptomyces avermitilis
MGHYKSNLRDIEFNLFEVLGRDKLYGTGPFAEMDTDTAKSILEELTRLSENELAESFADADRNPPVFDPETNTAPVPASFKKSYQAFMDSEYWRLGLPEEIGGTTSPRSLIWAYAELVLGANPAVWMYSSGPAFAGILFEEGNEVQKHIAKIAVEKQWGSTMVLTEPDAGSDVGAGRTKAVQQEDGSWHIEGVKRFITSGEHDMSENILHYVLARPEGAGPGTKGLSLFLVPKYEFDFETGELGERNGAYATNVEHKMGLKASNTCEMTFGDRHPAKGWLIGDKHDGIRQMFRIIEFARMMVGTKAISTLSTGYLNALEYATERVQGPDLANFMDKTAPKVTITHHPDVRRSLMTQKAYAEGMRALVLHTAAIQDDIQVKESAGEDTTALEALNDLLLPIVKGYGSEKGYEQLAQSLQTFGGSGFLQEYPIEQYIRDAKIDTLYEGTTAIQGQDFFFRKIVRNQGTALNSLAEDIKKFLAIGTGGEELAPAREQLAKAAVELEAIVGLMLTDLAATEQDVKNIYKVGLNTTRLLLASGDVVVGYLLLRGAAVAAEKLETASAKDKPFYTGKIAAAKFFAANVLPGVTGARKLAEGVDLDLMELDEAAF

SEQ ID NO: 11925 - protein, 154 aa, Streptomyces avermitilis
MYGYEQSAGAQQGYIPPQQQMPGGYGQQAPLYPEPSPPSLADAVRAFTTGSMSAEDFQQVFSASKVYCPRGDNPGFLALHNTQQPVIPMFTSLKELRRYAGKESKYFVITGAEVIDLLPTGYGFVLDMEGEHRMVFDAKAVEQMVDFAMRRMYG

SEQ ID NO: 11926 - protein, 323 aa, Streptomyces avermitilis
MPAVTVENPLTLPRVVASADAVARPVLAVTTAPSGFEGEGFPVRRAFAGINYRHLDPFIMMDQMGEVEYAPGEPKGTPWHPHRGFETVTYILDGIFDHQDSNGGGGTITNGDTQWMTAGSGLLHIEAPPESLVMSGGLFHGIQLWVNLPAKDKMMAPRYQDIRGGQVQLLSTPDGGALLRVIAGELDGHQGPGITHTPISLVHATVAPGAEVTLPWREDFNGLAYVLAGRGSVGTDRRPVHTGQTAVFGAGSSITVRADEKQDANTPDLEVVLLGGQPIREPMAHYGPFVMNTREELQQAVEDFQKGRLGTIPAVHGMAEGGL

SEQ ID NO: 11927 - protein, 347 aa, Streptomyces avermitilis
VQLLPEGARRLAAWCAVILLVAGVGWVGVQLCGELRTAVVPVLLALLGTALLGPLHRRLVRVGVNRSLAAGITCVAVVAVVGGAVYIVVAALLDTGDEIVASLKRAAQSVAAHFGAAGTSLDDLASNAKELLTKFGGTAASNVISGVSVVGESIAMAVLALLLVFFFLRDSHRAAGLLRSLAPGGTADTVEAMARRAFEAVEGFMRGTTLIAFIDAVCITVGLLILGVPGAVGLGALVFVGAYIPYLGAFISGALAVLVALADRGFVIALWALGVVAAVQVLEGHVLQPAIQSRTVQMHPAVVMLTITGGASVAGILGMLLAVPLTAAAFAVVHELRARYAADTPQP

SEQ ID NO: 11928 - protein, 714 aa, Streptomyces avermitilis
MRTGEPLPAVGDVLTALATGLWRWDDAAGLVTVDAEAARLLGLPPEPTTLTQAGVRARFHPVDWNEVDGVVQLAVAEGTLAEVRMRIMDEHGRVIRTVRSRSKPSTDPTTGAYELVGTLQEVTEPPPGTAARTPVTGDWRRSREAFLLDAGRALAEARSTAEVLRVAAGLSMPGFSPDGLAVFGAEGDRLTVIGHHGQAPGDENPFLNMPLDTDYPAAEVVRTGRAVYLSSQADYKARYPASWPLAQHFDRQSWAFLPLTVAGRTLGAWMAAFAYPVTFTPDERSVLTTVARMLAQALSRAGAAESERELTDGLQRSMLPTLGPEIPGMAVAARYVPTGGGLQVGGDWYDMIPLPGGSRFALVIGDVQGHDVRAAGLMGQLRIALRAYASEGHRPDAVLSRASRFLYGMTYADDGDAGADMRFATCLYVEVDPATGALEIARAGHPDPAIRMSDGTVLTRSTAGGLPLGIDPDADYPTTRLVLEPGETMLICTDGLIETGGHDLETGWRRIRRILEEHDGDMEELADALVQAVHGPSSHHATGPLTDRREDDIAVLLLCRAGDRLGLGQPDTLLPSVRRTMLTVAQAEPERVASARQQLRELLHDWASEDQVDSAVLLVSEMLTNVLVHTDAEALLTAEVTGEKKERRIRVEVTDASDDLPHRRQPGELASSGRGLMLVELLADTWGVDPRGEGKSIWFELHEPPAESYETYAT

SEQ ID NO: 11929 - protein, 587 aa, Streptomyces avermitilis
MHRYRSHTCGELRASDVGSDVRLSGWLHNRRDLGGILFIDLRDHYGITQLVARPGTPAYEALDKVSKESTVRVDGKVVSRGTENVNPDLPTGEIEVEVSEVELLGAAAPLPFTINAEDGVNEERRLEYRFLDLRRERMHRNILLRTAVISAIRHKMTALGFNEMATPILSATSPEGARDFVVPSRLHPGKFYALPQAPQQFKQLLMISGFDRYFQIAPCFRDEDARADRSPGEFYQLDVEMSFVEQEDVFQPIEKLMTELFEEFGGGRHVTSPFPRIPFREAMLKYGSDKPDLRAQLELVDITDIFEGSEFKAFAGKHVRALPVPDVSGQTRKFFDGLGDYAVEQGAKGLAWVRVGEDGSLTGPIAKFLTEENVAELTKRLSLAPGHAVFFGAGEFDEVSKIMGAVRVEAAKRSGNFEENVFRFCWIVDFPMYEKDEDTGKIDFSHNPFSMPQGGLEALETQDPLDILGWQYDIVCNGVELSSGAIRNHEPEIMLKAFEIAGYDRDTVEEQFAGMLRAFRFGAPPHGGIAPGVDRIVMLLADEPNIRETIAFPLNGNAQDLMMGAPTELDETRLRELHLSVRKPQPK

SEQ ID NO: 11930 - protein, 291 aa, Streptomyces avermitilis
VTGGAAIAAVGVGGGLAVNAFADEATSDVSSSSGSETCYTLTSETTEGPYYIDADKIRQDVTEDEEGIPLTLTLKVIDADTCKPLRNAAVDIWHCSALGVYSGYESSGNGGGGGGNPPPTGAPTGTPTGEPPTGGPGGGGGGHAEPTDDERYLRGTWKTDKHGYVTFRTVFPGWYQGRCVHIHVKVHVDGTWTDAGYEGGHTCHTGQLFFDEKSVLASAEVAPYSTNAATRTTLDEDTIYPDNGHAGGLLYLKYNKRHIAKGVRAHLTLGVAPDETHDSTDTPPSASASAG

SEQ ID NO: 11931 - protein, 93 aa, Streptomyces avermitilis
VVKGPELQEAGVPGPSGCRTGSGRGGRLRREQVVCRAGGDGSAEPVAEGVEVGQAWSGTSFGSSANRSSASLTVTAWSSQRSSVSGSAQSETR

SEQ ID NO: 11932 - protein, 147 aa, Streptomyces avermitilis
MPENGEPADAPADAPWEYTLSIPNDPRAVTICRRTLRLILALHGLPHLTESAELVATELVANAVQHTKGPAAIRLRWANRVLRIGVWDADPTPPTPAPTPATALAESGRGLALVQGCANGWGWYHLGRSHVPGGTGKFIWCELTTAA

SEQ ID NO: 11933 - protein, 282 aa, Streptomyces avermitilis
VPARIQPTARQVRLGAELRKLRDAAGLTSRQAAALLGTNPAQMSQIEAGNAGVSGERVRKLGVQYASADMELVDALVEMATDRTRGWWEEYRDVLPPVFQDLAELEHHATFMRVVGTVHVPGLLQTQEYARAVFAYVVPELPVDELDLRVRHRMRRKLVLSERTVPYEAVIHESVLRTRVADRRVAVAQLDELLSQSERPNVSLRVIPFGVDGFAGAGAMMLYAGGRVPALDTVQRDAPYGSVFLDASAQLLAMRTLFRRVESAALPPAKSRDYIHRLTKEL

SEQ ID NO: 11934 - protein, 141 aa, Streptomyces avermitilis
LIGEEFAGALSVVLRDLRAQCSVQPEVREDEEYPGVILYAPDGSGQGVYGEPDGRPAAALLVAVADQVQDWAVEALWGQGEPAVWPHCPAHPGGHPLTATVVGGAAVWVCPASGRPVGHIGGLPPADVADVADLAPTPRTR

SEQ ID NO: 11935 - protein, 177 aa, Streptomyces avermitilis
MTEIHTPRLLLRRWTDDDLAPMAEINADPEVMRWVGDGSVRDLELTAQDIERWEEEWDEEGLGLFAVELLASGELAGFTGLSWSEFLPDALPDVQIGWRLGRQFWGQGYASEAAQATLEFALQDRGLERVVAAVRPGDEASENVLRKLGMPAEREITHPEHGFPLTVHAIDLTEYEA

SEQ ID NO: 11936 - protein, 161 aa, Streptomyces avermitilis
MAVPHVIPIAYQPKHRTDSIGRYADGQFLASVTYAFPEGFRPADGWEEHKRLYTVLHTFDAEGRYRDSEIWCAGTWAEQQRTPAGENGENPVLARARAHLAKLLRSLPRRAYTDIAIRPFRLTVDGVLFGLLTGEDEGEHWAELYPDRLGFGEPWDGRYDT

SEQ ID NO: 11937 - protein, 574 aa, Streptomyces avermitilis
MARHLITSALPYINGIKHLGNMVGSMLPADVYSRYLRQRGHDVLYICATDEHGTPAELAAKERGLPVDEFCAQAHDAQKAVYDGFELAFDYFGRSSSEQNREITQHFARRLNENGFIEERAIRQVYSPADGRFLPDRYVEGTCPHCGYDKARGDQCENCTRVLDPTDLINPRSAISGSTDLEVRETKHLFLLQSKLQHEVEEWVARHEEEWPQLASSIARKWLNEGLHDRAITRDLDWGVPVPADTWPELAAEGKVFYVWFDAPIEYIGATKEWSDLDPENRDWKSWWYDADSGENPVRYTEFMAKDNVPFHTVMFPATELGVREPWKKVDYVKAFNWLTYYGGKFSTSQKRGVFTDHALEILPADYWRYFLIANAPESDDSSFTWEHFTATVNKDLADTLGNFVNRVLSFSKKRFGEEVPAGAPAGESETKLGEEIAALLAEYESHMETLQFRKAAAALRALWSAGNSYLEEKAPWLEIKTNPEGAALTLRTAMNLIHLYSVVSEPFIPASSKAMRSAFALSEDTATWVTQDEAKSLDSVPAGTPFTVPPVLFAKITDEDLESYKERFGGAPE

SEQ ID NO: 11938 - protein, 582 aa, Streptomyces avermitilis
MGILTLLRNAFGRSRKGRAADGEPSRETTSEPTVPAPAGEREATAEPDRPTEAPAEVPAQASVVDELVSAAFDNVAVPKPRATEATEKATEATEAKETKAEEAEEPEVTEAEAPEAEAPEVAPEPTVEPEPVAETTPEPEPEPEPVAETTPEPEPVAEVAPEPEPKPEPEAEVAPEPEPVAETTPEPEPEPEPAVAEKTAEPEPVVEPESEPVAETAPEPEPAVEPEPDPEPVAEAAPEPVAEVAPEPQPEPEPAVEPEPVAEAAPEPEPAAEATSEPEPAVEPAPEPVAEVTPEPQPEPVAEATPEPEPTVEATPEPEPVAETTPEPEPEPTVAEKTAEPEPEPVAEQPTPEPSAADGDQAPQGPATRVKSDAPGLLTAYKAAATTLEKNDLTGTRAKVYLVLDRSASMRPYYKDGSAQALGEQTLALAAHLDPEATVHVVFFSTELDGTGELTLTEHENKIDELHTALGRMGRTSYHAAVEAVLAHHEKSADPKAPALVVFQTDGAPDAKTPATQALTDAAKNHPTVFFSFVAFGEHDNKAFDYLRKLKTGNTAFFHAGPTPRELTDAELYEGVLAAWRP

SEQ ID NO: 11939 - protein, 700 aa, Streptomyces avermitilis
VRRLLPLIGTPASHPGGRSALTCRFRCGDACFQEVPNTSANQYVGDVIAGALSRRSMMRAAAVVTVAAGAGTAAVARAPQAQAQAATGTPYAAQPTAQPTAQSTSSRRGARGLRFTPVAPNTTDAVVTPDGYRQNVVIRWGEPILRGAPAFDPENQTAEAQAGQFGYNNDFLALLPLPGERGRQLLVANHEYTDEILMFRGYDAASPTRRQVEVAWAAHGLSAVVVEEDRGTGRLTAVTRHHLNRRVTATTEFRLTGPAAGSALLRTSADPTGRKVLGTLNNCSGGTTPWGTTLHGEENFNQYFANGSRPTDTRYGIGTGATERKWERFDRRFDIAQEPNEVHRFGYVVEFDPYDPASTPRKHTALGRFKHEAATVRLTDDGRPVVYTGDDERFDYFYKFVGSKRMRHGTSRSAREHNLSLLDEGTLYVAKLTGDSPATDIDGSGKLPGDGEFDGGGSWIPLATATAGGAVSHVEGMTAEEVFVFTRLAGDKVGATKMDRPEDIQPSPHTGKVYVALTNNSNRGKTGYAPADEANPRNANKHGHILELTERHSRPESLTFGWSLFLVAGDPADSSTYFAGFPKDRVSPISCPDNVAFDPHGNLWISTDGNQLGSHDGLFGVATRGDRRGELKQFLTVPTGAETCGPIVQDRRVLVAVQHPGEVDGASVEKPASTWPDGPGKIVRPAVVAVWRADGCDIGI

SEQ ID NO: 11940 - protein, 316 aa, Streptomyces avermitilis
MELEVRHLRALCAIADTGSLHRAARQLGVAQPSLSTQLRRIEQELGGELFTRERTGCRPTPLGRTVLGRARPLLAEMRTLVAEARAAAADEPQLRIGSTASRALAGWLRRLRVRRGEPLLQMDVSANALLNLVAEGRLDVAFVHEVEGCPLRVPDGLRLRVLVEREPQFVSLPHDHPAAGRPVVHLSDLAADRWMVDPTVDGEWDAVHRMLRAAGLNPRILHGDYHTAATLVATGEVVTVCQPTSPSRPEMAVRRLHGDPLGVRLLVAARTEAELDGVFPELAEAYWETARQAPAYREWLERVASQPLGPDAVAVC

SEQ ID NO: 11941 - protein, 227 aa, Streptomyces avermitilis
MRMSTSALAAAAVGLSLATASLSMAVPATAAPVAPAAATAYSGYTGSAAEAKANQAFFEAVIKSVAEKRAAQPRSAAAVTVVYDASRAPSFSSVIARSTQIWNGSVSNVKLQSGSASNADFSYREGNDSRGSYASTDGHGSGYVFLDYAQNRQYDSTRVTAHETGHVLGLPDHYTGPCSELMSGGGPGTSCTNAYPNSAERSRVNQLWVNGFAKALDKALQKAGRQG

SEQ ID NO: 11942 - protein, 646 aa, Streptomyces avermitilis
MSRAFPVSLTPPDWLVRNLQPQQAPVNRSAVVRASVALALPLALGLAAGRPAYGALASMGALSGVISDTADAYRMRILNIAIPQLFGALGVTIGALAFGQGWVTVAAVTAVALVSGMISSIGAVASVSGLLLLLNCVIGAGLTLPGAWWLAPLLMSGGGLLVLALALLTWPLRSGVPERAAVAETYRRVADLLAACATDAYDDARYAMTASLNQSYDLVLARRAHHHGRSPDLVRLLAQLNAATPLVEAAPAAHQAGKRLPDAIPTAVRHLADALESDSTGPLRLSLPEPEGETARAVDHALRHTADVVTDQPTEKGTPHTVDDLGRPAALPVRAARAARNVVLSAASWRYGLRLALCIGIAQALVSLVVVPRSYWVALTVTFVLKPDFGSVFSRALLRALGTVAGLAVAAGVLTLVPRGWWDVLVMMLLGPLIPALTPRGYGYQTAAITPVILLLSDTLNHQGTGLLVPRLVDSLAGCAIALVAGYLLWPESWHTRVGQHLANAVADTASYVENAFGAGVDPAARPRMRRRLYRDLSAIRTEFQRALTEPPPMGRRAAAWWPLVVATERIVDATTAARVRVKQGAPAPTAAEIAQVTLQLRELSDGLRETNVLVGVRTDLTGPADSVLEPLRQEVAAARAITSPR

SEQ ID NO: 11943 - protein, 337 aa, Streptomyces avermitilis
VETATAERTGPAEVRRRSPARTLAAWLATLLLTGVSVVMGCRATGRDGITPVPQLLAFLPWLLAPTGLALLLFLLARRRTGLVWGVLVLGALAWFIEPYGKTGEPTGTPLAELRVLTSNVQFGRGTDSLVAAVRRARPDIVFVEECEYRCSATLERAFGGSDGTYPYRRAVEGAGSDGSVILSRFPLRAAAGVPGTMGMPGAVADVRGHDVRLQLAHPMPPLPGQLDVWRRELGRIRDYAVAGDDPTILAGDFNASQDHAAFRRILDTGLRDGARLAGADRTPSWPARTAGGRLRLGAQIDHVLVSPDFSANSADFLGIDGTDHRALLVDLTLHQHG

SEQ ID NO: 11944 - protein, 261 aa, Streptomyces avermitilis
MAPFLAYEDKGTQRDTSLPLVLVHGHPFDRTMWAPQLAAFAPSRRVIAPDLRGYGASPVVPGITPLSVFAEDIAALLDELKADRFVLAGLSMGGQIAMECYRLFPERIAGLVLADTFPTAETEAGKRARGAMADRLLREGMRGYADEVLHRMVAPYADADVQAHVHRMMTGTDPEGAAAALRGRAQRPDYRDLLTRVSVPALVVVGADDTFTPVADAAAMHAALPGATLRVIDGAAHLPNLERPEEFNAALGEFLFSLSGV

SEQ ID NO: 11945 - protein, 478 aa, Streptomyces avermitilis
MAEDYRRIADRIAADIASGRLEPGRRLPPQRVFARRRGIAGSTAGRVYGELVRRGLVVGEVGRGTFVRASPLPSGRALAEPATTAPVNLELNYPSAPGQSELLAAGLAPLLRPDVLAEATRTASAAGTRAAREAAAGLLATEGWRPAPDRLLFAGNARQAIAGALASLVPPGGRLGVESLTYPLVREITARLGVEPVPLPMDEQGLCARRAGRRPPFGAARGRVRPADAPQSDIGDHAGGPAARTGRHREGLGAAGRRGPHLVVPPGGRRPAGRVRPRAHVRRRRTVQAGRAGAHGRVPRGAGGPGRAGGGGGAGRGRGRRGAAVGRVDGGAVRAGGGGAVERGRDGRPAGRREAGGRGRAAAAGRRAPCRVHRSGRSAGVLRLVGAARAVAGGHVRGGGGTAGDRGDTGARLRGRPGCGGRRQARARVGSAARTGAGAADARRRRVYTPVSQAARATVRPRASSSQQTVRSVSVRAS

SEQ ID NO: 11946 - protein, 244 aa, Streptomyces avermitilis
VPDALAAAHRSAPLAAVYVQPTLHNPTSVTMRADRLRELADTVRDLGLPVVEDRIWSFLQEDGDPLAAYAPERTYVVDGLSKRVAPGLTVGFLVVPEDPEGPEEGAGRDEAAAAGALRSGGWTAGRFALEAAVRWSGDGTVARLVAAKRADAAERQRLVGEHLAGFTVRADPRAYYAWWELPEPWRADTFAAAAARRGIAVTPGPAFGAGQGAADAVRLGLASVPPPELARALRTLAGVACTRP

SEQ ID NO: 11947 - protein, 299 aa, Streptomyces avermitilis
VSLRVRSALSAVFIGLACLLAPLGALAAWATYGIEDSARYEATTAPLAADAEVREAVAAAVTDGIMREVHVGSPLQEPVRSFVHDAVRSFTGTEAFRTAWGTANLAAYDAVMRALRSDGDRPVTIDLAPATERMKRQLVEDQVPFADRIPVEHTEITLLGTRDLATLRKGFHVLEIAGFWLPVATVVFALTGILAAVCRRRAVLATGLGTALGAASLAGAVAVGRRLTLADLPPGASRPAAGAIYDALTETLRTVCWLLLALGLTVALAAWLTGVYTRRRRASAAPAPVRAAEPTRARA

SEQ ID NO: 11948 - protein, 132 aa, Streptomyces avermitilis
VPVVLGLVYGFWAAAINRDTGPITGWNILFGFVCAFVFAAAWMGVAKTASHLRREVHALLWTAFAGCAFGFIYSQTGASVLRSVFMSLAVAAGVFAVAFYRFYTHEDAQGHRVNAQGRPVSTPVSTEGHPAT

SEQ ID NO: 11949 - protein, 419 aa, Streptomyces avermitilis
MNRRSGAGQQRRARRSSLDPRPPGAGGPDAVQRQKLLRVRGRSVAWIPPVALLAAIAAFDWNTTGEFRVISWVVLVPGIAAAICGVWGTLVIAALALGTFVLEDNSWPHQYQTGLPDFILVVAGGALAVLACVVRVRGEQRMLHMRDIAETTRSTVLRPLPPGWGDLEHAAVYLAADSEARVGGDFYDIQPGPQGTRLLLGDVQGKGLGAVAAAAALLGTFRESAYHEPDLGTVAAHLEVRMARHVRYCAAVGRDNDADADRFATVVLVGFPETDPSYVEVVNFGHEPPLVVTPEGVRSLPAGEGLPAGFGELAHGATPPTLRVPLTPGETLLLVTDGVTEARDAAGEFYPLRERVAGAVAADRRVAEPARLVRYVRDGTLRHCGGRLDDDTTIFAVRRHRREERSARSPFTSVPPGAP

SEQ ID NO: 11950 - protein, 249 aa, Streptomyces avermitilis
MQQPYEFRGAEAVERGAGAGARVLVVDDDPTVAEVVSGYLDRAGYVVDRAEDGPTALARAAAHWPDLVVLDLMLPGMDGLEVCRRMRGRGPVPVIMLTARGDEDDRILGLEVGADDYVTKPFSPRELVLRVESVLRRTRPVTAPRPLHASGLALDPAARRATKDGEELALTIREFDLLAFFLRHPGRAFSREDLMREVWGWDFGDLSTVTVHVRRLRGKVEDDPARPRLIQTVWGVGYRFGTTPRQEAV

SEQ ID NO: 11951 - protein, 374 aa, Streptomyces avermitilis
MHDMLLIALFAFLGAAAAGLCGAGVLVLIRRRSLTVSLAVVSAVAVTAMLAGTLAVAWAMFLSAHDLTVVTTVVAMAAVVSLATALLLGRWVVARSRELALAARSFGDGGDFAAPDGPATAELDALARELAATSARLAESRDRERALESSRRELVAWISHDLRTPLAGLRAMSEALEDGVAADPDRYLRQIRTEVERLNDMVGDLFELSRIHAGTLALSPSRISLYDLVGDALAGADPLARELGVRLVGDRVEPVPVEVDGKEMSRVLGNLLINAIRRTPADGTVAIAAERSPGGVVLSVTDGCGGIPEEDLPRVFDTGWRGTHARTPPAGAGLGLAIVRGIVEAHQGQAAVRNIPGGCRFEVTLPTARAQPQP

SEQ ID NO: 11952 - protein, 380 aa, Streptomyces avermitilis
MPGTVLLLAASPAGKGCLVDAASVLPVLAAVAPSVLSGTDTANVVELADPLEPQAVLTRLRAAATAPGPLTVFLAGQLQLDRRQHLPHLALARTTPSTVRYTGFPWHWIREELRLRPPGTTTLFVDLHADAETWQHLRTGPLDAGRAAALYGRVAPPPPRRTVAPPAYMKAVATILRSGHRPEPGVLHEQALGRVAHEGGHADIVLTPPGGGAALPGGFVPGPAYPPEQPRPRTPDGPAAADVHATIAAAVRAGRHGEADALAAQWEQTAASTHGAASEEALHWREVRADLAMFAGDAARSCRAWLTVAGTRLAAGQAPADPAVEAAVDRAHHQWGRIDDPARARELGPALADLRLRVPGRREGALDHVQQHLRQLQTQG

SEQ ID NO: 11953 - protein, 698 aa, Streptomyces avermitilis
VKDDLMRGHDDLHTTRADGPPYLFRAWGFEIIVRIRTLPTATALAVLFSSAALAVGSAAPALADSSTLLPVRSTGDVVVDGVHQRVFISDPAGGKVVATDYAGTVLGTVDSLPGARGLELSADSGTLYAAVPGADAIVAIDTATATEAERYPTGAGTGPEYPALAGDKLWFGYGGSGEGNIGSLDLSGADPVVTLKQDTNRTWYDAPILGSSAGAPGTLVAGAPGQSPVVLGVYDVSSGTATLTAHAFDPGNTGGGNLSDLAVTPDGKDVVTASGAPYYQAVYKISDLSADGRYQTNTYPNAVDIAPDGTVAAGTFSWYDPDVHVFKPGVSTPVRQYDLPNTGTSSGADTLAGSGLAWSPDGSRLFAVSYNDKDVYSLRVFDDPTKAATSLTMVAPVKATRGKALSVSGTLTSAEALPAGATVSVTRTDMESPSGKPVGTATVAADGSYTFGDTPPAGGKVTYTATYAGDASHSGATATGSVEVSRSTPTLTLNNDGKVYAYGSDVKFTAHLGTTYKNRAVELWADPYGSDKPGKLVKSGTVNADGNLSVTLDLTRDTKVTAKFAGDARYAPKTAASTAGAKVKVSTSLSGFYKTKSAWGHTYSYFHKSKDPVVNTTMTAYPNRKQKLTVQAYYNGAWHETASEYFALSASGKSSVTLEGTPSTGIRFRLRSAYINNSSGDNVNSTTYGSWKYLIFTS

SEQ ID NO: 11954 - protein, 51 aa, Streptomyces avermitilis
VFRRTAARYSRSAAAAVIAVAALVAAANAGPARAATPPAHEASHSRLAPTP

SEQ ID NO: 11955 - protein, 447 aa, Streptomyces avermitilis
MADRDEPEIIGRRVQRLRAERGLTQRQLAEPAYTPAYISTLEAGRVRASEPALRHIADRLGVAYEELATGRPAHLATALRLRLTDAQRTLATGEAEAAAEQYAALLAEAVEHGLAAEEAAALLGLGECATEAGDLVTGRRRFEEAEQRLGDAPLPLRVPAIRGRAVSHYLAGELRYAVYLLESTLDELNRTGLHDPDALLLLYASVIGPYMDMGAHARAAQAAEFALALAPQVGDPALVARMHRSVARTMLAEGRAAEADASLVKAAELYRQLQIRTELANCHWMRGYLHAQNGELERAEGELRQAHSMLAAQRAALYSSQAAVELADVLHRRGKSDEAAALLHEVLGDLSPERGAVHSAGAHRLLGIIAEDAHDTEAAEEHYVRALSLLERAGAAGDLADLCRMLGDLLRRSGRVEAALDAYRTGLGHRTAPGTTTLGPAPAQPPL

SEQ ID NO: 11956 - protein, 73 aa, Streptomyces avermitilis
MTKPSAPRRHLPTSPFAAPVAPEAKHFGLGDRVSHDQFGLGTIVGVEEGIAMLVDFGSSQARILTPYTRMHSL

SEQ ID NO: 11957 - protein, 540 aa, Streptomyces avermitilis
MSAPEEQGRRRRIPRRVRTRRRRERWIRRALAAVLALIMLLCGAVVVAYLLTGVPEPHPETVSQSTVFLDADGEYLGRRGPVDRQDVPLSEVPRHVQDAVIAAENRSFRTDSGISPSAVVRAAVSTLSGGARQGGSTITQQYVKNALLSPEQSLSRKAREALIAVKLDRTRSKDSILEGYLNTVYFGRGAAGIESAARNYFGVDAKDLTLAQGAALAAIINLPSYYERAGADAKVTATLEKRWSWVLDGMRTSGTITAKERLAAAFPAFRFYPPGNTDGQRQYLIDAAATEAADRLGITADQLARGGYTVRTTFDLAAQQATAEQVRGAPAARKGTRLHTAVVALVPGDGAVRVLYGGADYARQPFNDAVNGAVEAGTALDPFRAVRFTGPLAALSRTAAPSPLRLASAYAATVAGGTYAKPYTVAKITRGGRTSYTARPDTRRVVASVQAQMLTKYTGAAGAVGHFSGGAGSGPGARTLWQTTSGGRLSVTVALFAEYPAAGKRPARPAHLPDTAPYLAAGLTESVSSKTLEVPPAGLP

SEQ ID NO: 11958 - protein, 224 aa, Streptomyces avermitilis
MSRTVPPPHHAELREAFARMADDVMPSPVPLAEIEREGRARRRRRRTTALVTGCLLVLAPLAYVSWRLTPTAPDGATAPSASVSGKAVRVVAAGERVQPLPGAELWLAKDGEHWSTPAGSGVSLPEESRGAGGPAVTLRLEEVHDRFLLSGTYRGTGQAARAEVETPSGTTAGTLLTLAGSPGWSVWYAIAPEPKSAGKRLFATVRVTMYDARGAVLARSGDGS

SEQ ID NO: 11959 - protein, 145 aa, Streptomyces avermitilis
VTPQPPSPREDFAAYAAHAWPRLVRTAHLLTGDPHEAADLARTALADAYARRRRIPRDDADFHVRRTLVRAHLRRRRPAPAPAPLARALAALPARQRVVLVLRHGEGLAEAEIAETLGCSVGTVKSYARRGLAALSALPLSGVPR

SEQ ID NO: 11960 - protein, 253 aa, Streptomyces avermitilis
VCALGLAGCSPGAQAQSADTRADTARRPASAVTHKTAPKALERLSGARINIADGRTVGVGMPVSVTFDHPVAAAERARTERQLTVTVRAGAGITRHFTVGRSLVATVDVRTHTMKVVKDGATRTVPISAGAPGMDTWNGTMVVSDKATSVFMDARTVGYGDAYADYYSYAVHLTASGTYLHQNPKAHTYAGRQNVTHGCVGLATDGTAKRFYDEVIPGDVVKVVGSKDTVAPGNGYGDRNVDWDDWRAGSALT

SEQ ID NO: 11961 - protein, 175 aa, Streptomyces avermitilis
MTEGRAGGMTEEEFDAFYATAFPRLTGQLYAFTGDHGEAQDVVQEAFVRAWDRRREFLADGAPEAWIRTVAMRLAVSRWRRARRWLELVRRNPPPEHTPGPGPERAQLVAALRKLPEVQRMAVVLHHLCDLSVEQVASETGAPVGTVKARLSRGRAALARELATGDGEREDDRVR

SEQ ID NO: 11962 - protein, 240 aa, Streptomyces avermitilis
VPGAEIRRRAGARRRRRRTSAAVGGAAAALTLGLALVLNLGGPGAERKPSPAGRPTSTPSTQEAPVATVRLASRILSVDGRTLFVSPGTARRDTPTGRLTVAAKYEVKLVSGEDIGFKGTYSYKVPWMVELRADDGTSVYLGGLSSDEKAPGNYDTTRGWIGLRVVDAKWLYGRLAVGDAVNIDGTASPADSATPDPAGVDTATTETATGGPAAAGSAPEASVRISPTTVTPSPTARNGT

SEQ ID NO: 11963 - protein, 100 aa, Streptomyces avermitilis
VRMSVSPAMEILGFFVVFALVLAGFAGVESKIGRADRRVARVEKKLDLILDHLGIDHVDPRMERVDALLRDGRKVEAIKTYRELTGAGLKEAKEAVERMG

SEQ ID NO: 11964 - protein, 127 aa, Streptomyces avermitilis
METLRETGTESTAHADTVQKNVADIARFLQENFGQRLAAFVAGIEDPKQVGKWCSGQNSPRIDSELRLRAAYQVFRMIALAENPHTARAWMIGMNPQLEDDSPVQAIAEDRHKDVMAAARSYIKGDL

SEQ ID NO: 11965 - protein, 230 aa, Streptomyces avermitilis
MHSSDESPVTLVPAPERGVWRLGKKGHPVEYNRLEPETSQGSSAGRFSLATYGMLYCASDPAGCYAEALTRFRVQPKMRRLIGNHWDNQSGNMGLGRLGSGWRDDHILIRLVPAKDAWFLDVDSEATRAVLSKELHNEFEAWGVASPLTDDHIHGRDRRIARQIAAWTVAQRNRAGHRLAQGIAYRSGYGGHRCWAVLSDVDLETAEQRPIRLEDTALRKVAAEFGLKLF

SEQ ID NO: 11966 - protein, 772 aa, Streptomyces avermitilis
MSDARAWDSPDDAHRLIAKALAELVAEDPTIPPHPYLSRHLAQHAARGRVLDDTHVPLAILPWESSRNVRILLRQTGATQQQDWLEAWAGIEPFVRDADPDSRLTSLHLAHHTATCRRLSLTARPVSERRLAGSRITPLWSDWTAPDNVLAVSDTLVESLAHTTTAPGRTLLISGDSHGTIRMWEANGTPAGAPLHTHGGAIQHLLPLQHDLLVSGGTDGAVRVWHSTRGQQLVEPVRRPHTWVSALALFEPADGARFLLVAHSDGHLTALDPVTFEPADTPLPALDPAPAILTPLATADGTALVIAQGRRVVVWRPGRGVVHISEHQGEVRAVVALPSGGRYAVCDDSGYLGFWDVSTGHETVAAGPAHDGPVIALTTLAVDGRQTVVSAGLDHTLRVWDADTGRPVGGALEGHTDPPVALTTLPGEGQELVVSAAADHTLRRWKLAGHGTRPRRPVRRPVTAAALPGPTVVPALLAAVADGAGTALWNVRTGRHVSLPAGEPPVTAFAWATVHGDPVLLTAHSDAAVRLWSLYAGNAVTPSLRGTLLNHSLPVQAMTAFPHAGATLLATGGADGSVRLWHLGDRLELAHWDDHALSVRDVTLLGTGEDALIVSAGSDGTVRLWDPGTRRASGGPVHCGQQVVHAVTTVAPHPDEAALIASGGEDGTVRLWDPTTRQPVGDPLDARDGAVTALASFHTPAGRPCLAAAGPSGTIHLWDVAARTHLLRIVTGNPLSTLAARQTGEPFTEHPVLLAAGTAGVCMFDVRLERLR

SEQ ID NO: 11967 - protein, 756 aa, Streptomyces avermitilis
MRRRAGGLVRIDGTPAEDERRAAGNTSTQAGNTGSRTGATEPRTGDPGARTGDEPPPQRTLLTVAVREYPDGDEDFTAGIDEQLSVVTDWWCDPEADEPFHRVVQPELHERYDVERFLHEARVRETGGQALVLFVTGHGKLGASGTHFLQLPKTELRRQLATAIRTSEIVAAALDSRAEHVLVIVNTCYAEAIAGELSELHKEIRQSRREQGSLDVIATCAQDQLVQVGRFPSVMRQVLRRLRTNAQITTPWLSVGDLMTEFESELRGDTERRRHRLRRIIDGGGQTVLTPCLPNPGYRPRRQLVGPARRQVATPAEDIDIWLDRASGRPQEADPGWYFSGRERLNRELAVFLTRPEGVLLLTGTAGSGKSAVLGRAVTLSDPLFRENADYADAVRSASPRTVPPENSVSVAVLARHRSAADVLRDLLLGLGVAPRPLGPTDDPVDLWGTQLDTHLAEPGETLTLVVDGLDEAYEPFRIVRDVLAPLNAHCAPSAPLPGQRGPARQPAEPEGQRRNLRLLIGVRSSRPPAHLAAPRGSAPRTALTRPPVTQEPGLLAALCEIFPTASVLRTDDTGSRDDIAAYVEALIGPKDCGSESTRRAAEAVADRVWPSFLDARLAGEQLRETTDPAVLAADPRWLDLLQAGTIGLLRRDLRLAADEGLPADVALALLRASAFALGAGIPWSNVWPAMAGALLGRPIEEPDRMIDSLLRRLSGYLAHDHEDERFVYRPVHEALAEILRDPRQDLLTDLSGDAV

SEQ ID NO: 11968 - protein, 457 aa, Streptomyces avermitilis
MGSELYDTEKDAVIWGLSPGLLLKAWTTPAGLGALHLTPDEREGRLGRVRPSRLLRTAGWAPVLKGQEPYTELVRTVTRSVAAPEAVLEFPYDWRLSVATNARFLAQAAREHLERWRRHPAHTAARRHRVDEREGRLVFVAHSMGGLLTLAALSTGPDGDLAGDTRGVLTLGTPFQGAVAAAVILNTGRGAPVPLPRGRLRSLAVTMPGLHDLLPTYPCVAEGADIRALSPVDVADLGGDKDLAVRSEAFHEGLRGRTLPGHRAVVGISQPTMQSLTLRQGVVTAYEHCYRYHRDGTLLTDGGTPRRFDVAGDGTVHKESASLTRGAVPFALQHGTLAKGEAAMEAVTSFLAEDEHLGPTQAAAGMGLTVPDFVTPGADWTLRVHGADSPAGLECTVEEVGTGSAVPVRAALYADEDELAARVSVPASGLYRVTLDSGDRTPLTQLVLAGPDDLVAD

SEQ ID NO: 11969 - protein, 346 aa, Streptomyces avermitilis
VTHVTSESGVSLRPLIPGTAPGGFALPAAVDRDPAHEDGVCMSIARRVTVSRLLGTGAAALTLTAVACGSAWATDTPGGDGWDNSHRGYTSGQGPGTVTETDRCQFSLDGTVFTDSVRVDDQNLKPTEDGKVHIKVRAAEDATSCTASLAAYRAHGATFATSGVQVFHDFDSVTVKRGETDSLDISVPDAGCFAQIDLYRGKVKFDGELDAKDGFEHGDVPKGPDRPVIKDKLIAAWNGGAKDCTAQPPSTPESKPPATTPPASTPSASTPPKASTPKPSTTPPSDEKSSTPPAATPNGGSSTPPGDLAETGGGNTLPLAAGAAALLAVGAGIVVAGRRRTAKSRS

SEQ ID NO: 11970 - protein, 245 aa, Streptomyces avermitilis
MGISRNAAGTLFVGGALMLTLSALAYPSMLGIQNTSSSPSRVIANTESGPLTEADRDFVVKVRAAGLWEFPAGELAVKKGTIASVRTAGQHLINGHVNLDKSCLKIAQQLNITLPNQASPQQQGFVATLTSDSGKQFDSDLANILRVTHGQIFPAIANIRATTKNTLVRQLADQANDTVLDHITVMEQTGLVDFDSVLFQETTPPKDAKSNHTPPAPQPGEPTVVLSPPAGFTPPPATTPSPTVG

SEQ ID NO: 11971 - protein, 255 aa, Streptomyces avermitilis
MPCLTAWWIRTERSDVRRYGRDAGEESLEQAKSVPREVSWVTWSGTRHAVRGTQHEARRPATCGPHARHWLPRARRNGTVECAVGTGTLRRPSPMSVIAWIVEGTWPACVDAARRYAPEPAGLDLLYVGGGDVPGIAHGAFAGLLGRGHPERDPGTRLEDLGAASAARLLDAAEERLGRPCGRMERYGRVEREVVAAAEGAELLIVARDGDRARLGPHSLGPASRFVVDHAPCPVLLVWPAPAPGLGTIPPPPHP

SEQ ID NO: 11972 - protein, 256 aa, Streptomyces avermitilis
VEQTCERGRTPMRKHRIRTVTLAAAALVAALSLTACNGSDDASGASSAGSSTGAPAKGTDTNGTATGGTGGTGSTGNKGTGNGGSSSGSADSDDSKSSSSSSSSSSSSSSSGGSGDKSGYGQSCGTNDLTWSSRSESQAGGYILVMAKAKAGITCVLSGDLPVVAFGSDGTEASNAEQVAGDPVTLSGSTVAYAGVNPKTTNNDYGKELTSIIVSASNDDPNPVSLKTGAIIVDRPIVTNWHTSAADAVPGDGTDG

SEQ ID NO: 11973 - protein, 351 aa, Streptomyces avermitilis
MAEVVEVSAVTVPAPGGAPGRPATRRPRTARFTAIGLSLAALAVAAALTGIGPRWLDAPAVGAWRTVCLAITIQALPFLLLGTVLSGAINAFVPAQVFTRVLPKRPVLAVPVASAAGVVLPGCECASVPVANSLIGRGVTPAAAFAFLLSAPAVNPVVLTATAVAFPGSPAMVLARLLASLVTAAVMGWLWLWLGREEWLRAAVRHTGHRPGHSRRTEFRLGFQHDFLHAGGFLVLGAMAAATFNVAVPRSVLDTFSGSPWLSVLFLAGLAVVLAVCSEADAFVAASLTGFSPTARLTFMVVGPMVDLKLIALQAGTFGRAFAVRFSAATTVVAVGCSVLVGGALVGGGLL

SEQ ID NO: 11974 - protein, 279 aa, Streptomyces avermitilis
VQRAGRRRAGRGWSAVKRPAQVLLLVLSGLGLLHASLFSDLCLRYVKEGVRPLLIASGALLLVLGLAAAAFDGRRADGRHARDQAHEGLEREHEGHGHEYGGHGHDHSAAPRIAWLLFLPALSLLFFAPPALGAYTASRAGDQSAVVQEQKRFDPLPATSPLPMTLTDFTARVRQDRERSIKGRDVRMTGFVTPGRQGGGWYLTRIIFTCCAADSQSVKVRMYGTAALPANTWVSVTGTWHPRGALGTRSAEAALDVRRTTRISPPVNAYTDDLPLTPS

SEQ ID NO: 11975 - protein, 240 aa, Streptomyces avermitilis
LTRRGEIACPCGRKFGGMPSRPPQLPVLPYRKPTRGRDYWIIDDVLPDVDAVRARCLAKDEWTEGHPYKPESWPGLRTMPGLEPGELARVERLVKKATGARRLWQEAAPGGGTLNHNCVQVVGRDEGEVRPHTDSRALCRYAAVLYLSPNVPKDCGTSFYRQSLPGGVLGGNMVTAPHTNLVEALGTRYVSPDAFVEDVRVPQRYNRLLLYTANMMHSATGYWGVDLEEKRMTAVFFWMA

SEQ ID NO: 11976 - protein, 229 aa, Streptomyces avermitilis
LVNRSSKPGTAAVPAGGWGRSGRETGGTPAGPKAFTEALMRVTALPYVDEHTMVVAAEAEDVWRGLGATLDRSFSGPGAAGYARLVGCADRTAGGPRPLAEGSTLPGFRVAAAAPGRELVLMGRHRFSSYALIFRLEAAGPGRTRVRAESRAAFPGPAGALYRWLVIATGGHVAGMRRLLSGVRRRSEQGDGSLGGTEEAARSRRRGAARRTMGTHGRPTPIRPEITEH

SEQ ID NO: 11977 - protein, 271 aa, Streptomyces avermitilis
MPRWRRWWCARWRKTPKGATHWSKRELARAVGISPASVLRIWHAFGLQPWRTETFKISPDPLLIDKIRDVVGLYLAPPANAAVFAVDEKPQIQALERTAPVLPMLPGVPERRSFDYVRHGTVDLFAALNTATGRVITKLSAQHRAVDFRDFLDEIDRQTEPGLAVHVICDNLSAHKAPVVHKWLLAHPRFRLHFTPTYSSWINQVERWFAELERRCLERGVFCSLDSLKAALEEWIKVWNEEARPFKWTKTADQILDRICRYCSRISEPAH

SEQ ID NO: 11978 - protein, 313 aa, Streptomyces avermitilis
VHYVDAYEQPTAPSAPAGPAQERNMSTSPSAPAAPHPHPGAPDIRLIVTDMDGTLLDGAGRLPAALWSVLAELRSRGVLFSPASGRQYATLARQFADAGQGMVFIAENGTYVVRDGVELSSDPLDSAVAARVVGATRQLVADGADVGAVVCGKKSAYVERTDAAFLAEARKYYALLRTVPDVTAVEDEIIKVAVFDFGPAERTTAPALKPFAATHQVVVSGEHWVDIMNLTADKGAAIRRLQQDLGITPAQTMVFGDYLNDLGMLDTAEWSFAMANAHPDVLRRARHMAPSHTENGVLRTITDLLRLPPLDGR

SEQ ID NO: 11979 - protein, 125 aa, Streptomyces avermitilis
MSHPDDLLVDIAALVESEQSSQMSLTVVVPGAVITGRLAPETMWKERVAEVLRDSEKLGFFSAVFTASGRGGEPPRSGARPTHLHFHVARILQGSFGIPDTGGMYRVALADVSAWTIGDIGYSDQ

SEQ ID NO: 11980 - protein, 510 aa, Streptomyces avermitilis
MNRTARTNNGSGRSRTDAGSGGSARGNRFRSQGTGGRQGAPSRSAKSGRNGRGGRPAATGGEFALPVTLTPALPAVEAFAALDMPERLLTALGAEGVTEPFPIQAATLPNSLAGRDVLGRGRTGSGKTLAFGLALLARLDGQRAEPRQPLGLVLVPTRELAQQVTDALTPYARALRLRLTTVVGGLSIGRQASALRGGAEVVVATPGRLKDLIDRDDCRLDRVAITVLDEADQMADMGFMPQVTALLDQVRPDGQRMLFSATLDRNVDLLVRRYLHDPVVHSVDPSAGAVTTMEHHLLHVHDTDKHATTTEIAARDGRVIMFLDTKHAVDRLTKNLLSVGVRASALHGGKSQSQRTRTLAQFKDGHVTVLVATNVAARGIHVDNLDLVVNVDPPSDHKDYLHRGGRTARAGESGTVVTLVLPHQRREMTRLMADAGITPQTTQVRSGEAELSRITGAQAPSGVPVTLTPPPAERPERSGSSSRGRRGRPAQARRRSSAPSSSSAKGRSSR

SEQ ID NO: 11981 - protein, 67 aa, Streptomyces avermitilis
MASGTVKWFNAEKGFGFIEQDGGGADVFAHYSNIATSGFRELQEGQKVNFDVTQGQKGPQAENIVPA

SEQ ID NO: 11982 - protein, 114 aa, Streptomyces avermitilis
MPAENSPVVDSLDDDDYPAYTMGRAAAILGTTPAFLRALGDARLITPLRSEGGHRRYSRYQLRIAARARELVDQGTPVEAACRIIILEDQLEDALRLNEEMRRSSDQPTADESS

SEQ ID NO: 11983 - protein, 60 aa, Streptomyces avermitilis
VRTYSSLLPDRRDGHGTAPAAARQDQPGTAGAGERHDHRDGGRGRFPARRRRSRTTHNER

SEQ ID NO: 11984 - protein, 157 aa, Streptomyces avermitilis
MPASAPVSSSVAQQTRAAPVRGRFRPMTSEATYRPDRAEADDRPEAHDRPEAEDRSRTEDRPHAVDRPQGVDGQPDKQGRVEVRLVSEDPAAARRVADALRLLFSGGEQRSYPAGVTGTGARLHLTLDASRAAGPLRSWLDSSRPPADRTHQGETAS

SEQ ID NO: 11985 - protein, 141 aa, Streptomyces avermitilis
MTLAPPSPGPSPTAVPGTCPTAVRVRLAVQPPHGRQARRIDGAWWPRSYDLMSELPVLLGGLPQVWGQISSVVVNGGEWSAPPGRMLVADHVVRVRRTDLPQAPPTACLLAPGRGRWDLLVVPPGASEAQARQLMADASGF

SEQ ID NO: 11986 - protein, 321 aa, Streptomyces avermitilis
MAGDTAGDTTWTAPGPGRRAVLTLGAGTMLAAALSRGGRAYAATPGGGASGARSERLYGRLRELEREHSARLGVFARDMATGRTLLYRADERFPVCSVFKTLAAAAVLRDLDHDGEFLARRIRYTEQYVKDSGYGPVTGRAENLAAGMTVAELCAAAVSDSDNAAGNLLLRELGGPTAITGFCRSIGDGRTRLDRWEPDLNSAEPWRDTDTTSPRAIGKTYARLILGDVLPPQDRTRLTNWLIANTTNTARFRAGLPADWILADKTGGGNSYGVANDVGVVWPPNRSPIVMTVLTTKHAAAGPSDSPLVARTAELLAAELT

SEQ ID NO: 11987 - protein, 383 aa, Streptomyces avermitilis
VRLTGCRAMEHLLRRLKTASPWVVDAGITLLVQIAVTMPFVIPRGPELPAATWPAYGLTALGVLPLLWRRRAPVAVLTAISGVQMLYIATLDGPGQPLPYAALIAVYTIAVLSPRRRRLAVLTVSGPLIFIGVRMNTGDVRELLFSLFCFCGAYALGRSQLRATRVEADQAAARERARIAREMHDVLSHSVALMVVQAEAGPVSVRTAPERAEAAFDAIAGTGRDAMTQLRRMLGVLREDGSGPRRPQPVLAELAALVRRVSDSGVPVAYATTGEVRPLPPDIETTAFRVVQEALTNAVKHAAPSRITARLDYGPRSLTITVTDDGRGPATGGGGTPGHGLIGVRERAAAHGGTARTGPGPGGRGFEVEVALPLVGSAPGVAQ

SEQ ID NO: 11988 - protein, 216 aa, Streptomyces avermitilis
VTISVVIADDQELVRSGFAMILDAQPDIEVVGEAGDGAAAVAAVRRTSPDVALLDIRMPGTDGIEACRQMCSSSGVRAIMLTTFDADEYVYEALHAGASGFLLKDVRRDDLVHAVRVVAAGESLVAPSVARRLIADYTRRGRRTAPVSGRLDVLTARERETLLHLAHGLSNAEIAAAMVVSEHTVKTHVGNVLSKLALRDRVQAVICAYETGLVSI

SEQ ID NO: 11989 - protein, 388 aa, Streptomyces avermitilis
MNSSTRIALCAALAFAVVTGPAASAFADAGSPAAGTSARATQGAGSLNSTALRQALAGLPDDDATAAVVRVAGQDGTWRGVGGVHDTETGREAIADGRFRAGSVTKVFTAAVVLQLVAEHRVGLDRPVQDYLKGLFPADRPPITVAQLLNHTSGIQPADGAGDSFADQYAHRFDSTTPRQLVASALSKPLEFTPGTQQDYLNINYTVLGLLIEKVTGTSYEHQVQRRILDPLHLRDTYFPGDDIRIRGAHNHGYQATADGLVDVTEWNASAGWAAGNIISSTADLERFTTALFGGKIVPRAQFRHMLEVPAGIPGAVQTMGMSRMVLPDGTVTYGKTGERYGYATGIGAILDDHGRIRRTLVYSVNSTDAKSKNGNARVLPIVQAWMS

SEQ ID NO: 11990 - protein, 130 aa, Streptomyces avermitilis
VFCRSCRPGCPEPALAPRSWTSRVPCLDQAMTSVGSPDGTRDAAELAVWFGGVSVACWFCCPFWTLVCFLALPTGLAGLVRARVEYRASTQGRASRPRAVAGGVLSLLGSVAAVAYLIFLGTHPDLPAQG

SEQ ID NO: 11991 - protein, 369 aa, Streptomyces avermitilis
MTRLIVAAGGGGDAVAAATVDAALYGDGDRAVILTYAWDRLPIDPVPGPRGPDQFTGLEAITPAVRAVPAGARPIAPAGSTLPRLAAQLPHTFALIDPHHGAEGITRQLEELVSHFAPESIDLLDVGGDILARGDEPTLRSPLADALTLAACCQVNAPVRLLVAGPGLDGELPLDDLRGLLGPLVRTLTAKDVEPIGSVLEWHPSDAAGMLAATARGVRGACEVRDAGPPVPLTDEGPTLHEVDVDEAVGRNRLARAIMETESLDEVEAHSREIRGCSEIDHERDQAARLGERPSAKPAPEAVLAELGRFEAAARSRGATHTTFRHITETLGLDGSQRDGLRHLLINSRPEQYEAPLWRITAEARTTAA

SEQ ID NO: 11992 - protein, 109 aa, Streptomyces avermitilis
MNRTRRLAALTFLVVPALGLGPAAAAYASTTTAPGAASRATCHVERESNGKYHLWGVGFTGGQKVTYSGSASGTVSTDKSGRFDIGGLSGSKWVVKTGKTTLTCAKVKH

SEQ ID NO: 11993 - protein, 563 aa, Streptomyces avermitilis
MALADEEPMTSQKHRSRPRRVALAAGAALTVAVAGAGAAPGAGAASTAAKPKLKLIAASNSVTLERWEGEPGVYLDLGTYVTVDGAPLEFKVTRKSYKDPVVAQQIIRNGTSTQKKALPAGLVKDFSGLPGFLEVSVKNAAGAVVSKSKGTFCPNNASGRLRPDAPATSHYPESCATNPFTLGSVWGVEKGWASNSSTVDYDTPVDLPTGEYTAKVSVAKKYRDLFGIPNDQPTIKVTVREQSDGGGEGMTSSRSSAHHGGAHSGHSAHSAHHYGPRGADDPTPPALSHALEDRGTAHHLGDGRGHTDGSRIAPALKPAAKRPTGRAGVPANVPKPDLRSLPAWGIAITDGEDGDVPGKDYLAFSANVWNAGPAPLVVDGFRSPGKDLMDAYQYFYDAKGKQVGYTPTGTMQWDPREGHEHWHFTDFASYRLLSADQTKQVRSGKEAFCLANTDAIDYTVKNANWHPNNTDLSTACGEQNSISVREVLDVGSGDTYTQYRPGQSFDITGLPNGTYYIQVIANPEKRLQETNLNNNVALRKVVLGGTPGARTVTVPPHDLINAP

SEQ ID NO: 11994 - protein, 395 aa, Streptomyces avermitilis
VKNIRKTGRGIAGLLTAGALSAGLLTATATTAEAATTCSGGVNIYGVLDDGRLTFSTINPATGNLAKVLVGPDLGFEPKAMATLNFNTILVTSTSGALYRVDVKTNSSNLALLNAPVKIADSGWTHDKLTYDGHGHLYGTTAAGLLLRYNVTEDKPAGSQHIGARTEIDTGFVLKTLTATGDDRLSATTEDGRLLDYTIAGAGSWKSNALKTSGWSGFNQLVSPGGGLYYGRLATGAMYWYKDANPTDGSGADISYHLDDPVNTSGWTQKLLSAQPGTYTCTTTADTVDRDNITEVKAAGRQLMNDKDSAWATSAQWNCLETLWNHESNWRWNATNPSSGAYGIPQSLPASKMDVAGDDWKENPLTQIKWGLSYIDGRYGSPCDAWAFWQANNWY

SEQ ID NO: 11995 - protein, 435 aa, Streptomyces avermitilis
MCLRPLDFHAAGDPMKLSNAVRRTSAALAVGAMSLGLVTVTGGAAQAAASCTGDVSIYGTLSDGRLTYTQIEPNTGDRTKTLIGPALGFTPKAMATLNFNTVLVTSTTGDLYRVDVQTNNTSLTVAGVVKIWDGGWTFDKMVYDGAGHLYGTVEGQLHQYVVSQAKPSGSAHIGQHVVIDTGFVLKTLAAAGDDRIIASTSGGQLYSYKIDGVGDWTRATLKSDGWSAVDSLTSPGGGLYYGRTNGGMYWYHDVDPTDGDGSDIAYHSSDPVDASGWTQSLLSAYANNCAYVPPAPSATTGEKIAKVANAQVGKDFNDFDFHYPGAWCAEFVRYVWANVGAKTSGVTPEAGSLYTYGQNNGTLHSTPKVGDAVVYGYSGGGNANHVNLVVAVDGDYVTTVGGNESDMVKKTTYNWKTNNNPLNAGDIAGFTSPVD

SEQ ID NO: 11996 - protein, 419 aa, Streptomyces avermitilis
MHVCVLGQGYVGLPLALRAAEAGHTVTGYEPDRKRCEQLAAGSSYIEDIESTRLQRVLRSGAYTASSDPKDLKGFDVAVITVPTPLTDRAPDLSCVREAGGVLAEWLEPGATVVLESTTHPGTTRDLLIPLLEEGSGLVAGQDFHVGFSPERIDPGNADWRLENTPKIVAGLTDACLRQVKAFYDSVTEVTVPASGLEEAELAKVFENTYRHVNIALVNELSRMAHTLGVDVWHTLELAATKPFGFTKFLPGPGVGGHCLPIDPVYLSHHVKARHGQTFRLIELAQDINESQPDYVVRRLQDSLSRRFRRSVHGARILALGAAYKPGTADARQSPAVQVIDRLRTMGADVTVVDPYLSDGGSREIPFAAVEDGTSVADFDAVVLLTPHGEFDLTQLAAEAAYVLDTRGVMATAPHVERL

SEQ ID NO: 11997 - protein, 439 aa, Streptomyces avermitilis
LSTSSRARFTVVTAVVVAALAAATVVVHLQSKSPILTFYWWLGTMVIVLCLVSFLKGRSFTHLPVAPGRTVAIIPAFEEPTDNLHRTVWSLLAQTHPIDEIHVIDDGSKQHPVEPFEHPRVFWHRQENKGKRGAQVTVLRHLQAEGKHFDFVLTIDSDGEPFPDALEQQLRAMSNPKIQATTGMIYIRNFEETWVSRAADIDIGTSCVMMRSSRSMLGALETTSGALALYRAELLYDHLDAYEVECGTGDDRWLALRALMRGEVVAVNEAGVITDMPTTLKKTYRQRLRWARSWWWMLPFVYSRLSLKQLISPTFGLLQLVITPVMLAWTLVMTLMTLGGRYHNPGVALVYLGVYLVVRYGQSGLYVLMRPDMTTRQRWRSWLVGTPTAVFMNIVLLCPTRYWALFKLRDNAWQSRGLTAKTALPKGRHYAEAKDLTNA

SEQ ID NO: 11998 - protein, 191 aa, Streptomyces avermitilis
VLLSDKDIRAEIDAGRVRIDPYDESMVQPSSIDVRLDRYFRVFENHRYPHIDPSVEQADLTRLVEPEGDEPFILHPGEFVLASTYEVISLPDDLASRLEGKSSLGRLGLVTHSTAGFIDPGFSGHVTLELSNLATLPIKLWPGMKIGQLCMFRLSSPAEFPYGSDRYGSRYQGQRGPTASRSFLNFHRTQV

SEQ ID NO: 11999 - protein, 169 aa, Streptomyces avermitilis
MSDVRENLTYERFGTAVRELAQAIADDGYEPDIVLSIARGGVFVAGGLAYALDCKNIHLVNVEFYTGVGTTLEMPVMLAPVPNAIDFSDKKVLITDDVADTGKTLKLVRDFCVDAVAEVRSAVIYEKSHSLVKCEYVWKRTDEWINFPWSVLPVVRKSGEPVTPSKEAI

SEQ ID NO: 12000 - protein, 262 aa, Streptomyces avermitilis
VTTSGRMRLLTDEQWARLVPCLPHNTGKAGCPFADHRRIVEGIIYRYRTAIPWRDLPREAFGPWQTVSKRPRRWAADGTWDTVLAQLTAQADSIHRVDWTVSVDSTINRAHQHATNTVRPEKDTGAATCRSKTEVPATRSEPAGHAIGRSRGGLTTKIHHAVDGNGRPLAVVVTPGQVHDAQVLPLLLGDIRVPRLGRGRPRTTPDALLADKAYSSKQVRADLAARGIRTVIPERADQQANRKRKGCSGGRLPRYGHRDLQA

SEQ ID NO: 12001 - protein, 283 aa, Streptomyces avermitilis
VPVSLPPALALSLDLLCCPTCRTRHLYLLRGALRCPVGHTFDIARHGYAGLLTGTRATSGDDTAMVQARSRFLSTGTYAPIRNVGARLAIDTAPEQATIVDVGCGTGYYLAGVLDRLPGARGLGLDTSVRALRSAARAHDRGAAVAWDVFRPFPLADGVADVVLDVFAPRNPAEFHRVLRPTGRLIVVRPTGRHLAELRDRLPAMVTIDPAKEQRLHQALDPFFEAAVTEEVEYPATLSRQDALDLVAMTPSARHVSRADLDDDGFLSDQVTVSVLATAYQPR

SEQ ID NO: 12002 - protein, 477 aa, Streptomyces avermitilis
VARRVGIYTRISRDDEGDALGVARQHRDCERLADLRSWQAVKVYEDNDVSAYKRHVVREQFELMLSDLGAGLIDGIVAYDLDRLARQPRDLERLIEIFDERPRLEFATVTNDVNLGTPDGRTMSRIMVAFANKSSHDASRRIKRKHLELAQQGKDSGGPAPYGWLKEDRSKVDPKAAAAIREAQREILAGVRIGTIRTRWQEQGLGNPRAGTKRMAHHHVEHILTSPRLVGYRTYHGEVLNDEDGRPVMGEWEAINTLEEWEAVCAAVAERKQKQPGRSLARKYMLSGIARCGLCKTKIRGQINQRWQPGSKATKFTYQCSVVNGGCGKVGRVGEPVDRLIAELALEEQRARAAATTVPIDQRWSRNAELEQVNDDITQLVNAERSKQITVTTLLQLLPGKERQRDELKLERARFYKELKQSEAKGDAANLTLDEFFGLPIERQQEIVLHRLSAVIIHPAGKGRRRFDPSLIEPVWR

SEQ ID NO: 12003 - protein, 337 aa, Streptomyces avermitilis
MSQVGSKAGPVAPGPARDSSGPGTFDYVAGFRIGRGDRDNRAPQGRPQQHPQQQPYGQQAPQGPSYGYPAAPPQQQYGGAQPYGGQQGWPQPGGGGHGEPEYFGDGGGQQGYGQGHPQSPDPYAANSPGHTQAFTVGEDPYGQGETYRAGQASAPPVGPRLHWKDLLRGIVLAPNQTFLQMRDYTMWGPALIVTFLYGLLAVFGFDGARADAINATLSNAVPIVLITAVAMVLSTFILGVVTHTLARQLGGDGAWQPTVGLSMLIMSLTDAPRLVVAMFFGGDASFVQILGWATWVAAGALLTLMVSRSHDLPWPKALGASAIQLIAILSIIKLGTF

SEQ ID NO: 12004 - protein, 171 aa, Streptomyces avermitilis
VTRRTHCETSGDPEAHRPVTPRRSRHSHRPQAAHPSRPHRETRMPAPWEYTLYIPHDPRAVGICRRALRDILTVHHLPALIEPAELLASELLGNAIRHTDGPAALKLRQSGPSFRLGAWDTDPTPPTTTQPHGETGRGLHLVDAYADDWGWFQVNGTAGKYVWCELKAVPF

SEQ ID NO: 12005 - protein, 280 aa, Streptomyces avermitilis
MPARSIVTARQQRLGAELRKLRERAGLTAREAAQAAGIAESKISMTEAGRVGVSEERVRYLASQYACDDTEYVDALVAMANERVRGWWAECRGQLPPSFLDLAELEHHAARLRSFESVHIPGLLQTEEQVRAMYAASVSGFSEEQVDARTEFRLRRQGVLDKVRYEVVIHEAALRVRVADRKVARRQLLHIVEQSERAQVTLRVVPFDLDGFTRIGNAMLIAGGPVEQLDTVLLDSAHGGTFLDAEAQLSRYRRVIDDVERAALGVVESRDFVHRLAQHT

SEQ ID NO: 12006 - protein, 61 aa, Streptomyces avermitilis
MAAVSVWQKSSFSSDEDAPNCLEVAATQGALRLRESEEPGTVVTTTATGLAALIRHIRSRR

SEQ ID NO: 12007 - protein, 478 aa, Streptomyces avermitilis
MRSTTALAALLTTALTPLSLPTPASAAPATYADDFNGDGYRDLVVGAPDATVSGKESAGAVVVLYGSASGPGTTKKLLISQNATGVEGAAEAGDGFGSSVASADLDADGYADLLVGAPYEDVTGAKTRGSVTVLWGGAQGLKGSAVLPAPSPFSDGDTKGCSYGTGVAAVNPKAAPGAAEVSVAGWCAGLRLTGPFTRAGKPARTSLRTATPSLDDAALGDLDGNGRPESVDISVGLSDHPSGGVYVNPPASSASPLSTDGDNVALGDVNGDGYGDLVVGDPGDTVIDGTPQEGTGHKGGQIAIWPGGAHGIDATAEPILIHQDTPGVPGSAESYDSFGADVSVADVNGDGYGDIAVGVPGERLGSARSAGSVILVPGRAGGPTGAGSTTITQNSTAVPGTAERGDTFGSTVRLTDLTKDGKPDLVVGAPGEDNSTGGIWVFKGTTTGPSLRNSYSVMGNAVGLPKEHYTNWSSVQSS

SEQ ID NO: 12008 - protein, 481 aa, Streptomyces avermitilis
MRSRTLLLAATLTTGLLTTLPTTPASAAPSGRSGDFNGDGYRDVAIAAPAAKAGGKAWAGQVAVVYGTASGLNPDKRTVISQNTAGIPDSAEADDGFGSQVATADLNRDGYADLVIGTPEEDSGSLESAGTVVIVWGSASGLSGGTTVKNPEPQYGSSFGLSIAAADFTGDGKPDLAVSTQSSTGSRYKIRLIRGPFTKSGSTGRVSSYSPGVDKPRLTAGKVDKNAKADLVVTGRKTNSEHLAAAAFYKGTSNGLTKGAALRAGTTAAIGDLDGDGYGDIVLGNPDEPHNEPSGSKGGEISVVYGTSTGPSGSRRTTLTQSSAGVPDSPEYGDDFGEAVAVGDLDKDGRADLAIGAPGEAFGDDAHYVSSAGAITLLRGSASGLTTTGAVFLTQDSPGVPGAVESVDSFGSQLLASDVNGDGHADLTAIAAQENDPAGAAWHLPGATGSLYSTTTATTFGPTHLGLSTAQAGAFGSDLAG

SEQ ID NO: 12009 - protein, 457 aa, Streptomyces avermitilis
MRIRPAALAALTAAALTGALLATTGSASAAPSGLVGDFNGDGFQDVAAGAPFATAGGKFDAGSVAVGYGSATGLGTRKSIDQGTSGVPGSAEEEDGFGRSTAVGDLNGDGYSDLAVGAPYEKVGDDTNGGAVVIVWGSASGLSGATTVKDPAVSQHDYWGASLAVADFTGDGKADLAVGASGTTQWIIKGGFTKAGATGAKLTYTLPFAAARLVNLTAGKVNGDGKADLVVGAGKKLGSERYLDRNFLYYGTTSAPARQLELPYGKSTAIGDLDQDGYGDIVIGETESATEGDLGSTGRSALSYGTATGVKPAVELSDGAYGRPSIGDIDGDGFPELAVGAPASGAAADYAGAVVVHRGTADGPGSVVTLTQDTAGIPGTAETNNFFGTATLLTDVTGDGHADLVVGSDTENDGNGLLTFLKGTADGVTTAGATNYSPSAFGMSTAYYPQLGMYLAG

SEQ ID NO: 12010 - protein, 481 aa, Streptomyces avermitilis
LRKRTLLLAATLTTGLLSALPGSAFAAPSGLTGDFNGDGFGDIAFAAPYAKVGDQGMAGYVAVVYGSATGLDPANRTVIDQSSAGVPGTPEAEDTFGSALAIADFDGDGYADLAVGASGEDVDSDIDGGTVAILWGGASGLAGGTTVKDPAASAHDEWGRVLTAGDFDGDGAADLASGTTASHAYVVRGGFTRSGTTGSAQRIGLPQTAKYGIDAIKAGDTNGDKKADLVLTYRTALNEDGSGDWSKGVAYLGTSGGLETSVPRGLNGGTTIAIGDIDGDGYGEIALGNVFSTEDDHTGSLGGKVTVIRGSEGGPVNGDAPMAELTQDSPGVPGADEAGDGFGSAVSIGDIDGDGYGELAVGVIFEDIDGIEDTGSTVLLKGSAAGVSPTGARTLSQASSGVPGTAEAMDYFGSDVLLKDVTGDGKADYTVSATFEGEGVGAVTAMLSDGTGISPDGDRGFGPTAFDRPATYGAFGANLIG

SEQ ID NO: 12011 - protein, 493 aa, Streptomyces avermitilis
MHKHLRLALATAAAATLTSGLLTFTAVTATAADSTTVPQADFNNDGIGDVVVSAHGAYVNGRQGAGQIVALYGSATGVSSAKRTTISQNTTGVPGTAEAGDGFGGETAYADFNDDGYDDLAVATPWEKVGTDTNGGALSILWGSASGLTGKGVDVPDPAVSSHDYWGKDLAAGDFDGDGKADLAVGSSASTIYVYKGGFSSTGTPGGRTTIKPPIVSGSGTDPYGPMSLTAGDVNGDHRTDLIVDGYETQTDYGWNTNYFVPGTASGLNVASAQALKPGIVTGIGDINGDGFGDIVSGAGWDHTTTDGTTVPDSADGGKVNITYGSASGPASTAGVTQNTGSVPGTSEKGDGFGWDLDLGDVNGDTYQDVVVSAPNEDIGGVTNTGIVTVLYGSASGINTASGTQAFAQSTAGVPGSDEKGDLFGADVKLDDVNGDGRADLLVGSYENSANGAVTYLPSSGTKITTTGSRTLSPSTSGVSTTGTPQFGALFAD

SEQ ID NO: 12012 - protein, 481 aa, Streptomyces avermitilis
VRAKKLAVAVGVAALAATGLTLPLAGSAAAVSTLKDDFNGDGYADLAVGVPDATVAGHARAGYVHVLWGGPQGPGTAGSTTLSQNTAGIPGHAEATDLFGQAVATADVDGDGYGDLLVGAPGESLTDSAHDAQGTITVVRGSASGFRTDAMLAMKGAYGDERVGGLLTTGDYDHDGDVDLALGVSGEEGGALLFRPGPLASPAATTLLDGYDFGGPGALATGDFDGNGTDDVAVTWSGMELYGTSVWSWSGGSAAESRRTGDYAVSLAAADLDGDGADDLVLGQKHDNPEADEPSPCPDESSGAVLIRFGGADGAGGASGESGRKTCLSQSSEGVPGTAEPGDAWGASVAAADLDGDGAPELVVGAPGEGVGSLKSAGSVTVLDGTGEGPLSGGVTYTQNTPGIPGTAETADRFGATLTAGPYHPGGRPDLAIGAPGENAAKGGVWYVPTTDDARPAGARALTPKALGLSGAKGFGSALAP

SEQ ID NO: 12013 - protein, 488 aa, Streptomyces avermitilis
MRTRRRPTAAAVLGCALLFTAAACASDEPSDSDRPQRPTAGKAAAHPDSGDFNGDGFDDFADIVESTSKDKEKYAATLVVVYGSREGLNTATAQRTPAGSRPFSMFMSPLLRTDLDGDGFTDLVGGRGVNETVSEPFALFGGAHGLGPARRLGLPDGFRPLAAADFDGDGSVDLLDGGHGGSGDPNSTGKGSDGLLLYGPFDRAGKPKRQAVLDLGQHGYATPATATTGDFDGDGRAEVVFTYSFDPEEDETAPADLHGVGYYEGGGRGLVRDTRQEARIGALAGTDDGLRTPVAGDADGDGLTDLLVPTQLAVAPADMPGAGGALTILYGAKSGLNTGRKETVIGGMDTADRRRVDFGSSPSVGDVDADGKPDIVVNTPGFRRHDGKVTLLPGGADGAQSLAGEQVVDARTGGLPGTPNPYYWNAFGHRPPLLDVDDDGHADAVVFGPLYEKRKGAYLVLRGTDDGFDPKKVQLFTPDAIGVPLRLK

SEQ ID NO: 12014 - protein, 142 aa, Streptomyces avermitilis
LLFHRKDAVMTGSTSMRAVLAAAALAALAVGCMPSDGGGVSAGSCDDVMEFDHRTYLSVGDVEFTVGAEAGAAGRPPCDDTGGESEEETRFDMTAYEVEGLDTGVAIAVGDSPHGARLYAMYEEDGDLPAEVQKFIGGGQKD

SEQ ID NO: 12015 - protein, 482 aa, Streptomyces avermitilis
VPSLQKEKAMMSKTRSNEKVRPKYRLGMAVAAASAAVVAGGVILPAAVASAAPMPKMPPTAPGHHAKEQKKPCGKKPGKGHKKSGKKYSCKANNRTYYFEEHCSCYYYTENDHNYYWDDHYNSYYVVQYNHKYYWDYHYDCYYVVEKHCKYYYWNTYKEYNYWEKHKDDKCYWNEKDTKNWKEENWVEKHDTDKKPGDEGPEKGPDGTKPGTEDGNGKEHEEGTEDDTGKGHEEGTEDDTGKGHEEGTEDDTGKGHEEGTEDDTGKGHEEGTEDDTGKAPDEKTEDDTGKAPDEGTEQAPDDGTGKAPDEGTEQAPDDDAGKAPDEGTQDDTGKAPDEGTEQAPDDNAGKAPEEGTEQAPDDNTGKAPEEGTEQAPDEGTEQAPEEGAEQAPDTGTEQAPDQGTEQAPEEGTEQAPDTGTEQAPDQGTEQAPEEGAEQAPDAGTEQAPDQGVADTGAGTDTGAGADQGGGADAGAGDAGAAE

SEQ ID NO: 12016 - protein, 755 aa, Streptomyces avermitilis
MQLAAIIVSLVLTVVGVALLARAIGQFVRYFKLGQPVPAGTRTDNPYQRSVTLVREFLGHTRMNRWGIVGFAHWFVAVGFLTLPPTIITAYGQLFEADWTLPVIGGFLPYELYIEFIAAMTTLGIITLMAIRLLNLPSRPGRKSRFAGSKMGQAYFVEYVILTIGLAIYVLRGLEGALHHVDHFEAAYFASYPLILAFKGLGLGTLQNLVYFTAMVKLGTTMIWMITVSLNTNMGVAWHRFLAFPNIWFKRNATGGTALGGLQPMTSGGKPIDFTDPGEDDVFGVSQVEQFSWKGLLDFSTCTECGRCQSQCPAWNTGKPLSPKLLIMSLRDHAHAKAPYLLAGGGKTMEGEEKASEEQLKDVPAAALAEAERPLIGTLEENGVIDPDVLWSCTTCGACVEQCPVDIEHVDHIVDMRRYQVMIESAFPSEAGTMLKNLEKKGNPWGLAKKQRLEWTKEVDFEIPVVGRDIEDLSEVEYLYWVGCAGALEDRAKKTTKAFAELLHIAGVKFAIMGGDEKCTGDSARRLGNEPLFQELGMENVAALNMAFGEDDEDESTKKPKSAKKIVATCPHCLNTIGNEYPQLGGDYEVIHHTQLLQHLVDEGKLVPVTPVEGIITYHDPCYLGRHNKIYTPPREIIGKVPGLRNEEMHRHKERGFCCGAGGARMWMEERIGKRINNERVDEALSLNPDIVSTACPFCLVMLTDSVNGKKNDGKAKESIQVVDVAQLLLDSVRTPLDPAGEAEAESAPEPEPVK

SEQ ID NO: 12017 - protein, 350 aa, Streptomyces avermitilis
VLYGIIAATSALLLASALAAVLRVPALRLGLVERRRGRTVSRLGGAAVVVGTVVVAGVGDWSGVARLGTGVGELLVVGAGVGALGLVADLRPVPRVVRLAGQAAAAAAVVPYDELGAGAGLFAAAWIVLVTSAFGSLDQADGVMGTVGVVTAFALGGCAAAEVMDGLAALLSVLAAALTGFLMHNWAPARTVAGRCGALFTGFVLASAAVLVHAGREPLGSAGALFALTAVATADGVLVLAGRLRGGRPGPGAGRRGLAHRLRGLGLTARGAAVVIGAASFASALVGLLIDLGWAGPGAACWVAGAAGVSVLGLLRVRVPSDRGFRMHPDRGTRPGVVPPPGASLRVRSG

SEQ ID NO: 12018 - protein, 622 aa, Streptomyces avermitilis
MARAVGIDLGTTNSVVSVLEGGEPTVITNAEGARTTPSVVAFAKNGEVLVGEVAKRQAVTNVDRTVRSVKRHMGTDWKINLDGKDFNPQQMSAFILQKLKRDAEAYLGEKVTDAVITVPAYFNDSERQATKEAGEIAGLNVLRIVNEPTAAALAYGLDKDDQTILVFDLGGGTFDVSLLEIGDGVVEVKATNGDNHLGGDDWDQRVVDYLVQQFKAGHGVDLAKDKMALQRLREAAEKAKIELSSSTETSINLPYITASAEGPLHLDEKLTRAQFQQLTADLLERCKTPFHNVIKDAGINLSEIDHVVLVGGSTRMPAVAELVKELTGGQDANKGVNPDEVVAIGAALQAGVLKGEVKDVLLLDVTPLSLGIETKGGIMTKLIERNTTIPTKRSEIFTTAEDNQPSVQIQVYQGEREIAAYNKKLGMFELTGLPPAPRGVPQIEVAFDIDANGIMHVTAKDLGTGKEQKMTVTGGSSLPKDEVDRMRQEAEQYADEDHRRREAAETRNQGEQLVYQTEKFLKDNEDKVPGEVKTEVEASIEELKAALKGESAEGDNTAEIRTATEKVAAVSQKLGQAMYADAQAAQAAGGAEGAAGGEHAKAADDDVVDAEIVDEDRKDGAA

SEQ ID NO: 12019 - protein, 221 aa, Streptomyces avermitilis
VTEETPGFDEKPDVPSGATPEDAEPKAAPSEGAAPAGDAAAAAQTAAQTAGLTAQLDQVRTALGERTADLQRLQAEYQNYRRRVERDRIAVKEIAIANLLTELLPTLDDIGRAREHGELVGGFKSVAESLETVAAKMGLQQFGKEGEPFDPTIHEALMHSYAPDVTETTCVAILQPGYRIGERTIRPARVAVAEPQPGAQTVKADEAEAADDKESGGPEEG

SEQ ID NO: 12020 - protein, 396 aa, Streptomyces avermitilis
MSTKDFIEKDYYKVLGVPKDATEAEIKKAYRKLAREFHPDANKGNAKAEERFKEISEANDILGDTKKRKEYDEARTLFGNGGFRPGPGAQGGSFNFDLGDLFGGGAQQGGGAGGGFGGGIGDVFGGLFNRGGAGPGTGTRTQPRRGQDIESEVTLSFTEAVDGATVPLRMSSQAPCKACSGTGDANGTPRVCPTCVGTGQVARGSGGGFSLTDPCPDCKGRGLIAENPCEICKGSGRAKSSRTMQVRIPAGVSDSQRIRLRGKGAPGERGGPAGDLYVVVHVDAHPVFGRKGDNLTVTVPVTFAEAALGGEVKVPTLGGPAVTLKLPPGTPNGRTMRARGKGAVRKDGTRGDLLVTVEVTVPKDVSGKARDALEAYREATAGEDPRAELFQAAKGA

SEQ ID NO: 12021 - protein, 149 aa, Streptomyces avermitilis
MDGRRRNPYELTEETPVYVISVAAQLSGLHPQTLRQYDRLGLVSPDRTAGRGRRYSARDIELLRTVQQLSQDEGINLAGIKRIIELENQVAALQSRVVELESALDGAAAMMQQREAAVHASYRRDLVPYQEVQQTSALVVWRPKRQSSD

SEQ ID NO: 12022 - protein, 378 aa, Streptomyces avermitilis
VNTRNTGMRRTRRTVIALATSTAAVSLSACGVVDGIGNASGSASPKKGNDITVGLLLPEKENSRYEKFDYPIIKEQVANLTKGKGDVAYANADQDAAKQSRQLEQMITDKVDVLLVDAVDSKAIASDIQKAKDAGIPVIAYDRLAQGPIDAYISFDNELVGQVQGRALVGALGSDAATDKVVMMNGSPTDPNAAQFKAGALSELQDKVNVAKSYDTKDWKPANAKANMMEAIQAIGLSNIAGVYSANDGMAGAIIDALKTAGVSKVPPVTGQDAELDGVQRIVAGDQYMSVYKSYPQEATAAAEMAVAKVQGRSIEFDALTRDKVDSPTDKKIPAQLVPVVALTKDNIEDTVIQDGIYKIKDICTAKYKSACSAIGLK

SEQ ID NO: 12023 - protein, 109 aa, Streptomyces avermitilis
VQPASPPPPPQPEGRPPMTETTPPVSPVAPAAAEATGAQVRVFSPNAGLIDGVPVTAPPYGDIQDIVISILQQRAQQLGAPTPAVITDDRYGGEIRLLVHPDGSTEQVG

SEQ ID NO: 12024 - protein, 584 aa, Streptomyces avermitilis
VTVPRSRAPRPLNGRTVDVRVNVVSRHCVRAPMALQMRCVRLTECFKVPRDQGSPRGTTKMRMASHTTLPAMPAPPARGPVRAYVPDAALPCRRRPDVFQHPLLENAEAVRGGTPQQRRQYLILLRTARDLCASCPLWAECLQDAVAHAEPSGYTAATTADDRRRLRLALGLGDENGDLPVREAAGPGCMSVPRRLARLRSRTSDATALRPADPALPELERVLDAFDTLQDQLASGQDLLAAGPSDTDAPESLQSHIRPGSRRSRTPRESRNEEPMAAAEAGQRIVFSLTDPAQAVRQAVLGPLIRSALPALVSVEQLAAMLLTVPGGGITPETLRDIREVRTAVTSMLPDDAPDHGGTEGTEGTEGTAGTADAAGPNGAVGAAGVAGGGTVPLALLRPLTGSVSVELAMSDPVAALRRDFLEPLLRDLLSSLANIEKVATMLAATSDRTAGPGDGADDAPLETVRAALRELTSRLPHLGSHTAPAALRPPPHPSEGGHDRRAASVPSIRAAVERAAETFPGAFSARDVLRTLPAGVYGDPAKTISNVLSAMVKSGHLQRLSRGTYTRDRGPGPADGQERAKSA

SEQ ID NO: 12025 - protein, 211 aa, Streptomyces avermitilis
VNRPRMSSSRLLRLLHQDKTDPWAVRLLPRLVFGLAAACTLFVIASSSGSNFVTLCALLLFGLAVWLLRGRGQLLLALGSTTVAAALAGYFAAAGEAARWGQGLTVSGQAVFGYWALAGMALLGAWMVREHPGRRGVTVVLADVILVITSVLGMFVPEAGVAAGFLGVVGVLAVRGGGTAVARRGVSALLTGVRRDRAAQPGAKATERADS

SEQ ID NO: 12026 - protein, 410 aa, Streptomyces avermitilis
MSQEPLPVEILDDARARQRAGDGELTPAQVKKIARQLREGIAQLPPEQYKEKLRERLREIASEQDVELPHPDTRSAFWSYKLEEHPDIGVGEDLYSMHVAAAYAEAEESVRYLEGTPGGKALGELHLWDPAVRTALKLDKDSGRELAGDAWSALSQKYATRTENEALFFMAELNPGTVAYQTEAPQLREDGKLDIIRFMYPPPSTKLEGFPPETQELLSRDAVRAQLHTFAYDEKANELTKAGYLNLDVLRSLPTPEAQRAAVLELCAGVARLDGREADVEKLTEEVLALRAEQEAAAPGVEEQEQQPQKEQAQQVPQAQEARQTQVAQEAREAQEVQEVREVREPQPTPAGHPTPAPATVSAAAATPFMPGVTVTPKQVVPAGHGVLRPTEPEQAPPAAAKAHDTDMGM

SEQ ID NO: 12027 - protein, 238 aa, Streptomyces avermitilis
MRGSASPATTPLTRRVPGGSGSDDPGPAGARGRRHGMTTLRIERTPEQLAEELKGLEHVDWPAVWAGPPSPGQALDDWCALFGWQPTSAERVLSVRSSTGQSIELSPVRSGGWAPVKQLGWTSWNLWADDPSENDEVLARAAEVWAAYEEAARTVLGEPTFSGAWDAPDFPEPPHERHWLMPRDLRLEDMDPYRLAMWPEDGPEGRITVLTVNPGLAPVPGESRGVLIEVNCYPPEAP

SEQ ID NO: 12028 - protein, 209 aa, Streptomyces avermitilis
MPALTTDRTPDQLVAELEQLVGVDWPTVWRGVPRDAGKRAHWCAGFGWRPLWFEAGLRVRTPLGGRLYLAAQAPERPVTRVEHTVWAARGRHAGENGVVAELAEAHWAAYVTALRGFMGWPSWNGTWDAPDFPELPGSAAWPSAERRRRQRDPYRLAVWRFRTPGAPLIELRTTLDQGSQARPAPANARISLACHDPAHAESPRRERLG

SEQ ID NO: 12029 - protein, 756 aa, Streptomyces avermitilis
MPPRNALRRRIGRFGAAVRAGLFVVLALVALTLAVPTSAYADFSCNFTGDESYQMDSPGSNGESIIPAVAQWQGESAQNLSEDTGMVTGAVKMPIDKASNYTLYELNGMRGLNWSMTFKGKGNASQDNGTWGSGADSCQVMAYVNNGIADTILNGTKVLTRFSISIKEMASNPSPFSGLYSGRDNVVTTLRENVLKPAVAVMILLVGLWVFTKWRKGDMREVWSGISWTALTVIAVTAFLTGNNYHQVVESADNYIAQANSAFTATVLAGASGEMQSPCDLPKGGKDDDGRRGLRLSSCAMYDTLVFRPWALGQFGDVGKTCIFKNKSGRISADGVCAPQSAGTSCYWGKGARCEDLRVRQAAAQSWTNVDDQRDHVDKFKEWQEIRKDIAVGEKAPDKSIYPVAFNDWAGKNSSNRVGIAFYSVVAAFIVGVMVLVLSALTLLWHAVTLILVMLLPLVATLGIHPSQQKLLKSWLETFIHSFVLRAGFGVILTVLLVLYQMILPARVALGTQLLMLLLVTVAVVMMLKKLLAGNFTPQVAGGEDALGIREGADATFNKAAVMAPGLAVAGARTTGRVAGNAAKGTGRAAGSTVRGTAWAVDKFANKGRGRAALQKRGWLGQSKREQRQTAHQAAETARRSYESDGPSAKEQPSASAPEPAPRRGRRVSGSSGQQPAPQSSAPAEQRPAAPQPQPAAPRPMPSAPAPAPAPQPRPTMPSPRTAAPKPPVTPKQSPAPAPAPAPASPRDPRGPSGRV

SEQ ID NO: 12030 - protein, 172 aa, Streptomyces avermitilis
MRLQRAVVGSAALVVLSLLAGCGSDDPMDDLGLPSAGDMASIAYYLNKHTSCLDLTAEADATDYLVEEAGDPAWGIKERASCEGEDGGNITLFTLKDMKKFQTAVKKDDDRPAFAVGRDFAVVPENDTTVQQLSSSEMMFLTCDPDFTVPSGYKKVSGLVDGCVLSDYFPTD

SEQ ID NO: 12031 - protein, 203 aa, Streptomyces avermitilis
MRPTPSLVTAAVSLVLLSTLSACGPDSGDDAKALPSAKTLKEAQEFIAKAGLPCTSMTTDEGAHGTPAEGFLGTTDDYDSPQEKREAAAWKIGEAGFCGDTRAKAGGWIVYLPKDMKAFQQNYRKTALAADKEYGDKYSDLRTGRFLIGADFVVNPTNSLRTSGLLETGLLIENCDPDLKVPTGYRKQDASAAGCVLTDYVPS

SEQ ID NO: 12032 - protein, 994 aa, Streptomyces avermitilis
MFMMILLGAAVAFFVVAMIMAAGSGKKGQGQSQGRSQNRSRSSSGNGQSARREDLRLPYRYADDLLFVHGDSVWTGLVLPTAIDEYLNASELQAMAEGPARGLLNLARGDRNVECHYRKLYQPITALTWAEDLNAVAWDPTDNYKAYNLRKADYQERIGAKRERNILLVKLGSIKRNGGTGVLADGAEPFDEPGLLSGARGAADQAVSTATGVADEYLSPSVLAEWTQVAIEVHESLEGLKGTPLTREELVWLIRKPLHGDLPVPPEPVLGSRAWGPDQFDLVVDFSGENRKTHIVLHQYDEVTGEQQTSYTTTLVAANWPAETRFRQSTAWARYAAQHVDFPVEIDMRFTLIPYLRFKDRADKIRGNLVDEMNDMANSGRTPDTKLAGQVTRAQELVDDIDEHKMPGMEAQIRFTVSAPDLKELERRRRVLEMQFKQDLKVTLLRPTRQQWRLLQSQLPGDAPKLPVAPYLRLQEVEQLGAGLPTAGTELGDNPEHRSGKRLGWVGNLVGWAGKMPVHYSLHVGPARNDGGGLAIVGASGGGKSSLALQKFYEESESGVRCLVIDPKTDFAQMCYYLAFGAQVNDPSFASDAEQGLLGTEHSRFHPVNPDFWAETEVVDLLKGQAGVLDPWVIARDVPSGRLLAESMLRGFLGDEDYQRVRLPVIEGMATVIGRYNSAIRQAVDQGLTAREAEQSVARPTLWQVVDEVVAAYDHAVATGDREAMKDLKLAQMLLTELRTLPYARLSFAEHPQPLSSMRKRRTVITLRGFQSPASSDPRHWNPAERLAATALMAVVELGSQMLDVGYEKNPVTGEVGLRPKALFVDEAYVVTATESGRDLMRRALKQGRSYLAVTVLITQQAIDLVQIEDSEARSGGANQIHTVFAFKQKSAQEASLVAPLLGRPEDDPKVIAALQELRTGVCLQRDADKRVGTVAVDLVFQEILAATDTNGTTRPARQGVNPPLSVWEWTFLQEVQEDPARASSQSTAQTTAV

SEQ ID NO: 12033 - protein, 165 aa, Streptomyces avermitilis
LTQEAPEPLVAYDHTDLMNRPKRIWNWGNIPLPGLLLPALGAAFGFGLLWLVTLFTLSTFLPFLGMSMWTSVLYFGPPFAVYFIWGRPLPSALTLSQQLVVWGDYWFQPKRLQGLSADQEPEELHWQVILWTPGSHRWQTRYDTARQAAAQHGSPFTAQDPAAQD

SEQ ID NO: 12034 - protein, 88 aa, Streptomyces avermitilis
MYLAADELGEMFGRIEDILRNAGTMVAVIALLILGIRMLMSMKRGDGMREAFQGFGMIALAALIIGGATGLAGLLISLGGEIGGGNGS

SEQ ID NO: 12035 - protein, 533 aa, Streptomyces avermitilis
VISRVARRATCVRRPPAGIRPPGLGTSKSRAGFAEAGVGRAPAGVAPARVVVAAEPVVVVPASTVWAGAGAVAVDGMVVVGAVAGRGRGRGDGVVRGGRRDGRGGRSGGVGGGRGGTGDRPAPLALLLLRLLLLVRGLARGPLPFALLLLGVTRRAGLTRRQARYGGLARRATDPGGGDLRARRVGGQVLRLRLGVGGLLGHRRLRLGLLPVHLLPLCLPDLLVRLLGLLGLLGRTEGPGLPGRLVSADRASRAVVVCHRVGYSSESVPRPPPRLRPRCMTGPGPARCAGSVTKTGDGTGCPFPAGSTGDSRPPGREESAGKRKDPGPGKRARPRAPARAHSAHNARGTSRPTYPRSTPWAHGSGEGRELSEHNGQPHEPDPRDWDTSRQAPEIQQAPAVLAPQVFQTDRAWVDGYEPGNPWQSRLCVETPYGTFAYPLTPHTMPELLEALVVVAQEQQGLPVGFGEEAEPVAGAGEEDEEQQGGGARLQGGRAARMTGWAVVHDLWEREDPTARIVMGAVVVGLLLLGIFLT

SEQ ID NO: 12036 - protein, 351 aa, Streptomyces avermitilis
VALRATLLITTCLFALGSCGVMGLVVGRSSGAGTAGLDAADAARYRLTEFPTQQAATFAEQYAMLCLTYSPDGASKRRDSLARYASSGVDPECGWSGEGTSKAVSAVWDGTSEKLAEYGDHGRYLGIQVRTDEGDLTTLTVPVYVKDLASGEGMRVAGDIGEMPMPGRANVPELDKDDEVVDTSLSQQLQEKVLPGYFEAWGASDSTAMARFTAPGATLSATAGLAGRLTGPKVGTAEALVPANVQDTKPYAYRAGQSVQVRVVVDWSEGESRIVRRAYRMTVVNTAQGWFIKDIRGGVLDAQGGRADSDEDNQPAEEDPGTGATDSASPSASASPSASTQSSKGKRPGKP

SEQ ID NO: 12037 - protein, 209 aa, Streptomyces avermitilis
MLTETTGRTAQDLAVELAVLRDADWAALWAGPPQSGIALERWCGRYGWEPLTSDRQLVVRTGNGGELTFDSGGIWGSPVTSVSLSACWHVKASAPAENGTVLTAAAERWPTYLEAATGALGAPVWAGPWDAPDFPEPEDHAGVWEGRESRLKHRSPYQLAFWGPLGEAPVEALFVLNQSVSFPTWTPDMPGGSTIRMAVHRPVGFRSRR

SEQ ID NO: 12038 - protein, 341 aa, Streptomyces avermitilis
VSLGSPPARDEIERALALQDAYEAAAPRDRDEARVAVGRMYADWRVAHEQGREFPDLFSFVRDVAGNGSVTHPDRGEVRAFWSWKSQPEGAPREVGHRYLAQACGSSRGMQVLEDSPAGRQLDSYHLWNTEVQRALVDDFELDEAAVTALAPEVWSTVSQRYAEAAEGPVVAFAADIGAASVLGKDELPRLLAHTNVGKENIKFPLPSPRHEHLPPEIDGLIADDAVRAQVRMDDFDPAGSPKDFARKLGGVDVPERLREDHEAAMWRLGLADTYEQLHPKPPTRQRATASEFLPGVDVRLVARPAAPRGPTGHGVMNPAAALSVPPPAAVPAHQPTGIER

SEQ ID NO: 12039 - protein, 126 aa, Streptomyces avermitilis
MTTPRTSSETQQDAAEPEFYFADVYLFVSDYLSPTVRRRINGSSATWCPKWWEHPEAGARLSALWLAWEHLRHDPALGMSTWWLHHADPHLRVLMDPDLGPFAACSPRDGHTAYPFDPLPVDERPA

SEQ ID NO: 12040 - protein, 227 aa, Streptomyces avermitilis
MELPAENKRAGLLALAVLGILLVAVLTVFTVFDGDDGGGADEAAPAGPSGQSDAGSEPGPGGQDDANADEPAGGAPTPIVALSEVAKAHTVMARYMAGLSTYDHTSKAPAWSAPLLRLTTDDTQMKQATTLPTGKEWALCRAARCSSKGAAVVVRDAVISDDVVRGSGRTISSVVKVTSAREADGKQSTESNRWLVSVKESGDGQWAVSGFDIFGLGDVGASDESGG

SEQ ID NO: 12041 - protein, 701 aa, Streptomyces avermitilis
MVAPAVLAAASKAAKVAKKAKQAGRAAAGPGGGKGGDDGKKKNGLKLWLILGSGGGLAAGAAVFLVLLLIGSMVGGVGNGAVAAACGDYADNAEAGNTGDAAATNPIMPAGKVYMPSETARNEIPPRMILAAMRGAARYKGLDWTLIVGQMYQETKYGQDKSAAPGGKNSLGYMGILQFGPPAWHDYGADGNADGTKDLYNIDDAAWAAANFLHAQHAETKPWKALQVYSGSTASNTIYPRVVLTQAARYRGVLTGDEDLIKRWYAHLKKTIDKNPGFPTLGKQSDIPEPVGNDAQPGSALSIAAASPRSWSTPALDGGDDSGVTTAMAPAAYTASTATLAGPATGLLAARKHTDGGKDWQWPLKEGTYQLGTRYHENGTMWSTGYHTGLDLVASTGTPIYAPADGKVVHAGPGGAYGNETEIQHADGVITLYAHQTTIKVSVGQQVKRGDQIGTVGATGNVTGPHLHWEVRLPGVDNPFVAGQDQGPGMVDPAAWMKGKVTASPDYGTVPGSGDKGKDAQYADCAEENGSAAVAPDGAGASGVIPDADDPVIRAVLGWAQRGIGVPYVYGAQRLQGQNPTSFDCSSFTQWAYYMASDGKIDIGTTTGTQEPYLRAHKVSLSEAQPGDVIFFRPEADGTSGHVGLVWDAKGHKIIHAPRPGKTVSFSTWDVQDKITGVYRVPIPKGTDAVEGDGTENAKGA

SEQ ID NO: 12042 - protein, 481 aa, Streptomyces avermitilis
LTKRHIWYAAGAAALSLGFAAGCGTGDDTQGAGATRSAKPRTSASATSTGPAYKGAALPALSRRPAWSLRADSSTGCAGDPARAAATSTVGDDPETCVLGDAVVVTQDLTKYPGSSSSGDEPDEYHFRARLYDAATGGVRASVDVEIPDSWPGKREHKPSAFLTVSQWTDGSPALLVVDGDVTEASGLKKESVETSYTMYSPSGRKLGSSSFQGAGRTDLTAEAGHVLLDEGSKSSTYAPIGGGDTVPVHNRAYGQQPIGSGFGYRVATGSDVWDTSGTWLVVSDRLTGKELWNTKDDVDVPADIASANDDDAKPVRIYPLSADKALLAWELSDDDPYDALLGVVDLKTGRTLAQGPKVAFGDVAGDDTADIALSPDGTTVVTRFGGGAVAWNVKTGDELWRQEDDEQDITPLALPSADVLYASVGDMRLAALNMRTKKLLSPDLAPDVSLAEDGDALQFTTDGYGVLAGQHLFVFAPGSA

SEQ ID NO: 12043 - protein, 576 aa, Streptomyces avermitilis
VTAEQQKKPRAEDDWTFEIVALVAVVLLGVGGAWLAAKLGAGFADAPGPPSNPLSFLVACVKGDYSWPGGAASAVAAGEALLLGILGLAAYRVRERLRNRPKVDGAAQHLAQGEELGKLTMKGAAATAERLGVRSKTPGVFIGRSVKGRQPLFGSYEDMHVDIWGPRTGKTTRRAIPAILDGPGAVLVTSNKRDIVDATRGPRTARGPVWVFDPQQVAQETPSWWWNPLSYVTDVAKARKMADHFASGSRDANASTDAFFDPAGQDLLANLLLAAATAKAPVTQIYTWLSNPKDDTPERILRGAGHTMSADGLSGVISAPDKQRSGIYGVAQQMASCLVNPEVNRWVTPPADPSAPEFDPHEFVRTGGTLYSLSREGRDSAGPLVTALTVAVVEAAEEYATTQRGGRLPLPLVGVLDEAANVCRWRTLPDLYSHYGSRGIILMTILQSWAQGIEVWGERGMEKLWSAANVRVYGGGVSDTRFLGDLSELAGEFELRDYQTSRSSEFGGWSGNRTVSESVRRERVLQVSDLGSMPPGRALVLASGTKPVLVETVPWWEGPYAREVQTSLKKYDPGAR

SEQ ID NO: 12044 - protein, 404 aa, Streptomyces avermitilis
VVAPRDRWRAVSRTDRSTPLRSAEDAGAKGWSQGWEMAGHGTDAHPHGADRLCEAGDRVYSRAVRRGRVPREDAETVPCLVDLALLHPDPDDMAWLVPTSPQEVMTRLLRSVHDEVGASQARVGAAVAAVEWYAGLGGREQAPQEGVAIRVLDGLPRIRAAMDEATQACTSEVLTVQPGGIRREDELAEGLHRALELRRRGVRMRDLYTHVARHGQGLHTYMELMGDAAEARTLDEVVERLILFDRKVAFIPASADRTIALELRHPALVSYLVTVFERLWRLAIPLAAPLPETGIDGITHRERSIAALLAEGHQDAVVAERLGISVRTCRAHIARLSETLGAASRTQLGVRIAQAGLDGPPRSPELPPATRAAGSTNAAGPANPAGAASAAGAASAPRGSRTAR

SEQ ID NO: 12045 - protein, 327 aa, Streptomyces avermitilis
LATNGAQAEHPHAVTELCDEGGLLYANALRTGRIAREDAAGVPCLMEFALLHPDPDDPNWLRPVPPSVALAQRLNPIEREITERRRLSIELADAFEPFMAVSAQATVSTHSITVLEGFERINAALNLATDQCRTEMLTVQPGGRRPEHSLIQGLERDRPLIERGVRIRTLYQHTARYSPETLAYVDQIADGKVEIRTIDELVERLIICDEAVAFIPTRDDRQVALELRHPGLVRYLIKVFEFMWGRAVPLDAGAPYETAADGITDIQHSIAKLLVEGHVDEAIARRLGMNVRTCRAHIAKLATALGSGSRAQLGFLIAQSGILNQNG

SEQ ID NO: 12046 - protein, 111 aa, Streptomyces avermitilis
MTTPPDDRTFRREMATAYRSGWHFIDLVTAIPQGGDSLMVTVFGEPVVVTRDEDEDVRAYRCLRRPRGAPQPVRCAVRYGMIFVNLDQRDHQLVEPETPDVRTISATPRSA

SEQ ID NO: 12047 - protein, 138 aa, Streptomyces avermitilis
MATYPVNPRDPDPAYLDFWRERHLCTLTTLRPDGTPHVVPVGVTYDPEAGLARVITNKSSTKVANVLAAAGPEGARAAVCQVDGRRWATLEGRACVRTEPARIAEAERRYAERYTREPSPNPSRVVIEIELTSAMGRG

SEQ ID NO: 12048 - protein, 870 aa, Streptomyces avermitilis
VDAELTNRSRDAINAATNRAVSEGHPDLTPAHLLLALLGGKDNENITDLLAAVDADQAAVRAGTERVLAKLPSVTGSTVAPPQPNRELLAVVADASQRAQDLGDDFLSTEHLLIGIAANGGAAGDVLSQQGASAKKLLEAFQKTRGGRRVTTPDPEGQYKALEKFGTDFTAAARDGKLDPVIGRDQEIRRVVQVLSRRTKNNPVLIGEPGVGKTAVVEGLAQRIVKGDVPESLKNKRLVALDLGAMVAGAKYRGEFEERLKTVLAEIKDSDGQIITFIDELHTVVGAGAGGDSAMDAGNMLKPMLARGELRMVGATTLDEYRERIEKDPALERRFQQVLVAEPSVEDTIAILRGLKGRYEAHHKVQIADSALVAAAALSDRYITSRFLPDKAIDLVDEAASRLRMEIDSSPVEIDELQRQVDRLKMEELAIGKETDAASRERLEKLRRDLADKEEELRGLTARWEKEKQSLNRVGELKEKLDELRGQAERAQRDGDFDTASKLLYGEIPALERDLEEASEAEEEAARDTMVKEEVGPDDIADVVGSWTGIPAGRLLEGETQKLLRMEEELGHRLIGQSEAVQAVSDAVRRTRAGIADPDRPTGSFLFLGPTGVGKTELAKALADFLFDDERAMVRIDMSEYGEKHTVARLVGAPPGYVGYEEGGQLTEAVRRRPYSVVLLDEVEKAHPEVFDILLQVLDDGRLTDGQGRTVDFRNTILILTSNLGSQFLSGHGPAEPQTSEEEKKRQVLEVVRASFKPEFLNRLDDLVVFSALNRQELERIAKLQIDRLAQRLAQRRLRLEVTDAALAWLAEEGNDPAYGARPLRRLVQTAIGDRLAKEILAGEVKDGDTVRVDAFGEGLIVGPATGKTL

SEQ ID NO: 12049 - protein, 175 aa, Streptomyces avermitilis
VSIDPSSIPNFGGQPEPEPQGPAGPVVPDQDLVKQLLDQMELKHLVDEEGDLVAPWEQFRTYFMFRGEDDQAVFSVRTFYDRPHQIDQKAALLESIDDWNRRTLWPKVYSHTHDDGTVRLIGEAQMLIGTGVSLEHFVSSTVSWVRAAIEFDKWLVEQLGLEQDVNEAEKPEDDE

SEQ ID NO: 12050 - protein, 403 aa, Streptomyces avermitilis
VTHAFTIPAPSVEDPEGPPGGGARRTGAARRLPTTAAAALGLFAAARLCGFLVLAAVAWASGKSPLRLLGHSWDSVWYLRIAAHGYVGPQYVRPAVVRSDTAFFPLYPGLLRSVSEVTPLSLETAGLLVSWIAAAVAAYGIYLIGNRLYGRAIATALVLLWGLLPHSVVLSMAYTEPVLTAFAAWSLYAVLTGRWVWAGVLAACAGLARPNGCAVAAAVLVTAAYEIWRSRGRGVSHRLWTGAALAPLGWCGYVGWAGHRQGDLLGGYFTVQRLWGSRFDLGYGSLLFVKRLLLHGGRFVFPISLLLVAVAVLLFALLIADRTPLPLLVHSGVLLLVALGGAGFFQCKPRFLLPAFPLLIPLARALVRTARARPSHAVLVVGALAGLSFAYGAYLVAFARTPL

SEQ ID NO: 12051 - protein, 398 aa, Streptomyces avermitilis
MAAMTSSARPLLNRRLAEFGTTIFAEMSALAMSTGAINLGQGFPDTDGPEEIREAAVRALRDGRGNQYPPGPGVPELRTAIAAHQQRRYGLTYDPDTEVLVTAGATEAIAATLLALLEPGDEVIAFEPYYDSYAACIAMAGGTRVPVTLRPHPEDGRFRLDLDELRDAVTDRTRLLLVNTPHNPTGTVLTREELTAIAELAVERDLLVVTDEVYEHLVFDDAEHLPLATFPGMRERTVSISSAGKTFSFTGWKVGWVTGAPGLVTAVRSAKQFLTYVASGPFQYAVAEALALPDTYFEAFRADMLAKRDLLAAGLTAAGFEVFRPAGTYFITTDIRPLGERDGFAFCRALPERAGVVAIPNAVFYDHREAGAPFVRFAFCKRTDVLEEAAKRLGTLRG

SEQ ID NO: 12052 - protein, 172 aa, Streptomyces avermitilis
MLTTLNTSYTDTCAADLAWTLGREPLPALATLDLELAGAKLQMRLLGASHQVLLEEKRGNCSETVACISGSSTPLPLGVAKRVGDWEYEFAARVEVLSPGSFAGRAQELLALVSDHPHGLAGVFPGSPHAFTALLAQHHEGQVHWRTWHAYPQDGQLVATRTRVGARVRATS

SEQ ID NO: 12053 - protein, 548 aa, Streptomyces avermitilis
VIEPHAPAPPGAAPPWGGQSRPWLPVRPGVGRFFVLAGVFVCAACGLVYELELVALASYLIGDSVTQASVVLSVMVFAMGIGSLAAKRLRPHAAAGFGAIEAALALVGGSSAMALYAVFAWTGDWGGVWAGGPRCLLVAFSLAIGLLIGAEVPLLMELIQRIRRQDAGGAVADLFAADYVGALVGGLAFPFLLLPLLGQLEGVLLTGTVNALAGGALVLGLFRRDLTRRGRWLLIVVNLVVLGLLATAAVLVDDFERAARQAVYGRDVRVALQTGVQEVVLTGGTRGRPLDLFLDGRLRVSGHDERRYHEALVHPAMSDGRHARVLVLGGGDGLAAREVLRYADVARVDVVELDAGVVRLARRDPALSSLNAHAYDDPRVHVVTADAFCRLRHTRSAYDVVISDLPDPGITASTKLYSQEFYGLVSRVLAPGGRLVVHAGPVASRPRAYWTVEATVRAAGLRTVPYRVGGRDTGFAAGPDRSTDASRAPRDWGFVLASRTGPALSLGPGGPRLRTLTRASLAADALDPGRARPPDVAPSTLVHPRYAD

SEQ ID NO: 12054 - protein, 310 aa, Streptomyces avermitilis
VRSGPCWVGSADMEHEVFVPVPAERLRETLADPARVARAVPGLQQDAGTPPVAGRLKVRVGGHTITYRGALRIASQEDGSFAVEGDATEARGGGSVKLALTLRLRPAQDGTTLAFDGTATADGRVAELPPETVTSATTRLLTRFAENVATATATASPEAEAEAEAEAPEPAGSEVTSDPEPVPEAEPAPQAEAEPAPQAEAEAPASPPSSPEEFDEEDDLVAEGFVGEGEPPTDGFVGESGPPAEAAHARRTMIGRSAEEVDHAPPRGRYAPVPAPETTTAGATLRWAAPAAALVVASAIVVGRVLRRRR

SEQ ID NO: 12055 - protein, 262 aa, Streptomyces avermitilis
VSNDEITLTAGDAEVALVPGSGGRVRSLRVGGVELLRQGERYGCFPMVPWCGRIRDGKFRNGATLHQMPLNSPPHAIHGTARDGAWRVARTGKNEAVLTYDLVEPWPYPGRVTQIAALTEDSLTLTMSVEAYDSSFPAQIGWHPWFNRNLGQDDARVDFTPAWQEERGADHLPTGNRVAPLPGPWDDCFGMPDGVHVTLSWPGQLELTVASREEWVVVYDEQPEAVCVEPQTGPPDGLNTRPRLVTPIEPLEATTTWTWRTL

SEQ ID NO: 12056 - protein, 182 aa, Streptomyces avermitilis
MDDVRGALLQQIKDKAVVHGKVTLSSGLEADYYVDLRRITLDGEAAPLVGQVLLDLTADLDFDAVGGLTMGADPVAAAMLHAAAARGRRLDAFVVRKAAKAHGLQRRVEGPEIKGRRVLVVEDTSTTGGSPLTAVEAVREAGAEVVGVATIVDRATGAAEKIEAGAGVPYRFAYDKDELGLD

SEQ ID NO: 12057 - protein, 340 aa, Streptomyces avermitilis
MPIATPEVYNEMLDRAKAGKFAYPAINVTSTQTLHAALRGFAEAESDGIVQISTGGAEFLGGQYKKDMVTGAVALAEFAHIVAEKYPVTVALHTDHCPKDKLDGYVRPLLAISEERVKAGRNPLFQSHMWDGSAETLADNLAIAQELLEKARAAKIILEVEITPTGGEEDGVTHEINDSLYTTVEDAIRTAEALGLGEKGRYLLAASFGNVHGVYKPGNVVLRPELLKELNEGVAAKFGKADPFDFVFHGGSGSTEAEIRTALENGVVKMNIDTDTQYAFTRPVADHMFRNYDGVLKVDGEVGDKKTYDPRTWGKLAEASMAKRVTEACANLRSTGTKIK

SEQ ID NO: 12058 - protein, 529 aa, Streptomyces avermitilis
MAASAQDLPAVRIATPSGKWILLTTVLGSSMAMLDSTVVNVALPRIGRDLNADLAALQWTVNAYMLTLAGLILLGGALGDRFGRRKIFVLGVIWFATASLLCGLAPNAGVLVAARALQGIGGALLTPGSLALIQASFHPDDRARAVGLWSGFGGIGAAVGPFLGGWLVDGPGWRWVFLLNVPVALLCAPVALRHVPESKDDRIHGRGFDVLGAALGALSLALVTYALIEAPTGSPAVAVTAVAGVAAGVAFVYVEKRRPDPMMPLDIFASRQFTAVNLVTLCVYAAFGGFFFLTALQLQVVAGYSALGAGTALLPTTVMMLFLSARSGELGQRIGPRIPLTVGPLLCATAMLLMLRVGPHASYLTDVLPALLVMGLGMVTLVAPLTATVLASVDSGRAGLASGINNAAARAAGLIAVAALPLLAGMGPEAYRSAEQFNDAFRRAMPLCAGVLVLGAVLAFTSVRRPAPDCRRPECHTHGALTAPPLEPGRPLPTAASGAGSSAGSGAGSSPGSSAPSSPGPDTPSPSGD

SEQ ID NO: 12059 - protein, 137 aa, Streptomyces avermitilis
MTIHGNLLGGPPPTHLPDDPEPRELLASGTAPADVAAKYPTSSLAWAQLADEAFERGSVVESYAYARTGYHRGLDALRRSGWKGHGPVPWEHEPNRGFLRALHGLARAAQAIGEQAEYERCTQFLQDSSPAAAQTLG

SEQ ID NO: 12060 - protein, 281 aa, Streptomyces avermitilis
MSHQAQPAEASEPETPHLDFAGTTPYEDYVQADVLTHLQHTLSDDPGEMVFLVTTQVMELWFTVIVHEWETAANALRGDDIPVAVAALKRSVRELEALNASWRPLSQLTPAQFNSYRSALGEGSGFQSAMYRRMEFLLGEKAASMLVPHRGAPRVHAELEKALHEPSLYDEVLRLLSRRGYGVPRAVLERDVSLRYEPSPEVEAVWTSLYSGKPDDELARLGEALTDVAELVWRWRNDHLVATRRAMGAKTGTGGSAGVAWLEKRAQKNVFPELWTARSHV

SEQ ID NO: 12061 - protein, 394 aa, Streptomyces avermitilis
MSELAVRAEKSDAADELAGLRERFVLDEAVYLDGNSLGALPAAVPGRLDDVVRRQWGSLRIRSWDESGWWTAPERIGDRIAPLVGAAAGQIVVGDSTSVNVFKALVGAVRLAGEGRDEILVDATTFPTDGYIAQSAARMTGCELRPVAPDEVADALGPRTAAVLLNHVDYRTGRLHDLPSLTAAIHAAGALAVWDLCHSAGALPVGLDAHGVDLAVGCTYKYLNGGPGAPAYLYVRRDLQDRFDSPLPGWNSHAEPFGMRTAYEPAAGAVRGRVGTPDILSMLALEAALEVWDGVSVEAVRAKSLALTDFFLECVGAYVPEGVVESLTPAAHAERGSQVALRCRDAGAVMKRLVERGVVGDFRSPDILRFGFTPLYVGFADVERAARVLAETVG

SEQ ID NO: 12062 - protein, 117 aa, Streptomyces avermitilis
MAHGDDNRVYANDNRGTLYAHNGSVTHNADPRAADDARELLRRLEELQGLLAQHAAALPDARRLRDVARELGNQLQDPQPSRTVVRSLLDSLTAGAGGVTAVLTAVNGLSQFVSRFL

SEQ ID NO: 12063 - protein, 653 aa, Streptomyces avermitilis
VVGNGGGPPYLVAAVPPQLAGTTWELTRASHIVGRLGDIRLAPSDVSKRHAELRLGSDGVWLSDLGSRNGVLHNGRRLDPGRPVRLSEGDHLHFGSVQLVFRSNAPQAPGAAGRTPHGHDREHDTSTVTDLGDARRRRFAGRHGPDPDLPPPPPRHAPPPPVEDDARSMTTRHLAAATQFDPWFADLVVHQVVDEPYRALAPVFGADLGTVTRWALSARRRRLTRDAALCALLCCLVALLGLGARGNVDAIKAADLGGWWRPYAAGALLLLALAWLVLGVDVWVTEYLVLRRRLAPQHYDPAQAPDALSGRVRDRLATVAERPAGNLVVCSDYWPFAGSGDQIEEWDRPVDIRKGSPREDGGRRRPQPFTKDELYEVLIAAACRLGLANLRVEERLFVGGNDVARDPRLLPDRFQPPLTRIPPHLIRGMPDGLGAARRSYVSIEVPAWSGQLVLTMFLRAVQVQGTLYLEFSAYALLPMRPEYYAVDNLPHRTAAGAAVRALAAALPWTPRALLGSPGALARRAAASRAAAAGRRRQRRTIGGGYRFDYGAQLSIREFARGLDEGHYFLGRDLSRVLNTTQQHLLNTIGDFLEAKGIDSDDFQRFQQNVVQNFGDDNRVYANNNRGTMYAHNKRVRHPQGGKGQAPGPSAQRG

SEQ ID NO: 12064 - protein, 201 aa, Streptomyces avermitilis
MSAEPGTVRPGGRTARVRAAVLRAAGDVLAEQGFAHLDLADVARRAEVGKTTVYRRWGSVTGLVADLLDDMAEQSLPRAETGSVREDLRANAHLVQRTLADARQGALFRAVIAAATCDARTAESLRRFYEVRVAEWAPCVERGVERGELPVGTDAATVVRAVSAPLYYALLTTGTAPEPADADRAADAALAAARAEAYVVG

SEQ ID NO: 12065 - protein, 339 aa, Streptomyces avermitilis
MPDDAAPRDAAEPRDGAEREVAKRAAAEEASVFSHPPVEPDSTASYGAHPDQVIDFYAPRGVEPEAPEVPGAAAGSGVPGALAPLVVVLHGGAWRAPYDRRHVTPFAGFLARRGFAVANVEYRRGADPVPARGGADVPTEGGAAAAQGGAGPVAGRWPDTFDDVAAALDALPALVREALPQADLRRTVITGHSAGGHLALWAAARHVLPAGSPWRTESPAPLRGVVALAPIADFGVARKLDVCGGAATQLLGGEAAFTDRRPHADPALLLPTGIATTLVQGRTDIVVPHAVAEAYADAAAKAGEVVGLTLLEGVGHFPLIDPAADACAVVAEEIAQLGW

SEQ ID NO: 12066 - protein, 363 aa, Streptomyces avermitilis
VRDGGRGGIRVRDRGRGGVRDRGRRGVRDRGRGRSSGRGFGRLRRTLLAVLIAGAVVVPVSAAAAHPEIPAPAPATLAPVTAATLEATYAANRANAAEASRMAGAHGDHARAAADRSMAAPSRDFLTFDGRGRGRAVEVFGDLATADRVAVLVPGSDTTLDTYGRFRAGALALHQRTGPRTAVIAWLGYETPRTISTIALTATRAKEAAPQLRGLISELRDLHELSENRGLNPSSHPAPHISLLCHSYGTVVCARAAGDLDVDDIALLGSPGTGADSAAALHTPARVWASRGADDWVEDVPHTHADLFGTTVGFGTDPVSPSFGAHVFAAGDGGHSDYFRPGSVSLDNLARIVLGDTSEVTRA

SEQ ID NO: 12067 - protein, 431 aa, Streptomyces avermitilis
VHRPTLRQDVRTDVRTDGRVDMKDGARTAARTAVRAIATGIRDGARRVDTATPAHRDRAVDTLRAFAILGVVLGHWLVTALVADGGTLHTASPLQHMPWLAPISWVFQTLAVFFLVGGHVATKGYASARARGTTYGRWLRSRLARLFKPVAAVLTLWTLAVGGLLAAGADFGTVHTLVKLALSPLWFLLVFAGLTAATPLLTRLNPLWPLAVVLHVDLIRFGLGGPSWLGWVNVAAGWLVPYTLGAAWTRGELDRRRAGWVLLAGGAAATAGLVAWAGYPASMVGVPGAAVSNLDPPTTAAVTFGLAQCGLALLLRAPLRRITRRPLAWAAVALVNLSAMTIFLWHQTAMMATTATGLLAGRLPGLHTTPAGLSWVAARLLWLPAFVLVLAVCWAAFRVYEQGGRRSGGRRSQVVLVHNSGRTQAQATDRA

SEQ ID NO: 12068 - protein, 484 aa, Streptomyces avermitilis
VDEARQADPGSGPPPPSASPLSASTALRRPHDYFRALRADLWTVAADPLPPLSRPRRLRWLPHVLVCVVALTLALAGTEEIRTGYHLASGLSRVLGFLQGGAVVLALRRPVPAWWLSLAVTAVSAEAARIAQDGVAYGVSVLPSPSPVSSIRPSWPWTSQGIMACAFVLFLLALRVPVRASIGVLALTTLVTYFLQGIQGATAYSPTGLLAVLVFATVVLVGAALRGRREARTQLVEQASLTAEERARRTVLEERSRIARELHDVVAHHMSVISIQAQVAPHLVENPSEELRENLAGIRQNALEALTELRRVLGVLRSEDPQDPYGIGSGTGDAPDSPQPTLARLDALVENTRAAGLTVLTEISGDARPLPPGVELSAYRIIQEALSNALRHAPGSTVRVELTHFPRGVQVRVINSRPQRPVPPSPGAGHGLLGMRERAAMLGGTLVTSETSCGGYAVAAFLPRSRDQGPATGDDLPHPPGPRD

SEQ ID NO: 12069 - protein, 224 aa, Streptomyces avermitilis
MTSSAIRVLIADDQMMVRQGFTVLLNTQPDIEVVGQAVDGLDAIAKVAELAPDVVLMDIRMPELGGIQATGRIAVDFPQVKVLVLTTFDLDEHVYDALRAGASGFLLKDASADQLAEAVRVVAAGDALLAPGITRRLIAEFSRLDTTPRAPLKVRVGELTERETEVLALIAQGMSNAEIADRLVVAEQTVKTHVGRILVKLSLRDRTQAAVFAYESGLVRPAGY

SEQ ID NO: 12070 - protein, 459 aa, Streptomyces avermitilis
VTTTTPGSAYLFHVTETTQMQMTPPGGGATQRSPEFRLAVDALRGLRQDLIHDAFAYRPLPRIRVDGPRIRRLPEGIREYASWTPHGMVAAAGLLSMAIGVSSAEGSGTSLLFGLLALLPVLLTLVRPLGAFWFSMAATAVVGVFADMWDDWPWLPSSFAAHLTVLTVVALRTRPRIAAWMWFLTAVYGIFAETLFGSGHYGTNTLPLLFVSALALLAITVLHTRRAAKQEVTAQQSETAHERSKRTLLEERTTIARELHDVVAHHMSVVAIQAEAAPYRVENPPEELEKAFATIRENAVAALTELRRVLGVVRAEDYEAPDAPQPTLADLDALLANVREAGLTVDKAVTGAVRELPQGVELSAYRIVQEALSNTLRHAPGATARVEIGYVLGGLGLRIVNGRAPGLTLVKSTHGAGHGITGMRERVSMLNGEMTADETEDGGYEVTVFLPVSMLEDSP

SEQ ID NO: 12071 - protein, 224 aa, Streptomyces avermitilis
VTSDAIRVLIADDQMMVREGFSVLLGAMPDIEVVGEAVNGREAVERVRELAPDIVLMDIRMPEMNGIEATREIVAAGGAAKVLVLTTFDLDEYVYQALRAGASGFLLKDASARQLADGVRVVAAGEALLAPSVTKRLITEFSRLAETPRLSASVHAAYGELTERETEVLVLIAQGLSNAEIAGRLVVAESTIKTHVSRILVKLGLRDRTQAAVFAYEARLVTPG

SEQ ID NO: 12072 - protein, 61 aa, Streptomyces avermitilis
MNWRKSTYSGGGQGDTCVEIAALHPRIAIRDSKAPTRATLSFPTASFTALIEHLKERKPAP

SEQ ID NO: 12073 - protein, 405 aa, Streptomyces avermitilis
MAAAFDLAFDPWDPAFLADPYPAYADLRAKGRVHYYEPTNQWLVPHHADVSALLRDRRLGRAYQHRYTHEDFGRTAPPAEHEPFHTLNDHGMLDLEPPDHTRIRRLVSKAFTPRTVEQLKPYVAKLAGELVDRLVAAGGGDLLADVAEPLPVAVIAEMLGIPESDRAPLRPWSADICGMYELNPPKDVAAKAVRASVEFSDYLRELIAERRKEPGDDLISGLIAAHDEGDRLTEQEMISTCVLLLNAGHEATVNATVNGWYALFRNPDQLAALRADHSLVPAAVEELMRYDTPLQLFERWVLDEIEIDGTTVPRGAEIAMLFGSANHDPEVFRNPEKLDLTREDNPHISFSAGIHYCIGAPLARIELAASMTALLEKAPTLGLVAEPKRKPNFVIRGLEGLSVAV

SEQ ID NO: 12074 - protein, 534 aa, Streptomyces avermitilis
MTATTSAVRSKGTHQLAGTATLLRFDLRRDRATIPIWIGINALMVLSMPNTLKNLYGTQAQRDDLMHQMATNSSLRALVGPVFDDSLGALTAWRVGVYAGALAAVTSLLVVVRHTRDEEESGRQELVASGMVGRRASLTAALLTAAVAHAVLALLVAAGLAGHGVFGAVAFGLGIAGVGMVFATMAAIVAQLTESARLARGLTAGVLGAAFVLRAAGDSATDDGSSVLTWLSPIGWLENLRPYADERWWVLALFVAASLIQGAVAYELAGRRDIGMSFLPTRPGPAVGRLGTAGALAWRLQRGSVFGWSVGFFLAGVAYGGMTDGAADLVGDNENAREIFERMGGQSGITDAFLASMVGMLGLVAALYVVASVLRLNGEETSGRAEPVLANAVGRLRWAAGHLTIAFGGSVLIMLLAGLGFAVGYGKEAGPILGACLVQVAGVWVIGGAAVLLFGVLPRAAGAAWGVAGAVLLIGWVGPALDAPQAVLDVSPFGHLPKLPGGAMNWPPVLILLGLSAVLVAAGLTGLRRRDLTT

SEQ ID NO: 12075 - protein, 304 aa, Streptomyces avermitilis
MTKAHPAIGVSGLHKSFGRTHALDGLDLEVESGEVHGFLGPNGAGKSTTIRVLLGLLRADSGTVRLLGRDPWTDAVELHRRIAYVPGDVTLWRNLSGGEVIDLYGRLRGGLDRARRAELTERFELDPTKKGRTYSKGNRQKVALVAAFASDVDLLILDEPTSGLDPLMEEVFQRCVEEERDRGRTVLLSSHILSEVEELCDRVSIIRQGRTVESGSLAELRHLTRTSVTAELAGPPNGLAHLPGVHDLDVQGHRIRLQVDTDKLDAVLRSLSESGVRSLTSTPPTLEELFLRHYQEEQPEVAAR

SEQ ID NO: 12076 - protein, 136 aa, Streptomyces avermitilis
MQRMPARVFAALLASDSGTLTSAELGEQLQVSPAAVSGAVRYLAQQHMVSREREPGSRRERYRVHSDQWYELLTNREAVLKRWEHALREGVDSLGAGSPAGRRLSETLAFFEFLDGEIASMMDRWRLHREERFGQG

SEQ ID NO: 12077 - protein, 500 aa, Streptomyces avermitilis
VAPEAAGASAEPGGAVHRLKPNAIGLLGVVFMAVATAAPITAMTGNVPFMVSSGNGIGAPASYLVAMVVLAIFAVGFTSMAKHITSTGAFYGFISYGLGRTAGLASGLLATFAYVVFEPALIGIFSSFATTTLKDQTGLDIPWWLFALLMLAVNATGTWFGVSVAEKLLVVLLATEVTVLAAMAVSVAVHGGGPHGFTFGPVNPVNAFKGTSAGLGLFFAFWSWVGFESTAMYGEESRDPKKIIPKATMISVLGVGVFYVFVSWMAITGNGETEAVRAASSANPLALFFNPTEHYVGHWAVVVMQWLMITGSLACGMAFHNCAARYMYALGREGVLPSLQRTVGRTHPEHGSPHIAGLVQTVVSAVLLGAFWAVGKDPYSGTYVLLAILGTMAILVVQAVCSFAVLAYFRKNHPESRHWFRTFTAPLIGGLAMLAVVVLLVSNMGVAAGPESGALILRATPWIVALIAVGGVGYAQYLKRRAPERYALLGRTVLEETKER

SEQ ID NO: 12078 - protein, 464 aa, Streptomyces avermitilis
MSTYTARLGGRTHSFPSLAALLAAASPERSGDRLAGLAADSAEARVAARWALAEVPLARFLAEPVIPYEDDDVTRLIVDTHDARAFAPVAGLCVGEFREWLLSDAADAGSLAALAPGLTPEMVAAVSKLMGNADLVAVARKARVVTAFRSTIGLPGRLATRLQPNHPTDDPAGVAAALLDGLLLGSGDAVIGINPATDSPKAVRDLLELLDGVIRRYAIPTQSCVLCHVTTSIDLMERGAPVDLVFQSIAGTQAANASFGVTLGLLDEAYDAARGLGRGTAGQNALYFETGQGSALSANAHHGVDQQTVEARAYAVARRYDPLLVNTVVGFIGPEYLYDGRQILRAALEDHFCGKLLGLPMGLDICYTNHADADDDDIATMLTMLGVAGASFVICTPGGDDIMLNYQSASYHDALYLREVLGLRPAPEFEDWLSRIGLLDDAGAIRDVTGTAHPLTAIGRELAA

SEQ ID NO: 12079 - protein, 262 aa, Streptomyces avermitilis
MTNRPPAAYEGESDRAMWAALRRHTQARIGLGRAGSALPTRHRLELQAAHAAARDAVHTPFAPDVVAAALTGFPTIRVRSAAPDRLGYLQRPDLGRRLDAADRAHLPRDDWDVVFVVADGLSSRAVHEHAAAMVHATTALLPADLRVAPVVLAEQARVALGDDIAHAMGARMTVVLVGERPGMSAADSLGAYLTYAPRPGTTTDADRNCLSNIRPPLGLAYATAAARLTALMKRAHELGRTGVDLKDESTESAEAPALTPTT

SEQ ID NO: 12080 - protein, 285 aa, Streptomyces avermitilis
MTEVATSDQLLVVIDPVARHSDGESVRIAKDVLSAGASTKVCLPEGPEEFARALARRGSRRPVVVGDDRALLRAVAHLHRQRELGACALSLVPVGRTLSLARSLGVPTGAVAAARTVLDGAEQWLDLLVDDSDGVVLGDLRIPWARGTAELAAEGVVPGPALAHPWLRTCQSLVRTLATRPSRLASAPPGPGPSRLRIEVDGVTLVDLDQPVAGVSVTPGASGGAWVEVRPVSVGAEVAPLRAAGRRVTVSGADFRYRADAAVGGPVRTRTWTLRERAWGLVLPG

SEQ ID NO: 12081 - protein, 427 aa, Streptomyces avermitilis
VPALVLLGAQWGDEGKGKATDLLGGSVDYVVRYQGGNNAGHTVVVGDQKYALHLLPSGILTPECTPVIGNGVVVDPSVLFSELNGLNERGVDTSKLLISGNAHIITPYNVTVDKVTERFLGKRKIGTTGRGIGPTYADKINRVGIRIQDLYDESILTQKVEAALDGKNQLLTKVFNRRAIEAGQVVEELLTYADRLKPYVADTVLVLNKALDDDKVVLFEGGQGTLLDIDHGTYPFVTSSNPTAGGACTGSGVGPTKISRVIGILKAYTTRVGAGPFPTELLDEDGEALRRIGGERGVTTGRDRRCGWFDAVIARYATRVNGLTDFFLTKLDVLTGWEQIPVCVAYEIDGKRVEELPYSQTDFHHAKPIYENLPGWSEDITKAKTFEDLPKNAQAYVRALEEMSGAPISAIGVGPGRDETIEINSFI

SEQ ID NO: 12082 - protein, 216 aa, Streptomyces avermitilis
LACDLWLVPLVDVLCHTPDNPFAEELALYDKVLGEAGLPPVPVYQYMPGLTGEVAPVAGFDYDALHFLRRAYLLQMCGLAVTPVDELGGDYEQLLEMFETNAQQSHLVWHYDHAGAYVPVDFPHPLSSDELLAGGGPLGSSQTLLRELEFVAPSIGIDPANPPAAPEPPGAPTELEEPAVAAPYDPSPFARERHVWLGLHAAATRSLAQGSMIIFS

SEQ ID NO: 12083 - protein, 822 aa, Streptomyces avermitilis
MSATQVPDVIEDMPATSIDLSVVVPAYNEEQRLGPTLDAIVDHLRENENRWGEWELIVVDDGSTDGTRDVVAAAKARDTRVQLVTSPRNRGKGHALRLGVLASYGRRVLVTDADLAAPIDELEQLDKALTDGQAAAIGSRATAGAAIERRQHRMRELLGRAGNLLIRRIAVPGIRDTQCGFKLFDGDRAREAFAASRLNGWGIDVEVLQHFRRSGWPVAEVPVRWAHQSGSKVRPADYGRVLAELTLLKARSVRPADLLAAALFLLLAVALQSGRWADPGHRYLPSSLQDQNQWEWFFAVTADNVSQLRNPLFTTFQGFPDGVNLMANTVMLGLSVPLAPLTLLAGPAFTLALVMTLGLAATAAAWYWLIVKRVVRQRGAAFVGAALAAFAPPMVSHANAHPNFVVLFMVPLIIDRALRLCTGARVVRDGVVLGLMVAYQIFLGEEPLLLASLGTVLFAGAYAAARREVARAAWRPLLKGLGIGAAVCLPIVALPLYWQFFGPQSYKSVLHGDNAGNSPLALLSFAERSAIAGDELTANALSLNPTEQNAFYGWPLAALAFAIVIRLWEHAVVKALAFTTIAAAVLSLGPRFRIPLTDITMPGPWALLADKPLFESVIEGRVAMICAPALGMLLALAIERLVRTPSQSTRLLGLTAVALALLPIVPAPLKTVERAEVPAFIADGTWKSYVDVDKGETLVPVPLPDSGNAEALHWQTAAGLGFKLPGGYFNGPYGKERIGIYGASPRSTSSLLSDIYYKGVVPQIGEDWQAQAKADFAYWKAGALVLAPQGREDALRAAVEKLVGRPGKWVDGVWVWDLHDGS

SEQ ID NO: 12084 - protein, 234 aa, Streptomyces avermitilis
MPGTGGNGAVTRSTLRQQIADALRDEVLAGRLQPGQEFTVKEIADQYGVSATPVREALVDLSAQGLLDAVQHRGFEVRAYSLADYRGMIEARSLVTDGMFHQLTGGDGRDPSDPRLAADLAVVRRRGEEAERAAGAGDLNILIGYDLRFWRELSALFGNPYLADFLHRLRVQSWVCAVQHLRRVSDLKGRLWSRHTDLVDALARRDPAGAHAVVTAYNAHSLDLVERLAAGSAG

SEQ ID NO: 12085 - protein, 451 aa, Streptomyces avermitilis
MTPQPNPQVGAAVKAADRAHVFHSWSAQELIDPLAVAGAEGSYFWDYDGRRYLDFTSGLVFTNIGYQHPKVVAAIQEQAASLTTFAPAFAVEARSEAARLIAERTPGDLDKIFFTNGGADAIEHAVRMARIHTGRPKVLSAYRSYHGGTQQAVNITGDPRRWASDSASAGVVHFWAPYLYRSRFYAETEQQECERALEHLETTIAFEGPGTIAAIVLETVPGTAGIMVPPPGYLAGVRELCDKYGIVFVLDEVMAGFGRTGEWFAADLFDVTPDLMTFAKGVNSGYVPLGGVAISGKIAETFGKRAYPGGLTYSGHPLACAAAVATINVMAEEGVVENAANLGARVIEPGLRELAERHPSVGEVRGVGMFWALELVKDRETREPLVPYNAAGEANAPMAAFGAAAKANGLWPFINMNRTHVVPPCNVTEAEAKEGLAALDAALSVADEYTV

SEQ ID NO: 12086 - protein, 200 aa, Streptomyces avermitilis
MTRKPAHLAVYDTFADWETGHTTAHLARAGYAIRTVGPTREPVTTLGGMRIQPDLALDGLRPEDSSLLILTGADLWDSGDDLAPFARTARAFLDAGVPVAAICGATAGLAREGLLDDRDHTSAVSFYLAATGYGGGERYVDADAVTDGNLVTAGPTEPVAFAREVFRLLGVYEGEVLDAWYRLFHDSDAAAYAVLEEAAR

SEQ ID NO: 12087 - protein, 151 aa, Streptomyces avermitilis
VSRERQDLFSRGALAVFRLNGQFLGVAEELARPAGLTAAWWQVLGAVLGEPLPVSGIARAMGITRQSVQRIADLLVERGLAEYRPNPAHRRAKLLAPTEEGRAAVARIGPGHAAFAGRLAQALGDAELAEAVRVLERLSNTLDEITPVTEP

SEQ ID NO: 12088 - protein, 682 aa, Streptomyces avermitilis
VEKLGAGDPQRIGAYRLLARLGAGGMGQVYLARSDRGRTVAVKLVRQQLAEQDEFRARFRQEVQAARRVGGHWTAPVLDADTEAAIPWVATGYVAGPTLQTVVGSDHGALPERSVRILAAGLAHALQDIHAAGLIHRDLKPSNVLVTIDGPRVIDFGIARALETVTDVRAQSHRKPARSSVRTGFHGHPEQVRGDRVTPACDVFCLGSVLAYAATGALPFGTASSGVHALMFRIAQEEPDLTGVPEGLADLVRECLRKDPAARPPLERILERTGAEDTVADGRSRDPWLPSALVAQLGRHAVRLLDAEDPETDEEPEREGAPTAGAPTAGAPTAGASAGGASAGGAPAAPADTPVWPGAAAVLSTPAAASGTPGPPHAPKRPEVSPEHGPASDAGAPNGAVPPPPGSPAPVDRLPTQIVGPGRTAPPAAPPAYGYPQQHPQQHPQPSAYGYPQNAGWGGAPAYGGPGLGSTPPYGPVVGAPGQQEPPRRSGRSTAALVVVALVVALGAGGSVYALMKGGDSGTTSDGKPSPVGSASTDPGPGSSDPSDPATPSTGDRTTRSTAGGAIPEGYLGTWTDGIDNSNGHSTRRLVIRQGEVGDTVLSLTADGPAGSGTYHCVFKADLAEKPSGDGPLEIGPSTVTVGEPASSCTPGDASEITLLPDGSLRRVKKGTSEALTYTKSD

SEQ ID NO: 12089 - protein, 248 aa, Streptomyces avermitilis
VSQPEMQPEGSAQDGRGDGGAGLRSGDLMGRPFPLGDWGEPAERLDELYRWVERGALDTAAWYLADRRWKRRGARALRTGAAVGAVCGAALPLLDLTGVVGGATPWAYLALLLGVACVAGDRFFGVTSGWMRDVATAQAVQRRLQALQFDWASESVREVLGPAEGTAGEASERCLGVLRRFSEDVTELVRAETADWMVEFRTGSAPLGMHSVGAGAARMDGVAPGRFAVPPPPGTRPNMPRQRPPEAR

SEQ ID NO: 12090 - protein, 113 aa, Streptomyces avermitilis
VIPGGGQPNMQQLLQQAQKMQQDLANAQEELARTEVEGQAGGGLVKATVTGSGELRALVIDPKAVDPEDTETLADLVVAAVQAANENAQALQQQKLGPLAQGLGGGGIPGLPF

SEQ ID NO: 12091 - protein, 199 aa, Streptomyces avermitilis
LYEGVVQDLIDELGRLPGVGPKSAQRIAFHILQAEPTDVRRLAQCLMEVKAKVRFCATCGNVAQEELCNICRDPRRDLSVICVVEEPKDVVAIERTREFRGKYHVLGGAISPIEGVGPDDLRIRELLARLADGTVTELILATDPNLEGEATATYLARMIKPMGLKVTRLASGLPVGGDLEYADEVTLGRAFEGRRLLDV

SEQ ID NO: 12092 - protein, 219 aa, Streptomyces avermitilis
MSDATLHNTTQDPDDFAVQIADQVESFLVAVTEVAKGDEPDSAVPFLLLEVSQLLLAGGRLGAHEDIVPDERYEPDMGPEPDVDELRERLATMLDPVDVYSEVFDPYEPRKAPVPARISDDLADVIADLRHGMAHYRAGRTTEALWWWQFSYFSNWGSTASATLRALQSLVAHVRLNQPLEELDGLDTDQDLSEDALAEEAGRVMASEIAGPLGLRTVR

SEQ ID NO: 12093 - protein, 430 aa, Streptomyces avermitilis
VGLVVQKYGGSSVADAEGIKRVAKRIVEAKKNGHQVVVVVSAMGDTTDELIDLAEQVSPMPSGREFDMLLTAGERISMALLAMAIKNLGHSAQSFTGSQAGVITDSVHNKARIIDVTPGRIRTALDEGNIAIVAGFQGVSQDKKDITTLGRGGSDTTAVALAAALDAEVCEIYTDVDGVFTADPRVVKKAKKIDWIAFEDMLELAASGSKVLLHRCVEYARRYNIPIHVRSSFSGLQGTWVSNTPLVQKAQQQGEQKVEQAIISGVAHDTSEAKVTVVGVPDKPGEAASIFRAIADAEVNIDMVVQNVSAASTGLTDISFTLPKTEGRKAIDALEKAKSVIGFDSLRYDDQIGKISLVGAGMKTNPGVTAGFFEALSDAGVNIELISTSEIRISVVTRADDVPEAVRAVHTAFGLDSDSDEAVVYGGTGR

SEQ ID NO: 12094 - protein, 358 aa, Streptomyces avermitilis
MDRTGPRAGRPTLAVVGATGAVGTVMLQILSQHADIWGEIRLIASPRSAGRKLAVRGEEVEVMALTEAAFDGVDVAMFDVPDEVAAQWAPIAAAKGTVVVDNSGAFRMDPDVPLVVPEVNPHAVRMRPRGIIANPNCTTLSMIVALGALHAEFGLRELVVSSYQAVSGAGRAGVETLRQQMSLVAGTQLGTSPGDVRRAVGDNTGPFPEPVALNVVPWAGSLREDGWSSEEMKVRDESRKILGLPQLRVAVTCVRVPVVTTHSLTVHARFEGEVTVDKAREILATAPGVVLFDDPAAGEFPTPADVVGTDPTWVGRVRRALDDPTALELFVCGDNLRKGAALNTAQIAELVARELTGA

SEQ ID NO: 12095 - protein, 191 aa, Streptomyces avermitilis
MPVIAPMPAARPARIPNQREGADETMAAGTTVDHLTETYRAHYRSLLGLAALLLDDTASCEDVVQEAFIRVHSARKRVRDPEKTLAYLRQTVVNLSRSALRRRILGLKLLSKPMPDMASAEEGAYDQLERDSLIKAMKGLQRRQREVLVLRYFADMTEAQVAETLGISLGSVKAYGSRGIAALRIAMEEPV

SEQ ID NO: 12096 - protein, 400 aa, Streptomyces avermitilis
MSGYDDKPFEPFDSIFDSIDSYDDEHAGNGTVKHGPDGQGPENTDTDGRGGGRGFDGLGPGADPDGFDSEPGDGLGSDELALRRMLHQAVREIEPHDATLEHLRRAVPARRARKRQAVVGMAAAALFIGTAIPALVHVSNATGSDADPSIAGQASQAQGGAGQDKGPDGGSNAAGSSGSSKGKGKDSQKGKGDKGTGASGGTTGGVNPPASAASAPTCTATQFGVVSANAGTPDSTGAVYGTFRISNISATSCTVSGTGSVTAAAAGAADQSKINVVPHVAGDAAAGLPDPSQDVASLVLQPGAAYDVKFAWVPSETCPTTGGPGGPSPDPTPSDDTTDSGGTDSAGAGTAPQLLREDGTADGSVTVSHITAAGSPTATTAVSNACAGTIYRTGILPAVS

SEQ ID NO: 12097 - protein, 275 aa, Streptomyces avermitilis
VYRFLLTPRWWGINVFVLLAIPFCVFMGSWQLSRFEDRIQDHRTASEQAAAAKTAAARPLAELLPVDKRTSGRQATATGRYDSGRQLLVPDRELDDRRGFYVLTMLRTDGGKALPVVRGWLPGTADAAKAPAPPTGEVTVTGALQASESPGSNGVSTVGGLPAGQTGAISSAALVNLVPYDVYNAWITLTKTDSGMKAVPATAAQGTGLDLKAFQNLGYTGEWFVFAGFVVFMWFRLLRREAEFARDAELGIFPPETDATGEAEARVEAEAEAKS

SEQ ID NO: 12098 - protein, 613 aa, Streptomyces avermitilis
MTESTGSTSQEQQVRGETMPDWEKRFRAPRVSLPDWAEDAPHRALFVSNATGTYELYAWDRTTGEQRQVTDRPNGTTDGVLSPDGEWIWWFDDTDGDEFGIWRRQRFTGGGTADGPDEPAADGLEPSYPAGLAIGRDGGTAVVGRSTDEDGSTVHVVRAGQEPVEIYRHRESAGVGDLSHDGSLIAVEHTEHGDAMHSALRVLRLDGSTVAELDDTKGGSVELGLEVLGFAPVDGDTRLLIGHQRRGRWEPLVWDVASGEETDLALELPGDVGAEWYPDGSALLVAHSFEARSELFRYDLASRELVRVPTPAGTVSGATARPDGSVEYLWSSAAEPSVVRSTSGGIVLDPPGMKSPGSVPVEDVWVEGPGGRVHALVQRPAGASGPLPTVFDIHGGPTWHDSDSFAAGPAAWLDHGYAVVRVNYRGSTGYGREWTDALKHRVGLIELEDIAAVREWAVSSGLADPDRLILTGGSWGGYLTLLGLGTQPDAWTIGIAAVPVADYVTAYHDEMEALKAMDRTLLGGTPEEVPERFEASSPLTYVDAVKAPVYISAGVNDPRCPIRQVENYVERLTARDAVHEVYRYDAGHGSLVVDERIKQVRLELEFAERHLGR

SEQ ID NO: 12099 - protein, 673 aa, Streptomyces avermitilis
MVVCGDDALALRLATELRGVYGEQVTLVVPPAERVARQPVVGRARTSTLLDRVSAAVTRAAGNGNGAGSTTGNSGGNGNSGSGDGAGGRGGSTGGGRTTEPPGTERLLEAVEANEAVLAEAGVERAAALALVYDDDETNIRAALTARRLNPHLRLVLRLYNRRLGQHIEELLDQAATLAAAGADGPAAQFDASTTVLSDADTAAPALAATAVTGTSKVVQTDGLMLRAVERPPPEPGQVADPGLCTLALLSATASDPAGADGSESSGEQGPRLLPDEEAIAAATGRGTVVLENVSYSGSSLPAGRNALPFASLLSRRLRWSFAGLVGCVVGLAVAQMAVTREHPLHATYLTLLDLFAINDPAVGQSTGRQILQLLSGLVGLLLLPVLLAAVLEALGTFRSGSALRKPPRGLSGHVVLLGVGKIGTRVLTRLRELRIPVVCVEGDPEARGLATARRLRVPVVLGDVTQEGVLEAAKIHRAHALLALTSADTTNLEAALYARSVRPDLRVVLRLYDDDFATAVYRTLRAAHPHALTRSRSVSHLAAPAFAGAMMGRQILGAIPVERRVLLFAAVDVGGHPRLEGRTVGEAFHAGAWRVLALDTAARGGRGQAHSPAPSPSPSASASADSPYRRSGLVWDLPATYVLRAEDRVVLAATRRGLAELLGRRPQARTDV

SEQ ID NO: 12100 - protein, 215 aa, Streptomyces avermitilis
VEGPAHPPVGLPPGHPPGHPRPTPGPPPARPRLQGLKPRPTPGRDRMLAGMRRTSFANWPCSIARTMDLLGDWWTPLVLREAFYGVRRFDAFQQSLGIARNTLTDRLRRLVDEGLMEKQPYQNEPVRHDYVLTDKGRDFYGVLMAMNAWGDRWLAGEQGAPVVFHHERCGRQGHAEVVCSECGEPMTATDTRPRLGPGYPPRLAERPDVRERFAD

SEQ ID NO: 12101 - protein, 256 aa, Streptomyces avermitilis
VNRQAQAVVLFLVGGAVLRAGSTDLYLRYVKAGLRPLLLVAGAVLIVAAVATVWYELRRPRGGQHDDHEDSHDHDHDRDRGHDHGHGHAHRESWISWLLVLPLFALILVAPPALGSYSAVRTGTALQAPWGFPALPAGDPIKLSVDDYAGRAAFDHGRSLKGRKVTITGFIALDRGGAPYLTRMILSCCAADAQPIKVGLTGRTPPVLQPDTWLEITGTYSSRRTKDPVNNGVIPFIDVSRATPVPAPRDQYESPE

SEQ ID NO: 12102 - protein, 336 aa, Streptomyces avermitilis
VTLTKAAPDRAERPDAGGSQGWHFNSSLGLTMLLVLVVAVQGPIRRALSTPVMQSWTTVFVAVVVQALPFLVLGVLLSAVIAVFVPPSFFARALPKRPALAVPVAGMAGAVLPGCECASVPVAGALVRRGVTPAAALAFLLSAPAINPIVLTATAVAFPRNPEMVFARFGASLLVACAMGWLWQRLGRTDWMRAPAHPSFEGAGKGAAFWGSVRHDVMHAGGFLVIGAMAAATLKAVVPAAWLHMAATNPVVSVLALAILAVLLSICSEADAFVVSSLTQFSLTARLAFLVVGPMIDLKLFAMQAGTFGRGFALRFAPATFAMAVLVSVLVGAVLL

SEQ ID NO: 12103 - protein, 473 aa, Streptomyces avermitilis
VIRDLLRDLAAALVAALLVVTAVLVGTVIQREDGTLYVGWPPLYAVAEPHVGAGTPAALAVAVAVVAYGPALAARLPWRALLAAAWATATAWTFSLALVDGWQRGIAGRLTTQYEYLRVIDRFHDIPGTLRDFTHHILIDSPGHWPAHVAGHPPAAPLTFVLLDRIGLGGGGWAGVWCITVGATACVAVLVTVRVLAGEVLARRAAPFLVLAPAAVWMGTSADGYFAAVAAWAVALLALAVTGGTGRTGGAGRTGGAGQTGGAGRTGHRVWAAAFGSGLLFGLTCYLSYGLTLFAVIAAGVLVLGRERVRVLPLLFAGLAVVPLVFTLAGFHWWEAYRLLVERYYQGAGGLRPYGYWVWANPACTVLVVGLATVAGLRRAGVALVRQRGQVLRSRDAPGPAAEPRLALLVYAALLALLAADLSGMSKAETERIWLPFAMWLLAAGAFLPRPRAWLAAQATLALLLNHLLLTGW

SEQ ID NO: 12104 - protein, 434 aa, Streptomyces avermitilis
MGCGPFRGVVPAYLRDMRAPRLPSSRAPWLPSSPGFWRSPVRGPWFTSVLGVVLLGGITVLFVTGLLSYAAYNPDLAPVNDQTPDKGLLGFYLFAWPTDPPWLYRLTQGLHVTLGLTLIPVLLAKLWSVVPKLFELPPARSLAHALERLSLLLLVGGALFEFVTGVLNVQLDYVFPGSFYPLHFYGAWVFFAAFVAHAVLKTPAALRNLRRPRTEEEEYEPGSPPRAEPTVSRRGALGLVGGGSLLLFGTTAGHSFDGPLRQTAVLAPHGGPEPGPGPGGFQINKTAAYAGIDDRETSADAWRLVLVGRTGTVRLSRAELERLPSRSSALPIACVEGWSTSDQRWRGVRLRDLAALVGHDEPPDVLVESLQRHGAFRRAALRANQVADPRSLLALYVNGEALTPDHGHPARIIVPAAPGVLNTKWVARMTFGDL

SEQ ID NO: 12105 - protein, 299 aa, Streptomyces avermitilis
MSTAREMAPEWATEAAEPTSGSHTRSGSGSGSGSGSMTETENVGSNRRLRGLLDGASPSWCADPYADALRAGRGPLFLRRADGWLLPLEVERWCAEADAADLDVVERCEGAVLDVGCGPGRLVAALSARGLRALGIDVSEAAVAHTRGIGGRALRRSVFAPVPGAGRWGTALLIDGNLGIGGDPDALLHRIAHLLAPGGLLIAETVPYDIDERVHVHVTDARATPGDPFPWARLGTPALLQYAARSGWHATDQWSTGGRSFVALRSRSTNRSAEPPNSTAVISSQRARKPSPGRPAADS

SEQ ID NO: 12106 - protein, 205 aa, Streptomyces avermitilis
VTTLLVIAKEPRPGRVKTRLTPPFTPRQAAELAEAALVDTLRTVAATPARRRVLVLDGTPGPWLPPGFEVVPQCAGGLDERLAAAFAGCAGPALLVGMDTPQVTPELLTVDFRGCDAYFGPAEDGGFWALGLADPDPGLLRGVPMSTPATGAVQRERLVAAGLRVRDLPRLRDVDTAPDAESVAASAPHSRFAAELDRLRAATGR

SEQ ID NO: 12107 - protein, 265 aa, Streptomyces avermitilis
VKAVTTSPSDPPDPFDPLDPVDPLASTKPEVDVVLPCLDEADALPWVLARIPPGWRALVVDNGSTDGSAEIARRLGATVVPETRRGFGAACHAGLTAATADIVCFCDCDGSLDPSLLVPFVREVRDGAADLVLGRRRPHGRGAWPAHARAGNLALARMLRRRTGLRLHDLGPLRAARREPLLALGLTDRRSGYPLQMVVRAADAGWRIAEHDVPYLPRTGVSKVTGTWRGTWQAVRDMSRVLAEPAQDGPPESGSLSSSQGGSSQ

SEQ ID NO: 12108 - protein, 333 aa, Streptomyces avermitilis
MRVLVTGGAGFIGSHVVEALGARGHEPVVFDVREDAGADVRDRDAVARALAGVDAVCHQAAMVGLGNGFTDAAEYVSRNDLGTAVLLTGMAEAGVRRLVLAGSMVVYGEGRYLCEWHGVVRPGPRTVADLTAGRFEPVCPACGEALSPGLVGEDAPVDPRNVYATTKLAQEHLAAAWARSTDGTAVSLRYHNVYGPRMPRDTPYAGVASFFRSALARGEAPHVFEDGAQRRDFVHVRDVAAANVAALEASSPVGALTVYNTGSGEPHTVGAMARALAAAYGGPEPVVTGEYRLGDVRHITADSSRLRAELGWKAETGFEDGMREFARARLRDE

SEQ ID NO: 12109 - protein, 421 aa, Streptomyces avermitilis
MTMPTHSKQALRYGRVVAAVAGVLLAGAAVTPAHADTVRGQQWHLDAMQAEQMWKTSTGKGITVAVIDTGIQDNIPDLRGRVVAGKDFSNHPGDEHSDYDGHGTSMAVLIAGTGAKGRATGSYGLAPGAKILPIRIPDFIEQSRSDGNPDDYPTYMAKAIRYAADSDAQVINISLASTAHSPELTESVAYALSKGKLIFAGVGNTGGGLNKVEYPAATPGVVGVGAIDRGVKATKESQHGPQVDLVAPGEEMVAACLGSTELCKTHGTSDATAIASASAALIWSKHLDWTNNQVLRVMVNTASKSKSGKERTDYLGYGAVRPRIALTDPGDPGPVDGYPLPDFEYAASRTPEVSASASSKQEGAAPAASTNSGSGDSSPPWILLGVGSGVLISGAAFAGWCVRKRRRAQATSHVYPGRGSS

SEQ ID NO: 12110 - protein, 558 aa, Streptomyces avermitilis
MSDLGSSAWRTVRQSRFLTQDPEQLWSMVEGADGATATELGVLLTQAAKTIGEIGTDLRTHSMAVEWEGEGGEAFRKWIHQAALATLGLGDYSASAGKWLGHAGDTLHEVRPQLEILRNQSATARSVLDAHAAKATDIGDHDGSPSDAAVEKAKTSFADDSAEAAGLMIKLAQSYTASTEQIDALKAPEFPELPKRFVPIERDGGTHITAPTADGGTQGTVARADALGRETDADSGVGGMSSAPRASAPHHLTDLAVGPDAPPRPHTDTTNTAIDSVRTVPSAPAAPSAPPAPPPEPSSPDGRTQPTTGLLPPAFGGRAVTPQVPRAGGGHSVYGGRSALPTPSGSGTPGGSHVPGRGPTGPFGPGMSGGQPVPGRESAVPGAARNANGVTGGRPVSPPSGRSAGAIPRGTVIGGTPQQQPPIGRGTAPGGSGLGATTPRANGRTANPESASKSAPLPAQSDGIVGGQPRTSRQRGRAGFTSGGAGLVRGTGTDDVLPQSGGTARGASAVTRAPYGGDRSAHDERSRSRTNQRAEDEEGRPTTPRPPSGPDRHAGQEG

SEQ ID NO: 12111 - protein, 187 aa, Streptomyces avermitilis
VMAVDSTGDPQATGAGLGAAVGGIAASGIGPFAGVGAAAAQVLRVEGETLTAFKKRVDDLLTQLEESKAAPRRIADGALPTGRLGNFDEADALHAAYTRVHSQLEQLSQMLALQIEGLVVTVDASKAGYHDLDDDVRDRLSRIRVEADELLADRPGPGAENRTSRGVGRPSGDQQGSQPPDAEAGGL

SEQ ID NO: 12112 - protein, 152 aa, Streptomyces avermitilis
MAWDEWEQIKAAAAERRSTQMQLNQLPADQGGSTPTGGSKPGLNGGSGTLRHSNGPWTHAAGTADDLRISTESTKKSLQSGHTGVSAGAEGLASLGALKTVLTSWEKRLEAVRDECESLEPKLRAVAKDMGEYDSAVAAKARAVHVSDGGKG

SEQ ID NO: 12113 - protein, 643 aa, Streptomyces avermitilis
VTSALTWQQLRDLTLSGLDDAADGWVKVSHHADASAERVDAEMAGKLSKTQESESATAAIRRLQRLSRNYHYIHAECGLIRSSVNGLASELRPPQRRLKEALDDATALSYAVNEDGSIGYPAGGKNEMTGEKIPGGSAVGHNGMLAPGNNGLYPPSDKGLHTPGTGPGTPGLINPNPHHAKAQDIADRIAHALREARETDERYRQALSKLKAGPGLKVDTKTWADAAADVKAVGDAATEYLKDDIPLDKSPAARKDWWDHLTQEQREEYLAVYPDVIGNLDGIPATVRDEANRENVELLIGKLSGQDDEKSKTILEGLKGIQGKLQEASVPPMYLLGIGDEGNGRAIVSYGNPDTANNVSAYVPGLSTKLDGEFVGGSMKRAQDTALGAKEADPHSSTASIVWLGYDAPQLSPTDLAANTDVMFRENAEAGAPAYNSFMAGISATNENENPHITAIGHSYGSLTVGLAAQEKGGVPGADDIILVGSPGTDAKTADDLNVGKHHVFVGAADNDIVTKLPNHNEASGMGAGAAGGGSAGLVLGLGMGGPVGGVVGGAAGTVVGGIAGYMAQDQQTDPSQIWFGTDPANKAFGATRFLVDDGPPVTDGGFDAHSHYFTPTKDQMSADNIANIVVGKSDGIVLEQPR

SEQ ID NO: 12114 - protein, 261 aa, Streptomyces avermitilis
MIARIPKDIPDLPAIPGMPVLMPSAVPAAAVVAPTRRPLTTAFRLLVALAATAGVTIDLILGSPLRVLTYFTIQSSVLVALTFTLSAWRAWAARRPLPALLTGGTLLYAVITGLVYHLLLAHEPAPFTMTGQAGPLTGWQALTNQLLHTAVPVAVVLDWLLLTGSGRLRLRQASAWLLYPLAYLALTLARGELILPGTPGRYLYPFLDVEQHGYKSVLGNALLLGLAFYALAVLLVTLDRVRPNPLRRRAKNGFRLQPPVG

SEQ ID NO: 12115 - protein, 308 aa, Streptomyces avermitilis
MRARYGVPLGIVAAGAAGLLYSAGFEARSFRLRRVTVPVLPPGMRPLRVLQVSDIHMVGGQRKKQRWLRSLAGLRPDFVINTGDNLSDPEGVPEVLDALGPLMEFPGAYVFGSNDYYGPKLRNPARYLLEKTQGRHGLNGNKPAVDAIHNPWEDLRDGFDAAGWLNLTNARGALKIEGAEIELTGLDDPHIKRDRYARVAGGPSVSADFSMGVVHAPYLRTLDAFTADGYPLILAGHTHGGQLCLPFYGAFVTNCDLDTDRVKGLSRHTAEGRASYLHVSAGCGTNRYTPVRFACPPEASLLTLVERE

SEQ ID NO: 12116 - protein, 155 aa, Streptomyces avermitilis
MTTLKSKLQEDLNAAIKERDELRSSTLRLTLAAITKEEVAGKTKRELSDDEVQKVITREAKKRREAADAFAQGGRPESAEREKAEGEVLATYLPQQLSDEELQQIVGQAVQEAKAAGAEGPRAMGQVMKIVNPKVAGQAEGGRVAAVVKQLLAGG

SEQ ID NO: 12117 - protein, 763 aa, Streptomyces avermitilis
MPKKRSGGGLSPVQQAAKFLGVSVLAGAVMAGIAMPAAGALGLAAKGSVKGFDDIPANLKSPQLSQRTTILDSAGGQIASVYSRDRTVVDLKEISPYMQKAIVAIEDSRFYQHGAVDLKGILRAVNQNAQNGGVAQGASTLTQQLVKNYFVEEAGDDPTKVAQATQQTLGRKIRELKYAIQIEEKLGKKKILENYLNITFFGQQAYGVEAAAHRYFSKSAKDLNVQESALLAGIVQSPTRYDPVNDEAEAKKRRNVVLQRMAEVHDISQADADTAKEKPLGLNVSKPKNGCITAVKGAGFFCDYVREVFLTDPVFGKTKEARAKIWNRGGLTIRTTLDPQAQESAQTSIKQHVNKSDGVATAATVVEPGTGKILAMGQSRPYGFGKNETQINLSVDKDMGGGAGYQPGSTFKPIVAAAAVEGGMPATQAYPSPYEMLYPSPISACNGKTWRNDPNRPAKLTNENESERGPYGMKEATAKSVNTYYVQLISDIGICPVTQMAKKMGVSRADGAKITQAPSIALGTQEMSPLTMANAYATFASRGMHCTPVAIESITQTVGDEKKSLEVPKSTCSRAMTETTADTINTLLKGVVEDGTGTEAGLGSRPSAGKTGTTDGRYAAWFVGYTPNMAAAVWVGDPAHKRRMVNITIGGTTWAKVYGGQVPGPIWRDMMSGALQGKPAPDFNLINIPDSNADKDKGGDEGNNGGNGNGNGNTGGTTVTGGTDGGTTVPLPSFSIPDGFIQGNGNGGNGNGGNGNGGRNGNG

SEQ ID NO: 12118 - protein, 129 aa, Streptomyces avermitilis
MPLPPWGSLDSGEDGAGMGWVTDWSAQAACRTTDPDELFVQGAAQNRAKAVCTGCPVRTECLADALDNRVEFGVWGGMTERERRALLRRRPTVTSWRHLLETARTEYERGAGLLPLDEEEVYENYAAVG

SEQ ID NO: 12119 - protein, 474 aa, Streptomyces avermitilis
MSLDPAHTPDPAHPHDQEAAHAEDPARAIGSARLLDVDPLLDDPGTRIVVCCGSGGVGKTTTAAALGLRAAERGRKVVVLTIDPARRLAQSMGIDSLDNIPRRVKGIDDSASGELHAMMLDMKRTFDEIVEAHADRERAAAILSNPFYQSLSAGFAGTQEYMAMEKLGQLRARDEWDLIIVDTPPSRSALDFLDAPKRLGSFLDGKLIRLLTAPAKLGGRAGMKFLNVGMSMMTGTLGKLLGGQLLKDVQTFVAAMDTTFGGFRTRADATYKLLQAPGTAFLVVAAPERDALREAAYFVERLAAEDMPLAGLVLNRVHGSGAAQLSAERALAAAENLDLAADPGSTENLEESRIVDQEGGKAGLRNSPDTYGSSESPADLTPADQTPASSEGSPATDGAVEQLTAGLLILHAERMQLLSREQRTRDRFAALHPEVAVAEVAALPGDVHDLTGLRDIGDRLAANRPELPTSPGGA

SEQ ID NO: 12120 - protein, 325 aa, Streptomyces avermitilis
VSRLQVVSGKGGTGKTTVAASLALALATEGKRTLLVEVEGRQGIAQLFETQALPYEERKIAVAPGGGEVYALAIDPELALLDYLQMFYKLGSAGRALKKLGAIDFATTVAPGLRDVLLTGKACEAVRRKDKSGRFAYDYVVMDAPPTGRITRFLNVNDEVAGLAKIGPIHNQAQAVMRVLKSPETAVHLVTLLEEMPVQETADGIAELRAAKLPVGRIIVNMVRPAVLDQADLELAHTTPRTAIAKSLSAAGLGGARRGGLAERLVDPLLRQAEEYAERFALEREQRAVLTEQELPLHELPLLAEGMDLAGLYELAKELRTQGIS

SEQ ID NO: 12121 - protein, 53 aa, Streptomyces avermitilis
MTKWEYATVPLLVHATKQILDTWGEDGWELVQVVPGPNNPEQLVAYLKRERQA

SEQ ID NO: 12122 - protein, 156 aa, Streptomyces avermitilis
MSGAVEAKLAELGLTLPAVVPPLAAYQPAVQSGVYVYTAGQLPMVEGKLPVTGKVGAEVTPEEAKDLARTCALNALAAVKSVTGDLDRIARVVKVVGFVASASDFTGQPAVLNGASELLGAVLGDKGVHARSAVGVTVLPLDAPVEVEIQVELTEA

SEQ ID NO: 12123 - protein, 290 aa, Streptomyces avermitilis
MVNGQWYPPEWPVRIRALAEGALTPVAPKRAATVILLKDTDRAPVVHMLRRRTSMAFAGGAYAYPGGGVDPRDDERQVRWAGPTRAWWANRLGVDETSAQAIVCAAVRETYEEAGVLLAGPTPDTVVGDTTGDDWEADRAALVARDLSFAEFLDRRGLVLRSDLLGAWTRWITPEFEPRRYDTWFFVAALPEGQRTRNASTEADRTVWIRPADAADGYDKGELLMMPPTVATLRQLLPYAAAAADVLAAAPARDLTPVLAKARLADGEVVLSWPGHDEFTKHIPTGGAPA

SEQ ID NO: 12124 - protein, 276 aa, Streptomyces avermitilis
MTDAAALPGQPRGGVLSGPATRRAVNVLAPNASAMTLDGTNTWIVAEPDSELAVVIDPGPLDDVHLRNVVDTAERAGRRIALTLLTHGHPDHAEGAARFAELTGTNVRALDPALRLGDEGLAPGDVVTVGGLELRVVPTPGHTSDSLCFHLPADRAVLTGDTVLGRGTTVVAHPDGRLGDYLDSLRRLRSLTVDDGVHTVLPGHGPVLDDAQGAVEFYLAHRAHRLAQVETAVENGYRAPAEVVAHVYADVDRSLWPAAELSVRAQMDYLREHGLI

SEQ ID NO: 12125 - protein, 303 aa, Streptomyces avermitilis
LNRRGPIGVPSGVLIQKSSATTLLSGHSGRMAGQGHHGGLDAQGYIEREGSLGRIQETFWPVVAAARDRLTDVFGARMTSAYLYGSIPRGTARVGRSDLDLLLVLRDEPTEADRAEARALGDSLDKEFPGIDGVGTLLVSRTRTLSALETYDLGWFVACLCTPLLGEDLAEFLPRYRPDSHLARETNGDLALHLSRWRERIAGTADTDEARRPLVRFMSRHLVRTGFTLVMPRWNGWTSDLGEMAEAFAEYYPERAGQLREAALLGYDPTGDPTVLRRYVDDLGPWLAEEYARVHGVKEPRPD

SEQ ID NO: 12126 - protein, 224 aa, Streptomyces avermitilis
VDDVLRRAPLFAALDDEQAAELRASMSEVTLARGDALFHEGDPGDRLYVVTEGKVKLHRTSPDGRENMLAVLGPGELIGELSLFDPGPRTATATALTEVKLLGLGHGDLQPWLNVRPEVAAALLRAVARRLRKTNDQMSDLVFSDVPGRVARALLDLSRRFGVQSEEGIHVVHDLTQEELAQLVGASRETVNKALADFAGRGWLRLEARAVILLDVERLAKRSR

SEQ ID NO: 12127 - protein, 310 aa, Streptomyces avermitilis
VKKAARKTVKKAAKKATTAVKKDASADPVAKAPKSVAAKPPKSAAKPPRNESRTALVRRARRINRELAEVYPYAHPELDFENSFQLILATVLSAQTTDLRVNQTTPALFAKYPTPEDLAAANPEEVEEILRPTGFFRAKTKSVIGLSKALVEEFGGEVPGRLEDLVKLPGVGRKTAFVVLGNAFGRPGITVDTHFQRLVRRWQWTDEKDPDKIEAAVGALFPKSEWTMLSHHVIFHGRRICHARKPACGACPIAPLCPAYGEGETDPEKAKKLLKYEKGGFPGQRLNPPQAYLDAGGIPAPPLGAPQGTP

SEQ ID NO: 12128 - protein, 255 aa, Streptomyces avermitilis
MTHASNAQDSRAALSGDGRAALGGDGRAAFGEDGQVALRKDGMPDWLDPVVRAAETVEPLQLSRFLPPKDGAGRQSAVLILFGEGDRGPELLLMERAGSLRSHAGQPSFPGGALDPEDGDPGADGPLRAALREAEEETGLDPSGVQLFGVLPKLYIPVSEFVVTPVLGWWRRPTPVGVVDPNETARVFTVPVADLTDPANRATTVHPSGHRGPAFLVESALVWGFTAGVIDRLLHYAGWERPWDRDKQVPLDWRA

SEQ ID NO: 12129 - protein, 399 aa, Streptomyces avermitilis
VNVLDILLLVAAVWFAIVGYRQGFVVGILSVIGFLGGGLVAVYLLPLIWGWATDGTKVTTTAAVVAVIVVIVCASVGQALTTHLGNKLRRYITWSPARALDATGGALVNVVAMLLVAWLIGSALAGTTLPTLGKEVRGSKVLLGVARALPNQADTWFADFSSVLAQNGFPQVFSPFANEPITDVQPPDPALAKSPVATRAQKSIVKVMGTAQSCGKVLEGTGFVFGNRRVMTNAHVVGGVDEPTVQIGGEGRKYDAKVVLYDWRRDIAVLDVPNLKAPALQFTSTDAASGNGAIVAGFPENGSYNVQPARVRGRITANGPDIYHRGTVRRDVYSLYATVRQGNSGGPLLTPEGKVYGVVFAKSLDDANTGYALTADEVQKDITQGRRANQQVDSDSCAL

SEQ ID NO: 12130 - protein, 316 aa, Streptomyces avermitilis
MTDPATPSAQSTSVVRLDLPGGREVTHRDVAANGARFHIAELGDGPLVLLLHGFPQFWWSWRHQLVALADAGFRAVAMDLRGVGGSDRTPRGYDPANLALDITGVVRSLGEPDAALVGHDLGGYLAWTAAVMRPKLVRRLAVASMPHPRRWRSAMLADVKQTTAGSYIWGFQRPWIPERQLTADDGALVGRLIRDWSGPRLPDDEDVETYRRAMCIPSTAHCSIEPYRWMVRSMARPDGIQFNRRMKRPVRVPTLHLHGSLDPVMRTRSAAGSGEYVEAPYRWRLFDGLGHFPHEEDPVAFSTELINWLKDPEPDR

SEQ ID NO: 12131 - protein, 158 aa, Streptomyces avermitilis
MSAPDGSPVGAERSIGQLVASATTEMSALVHDEIALAKAQLKQDVKRGAVSGGAFSAAGAVLIFSLPMLNFALAYGIRTWSNWNLAVCFLLSFAANVLVAGALALLGTVFAKKAKKSQGPQKVAASMKETAGVLQHAKPHPRTAPVSDAVEAVARSSS

SEQ ID NO: 12132 - protein, 466 aa, Streptomyces avermitilis
VAAPRTSTRKFLGRLSLPERNFVAEALRTETVGGVLLLLAAITALIWANVPALHHSYESVSHFHFGPAPLGLDLSVQHWAADGLLAVFFFVAGIELKRELVAGDLKDPKAAALPVAAALCGMAVPALVYTLTNLTGGGSLRGWAVPTATDIAFALAVLAVIGTSLPSALRAFLLTLAVVDDLFAILIIAVFFTADLNFAALAGAVIGLAVFWLLLRKGVRGWYVYVPLALVIWGLMYNSGIHATIAGVAMGLMLRCHRHQGEEHAPGEHIEHLVRPLSAGLAVPLFALFSAGVVISGGALGDVFTRPETLGVVLGLVVGKAIGIFGGTWLTARFTRASLSDDLAWPDVFAVASLAGIGFTVSLLIGELAFDGDPVLTDEVKAAVLTGSLLAALIATTLLKLRNAKYRALCEDEERDEDSDGIPDIYEQDNPAYHLRMAEIYERKAAEHRRLAEVTGGAGAENDGPA

SEQ ID NO: 12133 - protein, 652 aa, Streptomyces avermitilis
VSNESLANLLKEERRFAPPADLAANANVTAEAYEQAKADRLGFWAEQARRLTWATEPTETLDWSNPPFAKWFKDGKLNVAYNCVDRHVEAGHGDRVAIHFEGEPGDSRAITYAELKDEVSKAANALTELGVQKGDRVAVYLPMIPEAVVAMLACARIGAAHSVVFGGFSADAIAARIKDADAKLVITADGGYRRGKPSALKPAVDDAVSRGDGVEKVLVVRRTGQEVAWTEGRDVWWHEITAKQSAEHTPEAFDAEHPLFILYTSGTTGKPKGILHTSGGYLTQTSYTHHAVFDLKPETDVYWCTADIGWVTGHSYITYGPLSNGATQVMYEGTPDTPHQGRFWEIVQKYGVTILYTAPTAIRTFMKWGDDIPAKFDLSSLRVLGSVGEPINPEAWIWYRKHIGGDRTPIVDTWWQTETGAMMISPLPGVTETKPGSAQRPLPGISATVVDDEAREVPNGGGGYLVLTEPWPSMLRTIWGDDQRFLDTYWSRFEGKYFAGDGAKKDEDGDIWLLGRVDDVMLVSGHNISTTEVESALVSHPSVAEAAVVGAADETTGQAIVAFVILRGTANAEDDNLVADLRNHVGTTLGPIAKPKRILPVAELPKTRSGKIMRRLLRDVAENRALGDVTTLTDSSVMDLIQSKLPAAPSED

SEQ ID NO: 12134 - protein, 791 aa, Streptomyces avermitilis
MSACVPTRAADSNRTKRIHQPHSPPPPQPRRFRIAGADWSASIAVFLIALPLSLGIALATGAPLQSGLVAAAVGGLLAGRLGGSPLQVSGPAAGLTVVTAELIHRYGWRTTCAITVLAGVAQLGLGCLRVARTALAVSPAIVHGMLAGIGVTIAVAQLHIVLGGTPQSSVLANLHALPAQLAHLQPAAVSMSALTLALLLAWPRLPGRVGRLLRTIPAALVAVAGATTAASLAALSLPKVDLPSWRSHALASLPEGPVLGIAAAVLTTTLVCSVQSLLGAVAVDKLTAGRPLPNRRSDLDRELLGQGTANIVSGALGGLPVAGVAVRTSANVRAGAVSRNSTMLHGVWVVVAALLMVPILELIPLASLAALVMAVGIQMVSLHHIRTVTRHREVLVYAVTTLGVVLLGVLEGVTLGVAVAVAVALNRLARTRITHDEQEGVHYVQVRGQLTFLAVPRLSRALHLVPHGADAVVELDGSFMDHAAYESLQDWQTAHTAQGGSVEFTGRAGTRISLPAMEAPAAERSTGLGEASACRCRPWTPWRNHQCARPQPAPPGEDPDESAATGPSGHQLARGISAFQRNTAPLVRGELARLAREGQRPSQLFLTCADSRLVTSMITSSGPGDLFVVRNVGNLVPPPGEESGDDSVAAAIEYAVDVLEVRSITVCGHSGCGAMQALLSSDPGSSQTPLKRWLRYGLPSLERMAAEDRARLAGRAAADAVEELCLTNVVQQLAHLRAHESVARALREGALELHGMYFHVGEAQAYLLSEDPAADGVFARVTETARDDMPA

SEQ ID NO: 12135 - protein, 423 aa, Streptomyces avermitilis
MAATHKIAAGVALAAACATALAGCASDTTGSKEGAYGPEKAGAPAPKSAVRLIGDGSTSYTGAQPHLPRPERLKPGQKPPQFVVFSWDGAGEDSQKLFSHFRKVAKANNASMTYFLSGVYLLPEEKRDLYKPPEHSPGRSDIGFNDQHGIKETAKQLRLAWLEGNEIGTHFNGHFCGKGGGVGEWSVEEWKDEIAQAKSFVKSWKTNADLAKAAPLPFDYDKELIGARTPCLEGQENFVKAARDLGFRYDTSGVNNQVWPKKREGLWDLSMQLVPFPGHSYEQLTMDYNFMVNQSGTQTQGDPAKRQLWGDQMRDGLLEGFRRAYDGNRAPLIIGNHFESWNGGTYMRAVQEVIESVCTMDEVRCVSFHQLVDWLDAQDPQVLQKLRKLTVGEAPRQGWAAFLPGRPPAPAPKGVPGAPAFKP

SEQ ID NO: 12136 - protein, 329 aa, Streptomyces avermitilis
LVNMKIAFVGKGGSGKTTLSSLFIRHLAATAAPVVAVDADINQHLGAALGLDEAEAAGLPAMGERLGLIKDYLRGSNPRIASADTMIKTTPPGEGSRLLRVRESNPVYEACARTVELDGGAVRLMVTGPFTDADLGVACYHSKTGAVELCLNHLVDGPGEYVVVDMTAGSDSFASGMFTRFDITFLVAEPTRKGVSVYRQYKEYARDFGVALKVVGNKVQGQDDLDFLRAEVGEDLLVTVGHSNWVRAMEKGRPPRFELLEDANHRALRTLQSAADATYELRDWESYTRQMVHFHLKNAGNWGNERTGTDLAAQVDPGFVLSEGLVATA

SEQ ID NO: 12137 - protein, 274 aa, Streptomyces avermitilis
MSTTGAAADPLAALGALPGVAESVESVRKAVDRVYGHRVMRRRSNEITSEAALRGARGSAALSGADWALEEVRRRTDFSGDDEARTVGAALRLTAEAGQLLSIWRQSPLRVLARLHLVAAAGKEDEVGRPRQDGEPVDEPLVELPLPDAREVAGRLEGLSQLIIAGGSAPALVTAAVVHGELLALRPFGSHNGLVARTAERIVLIGSGLDPKSICPAEVGHAELGRAAYAAALDGYVSGTPEGMAAWIAHCGKAIELGVRESTAVCEALQRGAA

SEQ ID NO: 12138 - protein, 277 aa, Streptomyces avermitilis
MLGPVENHSLPRTAAFFDLDKTVIAKSSTLTFSKSFYQGGLINRRAVLRTAYAQFVFLAGGADHDQMERMREYLSALCRGWNVRQVKEIVAETLHDLIDPIIYDEAASLIEEHHTAGRDVVIVSTSGAEVVEPIGELLGADRVVATRMIVGDDGCFTGEVEYYAYGPTKAEAIKELAASEGYDLARCYAYSDSATDLPMLESVGHPHAVNPDRALRREAIARQWPILDFHRPVRLKQRLPALSVPPRPALVAAAAIGAAAATAGLVWYTNRRRATAM

SEQ ID NO: 12139 - protein, 364 aa, Streptomyces avermitilis
MAGAITHDHAAAAQGRQGGPLIVTEDVELLDDLLRLCAAAGARPEVHHTVPDGRGTWEAAPLVLVGDDAARRVRGAARRRGVVLVGRDQDDSGVWRRAVEIGADHVLLLPDGEQWLVDRIADVAEGVGRPALTVGVIGGRGGAGASTLACALAVTSARQGRRTLLVDADPLGGGLDVLLGGETAEGLRWPAFAASRGRVGGGALEESLPELHALRVLSWDRGDAVAVPPQAVRAVLAAARRRGGAVVVDLPRRVDEGAAEALAQVDLGVLVVPAELRAIAAAARVASAAGMVLGDLRVAVRGPYAPGLDDREVARLLGLPLLGEVPAEPPVPDGGVPPGGAARGPLARFCAVFWDRALVEAGGV

SEQ ID NO: 12140 - protein, 433 aa, Streptomyces avermitilis
MSGGWDAGAGLDRAAGLDGATGSVFGGGAGGVVGRGAPAGGGSGARDDLSAGLLEGVRQWLAESGAEPTPARVAQALRERGRVLGDAEVLGAAERFRSELVGSGPLEPLLADPSVTDVLVSAPDRVWVDRGGGLELTAVSFPDAAAVRRLAQRLAAVAGRRLDDARPWADARLPDGTRLHAVLEPVAVGSACLSLRVVRPRAFTLAELVAAGTVPPGGDRVLRALLEARLSFLISGGTGSGKTTLLSALLGLVGPGERIVLAEDSAELRPDHPHVVRLEGRPANQEGVGLVTLQELVRQALRMRPDRLVVGEVRGPEVVSLLAALNTGHDGGCGTVHANAAAQVPARLEALGTAAGLDRAALHSQLAAALSVVLHLVRDRAGRRRIAEVHVLERDASGLVVTVPALRWGAETFTYERGWERLRGLLREGGEPL

SEQ ID NO: 12141 - protein, 209 aa, Streptomyces avermitilis
VRPCCHWRPGPSGCHCCAGCGLAAEARRARERRGEAVIGLCGALAGEVRAGRQPGEALLHAAGDSGGLGDAQAAVLAAARFGGDVPGALADAAGQPGAEGLLGLGACWRVAVDRGAGLAAGLDRLEAALRAERDQRAELRAQLAGARSTAVMLAALPVLGLLLGTALGADPLHVVLHTGAGLACLLAGAVLEGAGLWWALRIVRGAEAA

SEQ ID NO: 12142 - protein, 166 aa, Streptomyces avermitilis
MSAEVVHRLGVVWGASALWWLARALAAARRERRMRRRLGVLLVLHGAPARRRFEVRGTVLRWLPGAGALCSGWVLFGGLGGVVVGLIAGAGVSWWRLRRESGSAVPAEEYDPAVAARQLPLAADLLAACIAAGASPVTAAQRGRRGAAGARRGAAGDGGRRGAARG

SEQ ID NO: 12143 - protein, 101 aa, Streptomyces avermitilis
VRLGGEPADAWRRLASVPRAGALALLLERAGESGVPAAGPVGRLAAEARAEWGRTATARARRAGVLITAPVGLCFLPAFITVGVLPVVIGLAGGLLEGGSG

SEQ ID NO: 12144 - protein, 77 aa, Streptomyces avermitilis
MGRTVRVRVGVLVRRVRAAVHGVRGRAREDAGMVTSEYAMGIIAAVAFAAVLYKVLTSGQVSAELQDIVGRALDVRM

SEQ ID NO: 12145 - protein, 146 aa, Streptomyces avermitilis
MSGCERGAAGAACGPCGERRGARGMPGRDGGFVTAEAAVVLPALVLFAMALVWALLAASAQIQCVDAARAGARAAARQDPPDAVTAVARQAAPRGARVTVSREGDMVRVVVVAHPPGPRALTPELGDAAVALAEETVEVDTVGVQP

SEQ ID NO: 12146 - protein, 232 aa, Streptomyces avermitilis
VCGRGASGGASGGAAGSARCGHGGGPAGGATRGEGHGEPGGRHGARGGRGASARAKSADSRTRRRGGRVGGGDRGGGHGGGAAVRDRGSVRDRGSASVWVVCAIAGLCVVFGAVLAMSQAVVTRHRAASAADLAALAAADHWADAGGGACAMADRVARAQGGRLVRCAVEGEISDVTATSGRGPFTAEVRARAGPAGPADAVVPPGPAGPVVPVPPGAVSRTSARPGREAMP

SEQ ID NO: 12147 - protein, 835 aa, Streptomyces avermitilis
MAFNHLPAGVHDALGPLSVMPVTHSLPMAKNHRPDRSSSDTASSPSPGTVLDRLASGPSRASRITHTEHLPPREGRHAVWPDRIRSEVIAAVQAAGIEHPWAHQARAAEHALDGESVVVATGTASGKSLAYLVPALSALLDGSEAPNGRGATALYLAPTKALAADQCRSVKELSQPLGTAVRPAVYDGDTPVEEREWVRQYANYVLTNPDMLHRGILPAHPRWSSFLRALRYVVIDECHTYRGVFGSHVAQVLRRLRRLCARYGASPVFLLASATAAEPSVAASRLTGLRVVEVADDASPRGELVFALWEPPLTELHGEKGAPVRRTATAETADLLTDLTLQGVRSVAFVRSRRGAELIAVIAQERLAEIDRSLARRVAAYRGGYLPEERRALERALHSGELLGLAATTALELGVDVSGLDAVVIAGYPGTRASLWQQAGRAGRSGQGALAILVARDDPLDTFLVHHPEALFDQPVESTVLDPDNPYVLAPHLCAAAEELPLVEEDLALFGPSTADLLPQLEAAKLLRRRTKAWHWTRRERAADLTDIRGEGGRPVQIVEAGTGRLLGTVDAGAAHTTVHEGAVHLHQGRTYLVRELDLEDSVALVEEANPSYSTVARDTTAISVLETDVEVPWGEGRLCYGSVEVTNQVVSFLRRRLITGEVLGETKLDLPPRTLRTRAVWWTVTEDQLDAARITPEILGGALHAAEHASIGMLPLFATCDRWDIGGVSVPLHPDTLLPTVFVYDGHPGGAGFAERAFHTARDWLTATRQAIASCECDAGCPSCIQSPKCGNGNDPLHKRGAVRLLSVLLRGAAEQEKAGLPKEPARAAESSAD

SEQ ID NO: 12148 - protein, 113 aa, Streptomyces avermitilis
VDLSLSTRTVGDRTVVEVGGEIDVYTAPKLREQLVELVNDGNFHLVVDMEGVDFLDSTGLGVLVGGLKRVRAHEGSLRLVCNQERILKIFRITGLTKVFPIHTSVEEAVAATD

SEQ ID NO: 12149 - protein, 146 aa, Streptomyces avermitilis
MATVELRFSALPEHVRTARLVAAAVARRAGVDEAVLDEVRLAVGEACTRAVGLHQSSGVSSPVRVTLIEEEKQFSIEVGDEAPRSAPGERVPGTRAAEDPDADGDEDDMGLAVISGLVDDVEVTAGENGGLIRMSWPTMPPATLLP

SEQ ID NO: 12150 - protein, 801 aa, Streptomyces avermitilis
MAGLSTPHQFDHPTALAAAVLTDDNRVIVMVIGVVALAALVVAGILVRQVLAAGEGTDSMKKIAAAVQEGANAYLGRQMRTLGVFAVVVFFLLMLLPADDWNQRAGRSVFFLIGALFSATTGYTGMWLAVRSNVRVAAAAREATPAEGEPEKDLTAVSHKAMKIAFRTGGVVGMFTVGLGLLGASCVVLVYAADAPKVLEGFGLGAALIAMFMRVGGGIFTKAADVGADLVGKVEQGIPEDDPRNAATIADNVGDNVGDCAGMAADLFESYAVTLVAALILGKAAFGDSGLAFPLIVPAIGVLTAMIGIFAVAPRRADRSGMSAINRGFFVSAVFSLALVAVAVYVYLPGKYADLDGVTDVAIRAKDGDPRILAMVAVAIGIVLAALIQQLTGYFTETTRRPVRDIGKSSLTGAATVVLAGISVGLESAVYTALLIGLGVYGAFLLGGTSIMLALFAVALAGTGLLTTVGVIVAMDTFGPVSDNAQGIAEMSGDVTGAGAQVLTDLDAVGNTTKAITKGIAIATAVLAASALFGSYRDAITTAANDVGEKVSGAGAPMNLMMDISQPNNLVGLIAGAAVVFLFSGLAINAVSRSAGAVVYEVRRQFREHPGIMDYTEQPEYGRVVDICTKDALRELATPGLLAVLAPIAIGFTLGVGALGAYLAGAIGTGTLMAVFLANSGGAWDNAKKLVEDGHHGGKGSEAHAATVIGDTVGDPFKDTAGPAINPLLKVMNLVALLIAPAVVKFSYGEDKNLGVRIAIAVLSILVIVGAVYISKRRGIAVGDEGNAERVTKSADPAVVS

SEQ ID NO: 12151 - protein, 198 aa, Streptomyces avermitilis
MEGTNPVNKKLAAALSGGAVLVLALSGCSSSDDGGSDKLNSWAKQVCDAVQPQAKKIEAANTAIQKETSDNSAPADVQKTDSQAFQDISDAYKAMANAVDKAGAPDVENGKTKQANAVKELDDLSSAYADLKKQTDELDTKNQAKFADGLKGVATQLEKLSKSGSDALNNLEEGDVGKAMAQQASCKSASAPASATKG

SEQ ID NO: 12152 - protein, 529 aa, Streptomyces avermitilis
VPTPPSVVHRRACDVGRNGHNGGVSNSALSPLPSADRPDVAARLRDALLGASFTADGLLELLGAPAYAALARSEVVPALRATRGDTPLETLVRLFLLQQPVPHARVADVLPVDACLEAGWLTGVGGDEVAAAVDIRPYGGPDGEDWFIVSDLGCAVGGAGGIGSRDEGVVLGVGGASTTLAGITVRTPVAAALDLGTGSGIQALHAARHATRVTATDLNPRALHTTALTLALSGAPAADLREGSLFEPIAADETYDLIVSNPPFVISPGARLTYRDGGMGGDDLCRTLVQQAGDRLTEGGYAQFLANWQHVEGEDWQDRLRSWVPRGCDAWIVQREVQDVTQYAELWLRDAGDHRSDPVEYQARYDAWLDEFEARKVKSVGFGWITLRKTGAVEPSVTVEEWPHSIEQPLGEAVRAHFDRVDYLRATDDAALLAGHFKLAAEVVQEQVGLPGAEDPEHVVLRQHRGMRRATKVDTVGAGFAGVCDGTLSAGRILDAIAQLVGEDPVLLRDRTPAQIRLLVEQGFLDPVE

SEQ ID NO: 12153 - protein, 742 aa, Streptomyces avermitilis
MAGETPEQGEGRIISGRYRLLRTLGAGGMGRVWLAYDAELACEVAVKEIALPDLPIDASEPVQRIARARSEARNAARLRGHPHVATVHDVVVHEGLPWIVMEHVPDAIDLQAVVRRSGPLTPARTARIGVAVLDALTAGHRIGILHRDVKPANILLAPDASGDPYARVLLTDYGIALQPESREPRLTATAGILGTPGYLAPERARGEPPTPAADLFSLGATLYATVEGRGPFDRHGEYATLTALLGEEPTPPVRAGELGAVLHGLLIKDPVRRLAPEAVARGLEAVARAAPGEGFGPPPGWGSAPSVGQGFGPPPQGFGPPPDGFGPPSGTPSVSPPSAEGATTAPGAPGAPQVSAPGTPQTPGAPRTPHTPHTPQTPAGGPGTPPGSPSAYNPWRPTPPSGPYDPGNPYASSPSSPYAGTGAPAAYEGGPAYFPPRPSPRRKSAAALVALVVAAALVVTGGIWAALSLTGGPTGDGGGTTGQRAKKSPPVSGPQSTKPAGPVLPYGEQVGLTEPLQAGDCVRAVWSGAAFKSVPNLGVVDCADDWPDGQVVAVDTATDYADARDRGARRCAGQSQATADALPDAGVYAVAPTKEGFTAASGGTACLVLGRHAAIGGEVGRFRDTGTDLWVGQMSIGDCWIYKEEKDSYKAPLSDCAQPHTDQVIGAVSAPKNMDYKKGVDNGNKLCGNKFESSWAPGPARQVFGWVADKEDWNDGFDKVVCTVRRSDGAETSGKISAPGAV

SEQ ID NO: 12154 - protein, 113 aa, Streptomyces avermitilis
MSRDTVRPPCVHPGFARPLPARASLPFLGRVSPGDSSRRAGRDGRKWGMESGPAIFAGTVFALFGGGLLTWTVSRVRHRAPVAHDVNPVASATLAGLAAVSALVLGAWCFTHL

SEQ ID NO: 12155 - protein, 942 aa, Streptomyces avermitilis
LSPTSDTAHGGRRLVIVESPAKAKTIKGYLGPGYVVEASVGHIRDLPNGAAEVPEKYTGEVRRLGVDVEHDFQPIYVVNADKKAQVKKLKDLLKDSDELFLATDEDREGEAIAWHLLEVLKPKVPVHRMVFHEITKDAIRSAVANPRELNQRMVDAQETRRILDRLYGYEVSPVLWKKVMPRLSAGRVQSVATRLVVERERERIAFRSAEYWDLTGTFGTGRAGDASDPSSLVARLATVDGKRVAQGRDFDSLGQLKSANTLHLDETNARALATALENTNFAVRSVESKPYRRSPYAPFRTTTLQQEASRKLGFGAKATMQVAQKLYENGFITYMRTDSTTLSDTAVAAARAQVTQLYGADYLPAQPRTYAGKVKNAQEAHEAIRPSGDRFRTPAETGLTGDQFKLYELIWKRTVASQMKDATGNSVTVKIAGTAADGRDVEFSASGKTITFHGFLKAYVEGADDPNAELDDRERRLPQVGEGDPLSAEEISVDGHATKPPARYTEASLVKELEEREIGRPSTYASIIGTILDRGYVFKKGTALVPSFLSFAVVNLLEKHFGRLVDYDFTARMEDDLDRIARGEAQAVPWLKRFYFGEGAGTGGAADAGNGDGDHLGGLKELVTDLGAIDAREVSSFPVGNDIVLRVGRYGPYIERGEKDSENHQRADVPEDLAPDELTVDLAEELLAKPSGDFELGTDPATGHQIIARDGRYGPYVTEVLPEGTPKTGKNAVKPRTASLFKSMSLDTVTLDDALKLMSLPRVVGKDAEGVEITAQNGRYGPYLKKGTDSRSLQSEDQLFTITLQEALEIYSQPKQRGRAAAKPPLKELGEDPVSGKPVVVKDGRFGPYVTDGETNATLRSGDSVEEITPERGYELLAEKRAKAPAKKTAKKAPAKKAPAKKAPAKKTAAKTTAAKKTAAKKTTAKKTVAKKTTASKAAAED

SEQ ID NO: 12156 - protein, 1073 aa, Streptomyces avermitilis
MTRAEQPTAHHPAPDDALVADSRERAVRSLLRRPQLKRLWSAQLVGGVGDALALLTLVVLALQAAIVEGSFGGDYRGVALAVSAVFGARVLATLLFGAVLLGPLSSLTSQEGPLDRRWTMIGADGVRAALLIVAPLWIDWTPDDALAVLLVTAFVTGVAERFWTVCRESAAPALLPAPPLEGATVRPLPDHMDALRRLSLRTGFVAVPLAAATLVVVSLLNNLLGAGIDWFAQHQAALASYVAAGLFAASLSVITFVELPDVRTPRARSPLEGLRRPKTGTGIDKGRTGAIPHLVLACAAVAAAIAAAVAVSVLQAKDLGGGPVTYGLLVLALTGGVVIGIRTAPSVLPSLSRRRLLALAIAFTGIALLAAGLVPDVTTVLLIVGLAGVGAGVAANTGHTLLDQEAEEYRRARTTEHLHAVVRVFVAVAALVAPVVAAAIGPHRLENGKFVFAHGGAAFTLMLVGALLLPVAALVLAKVDDRSGVPLRHDLRDALRGGDDPVQTSAASGFFIALEGGDGAGKSTQAEALAEWIRAKGHEVVVTREPGATPVGKRLRSILLDVSSAGLSHRAEALLYAADRAEHVDTVVRPALERGAVVISDRYIDSSVAYQGAGRDLSPTEVARISRWATNGLVPHLTVLLDVAPETARERFTEAPDRLESEPAEFHARVRSGFLTLAAADLGRYLIVDAGQEPEAVTTVIRHRLDTLLPLSEAEVRAQEEARRKAEEEARRKAEEEAARKAEEERLERERLEQLAKLRAEEEERKQRELEEAQRREAERQAEEARQRAEEARRRAEEERVRLLAEEQARAAEEERRRVAEERRRKQAAEEERLRAEAEERRLEKQRKAEEALLRAEEARRAAAEAAAAATTAAASASTGVAPGRPDAPKVAGAGVSPSRPSRPSENETTVPTPVVTPSNATGGPVDETAVLPPVRPGAADSETTATLPKPPEPQGAADETTVLPPVPSGAADETAVLPPVRDAGPGGRAGDPSDRVPPGFFRDERPAGRPDAGDDRTRELPQVDSEGVARRRPRSDWAEETPLDDLPTLADELLGPRDDDTDDERGPGGRRG

SEQ ID NO: 12157 - protein, 401 aa, Streptomyces avermitilis
MPVWDDLVGQEKLSEQLAAAARDADALVTAATAGTPPPEASKMTHAWLFTGPPGAGRTTAARAFAAALQCVSPDRALGGIPGCGFCDGCHTALLGTHADVSTVAAVGTQILADDMRDTVRKSFTSPANGRWQVILVEDAERLNEKSANAVLKAVEEPAPRTVWLLCAPSVEDVLPTIRSRCRHLNLLTPSVDAVADMLVRRDGIEPEAAYAAARATQGHVDRARRLATDPRARERRAAVLKMPLRVEDIGGCLKAAQELVDAATADSKQLAEEVDVKETEEMRAALGGAQGGRMPRGTAGVMKDLEDKQKRRRTRTQRDSLDLALTELTGFYRDVLALQLGSRLALANTDAEDALERLARGSSPEATLRRIDAIAACRDALDRNVAPLLAVEAMTMALRAG

SEQ ID NO: 12158 - protein, 533 aa, Streptomyces avermitilis
MDTRRTSGQSRLLRSRSLRSTRTGGVFLAAAALLLSACSSGSSTGTTAEAALAALPRSTPSTLAPYYGQKLTWRSCGVPGFECATMKAPLDYAKPASGDVSLAVARKKATGPGERLGSLLVNPGGPGGSAVGYLQQYAGIGYPAEVRARYDMVAVDPRGVARSEPVECLTGRQMDTFTQTDMTPDDQRETNQLVDAYQHFAEGCGRRSPELLRHVSTVEAARDMDILRAALGDQKLTYVGASYGTFLGATYAGLFPERVGRMVLDGAMDPSLSARKLNEDQTAGFETAFQSFAKDCVRRTDCPLGGAHTTPEQAGDNLKAFFRQLDAHPIATGDADGRKLGESLATTGVIAAMYDEGAWEQLREALTSAMKDKDGAGLLALSDSYYERDPDGKYTNLMFANAAVNCLDLPAAFSTPDQVEKALPSFGKASPVFGDGLAWASLNCAYWPVKPTGAPHRIEAKGAAPIVVVGTTRDPATPYRWAQSLASQLSSARLLTYDGDGHTAYGRGSTCIDSAIDAYLLRGTPPTEGKRCS

SEQ ID NO: 12159 - protein, 126 aa, Streptomyces avermitilis
VSCVHAPWTASSRNSMHLLVLYQASQQAIAEAATTAHLDPDRLSLTTALHTVRLTVITARTPDPADLVSALVHVRNLAPVRRRSRTSPRCVKRTLSPYAYNKTKGSVGHKTTVTTDVTLLTSTASP

SEQ ID NO: 12160 - protein, 340 aa, Streptomyces avermitilis
VRERRTRSAPRRVTFLHRFEPCPPTCTTHRNYTRGCPQPCTKDCTRHASACPERKGGGLAFTRPKTKKSRNEVPIPPPFIPYLLEHKAQQGGARGAAGELRQENDAVFTRPDGRPLDPRADWEEFKELLEEAGISDRRLYDGSRHTAGTILNELGVDMPTIMEILRHTQISQTRRYVKGRSTLSKDAMRRIGDVFLPEPEPTTETRTETLDSKAARARRRRRVRQKQKPQITASEFWGFHRAAFGIRTRDLRITSALLWPSELRRRAVRTMVRSATSVSLHSFVGCSAHPPEAAPPGAAAGPMSSAFPLSAGCPGAGTRRSRSRCTCCRGRTPCGRRRRT

SEQ ID NO: 12161 - protein, 74 aa, Streptomyces avermitilis
MRIRRILAAVFATAALAGLGLTGAATATASVTPASVTPASVTPGECTDGGGTIDRSTPVLPTCRGGMYNGQTVD

SEQ ID NO: 12162 - protein, 238 aa, Streptomyces avermitilis
MNQQLLAKTFVELADNLVADFDLIDFLRLLTDRCVGMLDASAAGVLLADRNGELRVMAASDEQVRLLELFQLQNDEGPCLDCFRTGAPVTVPDLSAVTARWPRFAVQARRSGFGAVQALPMRLRDEVVGALNLFRATPGPFDPAATPLAQALADVATISLLQQRTAHRSTVLNEQLQTALNSRVLIEQAKGKLAERQGVDMERAFTALRTYARAHNRRLSDVARAFIDNSEPLTGLGS

SEQ ID NO: 12163 - protein, 291 aa, Streptomyces avermitilis
MPDSRSAHIRLLVAEQAAVRGARVGVVDVCTAAVVALPIGGAGLSAMSRGRASHPLCSTDHISEQLEELQLTLGEGPCVDAFTQGSAVLTPDLRTGELQNRWPLFVDAALSAGALAVFALPLQVGAISPGVLDLYAQVPVRLDAEELADALAFADLATLVLLDARIDETGGPPGGPIEDLGAYRAEIDQATGMLTVQLGVGIEEAFVRLRAHAYAHERRLAEVAADLVARRLRFSPGTEPVQDPADPHGDDEPFDDPDPRAPDPHGDADPHDADPHDDDDPRDDDDPRDSA

SEQ ID NO: 12164 - protein, 244 aa, Streptomyces avermitilis
VTARRRRTQEPGDSEPSGGGAVRLRRVNRRLVEGLREELADLYMQCCATAATAESPGERTPGERTPGEKSPGEKSPRGAYRRPDRSRFLTRLTADMRRPGFAMVLAEVNGLVGCAYGFPVRGDGSWWLDSDDALPLGMEQLTRSGRAFAFTDILVRPPPQGRELARRLQKRLLTDHRASLGVTSVDQADVTTLAVLRSWGWLDAGDVWRPAGPTVFRVLILPFGEQTLARPDGLARHAWTRWPD

SEQ ID NO: 12165 - protein, 94 aa, Streptomyces avermitilis
VAEVAELRARNTQLGRALASRPVIDQARGMVMALAPCSSERAWDLLVDVSQRCNLKLRYVAAALVATTKGEVLPDQVQRELGRALRRLHTADRR

SEQ ID NO: 12166 - protein, 112 aa, Streptomyces avermitilis
VFVLLLILVVILFGFLNPIWWVVAAVLVFGFGRSGRGSNRSPGGNSGSGEYREYGEYREYRDHRERQDRWDRRYSRRHRARWNREDRRDSEDRRARENQRARENRRAREDRR

SEQ ID NO: 12167 - protein, 114 aa, Streptomyces avermitilis
MYDQTRAQQPADSVTGSAGRRTPGPEPLLPSDERAKLALRLQQALNNFADSPRQSLEEAEGAFDEAVAHLTNTLAERRRALHEGWQDHDPETQSDALRLALREYREITQRLLRV

SEQ ID NO: 12168 - protein, 311 aa, Streptomyces avermitilis
MIVGRDGVGVVEHAEQGPRIAVAVVTMGNRPAEVDALLASVAKQDLPPARIVIVGNGCPLPEFARRLDLPGEVTGIEVDENLGCPGGRNVALAKLREFGDVDVVVELDDDGLLVDADVLRRVRDLYAADPRLGIVGFRIADENGETQRRHVPRVGKSDPLRGGPVTGFLGGGHALSMAMLARTGDWPAEFFFAHEETDLAWRATDAGWTILYAPELLLQHPKTSPARHAIYHRVTARNRVWLARRRLPLPLIPVHLGIWIAVTLVRTRSAGGLRAWFGGFMEGVRTSGGERRPMRWRTVWRLTRLGRPPVI

SEQ ID NO: 12169 - protein, 1137 aa, Streptomyces avermitilis
VSLSARSRRNSAQNRGEAGQFAAAREGSGRHMRYGLRYELRFGLLGPPVLYDADGEVRPIGSGKMRALLAALLLEPGRVVSVDALKDALWGGAPPASAQASLQNHVTRLRRLLGDDPERLRAVPPGYLLRVGEGELDVRVFEDHVAAARAAHAGGDWERTARECAAALALWRGTPLSGLPPETGGHALVQRLEEARLLAREWGFDAELHLGGARLAALVPELAALVAEYPLREAFHRLLMLVLHGTGRQAEALAVHRDLRARLIEELGVEPGSAVREAHLKILREGACGAGETQGCSGGGAALGGPAVVPDPGEAGKDAGAYEAGEGSGEGSDEAGKGAGEDSDGGTARAAVPAVPAVPAVATPPRPAQLPPAPAHFTGRGDVRAELLRALDPERGSCAVAVLSGMAGVGKSALALHAAHGLRKRFTDGQLYVNLHGATPGMAPLAPGQALASLLRDLGVEARRIPEHPDAAAALLRSLLAPTRTLMVLDDAANAAQIRQLLPGGPECAVIVTSRSPLTALDGARRFPLAPLSEEESAQLLRAVSGRGDGLDGAHRLVELAGRLPLALRIVAARLAARRALTPDDLAGQLAATDGRLHHLEYDDLSVRRSLAVAHDALSASDREADRDAALALCRIGALDLPEYGAPLLARLTGTDERRAEAALDRLVDVALLEETAFGRYAPHDLVRDFAREIAGTAGTAVTAGTAASVTDSYARGTGPAAPGAPGSAVSADSADSAASAGSTGSTDAGPGEGDAVPDLALRWYAATAARSYQAIVEPSAVRSDRLRTTPSEPDAHAADVAAAADFGSADEAHAWIGLELANAVALVERYAQASAYVPLLARYLAVSLQRGGRLGELEVLGEAALGAARRLGDEPAEAFALLDLAGLHFLKGRANDSLALLDRALEIWRRLDFLSCLCRGLGNRGLLLEGLGRYEESGETLRQCLEYARVLNDPHSEAITYSNLGNLYEHTDPRAAIEQHRRSLEIGEAIGDVVVRHSAHCNIGYAHLTLGEPDAAVPHFEESLRILGGHDNRHWQGERQTRLGLVRALRGQGDVARAARECDKLLTLAGRRSDRYSEGLARHQRGLLRLAAGDTDEALRQWKSALDALDGTDTPVVAELRELLIWRRHSTPPPPS

SEQ ID NO: 12170 - protein, 564 aa, Streptomyces avermitilis
MTGRWALAPAEDGGAEVVALGDGGLPSGPVRREPDLVEAVRSRPEATRWVWRSTADMAPRLLAAGVRVERCYDIEAAETLLLGHEGRLGEPRSAAAALARLRGGPVPPDPPQRAAVPGSQSSLFEPRPVHLPVDDLIEVYADQQRRHDATAHPDRMRLLTATESAGMLVAAEMNAAGLPWRADVHRDLLNELLGERYAGGGEPRRLAELTDEVSAAFGRRVRPDLPTDVVKAFAQAGIKVRSTRRWEIESVDHPAVKPLLEYKKLYRIWVAHGWSWLQDWVRDGRFRPEYLPGGTVTGRWVTNGGGALQIPKVIRRAVVADPGWRLVVADADQMEPRVLAAISRDPGLMEVAGRESDLYQSVSDRAFSGDRAQAKLAVLGAIYGQTSGDGLKNLAALRRRFPKAVAYVDDAARAGEEGRLVRTWLGRTSPPAAGASEDSAEEAGIPQDEPAPSSGAAQEWMPGYASTNSRARGRFARNFVVQGSAADWALLLLAALRRACAGLAAELVFFQHDEVIVHCPAEEADTVVAAIREAADLAGRLTFGETPVRFSFTTAVVECYADAK

SEQ ID NO: 12171 - protein, 229 aa, Streptomyces avermitilis
VIAADHLGDVADHLIGHFVDQARRSGASWTDIGKSMGVTRQAAQKRFVPKAEVDLDPSQGFSRYTERARNVVLAAHNEAKAAGNAESLPEHLVLGLLAEPEALAAKAVTAQGAPPDSVRRAATAALPPSADTVPELIPYGPAAKKALELTFREALRLGHNYIGTERILLALLELENGKGVLTGLGRQGGGGPCVEGTGGTGEGARARGVSGRLGQGKRDERAARARQEG

SEQ ID NO: 12172 - protein, 375 aa, Streptomyces avermitilis
VSTTTTVDRAFEAALYADTDATLDAGASLLAADPAADAELARRGEEFVATAWRRGWQPADLVRVVRRELDDVHIRLVSALILAQAPRHPNPGPRWAAQLGELDGAEAPRTDRFSYATAVLELYRLLLRLPAIEPVEPLEPPAGRAAPRDSDSRMLARIRALLAKAEATGFPQEAEALSAKAQELMTRHSIDEALLASRAPGKGAPGACRIGVDPPYETAKAVLLDAVAGANRCRAVWNDSLGFSTVVGFEPDLEAVELLYTSLLVQATAAMTKAEAAQRAGGRKRTKTFRQSFLAAYAHRIGDRLADVAQGQATQAEGELLPVLAARDVAVADHLEQMFPETVTTRLRGVSDAAGWEQGAAAADRAQVRGRRPIP

SEQ ID NO: 12173 - protein, 172 aa, Streptomyces avermitilis
MRAIPIAVTALAAALALTACDSGGSGSGSSDQSSKAASCRFGIEVEPGNAATTAGDTGNVPVTVTNLDSAPCTLKGFPGIELNSGDASWTAGRQPGAKAAKVTLQPDTAATFTITYVRGKSGAKDSAAVKTVKITIPGGGDAKSFPWSYGAVALKTGDDPNASVSPFQVAGD

SEQ ID NO: 12174 - protein, 169 aa, Streptomyces avermitilis
VTSASYVPHRPARIAVASAGLAAALALTGCSSGSGDSDSSTPSASASSSATDSGGSGKASPSAAAGKLEGSWLATSDGKAVALVITGKQAGLFSTGGTVCSGTAGEEAGMQMIHLKCSDGNTDRKTGMVDSVDAKSMKVTWTGKLGAETYMKSKGGALPSGLPTASLSS

SEQ ID NO: 12175 - protein, 101 aa, Streptomyces avermitilis
MAKKSKIAKNDRRQETVARYATRRAELTEIIRRPSTPEAERRAAQQELRRQPRDASATRVRNRDSVDGRPRGYHRAFGLSRVNLREQAHAGFLPGVRKSSW

SEQ ID NO: 12176 - protein, 73 aa, Streptomyces avermitilis
MLTGARPGFGNRISHSHRRTSRRFDPNIQSKRYWLASEGRHVRLRLSAKGIKTVDTLGVEAAVARIRARGVKV

SEQ ID NO: 12177 - protein, 54 aa, Streptomyces avermitilis
MARNELRPVIKLRSTAGTGFTYVTRKNRRNDPDRMTLRKYDPIARRHVDFREER

SEQ ID NO: 12178 - protein, 82 aa, Streptomyces avermitilis
MREGIHPAYAPVVFRDRAANHAFLTRSTMTSEKTVEWTDGHTYPVVDVEISNVSHPFYTGTARVLDTAGRVERFERRYGKGS

SEQ ID NO: 12179 - protein, 447 aa, Streptomyces avermitilis
MSHLSVVIVGGLHADARRAAVARLLADVPGSVALHHDLATAAAGTVVRTVRDATGLLSAGEAPLVDDCACCALREDLVPELERLADAGRTRLAVVELWDSVEPKAMAEVVAGSGLRLTGVITAVDPALLLPCLGNGDDLADAGLAAAATDRRTVADTFARQLEYAPVLAVAESEHADDEDRALLAQLHPTARQVPIAGDRPEGSAGSGHQGGEPADGHTVNGHTDDGHTVNGHTDDGHTDDGHTGVGRTEGMRTESVRASGRTPAGAPLSALAHAALAGFDVEAAAAAQHPACARLPAEADAHGVATLVWHRRRPFHPERLYTALEDLTCAAARSRGRFWLADRPDTLLHWDAAGGALCVENAGPWLASLPDAAWDLVPPVRRAAAALDWHPEHGDCCQHLVFTSPGLDRDGLELLLESCLLTDTEYAAGRAAWQQLPPAFDTLLEA

SEQ ID NO: 12180 - protein, 78 aa, Streptomyces avermitilis
MPRKPVRKVASTPRPNPLDQNGITYIDYKDTDLLRKFLSDRGKIRSRRVTRVTAQQQRLLARAVKNAREMALLPYSSR

SEQ ID NO: 12181 - protein, 73 aa, Streptomyces avermitilis
MAATRLHGAAWQKSRHSNSQGSCVEFARLPGGEVAVRNSRFPDGPALVYTRAEIEAMLLGIKDGEFDHLIVGG

SEQ ID NO: 12182 - protein, 174 aa, Streptomyces avermitilis
MLEPLRQGLPPLDPAAVSNAASCALPARYEAVREARQFTRRTLDQWDAGDRFDDICLVVSELVTNALRHALPSDTPRTNEQDPPVRLHLMRWTSRLVCAVRDPSHDSPVARESEDFSAESGRGLFLVDSFADSWGWHPSPSPHHESGRGHAVTAAFNGKVVWALFRLTHNPASE

SEQ ID NO: 12183 - protein, 274 aa, Streptomyces avermitilis
MLLGSHLRRLRESRGITREAAGYSIRASESKISRMELGRVSFKTRDVEDLLTLYGITDDSERTSLLSLAKEANVAGWWHSYSDVLPSWFPTYVGLEGAAHLIRSYEVQFVHGLLQTEAYAHAVVARGMQGASAADIDRRVALRLERQKYLAAKSAPEFHVVLDEAALRRPYGDRTVMRGQLQHLIDISERPNVRLQVTPFSFGGHSGESGSFTILSFPESDLSDVVYLEQLTSALYLDKREDVTQYEGALKQLQQDSPGPAESRDLLRGLLQLS

SEQ ID NO: 12184 - protein, 486 aa, Streptomyces avermitilis
MSSYFTDLAQQYIGGEWRPGTGSWDIIDFNPYDGEKLASITIATVDEVDEAYRAAAAAQKEWAATNAYARRAVFQRALRLIEDREAEITEAIIAELGGTHLKAGFELHLAKQFLLESINLALRPEGRIIPSPVDGKENRLYRVPVGVVGVISPFNFPFLLSLKSVAPALALGNGVVLKPHQNTPIVGGSLIAKIFEDAGLPGGLLNVVITDIAEIGDAFLEHPVPKVISFTGSDKVGRHVATVCAAQFKRSVLELGGNSALVVLEDADIDYAVDAAVFSRYVHQGQVCMAANRVLVDRSIEAEFTEKFVAKVKTLKSGDPRDPQTIIGPVINSSQADAISGAVDQAIADGAIALVHGTTTDNLVEPSVLTGLAADAPILQEEIFGPVALLIPFEGEEEAVRIVNDTPYGLSGAVHTADVERGVAFAKQIDTGMFHVNDGTVHDEPLVAFGGEKSSGIGRLNGEATVESFTTQKWISVQHGRSFFPF

SEQ ID NO: 12185 - protein, 179 aa, Streptomyces avermitilis
MVTHVSAEAPGDERGALLSFLEGERGGIRRALLGLTDEQAATRPSASELSLSGLVKHVAEVEQSWIARARQEAPAVKRDESNWHECFVLVGDETVASQLAYWEKVAAQTEAFIRSVPSLDDTFPLPNDPWFPPDERVSMRWVALHLIRETARHAGHADIIRESLDGATAFELVAREQAG

SEQ ID NO: 12186 - protein, 213 aa, Streptomyces avermitilis
MSAIRLLVLGAVRQHGRAHGYQVRNDLEYWGAHEWSNAKPGSIYHALKQMAKQGLLHAHEIAPSTVGGPPRTEYEITPEGTEEFRSLLRESLVAYDQKMDIQSAGIGFIVDLARDEAVALLKERIRRIEEWRAAVTEHYVPEDGPEQLGHIGEIMNLWVHRADSDAAWTRGLIERIEGGAYTFTGEGEPFVGVLTEGEENPYATGERHPEDAR

SEQ ID NO: 12187 - protein, 310 aa, Streptomyces avermitilis
MTDAIVVEGLRKRYGDKAALDGLDLTVARGTVHGLLGPNGAGKTTAVRVLTTLLRPDEGRVEVAGRDVLRRAYDVRLRIGLLGQHAALDEELGGRQNLEMFARLHHLRTRHARVRAGELLDRFGLADTGPKAVKHYSGGMRRRLDLAASLIAEPEVLFLDEPTTGLDPRGRAEVWAAVRSLVGGGTTVLLTTQYLEEADQLADRISVVDHGRVVADGTADQLKARTGGDRIDVVLRDAGQLGAAVALLPVGTSGVRVDRDRRLLSAPVTDRMAALSGVVRALEAAGIEAEDVALRRPTLDEVFLRLTGRA

SEQ ID NO: 12188 - protein, 253 aa, Streptomyces avermitilis
VSTYALIDSWTMTRRELAHWARQPVQALIGLVFPVMLLLMFGYLVGGGRGVAGDYVDFLVPGMLALTMAFGLEGTMLAVTQDLNKGVIDRFRSLPMANGAVLVGRAAADMLQSALGLAVLTGVGYAIGWRAHGGPGAFLAAVALLLLLRFAMLWIGIHLAMVAGRPEMVQAVQILVWPVGFLSNAFATPDAMPGWLGTAVEWNPMSHTVTAVRDLFGGPGGEPGHIWAAVAWPLALLAVFFPLAVRRFARLSR

SEQ ID NO: 12189 - protein, 470 aa, Streptomyces avermitilis
MPLHKGPVKSDERPMSFNPFFGEANPVSGMTEAPPKHRLADGPLPPSTAYQLVHDELMLDGNARLNLATFVTTWMEPQAGVLMAECQDKNMIDKDEYPRTAELEKRCVAMLADLWNAPDAGAAVGCSTTGSSEACMLAGLALKRRWARRNADRYPARDVRPNLVMGINVQVCWEKFCNFWEVEMRQVPLEGERYHLDPGAAAELCDENTIGVVGILGSTFDGSYEPIAELCAALDALQERTGLDIPVHVDGASGAMIAPFLDEDLVWDFRLPRVASINTSGHKYGLVSPGVGWALWRDSEALPEELVFRVNYLGGNMPTFALNFSRPGAQVVAQYYTFLRLGREGFRAVQQTTRNVARSLAERVAALGDFHLLTRGDELPVFAFTTAPEVASYDVFDVSRRMREHGWLVPAYTFPPNREDLSVLRVVCRNGFSTDLAELFVEDLSRLLPDLRRQARPQTHDKDAATGFHH

SEQ ID NO: 12190 - protein, 427 aa, Streptomyces avermitilis
VAHDTVHPAPAPATPARVLLPQILPALVVGVAASLLFVGVSALAGKLQNVLWQDLPDALGIGRYSVLWMIIMLTCTGVLVGLIVWKVPGHAGPDPATLGLGGAPPLAPAVLPGLLLATGLMLAGGPSLGPENPIIASNIALAYWLGRRFVPRLPGGLWIALAEAATIGALFGTPVAAALLLSEALAGQQAKGPLWDSVFAPLVAAGAGAITTTLVAHPTLDLGLPPLARPGWTDVLAAMVVAAAAAALGMVAVYAFPYVHGAFLRLRHPMVALPAGGLVLGLLAALGGHLTLFKGLDEVGDLAKDPDGWSAGQFLTMAVVKLAALLVAASCGFRGGRIFPSVFIGAAFGLFAHALVSAVPPALGVAAGVLGMLLAITRQGWVSLFTAAVLVASPAIIALLCIASLPAWLLVTGRPQMQLHEDGTPVR

SEQ ID NO: 12191 - protein, 253 aa, Streptomyces avermitilis
VSYSVGQVAGFAGVTVRTLHHYDEIGLLVPGERSHAGHRRYNDADLDRLQQILFYRELGFPLEEVAALLDDPQADPRAHLRRQHELLTARIEQLQKMAAAVEHAMEARTMGINLTPEEKFEVFGDKDPEEHAEEAERRWGGTEAYAESQRRAARYTKDDWKRMQAEVADWGERYDGLMAAGEPPAGARAMDMAEEHRLHIDKWFYDCSYDIHRGLGEMYVSDERFKEFYDSMRPGLAEHLRDAIAANADRHGG

SEQ ID NO: 12192 - protein, 121 aa, Streptomyces avermitilis
MGIEEYGGGQGPHSDVLVVTTNDVPGYRVQHVIGEVFGLTVRSRHLGSQIGAGLKSMIGGELKGLTKTLVETRNQAMERLVEQARVRGGNGILMMRFDVTEAADVGTEVCAYGTAVVLVKA

SEQ ID NO: 12193 - protein, 339 aa, Streptomyces avermitilis
VTTLALGPSWLDPNTLLDNFGIWGLLLIVFAESGLLIGFFLPGDSLLFTCGLLITAGTLDFPLWAAIALICLAAILGDQAGYMFGKKVGPSLFNRPDSRLFKQENVVKAHDFFEKYGPKSLVLARFVPIVRTFTPIIAGVSGMKYRSFLVFNVIGGVLWGAGVTLLGSWLGNIEVVHKNIEAILILIVLVSVVPIAIEFLRARSKSKKNPPQDPTPARHPDQDRPAAPVMDDATRPLRVPPIQQGQDQAYGNQGQDQAYGNQGQDQAYGNGQSYGDQAQGYPQDYGQGQQQYYPEEQYPQQYPQQGYGQGQQYPGQGYGQDQNYGQDQNHPYGQGYPQN

SEQ ID NO: 12194 - protein, 553 aa, Streptomyces avermitilis
VRQERVTEPEAEDRKPQSDEARSAFAAPVGVTSSDDESSTTSEFALPKGLDVPQPPTGDAEGSAFSTPHTYSAKHAPPAFTPPSGIPVVKLTKEAPWQDRMRTMLRMPVTERPAPEPVQKVDEAGPAVPRVLDLTLRIGELLLAGGEGAEDVETAMFAVCRSYGLDRCEPNVTFTLLSISHQPSLVDDPVTASRTVRRRVTDYTRLAAVYALVDDLSDPETAISLEEAYRRLAEIRRNRHPYPGWVLTAAGGLLAGAASVLVGGDAVVFVAAALGAMLGDRLAWLCAGRGLPEFYQFTVAAMPPAAIGIALTLTHVDVKASAVVTGGLFALLPGRALVAGVQDGLTGFYITASARLLEVMYFFVGIVAGVLVVLYFGVKLGAQLNPDQALGISERPVLQIVASMLLSLTFAILLQQERSTVLAVTLNGGVAWSVYGAMHYAGDISPVASTAVAAGLVGLFGQLLSRYRFASALPYTTAAIGPLLPGSATYFGLLSIAQNNVDKGLVSLTKAAALAMAIAIGVNLGSEISRLFLRVPGAASAAGRRAAKRTRGF

SEQ ID NO: 12195 - protein, 163 aa, Streptomyces avermitilis
VEFDVTIEIPKGSRNKYEVDHETGRIRLDRRLFTSTSYPADYGFVENTLGEDGDPLDALVILDEPTFPGCLIKCRAIGMFRMTDEAGGDDKLLCVPAHDPRVEHLRDIHHVSEFDRLEIQHFFEVYKDLEPGKSVEGANWVGRTDAEAEIERSYKRLKEQGGH

SEQ ID NO: 12196 - protein, 461 aa, Streptomyces avermitilis
VTAAGPWDSSGQRTAEREWAASRGGEGGADHGRDSRTPATAPRPAPSAASVLTGLGGATGTDVTTKSAPTEKALAGVLDPLLKDGSLGTRRSAAVVDVATGRRLYGKGVDEALTPASTTKIATAVAVLSAAGADHRISTRAVLEPDTKELVLVGGGDPTLTARKEGGGGWASLRTLADRTAAALKKRGMTRVTLSYDVSLYAGPVLHPIGENPNLAPVSPLMVDEGRVDDTVGGPATRSKEPAADAARAFGALLRAKGIRTTAPGPSKATGRSQALAEVESPPLSALVERMLTNSDNDIAEALARQTALAGGERASFEGGSRAIAAQLKKLGLPLGGAEFRDGSGLNREDRLTAGLLTALLAKAGDPAHAELRPVLTGLPVAGFTGTLSDRYEDGAQRSGTGVVRAKTGSLTGVNTLAGTVVDTDGRLLAFAFLTYESMDQETARAALDRTAAALAECGCR

SEQ ID NO: 12197 - protein, 377 aa, Streptomyces avermitilis
MTSIGGAASSGMVDWNLAVATATRLVRPGPEVSRDEARAVVAELRRHAKASEEHVRGFTRMGTEDTHDTPVLVVDRPGWVRANVAGFRELLKPLLDKMQERRGNTPGGAVLGAVGGKVTGVELGMLLSFLSSRVLGQYETFAPPTRDLPAAENGGGRLLLVAPNIVHVERELDVQPHDFRLWVCLHEETHRTQFTAVPWLRDHVGGEIQSFLGETEVDPMTVLERIREAAQSLAGGRPEGEEGDDGRSIVELVQTPAQREILGRLTAVMSLLEGHADFVMDGVGPDVVPSVGEIREKFQQRRAKGASRLDLALRKLLGLDAKLRQYRDGERFVRAVVEQVGMDGFNRVWTSPNTLPTKTEIAKPADWIARVHRKAES

SEQ ID NO: 12198 - protein, 345 aa, Streptomyces avermitilis
MGPHPAVAAIRLAVRRVLHDILIEHAPGSADLPRDVPHDLPPPPLVLVACSGGADSMALASALAFEAPKLGIRAGGITVDHGLQSGSDLRADEVVGRLVDLGLTPTESIAVTVGRDGGPEAAARDARYAALDAAARRHGACAVLLGHTRDDQAETVLLGLARGSGIRSLSGMAAVSGTGGRYRRPFLQLDRQTARKACMAQSLPVWDDPHNADPAYTRSRLRHEGLPALEKALGKGVVEALARTAQLSRDDADALDVWAGQAEASVRDAAGLLECAKLYALPPAVRRRILRRAAIEAGAPAGSLFARHIEEVDRLITGWRGQGAINLPGKVVAQRQGGRLVIRQG

SEQ ID NO: 12199 - protein, 186 aa, Streptomyces avermitilis
MRVDAKDMGTDLKSVLITKEEIDAKLAELAAKIDAEYAGKDLLIVGVLKGAVMVMADLARALSTPVTMDWMAVSSYGAGTQSSGVVRILKDLDTDIKGKHVLIVEDIIDSGLTLSWLISNLGSREPASLKVCTLLRKPEAAKVAIDVEWVGFDIPNEFVIGYGLDYAEKYRNLPFVGTLAPHVYGG

SEQ ID NO: 12200 - protein, 664 aa, Streptomyces avermitilis
MWIVLAVLAVVVLMQVVGSSGGYKTVDTGQVVQAINENKVQQAKITTGDEQVIKVELKDGQKVDGSSKIQASYIGDQGVTLAGTLQDKYQNKQIPDGYTVSPSKQNPFVGILLSLLPFVLIVVVFLFLMNQMQGGGSRVMNFGKSKAKLITKDTPKTTFSDVAGSDEAVEELHEIKEFLQEPAKFQAVGAKIPKGVLLYGPPGTGKTLLARAVAGEAGVPFYSISGSDFVEMFVGVGASRVRDLFEQAKANAPAIVFVDEIDAVGRHRGAGLGGGHDEREQTLNQLLVEMDGFDVKGGVILIAATNRPDILDPALLRPGRFDRQIAVDRPDMQGRLEILKVHQKGKPVAPDVDLSAVARRTPGFTGADLANVLNEAALLTARSDKKLVDNSMLDEAIDRVVAGPQKRTRIMSDKEKKITAYHEGGHALVAAASPNSDPVHKITILSRGRALGYTMVLPDEDKYSTTRNEMLDQLAYMLGGRAAEELVFHDPTTGAANDIEKATATARAMVTQYGMTERLGAIKFGGDNTEPFLGREMSHPRDYSEEVAALVDEEVKKLIENAHNEAWEILVENRDVLDALVLQLLEKETLSKEQIAEVFAPIVKRPARPAWTGSSRRTPSTRPPVLSPKELSLTNGANGASPAIANATESVPAAESAPEDRTEG

SEQ ID NO: 12201 - protein, 201 aa, Streptomyces avermitilis
MTDPVTLDGEGTIGEFDEKRAENAVRELLIAVGEDPDREGLRETPGRVARAYREIFAGLWQKPEDVLTTTFDIGHDEMVLVKDIEVLSSCEHHLVPFVGVAHVGYIPSTDGKITGLSKLARLVDVYARRPQVQERLTTQVADSLMEILEPRGVIVVVECEHMCMSMRGVRKPGAKTITSAVRGQLRDPATRNEAMSLIMAR

SEQ ID NO: 12202 - protein, 162 aa, Streptomyces avermitilis
VKELRIRTLAAVFVVAGVLSWAGARLWNSVGTLPRVPLAAPIVLALIAVVLLATALSLRARLKAQRERRPGAKGVDPLMAARAVVFGQASALVAALVAGMYGGTGAFLLESLDIPARRDQAIYAGFSVLAGVGVIAAAFFLERVCKLPEDDDTNGGGTAPAA

SEQ ID NO: 12203 - protein, 203 aa, Streptomyces avermitilis
MTAFYTEGQSDPTVQPVPASVVERVDAADTTLSNPKRAVISLGSNLGNRLETLQGAIDALEDTPGVRVKAVSPVYETEPWGVEPGSQPAYFNAVVLLKTTLPPSSLLERAHAVEEAFHRVRDEHWGPRTIDVDIVAYADVVSDDPVLTLPHPRAHQRAFVLAPWYDVDPEAQLPGRGPVEQLLAAVTRDGIVPRADLELRLPE

SEQ ID NO: 12204 - protein, 119 aa, Streptomyces avermitilis
VDRVALRGLKARGHHGVFPKEREEGQTFIVDLVLGLDTRPAAADDDLSKTVHYGIVAEEVVAVVEGDPVDLIETLAERIAFSCLKHAPVLEVEVCVHKPDAPITVPFDDVTVTITRSRV

SEQ ID NO: 12205 - protein, 169 aa, Streptomyces avermitilis
VSTPTPDTDVEQVGLANTAFYEAMERGDFETLSSLWLTPADLGVDEEYHDPADAGVVSCVHPGWPVLSGRGEVLRSYALIMANTEYIQFFLTDVHVSVTGDTALVTCTENILSGGPPPDDSDELGPLVGQLVVATNVFRRTPDGWKLWSHHASPVLAETGAEEGDESPD

SEQ ID NO: 12206 - protein, 310 aa, Streptomyces avermitilis
MSKKSGRGRVAGLPTWDRCAVMGVVNVTPDSFSDGGRWFDTTTAVKHGLDLVTEGADLVDVGGESTRPGATRVDEAEELKRVIPVVRGLASEGVTISVDTMRASVAEQALAAGAALVNDVSGGLADPEMIPVVAAAGAPFVVMHWRGFLAGGTIRGTYDDIVSEVVDELHARVEAVLEGGIAPDRIVVDPGLGFSKEADHDLTLLAHLDRLRDLGHPLLVAASRKRFLGRVLAGPEGAPPPARERDAATAAVSALAAHQGAWAVRVHEVRATADAVRVARAVEGARSERSAQAAPAAAAPDTAQAAEGAR

SEQ ID NO: 12207 - protein, 601 aa, Streptomyces avermitilis
MSDEVPDRSGVLRRIVRGPRPEAVPAVVASACTLVGVLDVAAGVFPRFRHSRMHAIAEVLPGALGPFAAALAISTGMLLLLLAHGLRRRKRRAWRAAVVLLPAGAVAQFAYRHSLIGVVISLALLAPLLRHRSEFEALPDPRSRWRALANFVLVGAGSLLLGLVIVSAHPNRLVGDPSLSDRIEHVLYGLCGFEGPVDYSGNTSWTVAFSLGALGLLTAVTTIYLAFRPEHPAARLTAQDEEGLRALLEKHGGRDSLGHFALRRDKAVVFSPSGKAAVTYRVVSGVMLASGDPIGDVEAWPGAIERFMDEAQAHSWTPAVMGCSETGGEVWTRETGLDALELGDEAVVDVADFSLAGRAMRNVRQMVKRIERAGYETRVRRIRDLSEGELERIRRAAEDWRGTDTERGFSMALGRIGDPADGDCLIATAHKADADPGPYGDLKAVLHFVPWGTDGVSLDLMRRDRSADPGMNELLIVAALQAAPKLGIVRVSLNFAMFRAALARGEKIGAGPVLRAWRGLLVFLSRWFQIESLYKFNAKFRPRWEPRFVVYASSRDLPRIGLAAMQAEGFVNLALPRLLRRRKAIPTPCAHRVAERGVRAA

SEQ ID NO: 12208 - protein, 376 aa, Streptomyces avermitilis
MGLTSNKVLVLAAFFAVLLFIGTVWLWPRLARRNWRAVGGRVALLLATQVAIFASIGVAANQAFGFYASWADLFGRESGQGVVVDHNAGGGSGGGPLQMLGTQPVNVTGGGRPQLGGQIQKVGIVGRTTHIATRAYVYLPPEYFQPQYRTRTFPAAVVLTGYPGTAEALIKGLHYPQTAHELAKNGQVQPMILVMLRPTVAPPRDTECVDVPGGPQTESFFAKDLPDAVLAHYRVGRKPGSWGIVGDSTGGYCALKLAMHHPKVYAAGAGLSPYYKAPLDPTTGDLFRGDKGLRNRADLFWYLKNMPAPDTSLLVSSSRIGEANYQNTLKFMEQVKAKRLTRVSSIILDSGGHNFNTWRREIPGTLQWISGRLSDR

SEQ ID NO: 12209 - protein, 514 aa, Streptomyces avermitilis
MLPPSVIAGVSLVCALGPWLFTEPMVLRGLAGGAAVTAIVGAVVLRRWDTAAGKRVADLTRARASDEWRHEERVAKLETDLEESRELRVKLEHKLRAKRAELAGLRNEHAALLRRYATAETERATALEGRRLLEIEATTPARALPAAPVRPQTPGGSETPGGSETQGRTETPGGSADSGSADAGVADAGAAGTPETATVAEPESTEPVESAEVEAAESAEAETDESVSPASAVFSPSGSPLFLRANSALDALTKAEAAKKAAADDTAPASAGPAPEASAPEATSVRDDDSVGADSVQDDSVQGDSVQDAPVQESAPKDESPKGGTPKSEAPDAGSVEEAVREDEAEGKPEAVDGNERAAAVPAPAVPVSAVPAPEEPEHSAVAAASTEAHPAKPAEPASSARRSGHFTVPTAVAVVPASPRRRPTVEGGFDFFGTQKGTSAQALEAVQNEDLADVVGQEALALHKAEAESGFKPAGEGSRGVGQVIDLTAHDETEHIDVQELRIDVKELRSAVS

SEQ ID NO: 12210 - protein, 457 aa, Streptomyces avermitilis
MAVSADGPPAAAGGEKPAAGGERPLDERRLHPVTPFRRAWAPVAVLVGWAVHDPNAAQEQLTRLTTTMLLIGLAVLIPAASLYGFLTWWFTHFAVTDSELRIRTGLLFRRTAHIRLDRLQAVDVTQPLLARVAGVAKLKLDVVGTDKKDELAYLGEGEARALRAELLARAAGFAPETAHEVGEAPVRQLLHVPPGKLAVSVLLTGATWGSLLAAVVVPPLLWFGTHSVWTVLATGLPLLGAAGASSVGRFLGEYDWTVGESPDGLRIDHGLLDRTHETVPPGRVQTVRIVEPLLWRRRGWVRVELDVAGSSNSVLVPVAPREAAEAVIARVLPGVTVPRSLPRPPRRAGWCVPLWWRGYGLAVTDTVFAARHGLLRRRLALVPHAKVQSVRLEQGPWARFKKVADVHVDTGANKTVTARLRDAGEAAALLHAQADRSRTGRREARPDRWMAKGAESE

SEQ ID NO: 12211 - protein, 173 aa, Streptomyces avermitilis
METGSAQNAGNTATTGGSGPEPVWTGLPPGLLRMRRLLLVVWLGLLTIGVGLLLGLLAGPGWAAFALLPPVLMAWGWVMLGRNWRSWRYAERADDLLISRGVLFREETVVPYGRMQLVEVTSGPVERHFGLASVQLHTAAAATDARIPGLDPAEAERLRDRLTELGQARSAGL

SEQ ID NO: 12212 - protein, 383 aa, Streptomyces avermitilis
MTPTTETMVGIGGAAESTDMVLNIGPQHPSTHGVLRLRLVLDGERIQHAEPVIGYMHRGAEKLFEARDYRQIIMLANRHDWLSAFSNELGVVLAVERMLGMEVPERAVWTRTLLAELNRVLNHLMFLGSYPLELGGITPIFYAFTEREELQHVMEEISGGRMHYMFNRVGGLKEDLPAGWATRARACVAALRSRLDVYDDLVLGNEIFRGRTRGVGVLTPEAVHAYGVSGPIARGSGVDFDLRRDEPYLAYGELQDTLKVVTRQEGDCLARFECLLEQTHNALDLADACLDRLAELPPGPINQRLPKVLKAPEGHTYAWTENPLGINGYYLVSKGEKTPYRLKLRSASFNNIQALTELLPGTLVADMVAILGSLFFVVGDIDK

SEQ ID NO: 12213 - protein, 352 aa, Streptomyces avermitilis
VTDETDGGGRVPGGEWRGWREAAQEALYGPAGFYRRPEGPAGHFRTSVHASPLFAGAVARLLRDLDEALGRPSELAFVDMAAGRGELVTGVLAALPPDIASRARGYAVELAGRPEDLDHRIEWLAEPPEGITGLLFANEWLDNVPVEVAEVDSAGVARLVLVRDDGTERHGEPVAGAESQWLTRWWPPAPEEGLRAEIGLPRDIAWASAVGTVHRGLAVAVDYAHFVDTRPPFGTLTGFREGRETLPVPDGSCDLTAHVALDACALPGARLLSQRDALRALGVSGERPPLSLASTDPAAYVRALAGAGAAAELTAPGGLGDFGWLLQPVGMSNGQMRRLRGLLVDVADHEEQ

SEQ ID NO: 12214 - protein, 401 aa, Streptomyces avermitilis
VQRLYDFLRRHPTWVDSFWAVVLFGITGVSISSVNGAPDQHGSLAEAVPISFVLSLVVALRRRMPEKMLVLAAAMGLLQLILDVQVLAADFAMLVIIYTVAADGARWASRFALVGGLFAAPVSQLRWPELHSSTAGNVLIAVFQTVPFVLAWVLGDSIRTRRAYLAQLEERAARLEREREAQSKVAVAAERARIARELHDVVAHNVSVMVVQADGAAYVLDTAPDQAKKALETISSTGRQALAEMRRLLGVLRTGEHQEGGEYVPQPDVEQLDDLIEQCRSSGLPVDFKVEGTPRPLPSGVELTAYRIVQEALTNTRKHGGPNAGASVRLVYFDDGLGLLVEDDGKGAPHELYEEGGADGRGHGLIGMRERVGMVGGTLDAGPRPGGGFRISALLPLKAAH

SEQ ID NO: 12215 - protein, 223 aa, Streptomyces avermitilis
MAIRVMLVDDQVLLRTGFRMVLAAQPDMEVVAEAGDGVEALQVLRSTEVDVVLMDVRMPKLDGVETTRRICSEPNPPKVLILTTFDLDEYAFSGLKAGASGFMLKDVPPGELLTAIRSVHSGDAVVAPSTTRRLLDRFAPMLPSAGKEPQFKELERLTDREREVMVLVAQGLSNGEIAARLVLSEATVKTHVGRILTKLGLRDRVQVVVLAYETGLVRAGGQT

SEQ ID NO: 12216 - protein, 210 aa, Streptomyces avermitilis
MLLWINGPFGGGKTQTAHEIQRRLPGSVICDPEHVGFGLRRMLPPGLRANFQDLASWRQGVVEVLDLALTRHDGVVIAPMTITDSGCFAQTVGRLRELGHDVRHFALLAERETVLRRLRERGFGHLLRYVAGKDAPLRGESWAVGQLDHCLERLREPEFGEHLWTDQSTVPKTADRIAVLAGLTLAPNTEGALRTRLRQVRVGVKHMRFD

SEQ ID NO: 12217 - protein, 374 aa, Streptomyces avermitilis
MSVCIDITGLPAERIVFETSPLAELAVALHALAEPGHHPATQGWATAISAALKPDLADRLSEADFLWRSTFSDIFMPFAGVAGGHVRPGATLAEDLDILDRLDDEEFVTAALEFSCGSQYAAGLPSPLVDRARHAIALELAASRGPRQLGFTQRLLADPPTVRAWVRRLLEDCDEAFFADTWRRVHPQLAADARHKTELLRHKGLEEALTSVSAALSLNTAGGRTRIEADKLAHGAATATDPAVGPGVTFVPSYHGWPHLLVLHASGWRPVVHYPVAAPELPSAASVELLKLRLEALAHPVRLRLCRYIARAPYTTGELAHAHDLSAPEVSRHLTVLKKAGLLTTRRRGRYVLHQLDVTVVARLGSDFLEGILR

SEQ ID NO: 12218 - protein, 42 aa, Streptomyces avermitilis
VRTRPWAGRPASTARNRRYSRSSRAVRRSWVPGAGGTGSPSR

SEQ ID NO: 12219 - protein, 413 aa, Streptomyces avermitilis
MSDTAEQGEERAAERAGEASAEGTGETSAEGTGEASAQLRRARRTAAYRGARRVLSRPGFRATIRERLALLEDASRLYDLDESVDMYGDGIVAALEERVAGLLGMEAAAFFPTGTMAQQVALRCWAGRTGNPTVALHALSHPEVHERNALGTVGGLRPVRVTDEPRLPTADEVRDFEEPFGALMLELPLRDVGYVLPSWEELSEVVAAARERDAVVHFDGARLWECTPHFSRPLDEIAGLADSVYVSFYKSLGGFSGAALAGPKTLVDEAKTWRHRYGGMVVQQFPAVLSALAGLEEELPRLPEYVAHARVVAAALREGFAAAGVPWLRVHPEEPHTHEFQLWLPYDPEVVTEAATRQAEETGTFLFANAWTRGGPGLAVTEVSVRAHGLQWTAEDVKAAVQEFVTRLPGAAG

SEQ ID NO: 12220 - protein, 306 aa, Streptomyces avermitilis
VSTFQQPDPRDRPARLTVGVVGAGRVGPALAASLQLAGHRPVAVSGVSDTSVRRAAAMLPDVPLVTPAQVLERADLVLLTVPDDALPGLVEGLAETGAVRPGQLLVHTSGRYGTKVLDPARSAGALPLALHPAMTFTGTAVDVQRLAGCSFGVTAPDELRLAAEALVIEMGGEPEWIAEENRPLYHAALALGANHLVTLVAESMELLRTAGVEAPDHMLGPLLGAALDNALRSGDGALTGPVARGDAGTVAAHVAELRKHAPGTVPGYLAMARATADRALAHGLLKPELAEDLLGVLANGTEGDAG

SEQ ID NO: 12221 - protein, 333 aa, Streptomyces avermitilis
MTTTLLRTADELHARVRHGRRAVVMTMGALHEGHATLIRTAREIAGAEGEVVVTVFVNPLQFGRGEDLDRYPRTLDADLKIAEAAGADVVFAPSADEVYPGGEPQVRISAGPMGERLEGAFRPGHFDGMLTVVGKLLHLTRPDVALYGQKDAQQLALIRRMARDLNFGVEIVGVPTVREDDGLALSSRNRYLAADERRTALALSQALFAGRDRHAAQEALRARAREVPATRARAEALSAIGESRAAADAHAVAKATPAGTSGPAAVRCAARLVLEEAARLQPPLVLDYLGLVDPSDFTEIPDDFTGEAVLAVAARVGTTRLIDNIPLTFGAAS

SEQ ID NO: 12222 - protein, 605 aa, Streptomyces avermitilis
VTGTGTGSTGIGPHGTGTGIRLHAPAPGWSIAADVVVVGSGVAGLTAALRCEAAGLTTVVVTKAHLDDGSTRWAQGGIAAALGEGDTPEQHLDDTLVAGAGLCDEEAVRILVTEGPDAVRRLIATGAHFDESSEGGLELTREGGHHRRRIAHAGGDATGAEISRALVEAVRARGLRTVENALVLDLLTDAEGRTAGVTLHVMGEGQHDGVGAVHAPAVVLATGGMGQVFSATTNPSVSTGDGVALALRAGAEVSDLEFVQFHPTVLFLGADAEGQQPLVSEAVRGEGAHLVDADGVRFMVGQHELAELAPRDIVAKGIMRRMQEQDAEHMFLDARHFGAAMWEHRFPTILAACRAHGIDPVHEPVPVAPAAHYASGGVRTDSRGRTTVPGLYACGEVACTGVHGANRLASNSLLEGLVYAERIAADIAAGPAENARHARVPQPVPQPEKPAHPLLAPEARFAIQRIMADGAGVLRSAESLAKAADRLQQLHTDARDALDENGKTAEPGVDTWEATNLLCVARVLVAAAQVREETRGCHWREDHADRDDTTWRRHIVVRLNPDRALAVRTTDTADFPPTLPPALGSARAGEAPMARPARPSRPQEQ

SEQ ID NO: 12223 - protein, 331 aa, Streptomyces avermitilis
VTEVSTPDLPLAQSGGCGDGCACGTGPGEEHEEYMECGLDPALAQLLADAGLDPLEVEDIANVAIQEDLDHGVDVTTVATISEDAVATADFTAREAGVVAGLRVAEAVISVVCTDEFEVERHVDDGDRVEEGQKLLTVTTRTRDLLTAERSALNLLCRLSGIATATRAWADALAATDTKVRDTRKTTPGLRSLEKFAVRCGGGVNHRMSLSDAALVKDNHVMAAGGVAQAFRAVGEMFPDVPIEVEVDTLHQLREVVDAGADLILLDNFTPTECEEAVAIVNGRALLEASGRLTLGNAEAYAKTGVDFLAVGALTHSSPILDIGLDLRAAE

SEQ ID NO: 12224 - protein, 265 aa, Streptomyces avermitilis
MLLTIDVGNTHTVLGLFDGEDIVEHWRISTDARRTADELAVLLQGLMGMHPLLGEELGDGIDGIAICSTVPSVLHELREVTRRYYGDVPAVLVEPGIKTGVPILMDNPKEVGADRIINAVAAVELYGGPAIVVDFGTATTFDAVSARGEYAGGVIAPGIEISVEALGVRGAQLRKIELARPRAVIGKNTVEAMQAGIVYGFAGQVDGVVTRMARELADDPDDVTVIATGGLAPMVLGEASVIDEHEPWLTLIGLRLVYERNISRT

SEQ ID NO: 12225 - protein, 240 aa, Streptomyces avermitilis
MPTPYGSRGGMAFGAEELRVLRRSLALALHPGSASAEDVQDCLRLAESVDEAARESARLRAFLLADLARYRAALPGTVSGFLPLLQDALDAGYRPTPDDLAALRALRGNPAAAALLYRCRILAERGVRARPATRPTASTSPTDARPAAAPLSLSIPASRTRLLALPGGRAAEGPDGKPAEKPAPAPTPKPTPQKTPRPDRPIPTPGEVFPPKRKPGPPATAAPPVPQVPPANPPHQLAAG

SEQ ID NO: 12226 - protein, 59 aa, Streptomyces avermitilis
MDYVSALVPPVVMAVFFIGLIVTIVKSQGGANKAKEDAFVDATLARADSARQASGDTGV

SEQ ID NO: 12227 - protein, 177 aa, Streptomyces avermitilis
MTRVWKWNRPVTVREVLEDLQRERSIAYTTVMTVLDNLHQKGWVRREAEGRAYRYEAVSTRAAYAAALMNDAWSQSDNPAAALVAFFGMMSEEQRQALRDAMRIAQGPEAAESHETFARATEKQAENRDENPDEKAAGKAGRNPDEKADEKADENQGRNPEGIVAENPASAEGDPGR

SEQ ID NO: 12228 - protein, 180 aa, Streptomyces avermitilis
VEKPAERAPEVSAKAITVRRARTSDVPAVRRLLDSYVRRGILLDKATVTLYEDIQEFWVAERDDNAEVLGCGALHVMWEDLAEVRTLAVNPDAKGLGVGHQLLGKLLQTARWLGVRRVFCLTFEVDFFGKHGFVEIGETPVDTDVYAELLRSYDEGVAEFLGLERVKPNTLGNSRMLLHL

SEQ ID NO: 12229 - protein, 111 aa, Streptomyces avermitilis
VAQKVQVLLVDDLDGGEADETVTFALDGKTYEIDLTTANADKLRGLLEPYVKGGRRTGGRASGGRGKARVASGGSQDTAQIRAWAKENGYEVNDRGRVPASIREAYEKANG

SEQ ID NO: 12230 - protein, 233 aa, Streptomyces avermitilis
MVHTVPLPRRPFAPVDPGRPDGPDGPGDLGGAGVPGGPGVPGGAGFPGGPGGPGGRVRQWYEHELGWVTMPGLPLRLATGLRFDVLDVPAAAGFPALRHLGPATPVALQGDRMRLLVAAGSADELPGLLDWLEWGALPLDLTAIGTGGHIEAPRPSGLNGSRPLPLGRAGSQGAAVWLRPPEPGCEVEASLPTLSAVGGDGDAPDLVRLVDTMATQCHRIRLRRSCAQPLAFS

SEQ ID NO: 12231 - protein, 841 aa, Streptomyces avermitilis
MFERFTDRARRVVVLAQEEARMLNHNYIGTEHILLGLIHEGEGVAAKALESLGISLEAVRQQVEEIIGQGQQAPSGHIPFTPRAKKVLELSLREALQLGHNYIGTEHILLGLIREGEGVAAQVLVKLGADLNRVRQQVIQLLSGYQGKETAAAGGPAEGTPSTSLVLDQFGRNLTQAARESKLDPVIGREKEIERVMQVLSRRTKNNPVLIGEPGVGKTAVVEGLAQAIVKGEVPETLKDKHLYTLDLGALVAGSRYRGDFEERLKKVLKEIRTRGDIILFIDELHTLVGAGAAEGAIDAASILKPMLARGELQTIGATTLDEYRKHLEKDAALERRFQPIQVAEPSLPHTIEILKGLRDRYEAHHRVSITDEALVQAATLADRYISDRFLPDKAIDLIDEAGSRMRIRRMTAPPDLREFDEKIAGVRRDKESAIDSQDFEKAASLRDKEKQLLAAKAKREKEWKAGDMDVVAEVDGELIAEVLATATGIPVFKLTEEESSRLLRMEDELHKRVIGQKDAVKALSKAIRRTRAGLKDPKRPGGSFIFAGPSGVGKTELSKALAEFLFGDEDALISLDMSEFSEKHTVSRLFGSPPGYVGYEEGGQLTEKVRRKPFSVVLFDEVEKAHPDIFNSLLQILEDGRLTDSQGRVVDFKNTVIIMTTNLGTRDISKGFNLGFAAQGDTKSNYERMKNKVADELKQHFRPEFLNRVDDVVVFPQLTQDDILRIVDLMITKVDERLKDRDMGIELAQSAKELLAKKGYDPVLGARPLRRTIQREIEDTLSEKILFGELRPGHIVVVDTEGEGETKTFTFRGEEKSALPDVPPIEQAAGGAGPNLSKDA

SEQ ID NO: 12232 - protein, 1039 aa, Streptomyces avermitilis
MEAASIGVKLASSVVTPLVKKLFVAEGPGAGLVEKPVRVSEFVSFKGEKRALAEKELTKLAAELVRRAVKSEGERPLPVDEEPAVVHALARTLHSLGDLDMTDVQAVRLGHQTLALHLRVASEAPDRHLSLDATLFYERLLENACLHILHFFTQRSTFVARTLVEQTRRQSELIAKIDELIARTPPTGGTDPSFEERYLAYVATKHSRLTIYGIDLVNSPERWPLDAAYLSIQALRPAEDNDTTAGIAAPHTTLPAEQAFAEHDLVLLRGVAGSGKTTLVQWLAVTTARGERGDRVPFVLPLRSLVRRPGGLPAPDGFLDAVRVPFHATQPDGWADRVLSARRGLLLVDGIDEIPERERERTRRWLRELLDVYPGNQWLVTSRPSAVRENWLTPDGFTELMLSPMDRDDVAAFVRRWHTAARIDASDTERLDGYERSLLDAVGTKPALGRLATNPLMCGLICALHRDRRGYLPHGRQELYDAALSMLLSRRDEERDMFLPGQDHGIHLTELPQIQLLQRLAYWLIRNNQSEMDRERAQRIVADVLPSLPSAAAQGDAEQILRHLLVRSGLLREPALGTVEFVHRTFQDYLGAKAAVEDGDFGMLVRNAVDEQWADVIRMAVAHARPRERAQLLGDLSETAGRLDEPAGTRVRLLALASLEHATELDPRIRAVVEGNAAPLIPPRTSQEARALAQAGPLVLELLPGPDGLTDAEARAVVVTASLVGTDAAIPVLARFRSHPSLPVRAQLTWTWHRFDTERYAEEVIAHLRPEGLYFTAQSASELRVLRELGGPSLLQLVGDIDPADIRSALRPGQLRELVVRDNRGLRDLRFLSDQGRLTRLDLSGLPLDDLTPLAELPLTWLSLALLPGLEAPDSLSPLSGSSTLNSLDIGIPLRTDSLDAALPRELPLEYLRFTRNALAFTRLRGLRHRHSVKTLSLANLPVRLTPPEFAEITRLPALEELRVNWNATGWEAGPVLPRVTRLRLNKFSGNEDLTKAPGLFPGVRTVTLHLAPDVTGVPDHVLGLFPSRPVIERTDSVL

SEQ ID NO: 12233 - protein, 185 aa, Streptomyces avermitilis
MDPVVLGTRPASSLVAPLVKKLFVREAPGAGPVDRPVRLSALVSFRGEQRSPAEKGVAKLAARLVREAVDSPGERPFPPDEKTAVTDVRSRRLLALGVRNSGQRTAPRGIGPRSGARFNGEYETHDMLSVLAPEVLTSPLRLRELTPRGVGGLAGLRALTTLRLHGARHRRRNRVMPACRRLTHN

SEQ ID NO: 12234 - protein, 203 aa, Streptomyces avermitilis
MSKRVTSRLSRTSLIRKRAAALAVGLGASAVLGAGVASAADTGLHASAAGAVQTQAAAAKKAPSASWIDPVKKYALSAGFNQAGGMWAHKHSGQDFAVPSGTEVLAAHGGTVVKAGGNGAGDGPAYGNAIVIKHGNGTYSQYAHLSRIDVRIGQVVATGQHIALSGNTGNSSGPHLHFEIRTTPNYGSGIDPVAFLRAHGVTV

SEQ ID NO: 12235 - protein, 191 aa, Streptomyces avermitilis
MDGTKRQRRGDTRQRIQDVALELFSEQGYEKTSLREIAEHLDVTKAALYYHFKTKEEILISLFEDLTRPLDELIDWGRQQPHTLETKQQVLTRYSEALTGAAPLFRFMQENQATVRELSVGETFKDRMLSMLDIIREPEAALTDQVRCVSALFTMHAGMFVLKDVEGDPEDKRKAVLEVAIDLVTQAHGAA

SEQ ID NO: 12236 - protein, 537 aa, Streptomyces avermitilis
VADNTGAGGSGDSAVGTEKQPRSVRVVLLALMIAMLLAMLDNMIVGTAMPTIVGELGGLQHLSWVVTAYTLATAASTPLWGKIGDMYGRKGAFMTSIVIFLIGSALSGMAQDMGQLIGFRAVQGLGAGGLMVGVMAIIGDLIPPRERGKYQGMMAGVMALAMIAGPLVGGTITDHLGWRWSFYINLPLGAVALAAVSAVLHLPKKRSQARIDYLGAGLLTVGITSIVLVTTWGGSEYAWGSAVIMELIGIGVAALVGFVFWQTKAAEPVMPLHIFRSLNFTLMSVIGFITGFVMFGAVLFLPLYQQSVQGASATNSGLLLLPMLGAMLAVSMVAGRVTTNSGKYKVFPIVGSVLMTAGLFLLAQMDTDTSRFTSGVYMAVLGAGMGCLMQITMLVAQNSVEMKDMGVASSSTTLFRTLGSSFGVAIMGALFNQRVEDEMAARAGALGSKVTEQSAQLDAASLAKLPVAAREAYQYAVSAGTHSAFLLGSVVAVVALVASVFVKEVPLKGAGPQKPAEDAAGDAASDVPPKQTVAESV

SEQ ID NO: 12237 - protein, 487 aa, Streptomyces avermitilis
MRGNLRRPGPAGTAGPGRTGIRTSADGGRARPRTGAGTGVRAGVRSGVVGVGAGIRTGVRWKISAAIALVGALVALALSLVVHNAARVSMLDNARDLADERIQVAERMYEAGRAQSFGVKLDDPAIPRDLMMKVTQGRRATYVADGPHGVPDIWAAVPLKDGRVLSLHTRFTDRSADIMKDLDQALIIGSIAVVFGGSALGVLIGGQLSRRLRKAAAAANQVAQGERDVRVRDAIGGVVRDETDDLARAVDAMADALQQRIEAERRVTADIAHELRTPVTGLLTAAELLPPGRPTELVRDRAQAMRTLVEDVLEVARLDGASERAELQDIMLGEFVSRRVAAKDADIEVRVVHESEVTTDPRRLERVLFNLLANAARHGKPPIEVSVEGRVIRVRDHGPGFPEELLADGPRRFRTGSTDRAGHGHGLGLTIAAGQARVLGARLTFRNVRPAGAPGDVPAEGAVAVLWLPEHAPTNTGSFPMLPLSGG

SEQ ID NO: 12238 - protein, 235 aa, Streptomyces avermitilis
MAEQTHVLFVEDDDVIREATQLALERDGFAVTAMPDGLSGLEAFRANRPDIALLDVMVPGLDGVSLCRRIRDESTVPVIMLSARADSIDVVLGLEAGADDYVTKPFDGAVLVARIRAVLRRFGHASGPNSRPAEDSSAPDGGVLTFGELEIDTEGMEVRRSGQPVALTPTEMRLLLEFSSAPGTVLSRDKLLERVWDYGWGGDTRVVDVHVQRLRTKIGQDRIDTVRGFGYKLKA

SEQ ID NO: 12239 - protein, 196 aa, Streptomyces avermitilis
VAGLAVLGLSVSACGTGGTGARDEGPAGSDSVAAGAATPTVSPSKAPKSVDAVKLVKDDPKVGAAVKRALKPCVADEYPVDVSYGDLTGGSADDIVVNVMTCGDAVGIGSYVYREQGHSYENVFRAEEPPVYAEIDRGELVVTQQMYEKDDPVSYPSSEEVITYSWSANRFSEESRTHTEYSNAVGGTDSATPAPN

SEQ ID NO: 12240 - protein, 179 aa, Streptomyces avermitilis
MAHGEVLEFEEYVRTRQDALLRSARRLVPDPVDAQDLLQTALVRTYGRWDGIADKRLADAYLRRVMINTRTEWWRARKLEEVPTEQLPDASVDDSTEQHADRALLMDILKVLAPKQRSVVVLRHWEQMSTEETAAALGMSAGTVKSTLHRALARLREELESRDLDARALEREERERCAA

SEQ ID NO: 12241 - protein, 313 aa, Streptomyces avermitilis
MTAPTKPTPSQSPSPTSPAPGAPGEALHAQVIAWFDEHARDLPWRRPDAGPWGVMVSEFMLQQTPVNRVLPVYEQWLARWPRPADLAKEAPGEAVRAWGRLGYPRRALRLHGAAVAITERHNGDVPTEHAQLLALPGIGEYTAAAVASFAYGQRHAVLDTNVRRVFARAVTGVQYPPNATTAAERKLARALLPEDESTASRWAAASMELGALVCTAKNETCHRCPIAGQCAWRLAGKPEHDGPPRRGQTYAGTDRQVRGRLLAVLREAVTPVPQSALDRVWDEPVQRARALDGLVADGLVEPLPGGLYRLPHS

SEQ ID NO: 12242 - protein, 124 aa, Streptomyces avermitilis
LTLRSLRNSYAPDRTPTFELTAKNSSGSDCKVDFGPKNSVLTITQADGDNDIWSSADCPKDSGSALFRVPAGDSATYTVKWDRKPSAPECATPPAGSAAAGTYLVEAKAPGFKKAQTSFVLAKD

SEQ ID NO: 12243 - protein, 374 aa, Streptomyces avermitilis
VAANDRAAAPGKSGGSSGADGLMRASLSAVAPGTALRDGLERILRGNTGGLIVLGSDKTVEAMCTGGFVLDVEFTATRLRELCKLDGGIVLSSDLSKILRAGVQLVPDPMIPTEETGTRHRTADRVSKQVGFPVVSVSQSMRLVALYVDGMRRVLEDSAAILSRANQALATLERYKLRLDEVAGTLSALEIEDLVTVRDVSAVAQRLEMVRRIATEIAEYVVELGTDGRLLALQLDELIAGVEPERELVVRDYVPEPTAKRSRTVDQALYELDALTHAELLELATVAKALGYTGSPEALDSAVSPRGFRLLAKVPRLPGAIIDRLVEHFGGLQKLLAASVDDLQTVDGVGEARARSVREGLSRLAESSILERYV

SEQ ID NO: 12244 - protein, 469 aa, Streptomyces avermitilis
MAARTKTAKDRPSYRCTECGWQTAKWLGRCPECQAWGTVEEYGTPAVRTTTPGRVTTSALPIGQVDGRQATARSTGVPELDRVLGGGLVPGAVVLLAGEPGVGKSTLLLDVAAKAASDEHRTLYVTGEESASQVRMRADRIKAIDDHLYLAAETDLAAVLGHLDAVKPSLLIMDSVQTVASPEIDGAPGGVAQVREVAGALIRASKERGMSTLLVGHVTKDGTIAGPRLLEHLVDVVLHFEGDRHARLRLVRGVKNRYGATDEVGCFELHDEGITGLADPSGLFLTRRAEPVPGTCLTVTLEGRRPLVAEVQALTVDTQIPTPRRTTSGLETSRVSMMLAVLEQRGRISALGKRDIYSATVGGVRLSEPAADLAIALALASAASDAPLPKNLVAIGEVGLAGEVRRVTGVQRRLAEAHRLGFTHALVPTDPGKIPSGMKVLEVADIGDALRVLPRSRRREAPRDEEDRR

SEQ ID NO: 12245 - protein, 582 aa, Streptomyces avermitilis
VMSSSPETFTHTTGAHRAHGDARKRVTAPRGATARTTAQRPSARYEPYLDGLFTYCLSVLCDHDAATAALGDVLALAERRHPRGPAAGDRRAWLYALARWACLRKLAETRRHRQATHAVGRRAAREDGENLSTRPAADRRTAEPTGSVPATEEDRARRQRELALLAWPEAAGTTPEQREALELAVRHQLGAPEVAAVLGMNLTAARELLAAAACEVERTRAVLAVVETGSCPSVARLTGDNQLVLSSALRRELVRHVDDCPCCRRTAERALPDAAWPGTSVTPAELPVLEAPRAALHLAMAHVPRARGGAPRFDRRGFPMDPKDRAARRDRFRARAVTTTVVATVIAAPVLALWAAYRGAPLTGEGVDGRSATASEAHATDTLDGEEASGYENAGNASARPVSGFTKGGRSPDVSVEVVSAKTGGRAAHLSVTAGHNGDTTLVTLTASGRSPVHWSARSGAPWLYLSRSSGTLEPGESFTIKVYVDHLREPVGPWHASVSVAPAGAVVTIDGYGTAGPPAPRPTPSHWTPPAPDPSATSPDPTPSDPPPTAEPTPTPTDPTPSDPPGSTPPSTDGGAPDPSS

SEQ ID NO: 12246 - protein, 289 aa, Streptomyces avermitilis
VPKTKKAKADKSSRASKGSKGSAQAKASPSATKSAKPPKVSDEKGLDFARAWVEFPDPADDEQVFRCDLTWLTSRWNCIFGSGCQGIQAGRADDGCCTLGAHFSDEDDEKRVAEHVARLTPEIWQNHDVGLRTGWVSEDEDGDRQTRPYQGSCIFQNRPGFAAGAGCSLHILALKEGREPLETKPDVCWQLPVRRTYEWIDRPDDTRVLQVSIGEYDRRGWGPGGHDLHWWCTSATSAHGAGDPVYVSYRPELIELMGKPGYDRLVELCEERLASQLPLLAPHPADPVN

SEQ ID NO: 12247 - protein, 310 aa, Streptomyces avermitilis
MRLGVLDVGSNTVHLLVVDAHPGARPLPAHSHKAELRLAQLLDEGGAVGPEGVDKLIGVVHEALQAAEDKGVEDLLPFATSAVREATNADDVLARVKAETGVELQVLTGAEEARLTFLAARRWFGWSAGKLLVLDIGGGSLEIAYGIDEEPDAAVSLPLGAGRLTAGWLPTDPADPDDVRALRRHVRAQIARTVGEFSRFGAPDHVVATSKTFKQLARLAGAARSAEGLYVQRELKRESLEGWVPRLASMTAEERAELPGVSDGRSSQLLAGALVAEGAMDLFAVETLEICPWALREGVILRRLDHMGPV

SEQ ID NO: 12248 - protein, 269 aa, Streptomyces avermitilis
VRIPDAKVALSTASVYPESTATAFEIAARLGYDGVEVMVWTDPVSQDIEALRRLSDYHRIPILAVHAPCLLITQRVWSTDPWVKLQRAKAAAEKLGATTVVVHPPFRWQRQYARDFVSGIWRMANETDVRFAVENMYPWRYRDREMLAYAPDWDVTKDDYRHFTIDLSHTATARTDATQMIDRMGDRLGHVHLADGNGSNKDEHLVPGRGTQPCAELLERLARTGFDGHVVIEVNTRRAMSSAEREADLAEALAFTRLHLASAVKVPRR

SEQ ID NO: 12249 - protein, 205 aa, Streptomyces avermitilis
MTEADAPRRRGRPSRTQTEAAPATRDRILEAAREEFSERGYEKTSVRGIAKAAGVDSALVHHYFGTKEQVFEAAIEVAFAPALNAPDAVADGPLDGVGERLTRFILGVWENPATRTPLLAIVRSAVNNDTAAAVFRRLIAAQLLRRIAGQLDFPDAELRAELAAAQLVGTAILRYVIKVEPLASADPEQIIARLAPVVQGHLTAP

SEQ ID NO: 12250 - protein, 617 aa, Streptomyces avermitilis
MPELRSRTVTHGRNMAGARALMRASGVPGADIGRKPIIAVANSFTEFVPGHTHLQPVGRIVSEAITAAGGIAREFNTIAVDDGIAMGHGGMLYSLPSRDLIADSVEYMVEAHCADALICISNCDKITPGMLMAALRLNIPTVFVSGGPMESGRATLVDGTVRTLDLVDAISDAVNDKISDEDILRIEENACPTCGSCSGMFTANSMNCLTEAIGLSLPGNGSVLATHTARKGLYEDAARTVVDITRRYYEQDDESVLPRNIATHAAFENAMALDIAMGGSTNTILHLLAAAQEAGVPFGLDEINEVSRRVPCLAKVAPNVAKDRTYYMEDVHRAGGIPALLGELHRAGLLNEDVHSVHSPSLSDWLKTWDVRAGSPSPEAIELWHAAPGCVRSSEAFSQSERWEALDEDAEGGCIRSAEHAYSKDGGLAVLKGNLAVDGCVVKTAGVDESIWTFEGPAVVCESQDEAVDKILRKEITHGDVVVIRYEGPKGGPGMQEMLYPTSFLKGRGLGKTCALITDGRFSGGTSGLSIGHASPEAASGGTIALVQDGDRIRIDIPNRTIDLLVDEAELSRRDQALNGVYAPVNRERKVSAALRAYAAMATSADKGAVRDVSKLG

SEQ ID NO: 12251 - protein, 732 aa, Streptomyces avermitilis
VMPPQRSAGTDPEAEHPQYAGQYLLEAALGSGGMGVVHLARSASGLRLAVKVVHAQYAQDPEFRGRFRQEVAAARRVSGAFTAPVVDADPGAGRPWMATLFIPGPTLAEHVKRNGALPPARLRHLMAGLAEALRDIHRAGVVHRDLKPSNVLLAEDGPKVIDFGISRPSDSELRTETGKLIGTPPFMAPEQFRRPREVGPAADVFALGSVIVHAATGSGPFDSDSPYLVAYQVVHDEPDLTGVPEELAELVAGCLAKEPDDRPTPDELMTALRSVSASYDTQAFIPVQRDGSSGSAWRPGPGPGTGPGTGPGPGPGHGGERVVTHQVRQPEPVAAPAARKRLGRRLWIPAVAVAVLACVAGALVLLGPGTGAPREQDAAPSKAAFQPWDIGLSAGGSKATGMAQCAYAPHRLYCTRPGVLAAAVDPADGKVLWSRGDAKRHSDGTVRPPVLSGGLLHVVSEGGKRLAALDPATGKTRWSHDLAAYGGRFAQVGGVVLLTGADARVTALDAATGEEKWRRRIPGQPQPAFVSYGDGLAYAVAAAGSGTKVAAVDPESGATRWQRRFDGVLSLVGAHDGAVWFASTTADSDTDAVVRYDVTRRTVRRVGLRFPLQGAQAVVRKDTVYVLANGGALVAVDTRTSKELWRLETSVSFASAPVAAGDRVYFAGADGRLLAVDASKGVLLGQTKARLGGAHGSLVSGLPSPVAADGKVYSAAPDGSLFAVDARRPGGW

SEQ ID NO: 12252 - protein, 114 aa, Streptomyces avermitilis
VNYSTGEADMATEDIQISGTEEAAEADSSAAATRTYPVAPGHRVNVRSGPGTHYSIVRTLPEGASVPIYCQRSGDSVSGPYGTTSLWDCIANAQYVSDAYVKTGSDGYVAPRCS

SEQ ID NO: 12253 - protein, 194 aa, Streptomyces avermitilis
VSDDENGTPATPAGPHPEPLRFFGTTWVDHEGGYAARRAGVAVGSLAAAVVGCLVLRFAYQGLEIAAVGRFVTLMVVGMFAVCSALAFGHTWGSFGKRPDPDRQASLRGLLAIGFIGSLLAYFFRSLTEAPGEKLHREEYETAREQYAKRTARRTPQSVPHAAQLIARGPACGAAPPPHRNHWPASPTPATMEV

SEQ ID NO: 12254 - protein, 210 aa, Streptomyces avermitilis
VDVGAGTGIATALLTARGADVIAVEPGDGMAAQFRRTLPGVPLLRGDGNALPLADASADFLTYAQAWHWTDPARSVPEAMRVLRPGGALALWWNTDAADVPWIAEQSERVRRYFGGEHGSKQGGGGTRGDAAFGGAVLRPDHTHRVVRWSRTVPVDTHLANIGSHSIFLLLGEESTNTFLTEERGHLLATFPDGLVEEVYDVVLIVATRP

SEQ ID NO: 12255 - protein, 491 aa, Streptomyces avermitilis
MRVVDVADAVGKLVNRSGKADLFASLVVFLVALPLCVGVAVASGVPAELGLVTGIVGGLVAGALPGSSLQVSGPAAGLTVLVYEAVKTYGPQALGVLVLGAGLVQLALGVLRLGRWFRAVSVAVVQGMLAGIGLVLVAGQVYAMGDVPSPASGAAKLAGLVSLPGDVAPVALLTGGATVLVLVLWPRWRRGARAVPAPLLAVGLASAATALFDLPVRRVEVRGLLDVVRPPSVGDLGRLTEVGVLGTVVAFALIASAESLFSAAAVDRLHGGRRTDYDRELIAQGTGNAVCGVLGALPMTAVIVRSAANVRAGARTKASRVLHGVWLLVFTALLPEVLGVIPVAALAGLLVHAGAKLVPVRELGALWRAHRGEAVVLGVTAVAIVIGNLFEGVLVGLALAVAKTAWDISHVHVETEDLGAAGIVVRVVGHATFLRLPKLLDALEALPHDREVRLELGGLRHVDHACAAALDGWAAARQGGQGRVATSSTSP

SEQ ID NO: 12256 - protein, 275 aa, Streptomyces avermitilis
MNIRRPRPPDPGNPATPALAVRAEGLTVVRGTRKVLKGLDFAVPPGRITGLLGPSGCGKSTLMRSIVGTQAKVTGTLDVLGLPAGDPALRSRIGYVTQAPSVYDDLTVRQNLDYFAAILDPGRAAAERRRAHVTSAIADVDLVSHADALAGNLSGGQRSRVSLAVALLGTPELLVLDEPTVGLDPVLRRDLWTLFHAIAADRGATLLVSSHVMDEAERCHRLLLMREGEILADGTPDALRTRTASETVEAAFLRLVDEASAASPAATAQGKEPVR

SEQ ID NO: 12257 - protein, 263 aa, Streptomyces avermitilis
MTTTATPTTTAGPFGGSAINHSRTTATAARVLRQLRHDPRTIALMILIPCVMLFLLRYVFDGSPRTFDSIGASLLGIFPLITMFLVTSIATLRERTSGTLERLLAMPLGKGDLIAGYALAFGALAIIQSALATGLAVWFLGLDVTGSPWLLLLVALLDALLGTALGLFVSAFASSEFQAVQFMPAVIFPQLLLCGLFTPRSAMHPALEAISDVLPMSYAVDGMNEVLKHTDMTATFVRDALIVAGCALLVLTLGAATLRRRTP

SEQ ID NO: 12258 - protein, 269 aa, Streptomyces avermitilis
MTQKVAVLGTGKIGEALLSGMIRAGWAPTDLLVTARRPERAEELRARHGVTPVTNAEAAKTADTLILTVKPQDMGTLLTELAPHVPTDRLVISGAAGIPTSFLEERLAQGTPVVRVMTNTPALVDEAMSVISAGSHATAGHLAHAEEIFGAVGKTLRVPESQQDACTALSGSGPAYFFYLVEAMTDAGILLGLPRDKAHDLIVQSAIGAAIMLRDSGEHPVKLRENVTSPAGTTINAIRELENHGVRAALIAALEAARDRSRELASGSS

SEQ ID NO: 12259 - protein, 331 aa, Streptomyces avermitilis
MKRIFSGVKPTGHLTLGNYLGAVRRWVDVDQHGADALFCVVDLHALTVDHDPARVRRLSRQAATLMLAAGLDPELCTVFVQSHVDEHARLSYLMECVATDGEMRRMIQYREKAAREQQRGGSVRLSLLTYPVLMAADILAYGTDEVPVGDDQTQHVELTRDLAVRFNQRYGHTFVVPRATRPEVAARVMNLQEPTSKMGKSDDVGPGIVYLLDEPEAVRKKVMRAVTDSGRDVVYDRESRPGVSNLLEILAACEGGSPEALSGAYASYGALKKDTAEAVVELLRPLQERHKALCAEPGYVEGVLRDGARRARELARPRVDAAYRAIGLLEA

SEQ ID NO: 12260 - protein, 214 aa, Streptomyces avermitilis
MRYDLVIFDNDGVLVDSEPLSNTLLAAYLTELGHPTSYEESLRDYMGAAMHRVHDLVQERTGQRLPDDFDEVFHGRVFAAFERELEPVAGAVDILEKLTADGVPYCVASSGSHERIRVGHRKTGLDRWFEDGRIFSSQDVGRGKPAPDLFLYAAERMGVPPKRCVVVEDSPLGVQAANAAGMDVFGYTAMTPAAKLAGATQLLSDLGELADLLV

SEQ ID NO: 12261 - protein, 233 aa, Streptomyces avermitilis
MSITAIETSTEATAAAATGTAAARPSFLPLILDVAVPVGAYYLLKNGFGMSTMAALGWSTVVPAVRTVWSAVKERKVNALAGLILFVNVVALALSLVAGDPRLMLAKDSGAGSAIGIGILVSVKLGKPMMTAGMKPFLIKGDAAKNAAWDRLIATSPRFRKAERTFSLIWGVALLGECVLRVVGAYTLPIDTMVGLGTVVMITTMVLAFLVSGRFGVVPMEKMLEAELAEQAK

SEQ ID NO: 12262 - protein, 403 aa, Streptomyces avermitilis
MTDVLRRGRASLAFGFFAQGVAFALLVTRIPAIQDRYGVSDALLPAFLAAVPILAGVGSVTTEHLVKRIPPSRVLRWSQPVVLLALLGVGWGDRLVELAVALGAFGLAVGALDASMNMLGVSLQRTYGRSIMLGFHATYSLGGIVGASLAWVGAHWHMALSVSYLPLVLVLLPATLVGSRWYVDGSAPSPQAHEAAATPLVFKLLLPLCLVMTFAYIGDSTVSNWSAKYLQDVLGSSEQLATLPYNVYMVTTLLGRAIGDFGVRRFGAVAVVRVGALVAALGFAVVAGAPGAWVGMLGFTLLGLGLCVLVPGTFAAAGRLFPGASDAAVARLNIFNYVGFLIGSPLVGALGDTWSYRGAMLVPMVLVLVTLVYARSFASGTDRYGDRHERPRTADVGRGSNGL

SEQ ID NO: 12263 - protein, 367 aa, Streptomyces avermitilis
MDPVRLALTRRLVDAFGLDREIEVVSAKPAGESTLRLVHREDYIEAVKAASAEPDAADGKYGLGTLDDPAFAGMHEVSALIAGQSVGAAEAVWHGDALHAVNFAGGLHHAMPGGASGFCIYNDASLAIARLLELGAERVAYIDVDVHHGDGVQAAFWEDPRVLTISLHEHPQTLFPQTGWPTETGADRAEGSAVNVALPAGTGDAGWLRAFHAVVPELIADFRPQVLVTQHGADTHFEDPLAHLAVSLDAQRAVQLACHDLAHQYADGRWVALGGGGYAVVDVVPRSWTHLVAIAAGRPLEPESMIPESWRQEVFARTRQLAPMRMTDGRWPVSWADWESGYDPADRLDQAVLATRKAAFPLRGMLP

SEQ ID NO: 12264 - protein, 271 aa, Streptomyces avermitilis
VLSTGALRAHLLAARLAGPVATSREESLRSYRLFAARDPRVMIGLDPEWTWEPRDLIELMADKCGVSADPTHTSGHDVIDPERTLEALDAFAARLGKAARDKVPVLLGTGHPHRLLGFYAALADALSAAGCTVLTPAQGHCVDITTRFGLRTYNLDYVRGVALVREPDVLTAGRETGAHSHSPLPVRTALAAAAEAGDPLPELVVGDHGWVCGAGQLGFEAIGLADTDDPALFVGEAEGRVSVVVPLDDAVRSDYYRPLTRYVLNRACLSQ

SEQ ID NO: 12265 - protein, 81 aa, Streptomyces avermitilis
VAVECGRFRCVMAAAGERPLNEVQFLTVAEVASVMRVSKMTVYRLVHSGHLPAIRVGRSFRVPEQAVHEYLRESYVGVETA

SEQ ID NO: 12266 - protein, 349 aa, Streptomyces avermitilis
VLVTGVARQLGGRFVRRIQRDPNVDRVIAVDAVRPEHHLGGADFIQADIRQPTIARVLAEHSVDTVVHMDVTGTALGTGSRATVKETNVIGTMQLLGACQKSPTVKRLVVKSSTNVYGSAPRDPAVFTETTPPKSLPSGGFAKDTVEVEGYVRGFARRRPDVAVCVLRFANILGPSADSPLASYFSLPVLPTVFGYDPRLQFAHEDDVIDVLRIASYEPRRGTLNSGTFNVAGDGVLLLSQCARRLGRPTVPLLLPAVTWVGSAVRTLGMTDFSPEQIRLLTHGRVVATNQMRETLGYVPKYTTAETFADFARSRGPGLLPPEALAGAVDRIAALPALGGGHPPTQSAN

SEQ ID NO: 12267 - protein, 348 aa, Streptomyces avermitilis
MADAKVIPFDDDRSRGAAVQRPPRRRGAGSRRGGEPAVVREVQPLPGRALPQDDVPVTREEQPPQRPQDGGLERRIAGGLAFLRRRLTGDYEVDDFGYDEELTDQVLMSLLRPVYEKYFRVEVKGIENIPAKGGALIVANHSGTLPLDGLMMQVAVHDNHPAGRHLRLLAADLVFMLPVVNELARKAGHTLACAEDAERLLERGELVGVMPEGFKGIGKPFGERYKLQRFGRGGFVSTALRQGTPIVPCSIVGAEEIYPMIGNAKTLARLLGFPYFPITPTFPWLGPLGAVPLPTKWTIQFGEPIPTDGYPPEAAEDPMLMFNLTDQVREQIQHTLYKLLVQRRSVFF

SEQ ID NO: 12268 - protein, 411 aa, Streptomyces avermitilis
VPPVIANVSAHRRANAFAQALEEQSDRDSAAGQPDGPAPPPTAAERTGQGRMLALTTGLGELPKPKLDPEVKVVQRAQLVAAMEAMLRDGTVPGGEAADPSVPEQRSHRARGAHRATGLGKLRPRTRLTKGLAAGGLSVGVAAASFGGVAAASSDALPGDSLYGLKRGIEDVKLGLVHGDSDRGQLYLDQASTRLSEARRLMERDRGGPLDHESVGEVRRTLSGMQHDAAEGHRLLHEAYERDGSLGPIQALSTFSRSHREAWGALRDRLPVQLGDVSQQVSSVFDAIDQEVAPLQSLLPQPPAPGGTGKRHGSGTESSRSAGTDQPEPSATGDSATGSDSSGKPQPSTSKSGEEGLLGGNTGGLLDPPKDSTSSSPASSKPPTSGAPDVTLPPLLPGLLPGLGIDSGETK

SEQ ID NO: 12269 - protein, 258 aa, Streptomyces avermitilis
VYPHVGVDASGLATLRTTVLDLLRGFVPTAYAVPAFATAAPLGPCYALAEGSAAVGGRRGRSSSAATTARRPAADSDSARMMDLVERAQAGEADAFGRLYDQYSDTVYRYIYYRVGGKATAEDLTSETFLRALRRIGTFTWQGRDFGAWLVTIARNLVADHFKSSRFRLEVTTGEMLDANEVERSPEDSVLESLSNAALLDAVRRLNPQQQECVTLRFLQGLSVAETARVMGKNEGAIKTLQYRAVRTLARLLPDDVR

SEQ ID NO: 12270 - protein, 296 aa, Streptomyces avermitilis
VLAGEASAEAARKSSQELEELAHEAAPDVTDQEPAFPVLGDDKAAAFFDLDNTVMQGAALFHFGRGLYKRKFFETRDLARFAWQQAWFRLAGVEDPEHMQDARDSALSIVKGHRVSELMSIGEEIYDEYMAERIWPGTRALAQAHLDAGQKVWLVTAAPVEIATVIARRLGLTGALGTVAESVDGVYTGKLVGEPLHGPAKAEAVRALAAAEGLDLSRCAAYSDSHNDIPMLSLVGHPYAINPDAKLRKHARNLDWRLRDYRTGRKAAKVGIPAAAGVGAVAGGTAAAIALHRRRR

SEQ ID NO: 12271 - protein, 102 aa, Streptomyces avermitilis
MADMSPIFRRKAAQSAPQDRLVTLIRKPGCHLCDDAQQVIEKVCGDLGVPWEQKDITQDAELHREYWEQIPVVLVDGAQHTFWRVNEERLRKALTQGLPGRS

SEQ ID NO: 12272 - protein, 252 aa, Streptomyces avermitilis
VATGRTHRPATRSRGIPEATVARLPLYLRALTALSERSVPTVSSEELAAAAGVNSAKLRKDFSYLGSYGTRGVGYDVEYLVYQISRELGLTQDWPVVIVGIGNLGAALANYGGFASRGFRVAALIDADPAMAGKPVAGIPVQHTDELEKIIDGNGVSIGVIATPAGAAQQVCDRLVAAGVTSILNFAPTVLTVPDGVDVRKVDLSIELQILAFHEQRKAGEEAAAEGAIPAAASKESADKGPDGDVPAVMPA

SEQ ID NO: 12273 - protein, 569 aa, Streptomyces avermitilis
MSLLVVGLSHRSAPVSVLERATLTADAQVKLLQDTVAAEPATEAAVLATCNRIELYADVDKFHAGVAELSTLLAQHSGVGLEELTPYLYVHYEDRAVHHLFSVACGLDSMVVGEGQILGQIKDALATAQELHTAGRLLNDLFQQALRTGKRAHSETGIDRAGQSLVTFGLEQLSAGTAVEAWAKGKRALVIGAGSMSSLAAATLARAGVAEVVIANRTPDRAERLAQILTEGDDTDVLARAVPMDAVPAELTRADVAVSCTGATGLVLTAEAVAAAVEGRTGTPVAVREETPASAAGGLAPAGTDEGCPLDLSAVQGATGFSVMGEAAVAGMDAATLEQHAAWVDRGTVDRRDSRRTPEVEAELITALAATVAAGGRLPERRRPEPVVEAPRPAPALALLDLAMPRDIDAAVHRLLGVRLVDIESLAEASADAPMAADVDLVRRIVADEVAAFGAAQRAAHITPTVVALRTMAADVVANEIARLDGRLPGLDEKQRGEITQTVRRVVDKLLHAPTVRVKQLAAEPGGAGYADALRTLFDLDPETVAAVSRADDRDTSDSTENAKNRGRE

SEQ ID NO: 12274 - protein, 324 aa, Streptomyces avermitilis
MSEQALRLGTRRSKLAMAQSGQVADAVRQVTGRPVELVEITTYGDTSREHLAQIGGTGVFVTALRDALLRGEVDFAVHSLKDLPTAQPDELALAAVPVREDPRDVLVARDGLTFEELGAPSPKGTARVGTGSPRRMAQLNAYARSHGLAVETVPIRGNVDSRIGYVRSGELDGVVLAAAGLHRIGRIDEVTEFLPVDTVLPAPGQGALAIECAADNADLIAALAELDDPFTRAAVTAERSLLAALEAGCSAPVGALADLLADGQIVTEMRLRGVVGTTDGSTLVQLSTTGPVPETHDQAMALGRELAAEMLAKGAAGLMGEREH

SEQ ID NO: 12275 - protein, 571 aa, Streptomyces avermitilis
LSPTTLPAGPEHGHVTFLGAGPGDPGLLTLRAVEALARADVLVAEHEVLDVVRTHARQGVAVLNTSSDAYSDTSSGTYSATSTPQLAVVDSTSTTAGTPASRDAANLVMEAARGGRRVVRAVSGDPGLDTYAAEEMLACAAAGVPFEVVPGIAAAVGVPAYAGVPLRDAQGADVRFVDARSASERCWTEVGASDGTVVVSATLDSVAAAAGELVAAGRKPDTPMSVTIAGTTTRQRTWSATLGSIAQTLKQAKVLPSPDGGRPVIAVVGERSAAAQRDQLSWFESKPLFGWKVLVPRTKEQAASLSDQLRSYGAVPHEVPTIAVEPPRTPQQMERAVKGLVTGRYEWIAFTSVNAVKAVREKFEEYGLDARAFAGIKVAAVGEQTAKALVAFGVKPDLVPSGEQSAAGLLEDWPPYDPVFDPIDRVFLPRADIATETLVAGLIELGWEVDDVTAYRTVRASPPPAETREAIKGGGFDAVLFTSSSTVRNLVGIAGKPHNVTVIACIGPATAKTAEEHGLRVDVMAPEPSVLKLAEALADFGLRRRASALDAGDPVTRPSERRPGSRRRRTT

SEQ ID NO: 12276 - protein, 330 aa, Streptomyces avermitilis
MTKYGSFPGTRPRRLRTTPALRRMVAETRLHPADFILPAFVREGVSEPVPITAMPGVVQHTRDSLKKAALEALEAGVSGIMLFGVPEDAKKDAQGSAGTDPDGILQVALRDVRAEVGDELIVMSDLCLDEFTDHGHCGVLDGQGRVDNDATLERYAEMAQVQADAGAHVVGPSGMMDGQIGVVRDALDQIGREDVSILAYTAKYSSAFYGPFREAVGSSLKGDRKTYQQDPANARESLRELALDLEEGADMVMVKPAGPYLDILARVADAVDVPLAAYQISGEYSMIEAAAEKGWIDRDKAILETLTGIKRAGAQNILTYWATEVAQKLR

SEQ ID NO: 12277 - protein, 238 aa, Streptomyces avermitilis
VAAGTDHPTSLGHPSTPLPATGRAATPTSHTRGGRPMSERTARTRLFAAAAVALAALALTACENGEGVRDEDPSAASKSATRPTGSTPTTAPDTADTTPGTTTAGSPPCTADTTRIMATEVSRPLNHLLLTLTNTGSRTCTLTGHPVTRFGEARSVPAARETRPRAAVRLSPRESAYAGVLLSSGDGSGASGSTAKTLTITFKDGSTARPALPPRGVHVDDRLTVTYWQSSMDTALTY

SEQ ID NO: 12278 - protein, 451 aa, Streptomyces avermitilis
MSSLWNTVRDAGEGENVAGDEFAGLLKELKERSGLSYGTLGKRLHMSASTLHRYVNGEAVPADYAPVERFARVCRATPEELVELHRRWVRADALRGQKGAPEPAVASAVAVPEPEVEAASGTEGAPEPDAASGAEDAPEVESDAGAEPESPVRRRRTVVLAGAAVAAAVVAAALVVNLVPGKGDDHGRKQSAGAAASSAGVTSDGTASAGAKSASPSPSPSASRGAGPAPSGSRSVGAERTRGPDDGAAAPIVVANAYKWDSPCSQHYLVDRDAARMPPPPTEPDARGWVTALGGVPAGQQMLALTVQGTGKATVVLESLHVRVAKKDAPLAWNDYEMGVGCGGGVETRSFEVDLDAGRPVAVPKAGQRDFPYKVSESDPEVFYVFADARTHDVSWNLELEWSSGTKHGTVRVDDNGELFRTSGNVGRPAYNYPLGSTEWGRNAYEPNVKG

SEQ ID NO: 12279 - protein, 300 aa, Streptomyces avermitilis
MPGDALSHDPAELRKRIDTTKAHPARVYDVFLGGKDNYPVDRAAAAAALAANPRGYLDVRHNRDFLRRAVTRLAQDDGIRQFLDIGTGLPTQENVHQIAQRINPDSRVVYVDNDPVVLAHARALLNSGPEGATDYIDADLKSPGQILEAAAKTLDFDQPVALVLVAVLHFVEDAEAYPIVRELVEALPSGSRLVLSHLTEDLNAENIRAVQRTFTERGFTFVLRTKGEVERFLTDNGLELDDPGVVPAHHWRPDDAAPVPEQPDASYLASLDDIEKVRYRDINDVTDADINVYAVTGRKA

SEQ ID NO: 12280 - protein, 317 aa, Streptomyces avermitilis
LPLRLPPMLPSVDTSEELDAMVRDEALLRPAAQDLCAHLGLTGARLVRFDDGSLPVYAVGGTLVLKLFPGFEAAEGVREARVLSHLWGQLPVPTPRLHAGEMYKNGWRYVLMSRLPGVSLSTAWSRIPAVEQDRIVDEAAETLAALHSVDWKPLADVVGPADWGTFLRRQRAGVLEHHRAAGLPKPWLDQIPGFLDAVRLPASGERVLLHTEFMREHLTVDPQDGWRLTGLFDFEPAMIGDPAYDFVSVGLFMSRGDPRLLRRFYQAYGRPPHDPYQLLAYTLLHVYSDLAWYLREMPAPPHPRLDALAETWFGTDG

SEQ ID NO: 12281 - protein, 303 aa, Streptomyces avermitilis
MATLPNPLPKLAADPSGRTLGLELPAGRLIDATHDGPWPEPLLWCADGPATPGAWAALTPARRTAGLLPVLLDVGGPQGEPDEWELMPAEASYPGDHDAEEVLAEFWEEYAADELSDGEGRPGEERAEEVFGTPASGDETVAPFGPVWPGLAPAAHLTTDAGAGPDESADPDAHAAGTADSLAADGSWLKEPRLALVPARRSADIPAALGWSGPLNHESDPARLCAVLRSWEDRFGIRVVALTFDQLVLSVAAPPTTPAEAEAVAAEHFAFCPDNITRGHHKTLRSYAAHEVLNRRTWSFWWD

SEQ ID NO: 12282 - protein, 590 aa, Streptomyces avermitilis
MASVTSLTASVHQRLADALSAALPEAGSADPLLRRSDRADFQANGILALAKKAKANPRDLATQVVARVESGEVIKDIEVSGPGFLNITITDQAITRNLAARYEDGERLGVPLAEHPGTTVIDYAQPNVAKEMHVGHLRSAVIGDAVVQILEFTGENVVRRHHIGDWGTQFGMLIQYLIEHPHELDHKGAAEVSGEEAMSNLNRLYKAARTLFDSDEEFKTRARRRVVDLQAGEPETLAMWQKFVDESKIYFYSVFDKLDLEIRDPDVVGESGYNDMLDETCRLLEESGVAVRSDGALCVFFDDVKGPDGNPVPLIVKKSDGGYGYAATDLSAIRDRVFNLKANSLIYVVDARQSLHFKMVFETARRAGWLNDDVQAQQLAFGTVLGKDGKPFKTREGETIRLVDLLDEAIDRATAVVREKAEKVGLSEQEIEENGRYVGIGAVKYADLSTSAVRDYKFDLDQMVSLNGDTSVYLQYAYARIRSIFGKAGDRTPLAHPELELAPAERALGLHLDRFGETLDEVAAEYAPHKLAAYLYQLASLYTTFYDQCPVIKPAPAQEVAENRLFLCDLTARTLHQGMALLGIRTPERL

SEQ ID NO: 12283 - protein, 548 aa, Streptomyces avermitilis
VVVASGLSPSGPIHLGNLREVMTPHLVADEVRRRGHTVRHLISWDDYDRYRKVPAGVPGVDESWAEHIGKPLTSVPAPKGSAYPNWAEHFKAAMIEALAELGVEYDGISQTEQYTSGVYREQVLFAMKHRGDIDAILDQYRTKKAPAKKQQGQKPVDEAELEAAEGSGAAAEDDGSSGSAGYFPYKPYCGRCEKDLTTVTAYDDDTTELSYTCTACGHSETVRLSEFNRGKLVWKVDWPMRWAYEGVVFEPSGVDHSSPGSSFQVGGQIVGIFGGKQPIGPMYAFVGISGMAKMSSSKGGVPTPADALQIMEPQLLRWLYARRRPNQSFKIAFDQEIQRLYDEWDKLAAKVADGAVLPADAAAYARAIGTAAGELPRTPRPMPYRTLASVADITAGAEDQTLRILSELDPENPLTSLDEVRPRLDKAETWINTQVPAEERTVVRDEPDADLLKSLDDQGRESLRLLLEGLDSNWSLDGLTHLVYGVPKVRAGFSADATPKELPQEIKVAQRTFFALLYHLLVGRDTGPRLPTLLLAVGQDRVRKLLGA

SEQ ID NO: 12284 - protein, 439 aa, Streptomyces avermitilis
VSAPLQLTRMHRVLIGVVVTGAVIIAGIGFAGSYAAVRELAIKKGFGNFSYVFPIGIDAGICVLLAMDLLLTWIRIPFPLLRQTAWLLTAATIAFNGAAAWPDPLGVGMHAVIPILFVVAVEAARHAIGRIADITADKHMEGVRLTRWLLSPVPTFLLWRRMKLWELRSYEQVIKLEQERLVYQARLHSRFGRGWRRKAPVESLMPLRLARYGVPLAQTAPSGLAAAGIEPVLLPPAPQPQPQLEAADPAAGSLAAGPAPAPQQAAAPQDNRPPEQPEYPEEPGPDQSPWFQAPQQQVVYGGGYDPSYEPEEAYEQWYEEQGPEQNEPDPEETGNFPIPAGPGRTRQLGDGGAPEPEPLPIPAQRVEQSPLSDEKSREESFYQVFRQSIMPGQGLPTKGEFGNNVEATYGVTLTDSELKRYMNRFQNRFNTELEEDHIA

SEQ ID NO: 12285 - protein, 316 aa, Streptomyces avermitilis
MHRPAQRDQRDQCEQRRPLEQREEPARRTSRLHRVALVCAAAVPVMLVASGCSSDSGSGDDAQKEAATSSAQPSQSASEKAVQEAAYATLPKPCDALAKKTLADLVPKANKSGKAGASNESGTRGSCSWDSLDNNGVKGSQFRWLNVSLLRFDSDAARGEGNELAQEYYVKQVKDAQAVEGAKNARTQPVSGTGDEATAVRYDLKKKEGSFKQQTVVTRIENVVVTLDYNGAGLAGEKTPDAADLTKAAEKAAKETVAAVIAANQGDGTASESAAPSKEASKSASPSKSASKPASGSASKDASPSASASASASKKN

SEQ ID NO: 12286 - protein, 291 aa, Streptomyces avermitilis
VQRKAYVPGAAVLLAALLAACTGGSGSDSPPDDPKPGDTGPSATAAQPGKYRTLSDACSALSQGTLDSLLPGIEQLTDQEQRDRAYQGEATPTYDNDRRSGCRWKAESTDATDHLLVDFERVVSYDNAVSDDTRAQKVFAAKQTDANLPEPSASGSGPEGSEGSEGSESSTSTSPSGSASPTPSGDSSRSAGSGGASSSGSATATAGATATGTPADLQPRTLDDLGDAAFLNDVLSTARQRTVTVVFRTSNVVVSIGYDEQSAHPGTVPDSEEMQDRVRKLAQQLADSFAG

SEQ ID NO: 12287 - protein, 397 aa, Streptomyces avermitilis
MSYVEMPGAKVPIRMWTDPATVEDVALRQLQNVATLPWIKGLAVMPDVHYGKGATVGSVIAMQGAVCPAAVGVDIGCGMSAVRTSLTANDLPGDLSRLRSKIEEAIPVGRGMHESPVEPGRFHGMATAGWDDFWGRFDGVAEAVKFRQGRAIKQMGTLGGGNHLIETCLDESGSVWLMLHSGSRNIGKELAEYHIGVAQGLPHNQGLVDRDLAVFVSDTPQMAAYRNDLYWAQEYAKYNRAIMMALLKDVIRKEFKKAKPTFDQEISCHHNYVSEERYEGMDLLVTRKGAIRAGSGEYGIIPGSMGTSSYIVKGRGNEKAFNSASHGAGRRMSRNAAKRRFTVRDLEEQTRGVECRKDSGVLDEIPAAYKNIDQVMEQQRDLVEVVAKLKQFICVKG

SEQ ID NO: 12288 - protein, 145 aa, Streptomyces avermitilis
VGYTSQGYPFVSLTTQSTAIGAYLCFYAGKVTGAERTLKRNARDRIYNIPYTKENAQELAAHLYYKDCLSLARKQTAADSLGAWVRPEGMKVAPDRRRWNGWEDRVLLRLNNDAAAAKELGRTEKSCCIRLWRLRTGQVPMPSDQ

SEQ ID NO: 12289 - protein, 259 aa, Streptomyces avermitilis
MTAPAAPSAASRIAVVTGASSGIGAATARQLAEAGYRVVLTARRTDRIEALAKELGAAGHEATAYALDVTDRAAVDEFATAFKTIGVLVNNAGGALGADPVASGDPAEWRQMYETNVIGTLNVTQALLPALTASGDGTVVVLTSTAGHGTYEGGAGYVAAKHAEHVLAETLRLEIVGTPVRVIEVAPGMVKTDEFALTRFGGDQEKAAKVYAGVAAPLTADDVADTITWAITRPSHVNIDLLVVRPRAQASNTKVHRES

SEQ ID NO: 12290 - protein, 112 aa, Streptomyces avermitilis
MLVLRSAALFVAAALFEIGGAWLVWQGVREHRGWLWIGAGVMALGVYGFVATLQPDAEFGRILAAYGGVFVAGSLAWGMVADGYRPDRWDVTGALICLAGMTVIMYAPRGGN

SEQ ID NO: 12291 - protein, 163 aa, Streptomyces avermitilis
MSGKADGGGSARERLLDELSDVSRRYMASYALFNQAIADHLKLHPTDLQCLNLLGLEAGPVTTGRIAELTGLTTGSATRLVDRLEKAGYVVRERDAADRRRVLVATVPERMAEFGRLWDRLGPRWYMLFEELDASELALIIGHMRRTVDFTAGQVARLREGDI

SEQ ID NO: 12292 - protein, 136 aa, Streptomyces avermitilis
VTRMATMTAAQRRDQARREYDAFIRSCPTNQLLDRISDKWVSLVVSALAAGSMRYSDLGRKIAGVSPKMLTQTLRALERDGIVARTVTPSVPVRVDYELTPLGTSLSCLLSAVKDWAELHIEQVNEAREQYDAEEH

SEQ ID NO: 12293 - protein, 292 aa, Streptomyces avermitilis
MRAVVVTSFGGPEAVEIVETGVPEPAARQVRIKVAAAALNPVDAGVRSGVFGGAGKRLGLGWDVAGTIDAVGVATGWTVGEEVVALAYGAAKSLGTHADYVVVDADAVAKAPVSVDAVHAATVPLNALTAAQALDLLALEPGQRLLVTGAAGAVGGYAAHRGIAVTALAREADAELVRSLGAAESVTGPVAPGSVDAVLDAAILGAAALEWVRDGGAFAGVIPQAQPASERGVRTGAVEVSPDGARLAELVALVDEGVLTPRVAETYALAEVAKAHARLAEGGLRGRVVLIP

SEQ ID NO: 12294 - protein, 471 aa, Streptomyces avermitilis
VTQILHDAKEKQLPARTRWAVLGVVLAADVLDLLDSTITNIAAPTIAADLGGGTALVQWLGASYALALGVLLVLGGRLGDRHGRRRLFLAGLSGFTAASLVCGLAWNPQALVVARLFQGAFGALVIPQGFGILGATWPRDQIRKAYSCFGPVMGLSAVGGPVLAGFLVDADLAGLGWRPMFLINLVLGGAALLAAARLLPRDTGDRAVTVDGPGSALLGGAMLGLLGGLIQGSAHGWTATPALLTAAGLVLFALFCHRQRTAENPLIRPSLLRNRGFTSGLALGTVFFAAVAGLLYVISLFLQQGLGRSPSGAALGLMPLSAGIVIASIACYRLIGRLGRRLVLGGLLITLAGTAYLLTLVALSGTDTGAWTLVPPLLVIGLGMGTCFGSMYDVTLGDITDEEAGSAGGSLGAAQQLAGAVGAAAVTTVYFHTAGGATHAMTVSLTVVAAVTLLCCSLVRLLPRKAREEHH

SEQ ID NO: 12295 - protein, 174 aa, Streptomyces avermitilis
MWVRRPGGVKANTANAGTGPGPDPGSLGCRGMKIIDLEPGDARLDAEILPVLRELRPHLTPELFAEVYAEGYAQGLRFTAAYADDGTCAGVAGWRVIVNTSALRKLYVDDLVTAESARSGGVGHALLAHLESRARVLGCHVLNLDSGTKRTAAHRFYLRERMDITGFHFVKRLD

SEQ ID NO: 12296 - protein, 269 aa, Streptomyces avermitilis
MAAPRRDTQGIVDAAELFARVDFRRREPAEPLRPYLEHYWLIDWDLTQPYASHVVPHPSVNVVFQKYAGQEGFGEVAGIGLELFTQKLQGRGRVCGIKFRPGGFRPFAPDHAATEWTGRRVPLPEVSPGADLPAVLTPDDEDARVAALDAFLLSIGPRPDPQADLAMALVDRIRTDRTIRRVGDFARAEGVSVRVMQRLFAAYVGVGPKWIILRYRIHQALEHAENSREVDWAGLAADLGYADQAHLVRDFTATVGVPPTAYAAGPHTG

SEQ ID NO: 12297 - protein, 364 aa, Streptomyces avermitilis
MQFGIFSVGDVTPDPTTGRTPTERDRIKAMVAIALKAEEVGLDVFATGEHHNPPFVPSSPTTMLGYIAARTEKLILSTSTTLITTNDPVKIAEDYAMLQQLADGRVDLMMGRGNTGPVYPWFGKDIRQGINLAIENYALLHRLWREDVVTWEGQFRTPLQSFTSTPRPLDGVPPFVWHGSIRSPEIAEQAAYYGDGFFHNNIFWPADHTKQMVELYRERYAHYGHGTPEQAIVGLGGQVFMRHNSQDAVREFRPYFDNAPVYGHGPSLEDFTDQTPLTVGSPQQVIEKTLAFREYAGDYQRQLFLLDHAGLPLKTVLEQLDILGEEVVPVLREEFAKGRPAQVPDAPTHASRVTAAAAAKEVTV

SEQ ID NO: 12298 - protein, 242 aa, Streptomyces avermitilis
MKLVVVSAGLSVPSSTRLLADRLAKATAARVPAEVEVVELRDLAVEIAHNFTNGFPGRALAAAIGAVTEADGLIVVTPVFSASYSGLFKSFFDVLEQGVLAGKPVLIAATGGSARHSLVLEHALRPLFAHLRAVVVPTGVYAASEDWGAEGLAERIERAAGELAGLMTGLMSGVSAVGPARDAQPRAGAEVSADGPAAAPAEGSVPRPRETVAQSATAGRGSRTDGFQVVPFEQQLAALRTR

SEQ ID NO: 12299 - protein, 712 aa, Streptomyces avermitilis
VTGRHAGGGRVCRPGTGAPVRPGSDRRTADGERWRMTAHVTDEDTAADTAATAAGGATRPASTATTAAIPVPAAPVPVTSVAPPAQTPMAGPGAPPTRVRPGRRRGWAAALRRWRPAPWPALRAIAEQTFRPLLLTAFRPTLLTIATAGAAAGIAVGPAGPTATVPAHAAGTKTRAGTTGTKTKTGTGAGAGTGTGAGTGNRGREPGTETGTATGAETRTAPQRPAPLPPGTATAPWRPRFPQGRGLEAVSLLYLLVQLTLVVPHLAHVLGWDETVYVSQVDPRTPAAFFSAPRSRGISVLVSPVLAVTDSVLALRIALALLSTAALYAAYRVWRPLLGPATTALAALVFSGLWIAQISGPEAMPNLWVALGAVAATGLFLRAPREPNARWWLAACLAGVALMRVPDAAWLGLPLFATAGCVRSHRRTLPYLLGGLAAGATQWTVEAYSRFGGVPQRLHVSGATEGGMHPHLNLFNAWRSLNGPELCRPCSGPVHHPELTLWWLALPLLALAALAVALRERRTGVPADRTLVPLAVAVCLSAPYLLLLSYSAPRFLLPAYALLALPVGGLLTRVARPRPALAVTVGCLVALQLVAQYPVLHRMTAQVASLDQRYRVAADELNALGLRAPCLLVGSHAQPVGYDAGCASAATKGNNRNTTPSSVLRRAERMPTAVLTADAQRPPRYARDWTRHPLPGTDGWTAWLAPAPGASR

SEQ ID NO: 12300 - protein, 441 aa, Streptomyces avermitilis
MKRMTRMTSRAGRRKIVFLLHNAYAIGGTVRTTLNLASALAERHDVEIVSMSRHRAEPRFAVDPRITLVPLVDTREGSADLADPAYAREAVDFPVADKRHHQYTRLTDLRARAYLESCDADVVIGTRPGINVYIALGPRRALRIAQEHLRHDAHAKRLRTVLARHYRDLDAVVTMTGADAEVYRTRMPLPGVRVVSVPNIVPEVGVAPSDGTAKVIAAAGRLVPGKRYDVLLEAFCAVAAKDPDWELRIYGGGAEKERLQGLIDGLGLAGQARLMGVRTPIEAEFAQASLVVSASDAESFGMTLVEAMRCGVPVVSTDCPLGPAEIITDRVDGRLVPVRDTRALADAMLDLVLDDDLRRSMGAAARASAHRYDPEPIVDHYERLFAELRAARPGRAWSRQRERARGWARRTVRAARRRLRAWGGGRRPELTGARTRTARET

SEQ ID NO: 12301 - protein, 245 aa, Streptomyces avermitilis
MPPRPWQTGGVTQTVLLAEDDRAIRHALERALTLEGYAVTAVADGVEALAQAHRTPPDVLLLDVMMPGIDGLQVCRVLRAEGDRTPILMLTALVETADRIAGLDAGADDYVVKPFDVEEVFARLRALLRRTGNASLDAPKEEPSPSGQVSVAGLRMDVQARRAWRGEREVELTRTEFDLLELLVRNAGIVLDHTTIYDRIWGYDFGPGSKNLAVYVGYLRRKLDQPGAPALIHTVRGVGYVLRED

SEQ ID NO: 12302 - protein, 551 aa, Streptomyces avermitilis
VPLVSRLPRSLRTRLRGISSLRATFTLSFAAVAVGVTVLVGFLSYDAAARLVRLDQQTVFAQVVHDLREQVRHDALDPEDFASSDPDHDGPLDDIIRPSRTDVQVLGPGGAVADRGHPVLPVAAADRQVAEASSAGKLAEHKEVEVAGDFYRVAAVSLGHGRGAVQIAQQFSDTEDLLRQLQQRTFLLVGGVVIAAGLFGWWLARRITRRLVRLTAAAEDVARTRRLGIQVPVTGRDEVARLGRAFDRMLGRLAQSEEDQRRLVQDAGHELRTPLTSLRTNISMLRRIDELPPAAREELVADLALESRELTDLVNELVDLAAGQSDTEPVQRLDLGDLAEDVAIVARRRTGRDVIVRVTGDPTADGRPAALQRALSNLVENAAKFDRDGEEAIEIVVTGAAGAGTVRGPGTARPDTARASDSARSEALRASGSLRSDVLRASGSARSEVLRAPGSARSDGAAPSEAAVGPGSVRVEVRDRGPGIADADLTRVFDRFYRAADARSLPGSGLGLSIVREVAMSHGGTPFAYRRRGGGSVIGFTVGGGAPGEGE

SEQ ID NO: 12303 - protein, 665 aa, Streptomyces avermitilis
MAGTVRKAVRQESPQMAATVPRDRTKRLRAWMLEGLSDMARPPQGPHAPPEPAHKGQRWWRVMCLTGVDYFSTLGYQPGIAALAAGLLSPVATIVLVIVTLAGALPVYRRVAEESPRGEGSIAMLERLLSFWKGKLFVLTLLGFAATDFLITITLSAADASTHLVENPHLTSALHGYQMPITLFLVALLGAVFLKGFLEAIGVAVALVGLYLALNVVVVVAGLWHVVTAGHVVTDWSTALTAEHGNVFAMVGVALLVFPKLALGLSGFETGVAVMPHVAGDAGDTEDRPAGRIRGTKKLLTTAAVIMSAFLICTSFITTLLIPESEFETGGQANGRALAYLAHEYLGGAFGTVYDVSTIAILWFAGASAMAGLLNLMPRYLPRYGMAPHWARAVRPMVIVFTLVGFLVTWIFDANVDAQGGAYATGVLVLISSAAIAVTIAARKAGQRNAAIGFAVISAVFLYTTVVNVIERPDGVKIGACFIAGIILVSLLSRLARAFELRVTSVTLDELAQRFVRDIASRKIRFIANEPDNRDIAEYRDKIEQIRHDNDIPAQEDFVFVEVTVLDPSEFEAGLSVRGEVLHGRYRVLTLESSSIPNALAALLLHVRDTTGGTPHIYFEWTEGSPFANFLRFFLFGQGEVAPVTREVLREAEPDRRRRPRVHVG

SEQ ID NO: 12304 - protein, 161 aa, Streptomyces avermitilis
MEPRTATGARPQTLRNGPTGSRRTRRSSRLRHGTRGCRRTWWAWVHEQSGRGKERTALMTSPSHVDDDRGCLRLVLAVPLTLLTLIAAYFCWTALTISPSGTWDDDAYAGIVLSCVLTIAAAGAAAALWLVPSVRRATPWWWMLPVLLLGVVAGVRWAVSG

SEQ ID NO: 12305 - protein, 206 aa, Streptomyces avermitilis
MEVDPWGVVVRHGRWYLLCWSHTWSHTWSHTRNARRVLRVDRVASVDVLEETFTPPAGLDPVETLEEHFADGCKYQVEVVIDAPADTVAEWLPRNLGRREPIDAHTTRLVATTDEPDWYAEQLTVIKAPFRIVGPRELREAAEAVGRRLLGAAGAGRPSPGKQPPPTADGPVPRSGRVLRSPGRFLRPASSAVPWPAGRKRPGSGR

SEQ ID NO: 12306 - protein, 231 aa, Streptomyces avermitilis
MSKILFVVTGADHWTLADGTKHPTGFWAEEAAAPYEAFKAAGHEVVVATPGGVAPTVDQGSLAPEVNGGQEGADRVAATLASFSELQHPVALEDVDLDEYAAVFYPGGHGPMEDLAVHAGSGRLLTLALRSGKPLGVVCHGPAALLAATDGDGANAFAGYRVAAFTNAEEIQAGLADKAKWLLQDRLVEAGVDVREGEPWAPHVVVDRNLVTGQNPASSAPLATELLKKLA

SEQ ID NO: 12307 - protein, 318 aa, Streptomyces avermitilis
MGSTLAVVSHEIPDGPAAAPAPADLNLLRTFLAVYRSGSFTAAAHLLGLSQPTVTTQIRSLERQTRRELFERLPRGVAPTTVADELAARVAAPLDALAAATGQGTLEETRAEPVHLAGPAEWLSTVALPALGPLLAQGVRLRVTTGLTDALLDELRAGRHDLVVATSRPRGRTLTAVPLADEEFVLVAAPVWAERIGERLAADGPGVLHEVPLVTYAEDLPIVRRYWRHVFGRRLNCQAAVTVPDLRGVRAAVAGGAGFSVLPRYLCADELTSGALVLLADPEDPPINTSFLAQRPGAFGNPHVARVRDHLLEAARSW

SEQ ID NO: 12308 - protein, 678 aa, Streptomyces avermitilis
VFNVTGILKRLVIGRAMRSEELHEALLPKRLALPVFASDPLSSVAYATQEILLVLTLGGLAYLHFTPWIAAAVVALMAVVVLSYRQVVHAYPSGGGSFEVVSTNLGPSTGLVVAASLLVDYVMTVAVSVASGVDNIISAVPRLAEYRVPLALVFVALLTAVNLRGLRESGRAFAAPTYLFIGGVLVMVVTGLIRYALGDPPVAESARYGITPDPGDAHLTGLALTMLVLRAFSSGCTALTGVEAISNGVPAFRKPKSKNAAATLVAMGTLAIVMFVGVTALALIAKVRITSDACRLTGLPGDCASYTQRTVIAQIAAAVFGGEHSVGFYVIQAATALVLILAANTAFNGFPLLASILAQHRYLPHQLHNRGDRLAFSNGILALAVVAALLLWGFRASVTSLIHLYILGVFTSFTLSQLGMVRHWNRELRVERDGALRRRHHVARVINAVGSVVTGLVLVIVLATKFTQGAWLAVLAAVVLWVMMRGIRRHYDTTAAELAVTDPKIELRPPSRVFGIVLVSTLHKPTLRALAYAHALKPDRLEALTVSVDRDSATELERRWEEYDIDVPLKILDSPYREVTRPVMEYVRSVRRESPRDVVAVFIPEYVVGHWWENLLHNQSALWLKSRLLFTPGVMVISVPWQLSSSARADHPPARAPGSVRRGEPQGDQRGPVGVRDR

SEQ ID NO: 12309 - protein, 186 aa, Streptomyces avermitilis
MAAEVFLRRLSRWQAEQQRNDIGDVHVMVYRGDVGTEYRDREDFLGRFEQDVRRPDFDMVVAGAARLVGCAYGFHASRTGGWWSGFDGELPPDIEEFTASGRVFVLAELMVLPAFRRQGIATRLRERLLERRPADLVVTTLDLDGDDAPTEAAGHVLRAWGWSRLGTLAPGPGAAPREVWIHRPPG

SEQ ID NO: 12310 - protein, 67 aa, Streptomyces avermitilis
MATGTVKWFNAEKGFGFIEQDGGGADVFAHYSNIATQGFRELQEGQKVTFDVTQGQKGPQAENIVPA

SEQ ID NO: 12311 - protein, 225 aa, Streptomyces avermitilis
MFTSPRSSAPRRALSAAATAAVLALTLAACGSGDPKDSSMPGMHHGSGSAAASSSASSSSSSSSGRFNGADVTFAQQMIPHHQQAVEMAELAEGRASDQDVKDLAAAIEKAQDPEISTMRGWLKSWGRPGSSTASGMPGMQHGAGGTDMAGMMSDEHMTALKAAQGTAFDKMFAQMMIDHHEGAITMAEDEQKSGRSADAKKLAGTVITNQTAEIAKMNRILGRL

SEQ ID NO: 12312 - protein, 157 aa, Streptomyces avermitilis
VDGRRRRGPGVARLLVLCAVLLGLFFMHGAPANAAEGCHGSTAMVMSPGTGHGEDVRMDAAALRPPGATAPGASAMAPTAPPAHGVAMPGMSGELCVSTPARDRTPLPATGLLALLGLVALVAWHPTGRSGVFGEPARRGPPLYGRHLLLQVCVART

SEQ ID NO: 12313 - protein, 288 aa, Streptomyces avermitilis
MPVQHILDSTMYHRESGTGVPIVFLHGNPTSSYLWRDVMPAVGSGRLLAPDLIGMGESGKPALDYTFADHARYLDAWFDALDLRDVILVGHDWGGALAFDWAARHPHRVRGIAFTETIVKPMAWAEFPEGGRELFRAIKTRGVGESMILDDNAFIEQGLPGSSATALTEGDLDVYRKPYPTRESRLPLLRWPRSMPLGGEPADVVARIEAYDRWLKASVDVPKLLLTFAPGPGAMMHEGIVAWCAANIAGLEIEHSEAVAGHHTPEDQPVLIARAISAWADRLGLRLS

SEQ ID NO: 12314 - protein, 150 aa, Streptomyces avermitilis
VGAAMSTRGHSGEPAGCTPMSTQVGTPVGDFLAEPQVATLTTLRPDNSPHVVAVRFTWEGRTGTARVLTVDTTRKARNVIAGPGGRAALCQAVGFRWVTLEGLAIVHDAPRRVAEGIRRYTARYGTPPPAPPGLVVIEIAVDRITRLNLR

SEQ ID NO: 12315 - protein, 273 aa, Streptomyces avermitilis
MIVVTGATGNVGRALVRLLTEARVPVTAVARHITDADVLPGVRAVTADLAEPAGLRSAFEGAEALFLLVAGEDPHGVLKEAKSAGIRRVVLLSSQGAGTRPETYRHPRLFEEAVRDSGLAWTVLRSGGMATNAFAWAESIRTRREAAAPFGDVGLPFIDPDDVAAVAAVALRRDAHPGAVYTLTGPAPTTPRERAAAIAAALGEPVRFTDQAREEAHALMARFMPLPVVEGTLAILGEPTEDEQRVSPDVERVLGRAPGTFAAWAERNTAAFR

SEQ ID NO: 12316 - protein, 197 aa, Streptomyces avermitilis
VTDSVNSRSPRAKDAGKRQRLMAAAARILHEQGVERTTIADIARAADVPAGNVYYYFKTKDELVEAALSQHTEYLKELTGRLDRLPDPRERLKGLVTAWVGARDVAARYGCPTGTLAVELDKRAEGGLDLSVGQVIRQLLEWVEQQYRQIGVPEPDGHALALVGAYQGMSLLSNALRDPEVMTREGARLLRELDSLA

SEQ ID NO: 12317 - protein, 194 aa, Streptomyces avermitilis
MDATVPRTTTSTPPGGPKPGPKPGPKPGPKPGTASRAPAEPPAEEDDLPAGAVESRVFSAQFTSSPRGARLARHLTALCMTDWGYPPSSDTSGVAALLVAELAANAVRHGRAPGRDFHLRIALDVRTRLIRIEVADASARQPRFGSQTVARPEDESGRGLLLVAVLAARWGTEPRTPTGKTVWAEVVADAPEAG

SEQ ID NO: 12318 - protein, 200 aa, Streptomyces avermitilis
MTATVSYPPPTLEDRTSSSYSSYLRLSLAPVGPAPALLDGAWWPRSRDLDAELPALTAVLDPLWGRITRVTVNPTYWPVFPRKVPVAGHVVKVGWFLAEQDPHELMLLSYQVGRWDLLVIPPRTPPASAAWLMAAASDPLGTSTASRLMEEAARLRTVAETDRAVEAVWDSEGGHEARDPASRPRIPAVAAAIPGQPKWM

SEQ ID NO: 12319 - protein, 79 aa, Streptomyces avermitilis
MEIFVNVLVLLAMIALGVLLIHLLNSQHDDRIAAFHYADRFAAFHQARSRPTGPGTGAAPGSERGEPDAPREAAGRHRQ

SEQ ID NO: 12320 - protein, 155 aa, Streptomyces avermitilis
MLPVRLLADTGSEPVLPGTAVLRMETTPKRTGTFDGAWWPHSRDLASQLTGLLTALTARLGPLARVGLDASAWDERPGHLVVEGHTVRIDWSAVEDNTMIITRGDQDHFLFLVIPPQAAPASARAAMTMAVRDDNDASAERILTATGVTPIGSSD

SEQ ID NO: 12321 - protein, 125 aa, Streptomyces avermitilis
MALPQLNVHRHDRNTHALLTLAGEIDLTTAPLVRAALTECLRDGIRTVDVDLTAITFCDGSGLNAFLTAYQIAHEAGTTVQLHHPPPPTARVIEITGSGFLLHELHALPRTPAARRVPAASGGAL

SEQ ID NO: 12322 - protein, 236 aa, Streptomyces avermitilis
VTAPPRREPQPPGGGSVPSPRDATVRLRRLNRWQAETLREDLADLYVESFQARPGEEYRGREAFLRRLTGDIRRPGFALLIAEDTAFAGCAYGFPVRREGTWWRGFDGPLPRSVEQLTASGHVFAITEIVVHPHAQDPDLARRLQERLITDHHASLGATMVDQADAATCDAFLSWGWRDIGAVRRPPDPVTRRPSDPAVRRPADPAALRVLVLPLGPRTATRPDGLAHENRTQRPD

SEQ ID NO: 12323 - protein, 284 aa, Streptomyces avermitilis
VAGYESRTEPGIMTSPLSGSGAQPLKIDTSKPHPARMYDYFLGGKDNYEVDREAAEQFIKVAPEVRAGVRANRRFMHRAVRHVVAEGGVRQILDVGTGLPTEPNVHQIAHAIAPETRVVYVDNDPIVSAHSMALMDDATDTSVILADLRDPRALLDHPEVRKTIDFDQPVALLLVAVVHFIADAEDPDGIVATLRDALPTGSYLVLSHATGDVHEDRREDAASVYNAATATLNLRPHARVLDFFGDFTLVDPGLVPVPDWQPDEPPKLDAPPIGIYGGVARRNS

SEQ ID NO: 12324 - protein, 312 aa, Streptomyces avermitilis
MLVIAAMNQNDGRVDLQQMRYVVAVAETRNFTRAAERCSVVQSSLSHRIAGLERELGVKLFARSSRRVELTSAGAAFLVGARECLAAADRAVADAAAATGVVRGRLAVGVIVTTAAVDVPELLQRYRAQHPDVHVLLRSGRSDELVAAIRNGELDIAFLGLPEGERPPGVETVVLDHDEHVLVVPAGHRLAGVSQVTLREIAEETYVDFVAGTPARAQSDQAFAAAGLVRDVAYEAGVVELITRLITRGLGIALLPSAFIRPLAADDPELALVPVVDGPHRIEYLAWSRFNPSPATRAMLDVLGVRPPSTVS

SEQ ID NO: 12325 - protein, 333 aa, Streptomyces avermitilis
MHSSTERSPGSLRTSYAQQVATVALTALAPASWGTTYAVTTELLPPGHPLFAGLMRALPAGLLGLAITRVPPRGDWWWKAAVLGVLNIGALFPLLFLAAERLPGGVAATLSATQPLLVAGLAIAVLRDRPTAWRWTWGAIGVIGVGLVVLGPQARLDGVGVLVGLGGTAAMVGGVVLTKRWGRPAEVGPLTLAGWQLTAGGLLLLPLTLAIEGVPQRIDAGAVGGYLWLGSMGGLIAYTLWFRGIGKLPVGVSAPLVLLSPLVATLVGIVLGESLGLPQTLGFVLALAALLATQLNAPNVFGRIARGGPAEDPIPDRIPDPSREDQIRGGRIR

SEQ ID NO: 12326 - protein, 222 aa, Streptomyces avermitilis
MTIAVLGATGMVGSRVITEAGARGHRVLALSRKPASEDPNVTLIAADANDPSAVREALAGVASNRAADAVVLTVRTHPVDQEFLIGATRTVLDIAAQLGIRVLVVGGAGALRSPDDHDLLVADNPTYVPAEWKTTAAAGIAQLRACQAHADADWVYLSPPALLEPGERTGRYRRGTDTLLTSADGRSWISAEDLAVAVVDELETPGRERLITVAHRDEPPSA

SEQ ID NO: 12327 - protein, 145 aa, Streptomyces avermitilis
VGVTYKYFGAPDGATAARVPISMRPEELGGDELGMNGMFTKIKPETMAAMVLTGIEGVPLSKVPPLELVVLHPDYAVVKLPMTVVDPLRGIGEEAVGAAAFIWSTVPDRGGPRDAFNVYQLLHEWQDFSHRLHEAGHQPYCLVWP

SEQ ID NO: 12328 - protein, 204 aa, Streptomyces avermitilis
VNPQLPAVLSLPKVPAGPQLRKARRVRKVPVTPEWLPTVRKAPAVPERLPKVPKVLVIPEARKAPKVRKIPAVPEFRKGRKAPAVPERLPKVRKIPAVPKRRRVPKIPTNPRIPTSPVPDVSRPLPPRRAGAFPAGHAEDRGHRSPRPVRHRDAYLHPTAVLGRVAPAAQPDHRVSDLPHGVPPKRAVKHLSAGSWRPLTPWLV

SEQ ID NO: 12329 - protein, 438 aa, Streptomyces avermitilis
MACVSYPYEAPVSQTLFERAAAVTPGGVNSPVRAFRAVGGTPRFMVSGNGPYLTDADGRTYVDLVCSWGPMILGHSHPEVIAAVQEAVARGTSFGTPGEGEVALAEEIVARVEPVEQVRLVSSGTEATMSAIRLARGFTRRAKVIKFAGCYHGHVDSLLAAAGSGLATFALPDTPGVTGAQAGDTIVLPYNDLDAVREAFRAHPGEIACVITEASPGNMGVVPPAPGFNQGLKDACAENGALYISDEVMTGFRTSKAGWYGVDGVRPDLMTFGKVMGGGFPAAAFGGRRDVMAHLAPAGPVYQAGTLSGNPVATAAGLAQLRLLDDAAYAKVDAVSAEIRTLVTDALTKEGVAHRLQNASNMFSVFFTDRPVNNYEDAKGQESFRFTAFFHSLLAQGVYLPPSSFESWFVSTAHDEQAVQRIADALPAAARAAAEATA

SEQ ID NO: 12330 - protein, 230 aa, Streptomyces avermitilis
MSIPSSDQDITVVHVMRHGEVANPDGVLYGRLAGYHLSELGRQMADRVAEHLASRDVTHVVASPLERAQETATPIAKAHGLDLAVDERLIEAENVFQGKTFGVGDGALRRPENWKHLTNPFKPSWGEPYVEQVVRMMGALDAAKDAARGHEAVCVSHQLPIWTLRSFVEKRRLWHDPRKRQCTLASLTTFTYQGDRIVSVGYSEPARELVPAHLLAGAKPVKGKDKAFGA

SEQ ID NO: 12331 - protein, 425 aa, Streptomyces avermitilis
MRDISRRGLIGLGAGAAAAMGLAACGTQEQDGGSHSGGSGKGKPGKPEHTARPLGDGSTSNTGKQPRQPGKPVPLEPGQTPPQFVIFSWDGAGEVGNGLFPRFLELAKEHDAHMTFFLSGIYLLPESKKRLYRPPNNAPGASDIGYLTDDHIKATLKNVRQAWLDGHEIGTHFNGHFCSGYGTVANWTPKQWRSEIDQAKSFVKEWRTNTGWTDLAPLPFDYDKELIGGRTPCLLGQNNLLPTARDLGWRYDASSPGGRQRWPEKKAGVWDLPLQAIPFPGHTFEVLSMDYNILANQSINSTKAPSYNYPGWRTQATNSYIAGFKRAYETNRAPFFIGNHFEEWNGGIYMDAVERAFKYIAREKEKGGDVRLVSFRQFVDWMDVQPPEVLAKLRSLDVGQQPAGGWKAFLGEAGKGSSAGAGNAA

SEQ ID NO: 12332 - protein, 210 aa, Streptomyces avermitilis
MSAACRVHQRLNRTNRTRSRAALLSAGAAVAALVLSACSSGGTHGGGGDTNFVAGKDGISTVAKGSRVDAPDLSGKTVDGKQLDVADYKGKVVVLNVWGSWCPPCRAEAPNFVKVAKDTAAQGVQFVGLNTRDPGTAPAKAFEKEQGITYPSLYDPTGKLMLRFKKGTLNPQTIPSTLVIDRDGKIAARTLQALTEEKLREMLDPILAEK

SEQ ID NO: 12333 - protein, 260 aa, Streptomyces avermitilis
VSLLVASTDLAAVADKNATVYSGALLLALPVAVLGGLVSFFSPCVLPLVPGYLSYVTGVTGTDLAEARRGRMVAGASLFVLGFTAVFVSGGALFGYFGTTLHEYQDTLSKVLGVLMIAMGVFFMGLMPWLTQREFRFHKRPVTGLVGAPVLGALFGIGWTPCLGPTLTSVISLSMEQASAGRGAILTVAYCVGLGVPFVFAAVAFRKALGAFDWVKRHYAWVMRIGGGMMIVTGLLLLTGAWDSIVQQMQTWSDGFTVGI

SEQ ID NO: 12334 - protein, 595 aa, Streptomyces avermitilis
MSTTDTGKTTDPAAAGQPVDGGADGDLGEAGSQLSTAPVETAMPGSFGGPRAPGAIGWLAWTLREVIGWSRWFWRQLTSMRVALILLFLLSLGAIPGSLIPQSGTDAAKVQEFKDAHTTLGPVYDRLGLFHVYSSVWFSAIYILLFVSLIGCIVPRTWQFVGQLRGRPPGAPKRLNRLPAYATWRTGAEPEQVREVALKVLERRRFRAHAAGDAVAAEKGYLRETGNLLFHIALIVMLVAFAWGQLFKSEGNKLIVEGGGFSNTLALYDDFKSGSLFSTDDLTPFSFDLKNFTGTYELTGPNKGTPRTYQADVTYSVGAYGKEKKTTVKVNEPLEIGDSKVYLTAHGYAPVVTVRDGKGNVVLHDAVPMLPLDSNVTSQGAIKVMDGYRNARGVKEQLGFAAFFVPSFAGDGNGTMFSQFPALLNPRLAVSAYHGSLGVDAGIPQNVYQLDTSRLKQFKTAKGAILKQRLKPGQTMKLPNGAGSITFEKDVKEWANFQVTQQPGSDWALAGAFGAILGLAGSLFIQRRRVWVRATTGADGVTVVEMAGLGRSESAKLPEELGDLAALVHEQAPTKTDEPDPAVAPPVPAEGAEKQ

SEQ ID NO: 12335 - protein, 358 aa, Streptomyces avermitilis
VTLATATNEHLANISNTLIYSAMAVYTLAFFAYIAEWLFGSRSKVGRTAAALTHKTAAKAPAVTVKSAGGTAVLDRPQVVTRSAPGARDVPDGPGAHGGDEQGDLYGRIAVSLTVLAFAVEAAGVVARALSVQRAPWGNMYEFNITFSTVAVGVYLALLALKKNIRWLGLPLVTTVLLDLGLAVTVLYTASDQLVPALHSYWLYIHVSTAILCGAVFYVGAVGALLYLFKDSYENKLATGGQPGRFATSVMERLPASASLDKFSYRVNAAVFPLWTFTIIAGAIWAGDAWGRYWGWDPKETWAFITWVAYACYLHARATAGWKGRKAAYIALIAFACWLFNYYGVNIFVSGKHSYAGV

SEQ ID NO: 12336 - protein, 161 aa, Streptomyces avermitilis
MTHPLDPLDPRDPRDPAHPAGPTGPIGPIGSIGAIEKGPVETRGNAYVRHYRLSFPQPVDKVWATVATSEGLRAWLAVAEPFEPRLGGAVGLQGEGRITAWDVERVAEYTVQGRGRVRFHLEPAHPTGTTVRFTHESDEATDPGWHARFERLVRAVADQGR

SEQ ID NO: 12337 - protein, 515 aa, Streptomyces avermitilis
MARVWTWLREDVWEIRFRRYVALALAAVLVSLGVWGGMTATKENRSCAPGVVRPRGSQECVGVSWTTYAFGRPQFADTVRAIHRENARLKPGSYVTVALLEPFTATDADNLGDVLHELQGAYLAQYQANHDSTGLKPKIRLVLANPGATGAHWRQTVDQLEGMTKGRNRLRAVTGVGLSTENNKKAVKALTARGIPVVGSSITADDLANGQNGKDPFPGLARVSPTNTDEARALASFAKVSATRAFLVYDRTGDPYTRTIQRSFEKMLKGSRYGAQPFTPPTDRSKEGSTANVFAQITNILCDTPKSTDTVLFAGRHTQLRQFINALGARGCSDRRFTLLTGDEGSYLTGDKDLDPSALRDTLLSVRYTALAHPDAWAKDAARTGGGAADAKVLTDLLALGKRDKEVGPIGSVDLSDGQLIIAYDAMRLAVRGIRGASPTGGIPALADVGLQWPQVKGKQLRVNGASGWICLDAHGNPYDKAVPIVELTPDARARFLRMAWPEGRPPAKECLPPS

SEQ ID NO: 12338 - protein, 699 aa, Streptomyces avermitilis
VHRGLHGRGALFDSDPPGLAPRLIGLRPYQLRSSPYEHAGELPFVVLAGGRGLGKSAALRELRDAYHGHTPVALIDGEEQQFAAPPPERPAEAWSPVGQALTTVAEQLAEPVRGAGRIGFPRLASGLLAVAAGGWSDRDVPRIRQEAERILLLNETGSVLSGFAGRWVSKVVAKLIASMSGTGPVVAPIIEATLEAFAEGIGPATRRLRRAATWYRDYPNAGGNPKLGLILLSRHFRAGGDSRTHAERHLVRALLADLDDAYAGVMQRSHRLGRPVVLIDNVQRPAGLGVLESVLRDRADGIADQVVFFAALRGYTHPALRNAGRRALPEVARGTGWEPGASPSSRALLVSLPPLTPDDTLHLVGAASHGLDVPPQLPHATHRLTGGSPLGITLLAESARQNLPQGAASLGELLTADVAMHEDHDGRPAYQELLDRLVPGGRLDELTVLAAAHDRDSACALAEAQLPEDFGTSGVLDLEERLGAEGWAAASGQFVGDPFLRALLLLRLHHGDPDHERWRAAHRTLIDHYGDEDPPDSARYRLHHELALGKADFAVAHLRDTFPRADTRSWLASLVFIASAPYYHAHDPDGRDFDGHDHRSSVALGHTDADQQPPDSVNAVLHLRVRRLLHAVWQLTDPLVLPDPKVTERLRFELEQLSNLRPAGNALLWRASRDWPSDALAGRPFRIPGDDHDSGDGGR

SEQ ID NO: 12339 - protein, 324 aa, Streptomyces avermitilis
VSDARTPRIPTVDLRPWLSGDPDARARIARTVDDALRTAGFLLVTGHGVDPSLRTRIRVAARAFFTLPAETKQRYAARVGGRGWLGPGAEANGYSEGTETPPDLKESLTFATHEPFEDPETNAEWYAPNVWPAEAPELREPCEEYLAEMAGLEDRLLTLLGEALGLEPDFFTKHMTHPTYGFNINWYPGTEVTGDPAPGQFRIGPHTDFGTVTILDRQAGKGGLQVYTDDGGWADAPFDPAAFTINIGDLMARWTGDRWRSGRHRVLPPPADAPAEELMSLVYFGECTPGTLVESVPAPVGRVAYEPVDSHTYLREKLNSITVD

SEQ ID NO: 12340 - protein, 153 aa, Streptomyces avermitilis
MDQVMDQAQARAWLATAVEEARAGLAEGGIPIGAALYGADGALLGRGHNRRVQDDDPSMHAETAAFRSAGRQRTYRGTTMVTTLSPCWYCSGLVRQFGISRVVVGEAATFHGGHDWLAEHGVEIVLLDDPECTALLRGFIKNNPALWNEDIGE

SEQ ID NO: 12341 - protein, 147 aa, Streptomyces avermitilis
VGGEASPRSLQDWRHVHNTIIPAHVLSLDDVRERAGRNRLEVAYLDDVLVGCSTVRPPADAPTPDAPATATVIARVLAAHRGRGFGGEMYERGLKHARALGAQVIETVVLSSNPDGLRFALKHGFAETERYLLPGDTVPWIDLRLSV

SEQ ID NO: 12342 - protein, 130 aa, Streptomyces avermitilis
MLRYLPFLLVLALWIYAFIDCLNTPEEEVRGLPKVVWVIIILLFGEVLVGPIAWLVAGRARRGPAGGSTPSEWHRNHRAEFVAPDDNPEFLQSLKAESKKDEALLKDWEADLRRREEELRRRESGEDSKD

SEQ ID NO: 12343 - protein, 483 aa, Streptomyces avermitilis
MAYDDLRSLLRALEREGDLKRIKAEVDPYLEVGEIVDRVQKAGGPALLFENVRGSAMPLAMNVFGTDRRLLKALGLKSYGEITDKIGGLLKPELPHGFVGVREAFGKLGAMTHVPPRKVKDAPVQEVVLRGDDVDLDQLPALFTWPQDGGSFFNLGLTHTKDPESGIRNLGLYRLQRHDKRTIGMHWQIHKDSRNHYQVAARRGERLPVAIAFGCPPAVTYASTAPLPGDIDEYLFAGFIQGKRIEMVDCKTVPLQVPAQAEVVLEGWLEPGEMLPEGPFGDHTGFYTPQEPFPALKIDCVTMRKRPLLQSIVVGRPPTEDGPLGRATERFFLPLLKIIVPDIVDYHLPEAGGFHNCAIVSIDKKYPKHAQKVMHAVWGAHMMSLTKLIVIVDSDCDVHDLHEVAWRALGNTDYARDLTVVEGPVDHLDHASYQQFWGGKAGIDATRKWPEEGYTRDGGWPEMVLSDAETAAKVDRRWKEYGL

SEQ ID NO: 12344 - protein, 301 aa, Streptomyces avermitilis
VTSASAALPQQPGRTKAFLRLVMIEHSVFALPFAYIAALTAMFQWDRNIHWVRLLLVTVAMVGLRTFAMAANRIIDREIDARNPRTAHRELVTGAMSVRHAWTGALVALVFFLGAAALLNPLCLALAPIAVIPMVVYPYGKRFTNFPQAILGLAQAMGPVGGWLAISGEWSWDAVILGLAVGVWIGGFDLIYACQDVETDREVGVMSVPARFGIQAAIWGARVCHAITTALLVWYAFATDAGAFFWFGLVIVAGAFLYEHSIVKPHDLSRLNRAFFSTNGFIGISLFVCALGDLLVRGLTV

SEQ ID NO: 12345 - protein, 221 aa, Streptomyces avermitilis
VPWIVGVSGASGTPYAAAVLRALVERGESVDLVVSRASRLTLLDETGLPFRDAHWRDDLRAWLARGADGKPDTFDAFEDHLDAVRHWSAGDLAAGPSSGSYPSKGMLIVPASTACVAGVALGLSKDLLQRAASVTLKEGRKLVVAVRETPLNGQTLRHLVSLDEAGATVLPASPAFYAGATHIQDLVDFVAGRVLDAAGVEHHLYRRWEGELGGGSRGGTT

SEQ ID NO: 12346 - protein, 151 aa, Streptomyces avermitilis
MDAVDRQLIQALRENGRASYAELGRLVGLSGPSVTDRINRLEAAGVITGYRATVDSASLGLGVTALIGISLSDAADHEDVAHRLRDLSEIEDCWFIAGDDSFMLKVRSSDVDELEKTIRRLSGTKGVSRTRTTIVLSTKWENRVGELPEEG

SEQ ID NO: 12347 - protein, 387 aa, Streptomyces avermitilis
MDVGLKRELEDKVRAGERLTREDGIALYESDDLAWLGGLAHEVRTRKNGDVVHFNVNRHLNMTNVCTASCAYCSFQRKPGEKDAYTMRIEEAVRLAKTMEGENLTELHIVNGLHPNLPWRYYPRSLSELKKALPNVSLKAFTATEIHHFETISGLSASEILDELIEAGLESLTGGGAEIFDWEVRQHIVDHRTHWEDWSRIHRLAHEKGLKTPSTMLYGHIEEPRHRVDHVLRLRELQDETGGFQVFIPLRYQHDFVDMKDGKVRNRLQARTQMATGAEALKTFAVSRLLFDNVPHVKVFWVMHGVQTAQLALQHGADDMDGSVVEYKITHDADNYGTPNKLTREDLLDLIRDAGFRPVERNTRYEIIREYDGPDPARRESPQPMRV

SEQ ID NO: 12348 - protein, 178 aa, Streptomyces avermitilis
MAPTFELDPAITPALREGVLALWADVSNAGGSVGFVPPVTVDDIRPELVKHFVALAEGRTRLLVGRDDEGAVAATAFLTHNTHRLMRHWVWLYTVMVHPRHQGKGYGRDLLAAAEDAASGLDGIEAIRLTCRGGEGLENFYASCGYKEVGRVPGAIRVAPGDERDDITMLLPLARTGY

SEQ ID NO: 12349 - protein, 99 aa, Streptomyces avermitilis
MLRYTLMRLGIFVGCLVVVWGLVYSGIAPRGLGDSNYMWVVLLSLVISAPISFVVLRGERDRASAEVIARVDRAKANLEANRNQEDVADDAARAQGRAS

SEQ ID NO: 12350 - protein, 213 aa, Streptomyces avermitilis
MGAVKNKRMPRAVREQQMLDAAVHTFGQRGYRAASMDEIAELAGVSKPLVYLYLNSKEDLFTACIRREAKALTAAVRAGVRPGLPADRQLWDGLTAFFTHTAQNPDAWSVLHLQARTHGEPFAAEVTAMREEIVAFVTQLIVVAARAAHRNPSLPEREVAGLAEALVGAAESLAAWANTAPGVSAKQAAATLMNFAWAGLGDLMEGRPWAPSA

SEQ ID NO: 12351 - protein, 308 aa, Streptomyces avermitilis
VQTLLPLLARGAVLSPFKRPRPDAAFPHSRLVLSGVRIDLARLAAYERACGFPTGADALPLTYPHVLGFPLAMRIMASRAFPLPLLGLVHTSIEVTRLREPAATGEYELAVHVEGLTPHRRGTEATVVTGARVDGSLVWESRSTYLARHRRATDARTPADARTATDARTPADARTATDARTAADARTAAPVPSAEPKPLPVVAEWRLAADVGRRYAAVSGDRNPIHLHPLTARLFGFPRAIAHGMWTVARCLAEQPADASVQLRAEFKSPVLLPGTVTYAADGGRFELRGGERVHLTGELREYRANSA

SEQ ID NO: 12352 - protein, 638 aa, Streptomyces avermitilis
VSTPYPTSSSFDPAAPASVEPEIRRLDGVVREVAVPPLVGQVTHGSLADIPFDNADVAPEDVVLSRKTPDGGWTDVTAAEFAGQVLAVAKGLIAEGLMPGDRLAIMARTTYEWTLLDFAAWAAGLVTVPVYPTSSVFQTRWILQDSGAVALATESAGQAAALGPELSRLPDLRHVWVFDKGHVERLAELGRDVQDQEVAVRRGVLGPDTLATLVYTSGTTGTPKGCALTHGNFFAEIDNAVELLYPIFKSKTKEEASTLLFLPLSHVFGRMVAVACVRARVRLGHAPSLTTEDLLADLASFRPTCLLAIPYMLEKVFNGARATAEKGGRASSFDRAVSVARKYGEAMETRQQGTGSGPSRGLKAGRALYDPLVYRRIRNALGGRVRYVICGGSPLGRPLAAFYAGAGIEIYEGYGLTETTGAATVTPPHKTRLGTVGWPLPGTRVRIAADGEILLSGGQVFRGYWDPHAGGVVPATPDGWFATGDIGRLDDEGHLTITGRKKEILITAGGKNVAPAPLENWLRSHPLISQALVVGDGRPYVTALLTLDPEGITHWRQMNGKHGVPPELLMDDEELFSVLQRAVDEANKLVSRPESIRRFAVLPVDFTEEAGHLTPSMKLRREAIARDFGREIEGMYAQ

SEQ ID NO: 12353 - protein, 165 aa, Streptomyces avermitilis
MNPRRRLAAYGVPGALAIVLLLVAAAYLRPGGEVEAAVPAVDAKTGRICRALAHDLPDTVAGLKRRATDPSSPLTAAWGDPAIVLRCGVPRPAEMNSAGAVGADLKGVGWMLGSRVVDGRHLCTTTLREIYVEVSVPTRYGDVFALEGLAAAVRKNVPEGISDQS

SEQ ID NO: 12354 - protein, 67 aa, Streptomyces avermitilis
MATGTVKWFNAEKGFGFIAQEGGGPDVFVHYSAINASGFRSLEENQSVSFDVTQGPKGPQAENVTPL

SEQ ID NO: 12355 - protein, 282 aa, Streptomyces avermitilis
VDNSRTRPRVGHIQFLNCLPLYWGLARTGTLLDFELTKDTPEKLSEKLVRGDLDIGPITLVEFLKHADELVAFPDIAVGCDGPVMSCVIVSQVPLDQLDGARVALGSTSRTSVRLAQLLLAEQVGVQPSYYTCPPDLPLMMREADAAVLIGDAALRANLSEGPKFGLEVHDLGAMWKKWTGLPFVFAVWAARRDYLEREPVVTRKVHEAFLSSRDLSLDEVGKVAEQAARWEAFDQAVLERYFTTLDFRFGAAQLKAVAEFARRVGPTTGFSADVNVDLLTP

SEQ ID NO: 12356 - protein, 583 aa, Streptomyces avermitilis
MQPLEVGEPTVVGPYRLLGRLGSGGMGRVYLGRSTGGRTVAVKIVHPHFALDEEFRARFRREVEAARRVGGAWTAPVLDADPEASVPWVATGYAAGPSLAAAVTDGGPLPTHSVRALGAGLAEALSAVHGLGLVHRDVKPSNVLLTLDGPLLIDFGIARATDGTASLTSTGVSVGSPGYMSPEQILGKGIAGAADVFSLGAVLAYAGTGAPPFPGDSSASLLYKVVHEEPELGSLEGELRELVAHCLAKDPDGRPGPAEVAERLAPQGAARLVTGGWLPGPLVEQVSRSAVQLLNLDVAGAAEAVPSGPVEFSTPSVRPPTGVFGPPPDLATPAYMPAPRPAEAQPRPEPQPQPQPQPQSQPPAQPQDAVPGVPLAVAPESGPPGRVSVSVAATSAPGTGGRGRRVSCTVALAVAGALATVTVGSAFLFGLLEGGDSSGGDSSGSADSPPAATASASRSDPGDGADGAVPKSYLGTWEGDALALGGTLPAGTFRVTIGEAAVGKEIGTFRSTDQLGGTCDDVLLLKKATAQQLVATSVAKDTNPSTCTTGRHEVRLTPVGDDLSYETDNQAAGNPTSRMSKVK

SEQ ID NO: 12357 - protein, 226 aa, Streptomyces avermitilis
LRGGRGFRQHGSPAAAVAVGRGGAGRVGGSARPKRRKAAGAALRYAHVRDRGPVRGSRGSKRETVLGCAVALAVAALLIGFAVADRAWGPDIWRGTAPGWPGGGYGFAATVGVLLPWAAAAALTSFGRVNWRRSRARSLGWSASALAGAALSALLLLVVFAAFVPKKRHRGYDCYREGGACWVHTQYPYVWAVGLAATVTGTALLAGGLAAYFRRQAPNGPPPPTT

SEQ ID NO: 12358 - protein, 247 aa, Streptomyces avermitilis
VDVDFDVWLTGPAALWGAAAGLLVPRAAYRLCVEPDEPWRDRCPRGHPITGGPGGWLGRARCPDGTVYGPSAVLVCAATALVCAALALATGTRPELAVWLLLAPLAVLLTIVDFRVQRLPDVLTLPLAGAAAALLGVAALAPEHAGEWLTALLGALALGGAYFVLFLVNPNGMGFGDVKLALGLGAVLGWYGWSTVVLGTFAGFLFGGLYGLGLVASRRAGRRTSIPFGPFLIAGAFVGLLIGAYTS

SEQ ID NO: 12359 - protein, 399 aa, Streptomyces avermitilis
VTEKADLQSVLDRAAAGGRITPEEALDLYRDAPLHALGAAADAVRRRRYAGTEHIATYIIERNINYTNVCVTACKFCAFYAAPKDTAKGWTRDLDDILRRCAETVELGGTQIMFQGGHHPDYGVEYYEKHFAAIKEAFPQLVIHSLGASEVEHMARISGVSVEEAIQRIHTAGLDSFAGAGAELLPERPRKAIAPLKESGERWLEIMETAHRLGVESTSTMLMGTGETNAERIEHLRMIRDVQDRTGGFRAFIPYTYQPENNHLKGRTQATLFEYLRMIAIARLFFDNVAHIQGSWLTTGKEVGQLSLHYGADDLGSIMLEENVVSSAGAKHRSNRMEIIDLIRKAGRVPAQRATTYEHLVVHDDPANDPVDERVMSHISSTAIEGGTAHPELKLLTSN

SEQ ID NO: 12360 - protein, 149 aa, Streptomyces avermitilis
VLTIHAADELRYTWDDPEPVKDGAVAVQGVRVAATGSLAELQERFPGARVRRWPGVLGPARVHEGPLPDAPTPRERVHAVLKLGAVAVLEEYAGTPELRAAAERNDVVVLSRGRRTAIVDMGRADLAVFDGAGACIATVCAGRLVHRRR

SEQ ID NO: 12361 - protein, 349 aa, Streptomyces avermitilis
MRSFLKPAAGIVCLVTMACAGCSSGGDGSSDTASSEPSGTSSPAGSPTGSPTRQAQTSSTAYAPYVSATTASDMDPAGSPSTYNLAFVISDGSDCTPKWNGTYAIGNSAVASRISALKESGASVRVSFGGASGKELAETCSSASKLAEAYGAALDAAGATLADFDIEGDTLTDSASVELRSQAIALLQKDRSDLSVSFTLPVMPAGLDDDSIALLESANDNSVQVATVNIMTMNYGSSYDGDMGDYALTSAEAAHDQLADVFGLSSKGAWQGLALTSMIGVNDVDNETFTLADAAQVRSFAEEKGVAWVSMWSTFRDQQCDDGSKSNDAATDCSGVKQTSGAFAEAFAG

SEQ ID NO: 12362 - protein, 130 aa, Streptomyces avermitilis
MQSESDIENRSPVRGRGRKRGNGSEEGPVFVDNSGRRSRLLRRFGILVCVACLGYVVVLGMAFMGWGTSLSNSITPFGGGQAAPGGGGLGPQGGGARTGTPPSGVPTGAPTGAAPSAAVTPGAASSTGAN

SEQ ID NO: 12363 - protein, 790 aa, Streptomyces avermitilis
MTKTTPSRGRRRAPSRMERAAGKAAALQKPRVILALLLLLGLTSVMLLDGYLRGEVFSDQRVRDSAAYDKVPKKILEAGPIFTSSNGTVDPKSVPKKTIVLTFDDGPNPTYTEKVLKILQDNDVPGTFFLVGSMVTRYPDAVKDMVDQGNEVGIHTFTHVDLSYQSTARVERELNQTQLALAGAAGITTTLFRAPYSAEADAIDNYSWPVYQRMAKLGYTSVFIDTDSDDWKQPGVASIIKTATPKKNNGASVLFHDAGGDRDQTLVALPKYIKKMKAKGYTFTTVSGALAKDRASTAAGRAGAGTGTGQQPIDQTANGGAANGGTANGGTANGGTANGRQPGAAAGTGTATGATATSIEQAAHRKATGATLYEGKALVAAVALAEWSMPALASGLVVVGVAVMGRFAMMLVLARTHYRQRNKRRFSWGPEITRPVSVIVPAYNEKECIENTINSLAQSTHPIEIIVVDDGSTDGTADIVEAMRIPNVRVLRQENAGKPAALNNGVRNASYDIVVMMDGDTVFEADTVRRLVQPFADDEVGAVAGNAKVGNRDTVIGAWQHIEYVMGFNLDRRMYDLLRCMPTIPGAIGAFRREAVLEVGGMSEDTLAEDTDITIAMHRGGWRVVYEEHARAWTEAPGSLKQLWSQRYRWSYGTMQALWKHRKSLTDRGPSGRFGRVGMPLVVIFQIVTPVFAPLIDVFTVYSMIFVDFWASLLAWLAVLVVQLVCAAYAFRLDREKYRYLLMMPLQQLAYRQMMYLVLIHSCITALTGGRLRWQKLKRTGEVGTPAGVS

SEQ ID NO: 12364 - protein, 471 aa, Streptomyces avermitilis
MSWGPEQQQGYGYGQQPQPQSQPYGQPSQSQPQPYGQQQPLAQPYGQQYPPPYGQQQPYGQGYVQPGPYEQQWQHAPAQPEAAAVTSTVQMDPVPAAPEAEAPEGATSGADAPAPGADAPEPRPKAKAGGRDRYFDALRAVALVRVVTYHTFGWAWAGLVFPSMGVMFALAGTLMAKSLERPALKVVKSRMRRLLPPFWFWGVFVVLAMMIHGWMPGWEIVYWIVPVGDPPGNAWGSQAYEILWYLRTYLWFVWLSPVLLWVFRKAPIPVLLLSLVPIVVFQFGWQPPWNRFGSALTDIATYLFCWLVGFAHREGVLQRLKPVAVVALSLAALAYGGWYAFAHQGEFGTYDLDENPLAQAFWSAGFVALLMYFKAHYDVDFAWLARFKRLDRIVTIFNGRAVTIYLWHEIALILAVPLIDQFWKVPAFEKWLPLESQWFMFGIGWALIWIAVPLVGWVEDVAAKKKPKLLP

SEQ ID NO: 12365 - protein, 231 aa, Streptomyces avermitilis
VTRASLDKQPHEVASMFDDVAERYDLTNDLLSLGQDRVWRREVAKAVDARPAQKILDLAAGTATSSLPFARAGAYVVPCDFSLGMLRVGKKNHPWLPLTAGDATKLPFKDDTFDAVTISFGLRNVQDTDTALSELYRVTKPGGRVVICEFSHPTWAPFRTVYTEYLMRALPPVARAVSSNPDAYVYLAESIRAWPTQPELAERLRKAGWSKVAWRNLTGGVVALHRGFKAV

SEQ ID NO: 12366 - protein, 833 aa, Streptomyces avermitilis
MASYCPHCGAPSPAEARFCMRCGRERVAVASDASDVSDASEAPDASAPEVSAAPEVPEVSAVSPVAPPAVPPVAPPVGPPPPAYAPGPARPSPVGAFLGRTFRGDWAGAAQAALWPVGLLLVSAVALGIPKYGQDSEEFVGFGDRLRIALALLLQALGGGFEVKAASGSGYGYGSGTGFGGGYDQGAAGDVTGGGSFSLVPLTVTVLWIAALCVGVRLLRGRLAVRAPGSPTAGLEAAVRVALLVTGAVLLLGLFAQPTIAGVEISASPALSALGALLLSLAVACGVLHRVGPDQWWAAHPGARTLLRATGTALRALTVVLALCSVVAFITVARLDDLDQAWSADGVSPLLVALLVLPNLAVLALGLSWGVPVGARAQGSSPYGGGYEHHAFGLSELADVTNAWAVVGALALGVVCALILGVVAARRSTSRGEQLLAAGVFLGLFLILAGLGGLGTEMSGSTSSDFGSSGLSAGGTLDAGLSFPEALLFGLLWISAATFVAPYLVRVAGGRTGMSAPPTVPPGPPVSPVSPVSPVSPVSPVPPVPPVSPVPQTPVGRPMPPVPPVPSTPAHTPTAYDLHAFPLGPQPPAAAPKPRSRAVVWAVTLAVAFVVGGGAAAGVLVWQDHQKGDTSSGKPRTKPTATASDSPSATPFADPTSGATDTATDEATDRATDGATGEATASPFELPAGYHRLDDPFGFSLAVPDVWAREGVKNGTQVTYAGSTGLEHVQVGVIANAGYTSYDNFLTLEKTAKKKDAGYQRIRLERNTFQGRDGAIWEYTYTDGSGRTVHAADQGYVAEDGTEYAIMLVGKDELWEGGLAETFRVALDSWQLT

SEQ ID NO: 12367 - protein, 115 aa, Streptomyces avermitilis
VTSVHIPPKTPEVRVPRLVGLMAVDARETAEAGGVLLAAPDRPDSPLTFLDFVVRQYPPPGTEVPRGAVVTVWFDLGEGGGGGGAGVHEPRRPIPPPGGLRRELDEPGDPFKVLR

SEQ ID NO: 12368 - protein, 168 aa, Streptomyces avermitilis
VNRALPDVRLRVPTDEDAFAWHRIFADPEVMEFHGGKAAELSVYEELTARQRRHDAERGFCLWTLLDESGEVIGFTGAQPWPHEWGPKGEIEIGWRLGRAHWGKGYVTAAAHATLERVRAAGVSGVVAMVDARNERSIAVTRRLGMELVETFTTPTAQRLGHCYRREL

SEQ ID NO: 12369 - protein, 434 aa, Streptomyces avermitilis
VTEPQPLSEHTADVIVVGAGPAGSTTAYYLAKAGLDVLLLEKTAFPREKVCGDGLTPRATKQLVAMGIDISEEAGWLRNKGLRIIGGGVRLQLDWPDLASFPDYGLVRKRDDFDEQLARQAQKAGARLYERCNVGAPIIDDRTGRITGVHAKLGDADSKEKREVTFHAPLVVAADGNSTRLSLAMGLHRREDRPMGVAVRTYFTSPRHEDDYLESWLELWDRRGPGEDRLLPGYGWIFGMGDGTSNVGLGVLNTSDSFKELDWREVLKAWCASMPEDWGYTPENMTGPIRGAALPMAFNRQPHYTRGLLLVGDAGGLVNPFNGEGIAYAMESGQLAADVIVQAHARATPAQREIALQRYPRVLKDTYGGYYTLGRAFVKLIGNPKVMKIAAERGLTHPLLMKFTLKMLANLTDPTGGDAMDRIINGLSKVAPKA

SEQ ID NO: 12370 - protein, 272 aa, Streptomyces avermitilis
MSHTAHIRSHRKPRRSTPKISVRAGVAGGVLSTLAVAGAAGAANAAEPVTQTVELPTLTADLATQVAQSADATQQAAANYELQAERDAAAAKAAKQAKSDLADAKKKAEATKKAEAARRAAAERAASRSAERATLSASASASTGTSTSTSTSTATGSAAAVIAFVKAQIGDAYVSGGTGPNSWDCSGLVQAAFKQVGVSLPRVSQDQSTAGTQVSLSNLQPGDILYWGGAGSAYHVGVYVGDGMFVGAQNPSTGVVEKPLSYDPPTGAVRVL

SEQ ID NO: 12371 - protein, 119 aa, Streptomyces avermitilis
VNAYAPILVLGALGAGFAIFSVVMATLIGPKRYNRAKLEAYECGIEPTPTPAGGGRFPIKYYLTAMLFIVFDIEIVFLYPWAVTFDALGVFGLVEMLLFVLTVFVAYAYVWRRGGLEWD

SEQ ID NO: 12372 - protein, 184 aa, Streptomyces avermitilis
MGLEEKLPSGFLLTTVEQAAGWVRKASVFPATFGLACCAIEMMTTGAGRYDLARFGMEVFRGSPRQADLMIVAGRVSQKMAPVLRQVYDQMPNPKWVISMGVCASSGGMFNNYAIVQGVDHIVPVDIYLPGCPPRPEMLIDAILKLHQKIQSSKLGVNAEEAAREAEEAALKALPTIEMKGLLR

SEQ ID NO: 12373 - protein, 248 aa, Streptomyces avermitilis
VSDANANGNGVNPEKDLGASNLPGQRGEGGEEIRLQRGMFGANNGGDTSGYGGLVRSIRLPGPAARPYGGWFDEVADELEGALEEQGLVPGNAIEKTVVDRDELTFHIEREYLLRVAQTLRDDPALRFELCTGVSAVHYLEDKGRELHAVYHLRSITHNRLIRLEVSAPDADPHIPSLVSVYPTNDWHERETYDFFGLIFDGHPALTRIMMPDDWQGFPQRKDYPLGGIPVEYKGAQIPAPDQRRSYS

SEQ ID NO: 12374 - protein, 443 aa, Streptomyces avermitilis
VSTSHASAASARETTEGTVYTVTGGDWDEVVQSAAKSDDERIVVNMGPQHPSTHGVLRLILEIDGETVTEARCGIGYLHTGIEKNLEYRTWTQGTTFVTRMDYLTPFFNETAYCLAVEKLLGIENEIPDRASIIRVLLMELNRMSSHLVCIATGGMELGATTIMIYGFRDRELILDIYELITGLRMNHAYIRPGGLAQDLPPGAVDQIREFVKKMKKNLPEYDKLATGNPIFKARMQDVGYLDLAGCMALGATGPILRSAGLPHDLRKSQPYCGYETYDFDVPTADTCDSYGRFLIRLEEMRQSLRIVEQCLDRLAPGPVMVADKKIAWPAQLALGPDGLGNSLDHIKKIMGTSMEALIHHFKLVTEGFRVPPGQTYSAVESPKGELGVHAVSDGGTRPYRVHFRDPSFTNLQAMAAMCEGGQVADVIVAVASIDPVMGGVDR

SEQ ID NO: 12375 - protein, 287 aa, Streptomyces avermitilis
VTTSSSEQGVSLGMPRLPAPDYPDDVRARLERDGREIIARYPDSRSALLPLLHLVQAEEGHVTRTGMQFCADILGLTTAEVTAVATFYTMYRRRPSGDYQVGVCTNTLCAVMGGDAIFSALQDHLGVGNGETTDDGKVTLEHIECNAACDFAPVVMVNWEFFDNQTVASAKRLVDDLRAGAPVEPTRGAPLCTFKDTARILAGFPDERDGAVEASGSAGPASLTGLRLAKGESAPARVVHPRGSGAPQDEPPHEPSPAEHLSSHDAPQDTSDSDPSHPAGPVAEEGE

SEQ ID NO: 12376 - protein, 449 aa, Streptomyces avermitilis
VMTLAPEINETSPEKLLAPVLSAFWDEEKSWTLDVYRRHEGYEGLRKALAMSPDDLIAYVKDSGLRGRGGAGFPTGMKWQFIPQGDGKPHYLVVNADESEPGTCKDIPLLFANPHSLIEGMVIACYAIRSSHAFIYLRGEVVPVLRRLHEAVREAYAAGYLGKNILGSGLDLEITVHAGAGAYICGEETALLDSLEGRRGQPRLRPPFPAVAGLYACPTVVNNVESIASVPAILHKGKEWFRSMGSEKSPGFTLYSLSGHVASPGQYEAPLGITLRQLLDMSGGMRPGHRLKFWTPGGSSTPMFTDEHLDVPLDYEGVGAAGSMLGTKALQCFDETTCVVRAVTRWTEFYAHESCGKCTPCREGTYWLVQLLRDIEAGKGVMTDLDKLNDIADNINGKSFCALGDGAASPIFSSLKYFREEYEQHITGRGCPFDPARSTAWADRTEVNA

SEQ ID NO: 12377 - protein, 834 aa, Streptomyces avermitilis
MTVTTSAPSGGGEAALPPEDLVSLTIDGAEISVPKGTLVIRAAEQLGIEIPRFCDHPLLDPAGACRQCIVEVEGQRKPMASCTITCTDGMVVKTHLTSPAAEKAQHGVMELLLINHPLDCPVCDKGGECPLQNQAMSHGNSESRFEGKKRTYEKPVAISTQVLLDRERCVLCARCTRFSNQIAGDPMIELLERGALQQVGIGDGDPFESYFSGNTIQICPVGALTSAAYRFRSRPFDLVSSHSVCEHCSGGCATRTDHRRGKVMRRLASPDPEVNEEWLCDKGRFGFRYAQQRDRLETPLVRGESGELEPASWPEALEAAAQGLLAARGRAGVLTGGRLTVEDAYAYSKFARVALDTNDIDFRARVHSSEEADFLAARIAGRGRDLDGTGITYTSLEKAPAVLLVGFESEEEAPGVFLRLRKAWQKHGQRTFSLATHATRGLAKAGGTLLPAAPGTEPEWLDALASGAGLEGDGAKAAEALRTGGAVIVVGERLAGVAGGLTAAVRAASATGAELVWIPRRAGERGAIEVGALPSLLPGGRPATDPRARDEVAAAWGVSGLPHRYGRDTGQIVEAAAGGELRALVVAGVEVADLPDPARARAALSEVGFLVSLELRPSEVTGLADVVLPVAAVAEKAGAFLNWEGRARFFEAALKPDHMTRRLAPTDARVLQMLADAMDVHLGLPDLRTARSEIDRLGAWDGLRATDPREGSAQLPRPAAGEAVLAGHRLLLDQGRLQEGDDALAGTRHAARARVSAATAAEAGVKDGDLLAVTGPAGTVELPLQITEMPDRVVWLPLNSAGQGVASDTGALPGALVRIGAATLAAEAPKEVQA

SEQ ID NO: 12378 - protein, 454 aa, Streptomyces avermitilis
MTPYLAAEDLSMFGRDPWWLVVVKAVFCFAFLMITVLFSIVWERKVVAWMQLRIGPNRHGPWGMLQSLADGIKLMLKEDLIVKRADKVVYVLAPIVAAIPAFMAIAVIPFGPADNEISIFGHRTAMQLTDLPIAMLYILAVASVGIYGIVLAGWSSGSTYPLLGGLRSCAQMISYEIAMGAAFASVFLYSGSMSTSTIVEQQHDRWYIVLLPVSFVIYIVTMVGETNRAPFDMPESEGDLVGGFNTEYSSIKFAMFMLAEYVNMVTVSAVSTTLFLGGWRAPWPISTFWEGANHGWWPMLWFVVKVQLLLFFFIWLRGTLPRVRYDQLMKLGWKVLIPVSVVWLMLVATVRTLRNENYDFADIALYVGGGVLVLLLLSFVADMFREKSKEAAAPAEEPAAFDPMAGGFPVPPLPGQTLPPVPRRRPRRDRELIVSGGPDTASDGPANGKEASDG

SEQ ID NO: 12379 - protein, 200 aa, Streptomyces avermitilis
MAEEPKETGPGFQNPVAGFGVTFKAMFKKRLTEQYPEQQKTTAPRFHGRHQLNRHPDGLEKCVGCELCAWACPADAIYVEGADNTDEERYSPGERYGRVYQINYARCILCGLCIEACPTRALTMTNEFELADSSRANLIYTKEQLLAGLDDNMVDSPHAIYPGMDEQDYYRGLVTEAAPGTERQVAVSKGEKPQDEGVEA

SEQ ID NO: 12380 - protein, 280 aa, Streptomyces avermitilis
MSAQLAAYSTSTGEAFQFWILGTVAVIGALCTVLMKKAVHSALCLAGTMIILAVFYLANGAYFLGVVQIVVYTGAIMMLFLFVVMLVGVTAADSLKETIKGQRWLALVCGLGFGTLLFAGIGNASIKEFDGLGTANANGNVEGLAALIFTKYVFAFEITGALLITAAVGAMVLTHRERTERAKTQRELSEQRVREGKHLPPLPAPGVYARHNAVDIAGLLPDGTPSELTVNKTLRERGQIRDVSTEALNDLKALERRAEERLERTDVEPVSPKRTEEASK

SEQ ID NO: 12381 - protein, 99 aa, Streptomyces avermitilis
VNPVNYLYLAALLFTIGATGVLIRRNAIVVFMCVELMLNACNLAFVAFSRLHGNLDGQIIAFFTMVVAAAEVVVGLAIIVSLFRSRHSASVDDASLMKL

SEQ ID NO: 12382 - protein, 634 aa, Streptomyces avermitilis
VTNPENLIALLVAAPLLGAAVLLCGGRRLDAVGHWIGTVLAAASFVIGVVLFADMLGKGAEERTFTQHLFSWIPVAGFKADVGFQLDQLSMTFVLLITGVGSLIHLYSVGYMEHDERRRRFFGYLNLFLAAMLLLVLADNYLLLYVGWEGVGLASYLLIGFWQHKPSAATAAKKAFLVNRVGDMGLSIAIMLMFTTFGTFAFGPVFTHVGDTGEGKLTAIGLMLLLAACGKSAQVPLQSWLGDAMEGPTPVSALIHAATMVTAGVYLIVRSGAIFNAAPDAQLVVTVVGAVTLLFGAIVGCAKDDIKKALAGSTMSQIGYMVLAAGLGPIGYVFAIMHLVTHGFFKAGLFLGAGSVMHGMNDEVDMRKYGGLRKYMPITFITFGLGYLAIIGFPGLSGFFSKDKIIEAAFAKGGTEGWILGGAALLGAAITAYYMTRVMLMTFFGEKRWQPDAEGHEPHPHESPSSMTIPMIVLAFGSVFAGGFFSIGDRFLHWLEPVTGHSEGNSPVSALSVTVATMVLLVVGAGIAYAQYGRRPVPVLAPRGSLLTRAARRDLLQDDFNHVVLVRGGEHLTRSLVYVDHTLVDGVVNGTAASVGGLSGRLRKLQNGYARSYAVSMFGGVAVLIALTLLMRAV

SEQ ID NO: 12383 - protein, 532 aa, Streptomyces avermitilis
MSFPLLTATAVLPALGALATAAVPAARRTAAKWLALAVSLATLVLAAVVLVRFEPGGARYQLTESHPWIKDFGVRYELGVDGIGVALVALTALLIPFIILAGWHDADPLETRSSRWRPTQGFFALILAVEAMVILSFEATDVFLFYIFFEAMLIPMYFLIGGFGDRAHGAYQSAVTAAQRDEAAATQRSYAAVKFLLYNLVGGLIMLAAVIGLYVVAGNFSLQEIVQARANGSLHMATSTERWLFLGFFFAFAVKAPLWPLHTWLPNAMGESTAPVAVLITAVVDKVGTFAMLRFCLGLFPEASKWATPVILVLALISIVYGALLAVGQRDIKRLVAYASISHFGFIVLGIFAMTSQGQSGATLYMVNHGISTAALMLVAGFLISRRGSRLIADYGGVQKVAPVLAGTFLIGGLATLSLPGLAPFVSEFLVLVGTFTRYPAVGIIATFGIVLAALYTLVLYQRTMTGPVKAEVAEMPDLRARELLVVAPLIALLIFLGVYPKPVTDIVNPAVQQTMSDVHEKDPKPEVEAAK

SEQ ID NO: 12384 - protein, 542 aa, Streptomyces avermitilis
VSASAVHSLWTTAADPISKIDAPKIEYGQLSPTLIVIGAALVGVLVEAFVPRKSRYYAQVFVSVVALAAAFAAVVALAAGGYGTTKAHIAAMGAIAVDGPALFLQGTILLAGLLGVFTFAERRLDPEVHGNRVDSFAAQAASVPGSDSEKAAVKAGFTTTEVFPLLLFAVGGMLIFPSANDLLTLFVALEVFSLPLYLLCAVARRKRLMSQEAAVKYFLLGAFASAFTLFGIALLYGYAGSMSYATIAQVVDGTVQNVDPALAGTMGNDALLLVGAAMLVMGLLFKVGAVPFHMWTPDVYQGAPTPVTGFMAAATKVAAFGALLRLLYVVLPGLRWDWRPVMWAVAIVTMLGGAIVAITQTDIKRLLAYSSIAHAGFILAGVIATTPDGVSSVLFYLGAYSFVTIGAFAVVTLVRDAGGEATHLSKWAGLGRRSPLVAAVFAVFLLAFAGIPLTSGFAGKFAVFKAAAEGGAAPLVVVGVISSAIAAFFYIRVIVLMFFSEPRPEGPTVAVPSPLTTTVIGVGVVVTLVLGVAPQYFLDLAG

SEQ ID NO: 12385 - protein, 658 aa, Streptomyces avermitilis
MSTAEALDESEALTTLHRVFGYEAFRGEQEAVIEHVVAGGDAVVLMPTGGGKSLCYQIPALVRPGTGVVVSPLIALMQDQVDALRALGVRAGFINSTQDFDERRTMEAAFLAGELDLLYLAPERLRLEGTLDLLSRGKISVFAIDEAHCVSQWGHDFRPDYLALSLLGERWPDVPRLALTATATHATHQEITQRLGMPTARHFVASFDRPNIQYRIVPKADPKKQLLSFLSDEHAGDAGIVYCLSRNSVEKTAEFLSRNGIEAVPYHAGLDAGTRAAHQSRFLREEGLVVVATIAFGMGIDKPDVRFVAHLDLPKSVEGYYQETGRAGRDGLPSTAWMAYGLNDVIQQRKLIQGGEGDEAFRRRAAAHLDAMLGLCETAQCRRGQLLAYFGQDPQSGGCGNCDTCLVPPDTWDGTIAAQKVLSTVWRLERERRQKFGAVQIIDILLGRRTAKVIQFDHDQLSVFGIGEELTEGEWRGVVRQILAQGLLAVEGEYGTLVLTEASGTVLRREREVPLRKDPPKPTASRSSAGSGAGSAKGERKPKAAVAELSPELQPAFEALRAWRAEQAREQGVPAYVIFHDATLREIVTAWPSSVAELGTISGVGEKKLATYGEGVLGALAALGGTPGDDTQKSPTAEAEPAPDWPEMDEEPEPEEWM

SEQ ID NO: 12386 - protein, 939 aa, Streptomyces avermitilis
VEIPALTDAEELSCDVLVIGGGTAGTMAALTAAEHGADVLLLEKAHVRHSGALAMGMDGVNNAVIPGRAEPDDYVAEITRANDGIVDQSTVRQTATRGFAMVQRLESYGVKFEKDEHGEYAVRQVHRSGSYVLPMPEGKDVKKVLYRQLRRREMRERIRIENRVMPVRVLTAEGRAVGAAGFNTRTGQFVSVRAGAVILATGACGRLGLPASGYLYGTYENPTNAGDGYAMAYHAGAELTGIECFQINPLIKDYNGPACAYVANPFGGYQVNRHGERFVDSDYWSGQMMAEFAAEVASDRGPVYLKLSHLPEESITALESILHTTERPTRGTFHSGRGHDYRTHDIEMHISEIGLCGGHSASGVRVDEHARTTVPRLYAAGDLACVPHNYMIGAFVFGDLAGADASRFRAYEGELPAGQLHEAHELIYRPLRHPDGPPQPQVEYKLRRFVNDYVAPPKSGARLSLALESFERMRADIAAMGARTPHELMRCAEVTFIRDCAEMAARASLARTESRWGLYHDRTDHPARDDASWFHHLDLHKSPSGSMEFTARPVAPYLVPVDEFTPTGGASRHLGEVHPEGVATAGARETAPMASPPEPLTTGITDTPGITGTTGTTGITGEDESGASEVTSPRLLELLALAEEDADLATVAPYLADPEPAVRRTAVTILTETVPPGTGPALATALADLHPAVRTTAAASLRELVETLTPEPALGEPLTRAVTHDDPVVRAAALDVLRALRMGDTGLFAAALADTEAAVRIEAVRALVSVDADRALLLAAADPSREVRVAVAKALATLGSKHPAGPTAADSTDDGVLAALDRLTGDTDALVRAAAFEALAATGCPPLLTARAVAARSDAAWQVRSGAATALSAAAADAAVPALSKSLADPNADVRKAAVLALVRHAESEGPGSPDARAALATATTDSDADVRAYASRAL

SEQ ID NO: 12387 - protein, 270 aa, Streptomyces avermitilis
VTSLSADPGAGLGAKSETGAEAAPGAASGAGLVLRSATLGRPGTPALSGVDLEVAPGEILTVVGPSGCGKSTLLRTFAGLLPALAGTVEQDGRPLTSPGAERALVFQEDALLPWRTLRANVELPLSIRGVRRPARREQAAAWLARVGLAAQHRQLPHHVSGGQRQRVQLARALAGRPRALLMDEPFGALDAQTRAGMQDLLVEVLHGTGATVVFVTHDVDEALFLGDRVALLGAGRLLGVRDVPRPRDRSAHDDPARHALRREVLTSLGP

SEQ ID NO: 12388 - protein, 289 aa, Streptomyces avermitilis
MTRYALRIGSLAAALATWQLLTSRNVDLWLRFSQFPTVADVARAFAGRLGGDDYWTDLTDSLTRILTGFLLAAVLGVATGVLVARSRLAEDLLGPPLEVLRPIPAIALVPVAILLFPSNEQGIVFITCTAAYFPVLVSTRHAVRALTPVWEEAVRTMGAGRWRVLGSVVLPGALPGIFGGLSVGIGVSWICVISAEMISGQYGVGYRTWQDYTVVDYPGVFVGMVTIGVLGWATSTAVEVAGRRLTRWLPRTSYVPGARVRATAPPVAPAVVTAGPKTEEEVPRDQLVR

SEQ ID NO: 12389 - protein, 448 aa, Streptomyces avermitilis
MKRTTVAVAAGALLLPLTGCGGDTRAGSGDTVTVTVGYQSKTINTVTAGTLLRSLGSFERELNSLGDGVTYKVKWQDYATGAPITAQMTAGKIDIGSMGDFPLLINAARGTQLGKPTHLVSVTGYNLRGGLNTIVTAPNSHLASLKDLRGKKVSTSIGSAADGTLVRALRRAGIDPDKGIEKLNQQPAVGASALSAGSADALSQFVAWPGLLAYQGKAKALYDGAELNLPTFHGVTAREDFAKRRPAVLQAFLKAQAEATDYLNDHPVTAAEKVAEATGLPAEVVYLYNGAHGIATFDPALKPRLISALKQDVSVLKSAKLIGNVDVDAFVDDRYAKKALGSSYTAGLTAAPAPAASEVWPKGATRTRSFATPTALLRHLAAHRDGIRAAYVPDATTGTPWFADKAVWVADGDRLLPFVAPATARAYVAGHQGARTVSYAAALARAAS

SEQ ID NO: 12390 - protein, 75 aa, Streptomyces avermitilis
MPLAPQRADVPVTIDESKCIDGCTLCVDMCPLDSLAIDESNGKAYMHVDECWYCGPCAARCPTGAVTVNMPYLLR

SEQ ID NO: 12391 - protein, 259 aa, Streptomyces avermitilis
MPAERIRDHAGQGATTVAAHRRRLRADRARQLADLLRHQVLTGGFPDGTLPHEAALGADYRATRGTVRQALDLLRAEGLVERLPGVGTVVVAQKYPHGLDRLMGLAETLREHGQVSNEIRTVGPVAAPAPVAERLRVPPGADVLYIERLRRLDGLPLSLDLTYVPLDLGTALLGADLENTDVFRLLEAITGQPLGHAEITLEAVNADAHSAAVLQAPRGAAVLMLERLTHLADGRPVDLEFIRFRGDRITMSGLLHRSR

SEQ ID NO: 12392 - protein, 407 aa, Streptomyces avermitilis
MPPFDVPEGDPFGPHNLPYGVFSPAGSGEQADRSVGVRLGDHVLDAGAAARALGSPYASLLARPTLNALLAAGRTAWSDVRRAITAWVTVPAHQEAVAPFLHPLSSVTLHLPFEVADYVDFYASENHARNVGQIFRPDAPDPLTPNWKHLPIGYHGRSGTVVVSGTEVVRPSGQRKAPTDAAPVFGPSVRLDIEAEVGFVVGTPSPMGRSVGLGDFRDHVFGLCLLNDWSARDIQAWEYVPLGPFLGKSFATSVSAWITPLDALEDARVAPPARTYPLLPYLDDADEEPGGYDLRISVRINGHTVSEPPFSTMYWTAAQQLAHMTVNGASLRTGDLYGSGTVSGPQENQRGSLLELTWNGRDALELPDGKRTFVEDGDVVTLTAWAPGPDGTRVGLGEVTGRVVPTV

SEQ ID NO: 12393 - protein, 429 aa, Streptomyces avermitilis
VGGPVARSTGSVPFDADRDVPGLIVKFGDYPLHHGGVGAIRSLGRLGIPMYAMTEDRYTPAAASRYLRRAFVWPTTGTEEPERLVEGLLRIGHLIGRPAVLIPTDEEAAVLIAEHQEALADRGRFLFPRVDAKLPRRLASKQGLHELCVEHGIPSPAAAFPQSYDDIVRFAEKARFPLVAKNREAFVRRSRPAVNGTTRIATREGLLTLARDWGDHPGVILQEYLPREEAEDWIVHAYFDADSTPLAMFTGVKVRSWPPHAGMTANAYVVDNPELADLAARFIKQIGFSGVIDLDLRFDRRDGQYKLLDFNPRMGAQFRLFENESGVDVVRAMHLDLTGRTVPEGEQRAGHRYIVENIDLPALLAYRRSGYTTPHAPARASGTELAWLAGDDLRPFFTMLARFVRPGAKHLYQLWRTNRRGGTNSSTAK

SEQ ID NO: 12394 - protein, 400 aa, Streptomyces avermitilis
VIQPVAVIGAGPFGLSTAAHLRARGIPVRVFGDPMVSWRDHMPAGMLLKSTPAASTIDAPQRGHRLVDYCDAAGIARLVTDEDIIPVETFIGYGRWFQEQLVPGLEQVRVVSVDRKAGGGFELKLDSGELFTARAVVVATGLSGLAHLPAELAGAAVDGPTPTGPVSHSSQHHDLSRFAGKELVVVGAGQSALETAALAAEAGAHVRVVSRGRGRVSFGAPPWKQPRLRPESPFGRAWSLWALSYYPHPYRYLPAEARHYLVRRVLGPLGAWWLRDRFEGKVEVREVASVARAHASEGSPVLTLRTHGGRTQELPADHVIAATGYRVDIAAMDFLGHELRTELVVSRGTPKLGAGFRSSVPGLYFTGLPAAASYGPVMRFVCGTEFASPRLAKHLAGAHG

SEQ ID NO: 12395 - protein, 270 aa, Streptomyces avermitilis
MAAPTAYSLIATDLDGTLLRRDDTFSDRSLAALARAAGAGAQHLVVTGRPAPRVRPLLDALGTRGLAVCGQGAQLYDAGANRLLWSVTLDRELAETALGKIEAEVGEVYAAVDQDGVDGLTLIEPGYLMPHPTLPAVRVPRRDDLWTEPISKVLLRHPLLSDDELASEARGAVGSLATVTMSGPGTVELQPCGITKATGLALAADHLGLTPARTIAFGDMPNDIPMFDWAAHGVAMANAHPELKAVADEITTSNEDDGIAVVLERLFPGR

SEQ ID NO: 12396 - protein, 158 aa, Streptomyces avermitilis
MPAFAMPARFARTLAVAGTGVAVLALPLLGATGASAATPATTAAAPSSAVTYTNNLDGWIRESLDIMAKHNIPGTYNGIYRNVIRESSGNPLAINNWDSNAAKGTPSKGLLQVIDPTFAAYHVPGTAFDPYNPVANITAACNYAAARYGSIDNVFGAY

SEQ ID NO: 12397 - protein, 684 aa, Streptomyces avermitilis
MSARIRTSFPYETTHDDLLVPLQDGTRLYARVWRPLTGEPVPALLEYLPYRLTDETAARDWQRHPWYAGHGYASVRVDIRGHGNSEGMPGDTHAEAEAADGVEVIEWLAAQPWCSGRVGMFGISWGGFDALRIAARAPEPLKAVVTVCSPDDRYDHDVHYRGGSVLAVGMHAWAATMLAFASRPPDPAHVGAVMWRDMWTERLESVTPFIHTWLEHQTRDGYWRPGGVREDYGAIRAAVLAVGGWHDPYRDTVLRLVECLPPDRVRGLIGPWSHQYPDRGLPPGPAIGFLQETLRWWDHWLKDTDTDTDTDTGTGTNGVMAEPLLRSYIGDSHPPATVYDVLPGRWVGDAAWPSPAVTPVSYGLQGAPVLVRSPMHTGVDAGRLLPVGNDADLPPDQRDEDAKSACFEFEVAAETWVLGRPRVRLRLTSWAPRGQVIARLCEVFPDGSSTLLTRGVLNLSARHGRDRATAWQPGATEDVTFELNGIGHAFPPGHRIRLAVSSAYWPWIWPQPGSEAGFTLDPAGSALQLPVRARESDPAIRFEEPEQAEPLGVVSPVTLDEPRPERLVVRDVAAGRWRLEDDPRFEDDPRHGGTRVYPDGLELTEDARETYTVDASDPLSARTRSDWSIRLHRPDLAWDASVRTRSEVTCDAADFITSDEVICKDGDEVVFHRTWRKRIPRTAG

SEQ ID NO: 12398 - protein, 336 aa, Streptomyces avermitilis
VTVVGPFGLSVRDQALEADVQAGLAAVEEGLLEATKSEVPFITEAAQHLVRAGGKRFRPLLVMLAARFGDPYAPGLVPSAVVVELTHLATLYHDDVMDEADVRRGVPSANARWGNSVAVLTGDFLFARASHILADLGPEAVRVQAEAFERLVTGQILETAGPMDGRDPVEHYLEVLSGKTGALVAVACRFGAMMSGADETVVDVLTQYGERLGVAFQLADDVLDIASDSHESGKTPGTDLREGIPTLPVLRLRERVARLGLAEDIALCELLDSDLTDDARHAEALTRLRAHPALEQARKDTVRYVEDARAALAPLAECNAKAALIELCDAVVHRAG

SEQ ID NO: 12399 - protein, 342 aa, Streptomyces avermitilis
MGTDATFAKRRKNLIITGVAVAAAAGVAAAVIPAVAAGGNGGAGHGTAHTGHGGQSIVTQGGAVGGSGGSGGAILAASLRGANEVPVAGGPAVGDKDGAALEFIRVKGDTVSVAVTWRGTGKPTLLHIHQGAKGTNGGVKIDFSELLEKGVRHHSVVGSVKVKDAALLSQLKTDPGAFYANLHTAQFPGGAVRGQLHKVTTAFDFRHALNNFQASVVKGKQIYECKPAEGGGYAFAQRDVAARLGGDIAHSFVKPNSGTPQWVAPDRSAVTGTLISKTANGDKNIPELDLKATRSGKHRGLLAHTAEILRLNTVGGVAPAGSCSPGTVVGVPYQADYVFVQR

SEQ ID NO: 12400 - protein, 409 aa, Streptomyces avermitilis
MAPYESDDSTRADEAEDVRAGRRKATRYVVPVTVVGLAAATIGLVPALADSGDPDLPKITAQQLIEKIAKSDVQQLSGTVKISTDLGLPDLGGLESGFLSGAAQGSGGDGSSADPSAKLMELASGTHTLRVAADGEDKQKLSLLDKAAEYSIIRNGADVWAYDSASNEAYHAKDAASGEKSDKARPDDVPATPKEMADEALKAVDDTTSVAVDGTAQVAGRDAYKLVIKPKQSGSTVGAITIAVDAKTGLPLKFTLTPAKGGAAVVDAGFTQVTFAKPSASTFDFTPPKGTKVTQDGDGAKVPEHSGKPGSGKDLGAGLDGLKTMGKGWSTIVRLDDGGGSGLPTGSDSSGNSDVSGFLNSLGDHVSGSFGSGTVFSTRLVNALITDDGKVYAGAVTKDALVKAANAGK

SEQ ID NO: 12401 - protein, 346 aa, Streptomyces avermitilis
MEELSAAEPGPEPGPEPESAPESESEPGPAGAGDAPGDGVIVTRALTKRYRGGQLAVDGLDLTVPAGSVFGFLGPNGSGKTTTIRMLMGLIEPTSGTARVLGRPMPRSARTVLPHIGALIEGPALYGFLSGRDNLLRYDAADPTADPRTRRTRVAATLDRVGLTAAAGKKAKAYSLGMKQRLGLAAALLQPRRLLVLDEPTNGLDPQGMREIRSLVRELASDGTTVFLSSHLLDEIEQVCTHAAVMAQGRLITQGAVADLAAGARGRLVVTTPDVTDAARVLKEQGVADIVVAEDRVTGEPPDGELAELNAALVTAAVRVRGFGVERASLEDAFVALTGEGFDVAG

SEQ ID NO: 12402 - protein, 297 aa, Streptomyces avermitilis
MSRAEAVTTAAAGEVRRPSPLWTLGLLRSELVTTFRRWRTLALLAVLAAVPVLVGIAVKIETNDGSGPGGGGGEGPAFITQITNNGLFLVFTALAATLPFFLPMAIGVIAGDAIAGEANAGTLRYLLVAPAGRTRLLLTKYATTMAFCVVATLVVAVSALAVGALLFPLGELTTISGTRISFGEGLARALLIALVVAASLVGVAALGLFVSTLTNSGIAAMATTVGLLITVQILDQIPQLHALQPYFFSHYWLSFADLMRDPVYWDDLLHNLGLQALYAAVFGSAAWARFTAKDITA

SEQ ID NO: 12403 - protein, 194 aa, Streptomyces avermitilis
MPRRFLFVLGSSRSNGNTELLARAAAEQLPGDVEQQWISLAGHRLPDFGDQRHDTDHGRPADDELALLLDATVAATDVVIASPLYWYSVSSHTKRYLDHWSDWLRVPGLDFKKTMAGRNLWGVTVLAADEPSVADPLAGTLNNTAAYLGMRFGGVLLGNGSAPGDVRKDTEALTRAKTFFAREPELARFPHQAV

SEQ ID NO: 12404 - protein, 232 aa, Streptomyces avermitilis
MYRVKSPGSRPRLASPRRHRLVPGTGTPLVRPFTGPEEWGTTRRRVVMQGSAQPEHGPGGPEIWIRGPVGGGEPQPRREAAQVSASPRRFSWVATHGGAGTTTLANVFGGHDAGRNWPRPERGEPASVLLVGRTHAAGLDAVSHTVDTFRRGEAPPGLDLDAVVLVADAPGRLPRQLAQRIKVIESVIDVYRVPWVPAWRTGELDGPPPRECEQLGRLTGTPAPQTGRRAPR

SEQ ID NO: 12405 - protein, 584 aa, Streptomyces avermitilis
MSRLSREHRRGRSAAGSGPRTDADAGVTPIEVRVPVAQDGTPGGGATVGGMPVVARAGETLQEAVLNYLHRLTLATGHPVLASVHDERIGCVVPIRVHGDGSSEFTGEPVRVGTPAGGTGAAGGGEAAAPPPPPPPPPSPPRPVVEPPVPQRPVAGPVGPPVPGDAPQGPPPRRDKATHLLRAVAEPTPAAQWTPPQQSVAPAPAPAPAPVERPASTPTHVLRALPESAATHQPEQVQAPEAPKGPKVPEGAEAVASEAEETPVRAGGTVSTFVLRAVPEQAPWITVAPGLAQALPGAPTGQGAPAPAPGTVSPPTGAFGPAPTTATPPPGPAPWEPAPAPEPAPAPAPAPAQGRTPTPDAGPNIDSGSGSGADPDLDPYAAPAWKPTPAPRTVPVAEVEEVKEPPVREFDSVAEAVLAPESGSGPDGAAAGPLAAPMARINEAVKQGRIEEAAAMAEEAVHGAAATLGPEHPDVLRLRELTAYIAYLAGDALRSFHLSLDLARLRRRARDPRGAYGNVQSAAAAWRAVRDPVQGLHLGRDLIGVWTELAAEPGPAAEDLDQLESARNRMGRLAERARTLTENP

SEQ ID NO: 12406 - protein, 315 aa, Streptomyces avermitilis
MKLSVPGRASTALVVAAATLLTGGAISGAAPAPVAAAAAPDLPVANVKAHLAQLQSIATANGGNRAHGRTGYKASLDYVKAKLDAAGFTTTVQQFTSSSRTGYNLIADWPGGNTNQVVMSGSHLDSVTAGPGINDNGSGSAAVLETALAVARTNYQPTKHLRFAWWGAEELGMVGSRYYVNSLSTANRSAISGYLNFDMIGSPNPGYFVYDDDPTIEKTFKTYFTGLGIATEPETEGDGRSDHAPFKNAGIPVGGLFSGADYIKTAAQAAKWGGTSGKAFDACYHSSCDTSSNINDTALDRNADALAYAVWSLSS

SEQ ID NO: 12407 - protein, 326 aa, Streptomyces avermitilis
VQSKGATGSKSEQRTGLLNGVAAYGMWGLVPLYWPLLKPAGAVEILAHRMVWSLALVAVALLVMRRWAWAGELLRQPRKLALVTVAAAVITVNWGVYIWAVNAGHVVEASLGYFINPLVTIALGVLILKERMRPWQWAAVGVAFTAVVVLTVGYGQPPWISLCLAFSFGTYGLVKKKVNLGGIESLAAETAIQFLPALAYLLWLTASGGSTFGTQGGAGHAALLASTGVVTAIPLVCFGAAAIRVPLSTLGLLQYLAPVFQFLLGILYFHEAMPPERWAGFALVWLALSLLTWDALRAAHRASRALRTAPSRIVADEQITPVYEHP

SEQ ID NO: 12408 - protein, 284 aa, Streptomyces avermitilis
MSIVVTGATGHLGSLVIEQLLEKVPADQITAVVRSAEKAAPLAARGVRIAVADYNTPETFDGLLAAGDRVLLISGNEFDKGRVGQHKVVLNAAKAAGVALLAYTSAPGSLTAALADDHRGTEEAILASGVPYALLRNGWYNENYTEQLAPVLEHNAVTHAAGEGRISSAARADYAAAAVAVLTGEGHENKTYELGGDAAWSLAEYAAELSRQTGKEIADNAVSPEALVGILTGAGLPGPFATILAGVDASIQKGELVIDSGDLSRLTGRPTTPIADSIAVALKG

SEQ ID NO: 12409 - protein, 157 aa, Streptomyces avermitilis
MSVSTPAVSGAPAATQPAATPSAGKTAATQSAGKYDIAEAMCPYRLVLEHVTSRWGVLVLIELLERSYRFSELRRAIGRVSEKMLTQTLQTLERDGLVHRDAKPVIPPRVDYSLTDVGREAATQVRALAVWTEKRMDDVERARRSYDEARAAGARAS

SEQ ID NO: 12410 - protein, 359 aa, Streptomyces avermitilis
MTETSTEGTGTIEALSLVPKAEARQSMKDFKSDQEVRWCPGCGDYAVLAAVQGFMPELGLAKENIVFVSGIGCSSRFPYYMNTYGMHSIHGRAPAIATGLASSRRDLSVWVVTGDGDALSIGGNHLIHALRRNVNLKILLFNNRIYGLTKGQYSPTSEVGKITKSTPMGSLDAPFNPVSLAIGAEASFVARTVDSDRKHLTDVLRQAAAHPGTALVEIYQNCNIFNDGAFEVLKDKQQAEEAVIRLEHGKQIRFGADAAKGVVRDPLTGDLKVVTVTPENEARILVHDAHSASPTTAFALSRLADPDTLHHTPIGVFRAAERPVYDAQMSEQLDTAIEQNGKGDLAALLAGGDTWTVVG

SEQ ID NO: 12411 - protein, 642 aa, Streptomyces avermitilis
VTSQVSSTTEQADEPVVGEQRKPAGAKDVRRLDRVIIRFAGDSGDGMQLTGDRFTSETASFGNDLSTLPNFPAEIRAPAGTLPGVSSFQLHFADHDILTPGDAPNVLVAMNPAALKANVSDLPRGAEVIVNTDEFTKRAMQKVGYGTSPLEDGSLDGYSVHPVPLTTLTVEALKEFELSRKEAERSKNMFALGLLSWMYHRPTEGTEKFLTTKFAKKPAIAAANIAAFRAGWNFGETTEDFAVSYEVAPAQSAFPAGTYRNISGNLALSYGLIAASRQADLPLYLGSYPITPASDILHELSKHKNFGVRTFQAEDEIAGIGAALGAAFGGSLAVTTTSGPGVALKSETIGLAVSLELPLLVVDIQRGGPSTGLPTKTEQADLLQAMYGRNGEAPVPVVAPRTPADCFEAAIEAARIALTYRTPVFLLSDGYLANGSEPWRIPETDGLPDLRVRFAQGPNHTLDDGTEVFWPYKRDPGTLARPWAIPGTPGLEHRIGGIEKQDGTGNISYDPANHDFMVRTRQAKIDGIDVPDIEVDDPDGASALVLGWGSTYGPITAAVRRLRTAGESIAQAHLRHLNPFPSNLGAVLKGYDKVVIPEMNLGQLATLIRAKYLVDAHSYNQVNGMPFKAEQLATALKEAIDD

SEQ ID NO: 12412 - protein, 223 aa, Streptomyces avermitilis
VEDRVRVVIAEDSVLLREGLTRLLTDRGHDVVAGVGDGDALIKTIGELAAQDELPDVVVADVRMPPTHTDEGVRAAVQLRKAHPEVGVLVLSQYVEERYATELLAGSSRGVGYLLKDRVAEVREFVDAVVRVAQGGTALDPEVVAQLLGRSRRQDVLTGLTPREREVLGLMAEGRTNSAIARQLVVSDGAVEKHVSNIFLKLGLSPSDGDHRRVLAVLTYLNS

SEQ ID NO: 12413 - protein, 452 aa, Streptomyces avermitilis
MTPMATQYGQGYGDWDSPGSPGAGERRHRLPAPLRAPIEARSWREFGYLMLGLPVGIAMFIYAVTMFALGAGLLVTFLGIPVLAAALAGCRGFGVLERARARRLLGLEVADPEPLRMKGHGPMAWMGAMLKSGASWRHLLYAVLQFPWAVFAFVVALNFWAYGWALLTYPLWFWVFPMYGGQGGLQLYGDQAHSIYLDNPFEITVTALVGLLFTMATPWIVRALTTVDRLLVHGLLGPSRLATRVVELESDRGVVIDTAAADLRRIERDLHDGAQARLVALAMDLGLAKEKLAEDPREAARMVDEAHGEVKTALQELRDLARGIHPAVLTDRGLDAALSAVASRCTVPVQVEVDLPARPAPAIEGIAYFTVSELLQNVSKHARATRATVDVWRVENRLLLQVVDNGVGGADVSGGSGLAGLAGRLDAVDGILVVDSPVAGPTRITAELPWRG

SEQ ID NO: 12414 - protein, 413 aa, Streptomyces avermitilis
MTERITSPGLREGERLPLPGSRDTRDGERLPPLRLALDGHTWREIAHLLANLPMALIGFTYVVTVLFTGAGLTVTVIGFPLLAAGLLGARQLGKVERARARLLLDVRVDEPSPLPLRKGSGGLFQQLWMGLKDPVGWRTFLYEFIRLPWGVVTFSVTLVSLFVAWPVLPFIARGLTSVDRAMVRVLLSPSDELEQRIAELESDRGVVVDTAAADLRRIERDLHDGAQARLVNLAMGLGLAKEKLLEGQADESVAAMVDEAHGEVKLALQELRDLARGIHPAVLTDRGLDAALSSVASRCTVPVKVTADLPTRPAAAIEGIAYFTVSELLQNVSKHSGARSASVDVWRADQRLLIQVWDDGRGGADVGGGTGMAGLADRLGAVDGLFVIESPVGGPTTITAELPWRDRREEPRP

SEQ ID NO: 12415 - protein, 146 aa, Streptomyces avermitilis
VPEPTVVTGTGAGTAGNAVAADHLQSYFHSYSVVGLLAVVGVLFVAVAFGAGHLLRPVVPTPEKLLTYECGVDPVGEGWAHTQVRYYVYAFLYVIFAVDSIFLFPWATVFAAPGYGAATLVEMFIFLGFLAVGLLYAYKKGVLAWT

SEQ ID NO: 12416 - protein, 203 aa, Streptomyces avermitilis
MDVTPEPVLLPEPKRLGALARLAPEPMKVVLNWGRRYSLWVFNFGLACCAIEFIAASMARHDFIRLGVIPFAPGPRQADLMVVSGTVTDKMAPAVKRLYEQMPEPKYVISFGACSNCGGPYWDSYSVTKGVDQIIPVDVYVPGCPPRPEALLQGILKLQEKIARESLSERYGSPRPSAAALQSDLVRPPAAGTGAGTAEGGAR

SEQ ID NO: 12417 - protein, 504 aa, Streptomyces avermitilis
MTAVGWLPAPAEELFGTEATAEASYEVLTVDVPPTSWISALETARDALGCTYFDWLSAVDEPGRGFLVSAHVVALPSPPSPSQPPSPSPSQPPSPSSVRRLLVRTTVPHEAPVLPTAVGVYAGAGWHERETHEMFGVTFEGHPALDPLLLPEGFEGHPLRKDFVLAARVAKAWPGAKEPGESDHGGPKRRQMLPPGVPDPNDWGPLKGQLPPAPARPARGAARAAGERPARAAGERPVRRTRTAGEGSASQAAAPATPPPTEAPSTPRRARTVSEGSVSQTATPGTTPDASTEVPTAPRRARTASEGSVTQRPSATEPTPPAAGPRRARSASEGSATQRVRPDTAKAADTAKAADTAKAADTAKAAEATDAADAPAPADTPAPAGTGEDAPTAARTTPKPAPRSSDAPWHHARPAFDEPEAEAAPEPTPKPPTETGAGGADADADADANADTAGAGSGADAADAGAEAGTDAADADSEVRPAGPRPETSPDTTPTPEDPTGGRQ

SEQ ID NO: 12418 - protein, 322 aa, Streptomyces avermitilis
VNDALDVALRLLVVFVVFLTFPLIVGQTEHKVMAHMQGRLGPMYAGGFHGWAQLVADGVKFAQKEDVVPAGADRRIFQLAPAVALLPYLLVLLAIPIGPGEGAVGEVVDAGIFFVLAVMGVGVLGSLMAGWASANKFSLLGGLRTAAQLLAYELPMLLTAASVAMAAGTVSLLGIVDAFQWWWLPWQIVGAIVFFVAGLAELQRPPFDMPVADSEIIFGAYTEYTGLRFALFLLAEYAGIVVLCGLTTVLFLGGWHGPWGADGLGWVWTLLKTALLAFVVIWLRVTYPRLREDQLQKLSWTLLVPLSLAQIALTGIVKVVIS

SEQ ID NO: 12419 - protein, 216 aa, Streptomyces avermitilis
MAPIPGSGLAKGLAVTLRTMTKKTVTAQYPDAQPELPPRSRGVIGLFEENCTVCMLCARECPDWCIYIDSHKETVPPAAPGGRERSRNVLDRFAIDFSLCMYCGICIEVCPFDALFWSPEFEYAETDIHELTHERDKLREWMWTVPAPPALDPAAEEPKEIAAARKTAEKLAAAQAAAAQTDAAQAEAAQAEAAAEAGSAAEGAPDAAPKPQEGEA

SEQ ID NO: 12420 - protein, 207 aa, Streptomyces avermitilis
VTPAAAHVATAVAAESHGFLSPTGIEIAFLLVGLVTFGAAIVTVTTKQLVHAALWLVATLGGLAVEYLLLTAEFIAWVQVLIYVGSVVVLLLFGLMLTKAPIGRSPDADSGNRWAALTVAVASAATLVWVVVDAFRTTWLDLNGAAAGSTAVTGASLFQNWVLPFEALSVLLLAALVGAIVLSRKAKADAATTTSLPSARSEKEGAR

SEQ ID NO: 12421 - protein, 129 aa, Streptomyces avermitilis
MHLAYPAVLSALLFSTGLYGVLARRNAILVLMSVELMLNAVNLNLVAFDVWLSKTARDTLHSGQALTLFTIAIAAAEIGIGLAIVLAVYRNRGTSDIDKLRDTAEGPEPDGPGTDGSAPTAAEKAEATA

SEQ ID NO: 12422 - protein, 663 aa, Streptomyces avermitilis
VTTTTLAVLVPLLPFLAAAAGLLLGRTAPGFVRPLAVLPTLTAFALAVVVAVRQGGGQAIDAATELTPTGSVPIELALHIDGFAALVAVLVGLVASCVQIYSTGYLRDDPRYPSYSALVSLFTSAMLLVVYSGDLMLLLVGWEIMGICSYFLVGHYWETSEARAASIKAFLVTKLGDVPFLIGLFALATDAGSFRITKVLGAVANGGLDHPTLIALLLLAGVAGKSAQFPLHTWLPDAMAGPTPVSALIHAATMVAAGVYFIARLLPVFAASSAALVVLAVMAAVTMLGSGLAALAQDDIKRVLAYSTIGQLGYMTGALAVGDRGAAVFHLLSHGVFKALLFLAAGVIIHAAGTNSLASMSRMKDLRARIPDAYWTMTVALLALAAVPPFAGFFSKESVLGAAEHVATGHTEHAPGAAGWIVLVAALLTAVLTAAYATRLWLLAFRGRGVEAPDHGRQPVVMTAVLWVLAVPSLAFGLAYGLLPDWFDGRDLAPTLTTSVLGTGLALTGGLITYGAWRHTSALAVRVPLGAVVAHPEGDAAHVEAEAIAIHESVYGDVAYAPDPADPGRLLLGPLHRHAAVGFHLDAVYATLFVRPVQAAASLVRFLDREVVDTYVSGASAVPRLLGAAVRRAQTGNVQTYVSALLAGTVVLAVAALLVATGA

SEQ ID NO: 12423 - protein, 527 aa, Streptomyces avermitilis
VIDINESVMQILLAFIVVGPLIGAAAALLPAPPGLKGKSPDQAVLRHGVTVTGAVLIAAIALTLGFDHDHPSKMQATTDISWIPALHVRIHLGIDGISLPLLVLTALLTFLCALYSYFKMPAGPTPKAFVALVLVLESGTLATFAVLDLLLFFLAFEMVLIPMYFLIARWGGAERQAAAWKFILYTLLGSVVMLLGLLLIGIKAGTFDMVALATDNGRSLTTSVQVIAVLAIGIGLAVKTPMWPLHSWLPDAHTAAPTVGSVLLAGVLLKMGTYGFVRILLPIAPDGLRTFAPYLAAFAVVGIIYGSLACLALAKQGAKGDLKRLIAYSSVGHMGFVLLGIATMTPTGVNGALFANIAHGLITGLLFFLVGALKDRTGSTDLDTLAEKTGAALYAKAPRLGGLLAFGAVASLGLPGLAGFWGEMLALFGAFKPADDLSRPAFLTFMAIAAFGTLLTAAYMLVVVRRVCMGAVPQESGQISTLADVQSYEFAAWTPLVALTVVAGLWPRALLGLTDPAVQQLLAGGTR

SEQ ID NO: 12424 - protein, 499 aa, Streptomyces avermitilis
MSSLVQSVDWLAIAPPTLAAVVGLVVLVADLFIGDHKKALLGWVSVAGLAASALLLLPLLDGDRATFCLTGDANTCSYTADHFTLAIQFLVLGGALLAALLSVTALKDADREIPEGEFWFLLLSSAAGAALLPASRDLATLIVALEVASLPAFALVGIKRGDKKSSEAALKFFLSSVTATAVSLMGVSFVYASTGTLYLTEIARKIQHVDGQLHTLAQTGVVLTLVGFAFKTAAVPFHFWVPDTYVGAPLPIAAYLSVVGKAVGFSGLILVTVVAFPSYADVWGPALAALAALTMTVGNVGALRQQATRAYSAVRLLAWSSVGQAGYLLVPIAAAAYSKDAEKAIGSTVAYALMYAAVNLGAFAVAALVGRTKVLNRVSDYRGLYASNPLAALLLGFFLLCLAGLPPGIIGLFAKVTVFSAAVDAGLGWLAVVMAVNVVIALFYYLQWTTLLFRAPEGEPEKHRVPAPLTAAIALTAVLGVALSGAPQLVLRFSDTGLF

SEQ ID NO: 12425 - protein, 287 aa, Streptomyces avermitilis
VHRRHNGLKTAVLLGGLSALIIVIGSFFGRTGLVVALFIAIGTNAYAYWNSDKLALRAMRARPVSEFEAPTLYRMVRELSTQARQPMPRLYISPTEAPNAFATGRNPRNAAVCCTEGILRILDERELRGVIGHELSHVYNRDILISSVAGALASVIMFLVNFAWLIPVGRSSDDDGPGLLGMLLIMILGPLAATIIQLAISRSREYEADASGAQLTGDPLALASALRKLDAGIKQLPLPPEPRIETASHMMIANPFRPGQGLSKMFSTHPPMTERIARLEQMAGRHQ

SEQ ID NO: 12426 - protein, 130 aa, Streptomyces avermitilis
VKTILNVIWLVLSGFWLFLGYLLAGVLLCITIIGIPFGIAAFRIGVYALWPFGYTTVERRDAGAPSCIGNVLWLVLAGWWLALAHIVTGIALCLTIIGIPFGIANFKLLPISLLPLGREIVRTDEPFATR

SEQ ID NO: 12427 - protein, 188 aa, Streptomyces avermitilis
MTETEQLLEKVAEEARNTRPWGWPSLPEPVDTAALARAEAALGFPLPPLLAALYLRIGDGGFGPEYGLLPLLDSPPSGEPAVVPQYLANRESGRKDPDWPWPEGILPISHWGCGMYACVDCRTPQGTVLLFEPNADDAHHAWYVDAPGLAEWLRTWLDGTGWYDESNDDMDLAPWADFHIRTDAARTS

SEQ ID NO: 12428 - protein, 422 aa, Streptomyces avermitilis
MTQSGAGPSGGFGLRRTLGVGDAVVVGLGSMVGAGIFAALGPAARAAGSGLLLGLAVAAVVAYCNAMSSARLAALYPASGGTYVYGRERLGAFWGYLAGWAFIVGKTASCAAMALTVGAYVWPGQAHAVAVAAVVALTAVNYGGMQKSALLTRAIVAVVLAVLASVVVVCLGSGAADAGRLAVGLSGGAGGVLQAAGLLFFAFAGYARIATLGEEVRDPERTIPRAIPLALGIALVVYAAVAVGVLSVLGADALGHAPAPLADAVRAAGVPGLVPVVRVGAAVAALGSLLALILGVSRTTLAMARDRQLPGALAAVHPRFQVPHRAELAVGAVVAALAATVDVRGAIGFSSFGVLAYYAVANASAWTLSSAPASRAVPAVGLLGCVTLAFALPAVSVGVGAAVLGLGAAAYGMRRWGASRRP

SEQ ID NO: 12429 - protein, 88 aa, Streptomyces avermitilis
MGIVGWIILGLLAGAIAKFLLPGRDPGGFIGTTVIGVAGAFIGGWISARWLDHPITKQFYDGATWAAAIGGSLVLLIIYRLLFGDSRR

SEQ ID NO: 12430 - protein, 162 aa, Streptomyces avermitilis
MADSSFDIVSKVERQEVDNALNQAAKEISQRYDFKNVGASIAWSGEKILMQANSEERVKAILDVFETKLIKRGISLKALDAGEPQLSGKEYKIFASIEEGISQENAKKVAKVIRDEGPKGVKAQVQGDELRVSSKSRDDLQAVQALLKGQDFDFALQFVNYR

SEQ ID NO: 12431 - protein, 393 aa, Streptomyces avermitilis
MSATAPPLAALSAELSLLRPRMEEVSRAIHARPELKFAEFHAVEVLTGWLAEAGFAVRAGAGGLDTAFVAAHEGSEPGPYVAVLAEYDALPGVGHGCGHNLIAAGGAAAAITAVRALPHHPGTIAVIGTPGEEMGGGGKVRLADAGVFAGVDAAVMFHPGDRSLTTQHGLAAAHLRVGFTGVSAHAARSPWEGRSALAAAQLFLNAIDAMRQFVPPTARLHGIVSDGGQAPNVIPAHAAVDLYVRDRTAASAEALVERVRRAAEGAALATETTAEVHETGPLYGERRDNTVLAERFGDTVRALGLDITAAGPDSPAGSSDIGNLSQLLPVIHPYIQIAEFGTPSHSDAMREAAATPLAHDRAEVAAAGLARVVTDLVLDPGVLEAARAEFVGR

SEQ ID NO: 12432 - protein, 218 aa, Streptomyces avermitilis
MRIVIAGGHGQIALRLERLLAARGDEVAGIIRRAEQGDDLRAAGAEPVLCDLESASVEEVAAHLQGADAAVFAAGAGPGSGVTRKETVDKGAAILFADAAERAGVRRHVVVSSMGADPAHPGDEVFDVYLRAKGEADEYVRSRPSLDWTILRPGMLTNDAGTGLVRLEAHTGRGPIPRDDVAATLAELVDTPATAGLTLEVISGSTPITVAVKAVAGN

SEQ ID NO: 12433 - protein, 413 aa, Streptomyces avermitilis
MPDSRPQPPHSSSGQTDPAGLLLCGARLTDGRTVDVRLGGGRIEAVGTAGSLATDAVGARVDLAGYLLLPAPVEPHAHGDTALSADGAGPVSYGAPEVQRRATEAALLQLGHGATALRAHVHVSDVQGLDALTAVLQARRSLHGLAELSAVAMPRVLTGAAGADGVAMLRDALKMGAAVVGGCPDADPDPTGYVETVLELAAEQGCPVDLHTDGDDPARLARLAAMAGGLRPGVTLGPCGGLRRLPAEVAARIADQLAAAGVTVVCLPQGGCGGADRPGTAPVRLLRSAGVRVAAGSGALRDVSNPVGRGDPLEAAYLLASRYGLRPEDAYDAVSTAARAALGLPEVRVEAGFPAELLAVRGDRLAGALSLAYSRIVVHRGRVVARTSAVREYCNSAAAVALDLPRQGRGEPS

SEQ ID NO: 12434 - protein, 54 aa, Streptomyces avermitilis
VAATDVRPKITLACVECKERNYITKKNRRNNPDRLEMKKHCPRCNAHTAHRETR

SEQ ID NO: 12435 - protein, 150 aa, Streptomyces avermitilis
MALDQSFVGRSYPPTDPYEVGREKIREFAEAVGDPNPVYTDPEAAKALGYADVIAPPTFVFAITFKAAGQVVQDPQLGLDYSRVVHGDQKFAYTRPVRAGDRLTVTSTIESIKSLAGNDVVDVRGEVHDEAGEHVVTAITKLVARAAEEG

SEQ ID NO: 12436 - protein, 142 aa, Streptomyces avermitilis
MTAKIAYDDIEVGAELPAQTFPVTRATLVQYAGASGDFNPIHWNEKFAKEVGLPDVIAHGMFTMAEAIRVVTDWTGDPGAVVEYGVRFTKPVVVPNDDQGATIEVTGKVAAKLDDNTVRVDLTAMSEGKKVLGMSRAVVRLA

SEQ ID NO: 12437 - protein, 189 aa, Streptomyces avermitilis
MVRMSAEERRESVIRAAMSEFGRGGYYGTSTEAIAKRVGVSQPYLFRLFPSKKAIFLAAAERCMEDTRRTFEEAAEGLRGEEALHSMANAYTRVIAERPEQLLMQMQTYVASAAAEEAGDHELAEAVRAGWMRLWDTVHLPLGGDKDETTTFMAYGMLVNCLVAMGFPPEHRVWEGLYPSARITGRLEK

SEQ ID NO: 12438 - protein, 489 aa, Streptomyces avermitilis
MSQQTARRGGAAWALVITSVAGFMAALDNLVVTTALPSIRKDLGGGLDDLEWTVSAYTLTFAVLLMFGAALGDRFGRRRLFLAGITVFTGASAAAAMAPGIDSLIAARAVQGVGAAVMMPLTLTLLTAAVPAAKRGMAYGIWGAVNGLAVASGPLIGGSLTEHVSWHWIFWLNVPLGLALLPLARLRLSESHGTGAPLDIPGTLLASGGLFGIVYGLVRGPADGWTSPFVLTGLFAGAALLTAFVLHGIRAKNPMLPMRLFRSRAFAGINAASLLMFLGMFGSIFLLSQYMQGVLGYSPTEAGVRMLPWTGMPMLVAPIAGYLSDRIGGRPVVAAGLFLQAAGLAYYAAVVAADATYTAQLPALIISGIGMSLYFAPASALVMSSVRTQEQGIASGANNALREVGGALGIAVMSSIFSAQGGYETPQHFVDGLRPALVVGASMVALAGIAALAIPTRRSAQAAEATASASDTAAASEPAEKAVLETAGH

SEQ ID NO: 12439 - protein, 364 aa, Streptomyces avermitilis
VPKRPTPSRTLVHVQELHDAPLAPLTTFRLGGPATRLITATTDAEVIAAVREADDSGTPLLLIGGGSNLVIGDKGFAGTALRIATTGFGLDGTKVELAAGEVWTDAVARTVEAGLAGIECLAGIPGSAGATPIQNVGAYGQEVSSTITEVIAYDRKTHETVTIPNAECAFSYRHSRFKADPERYVVLRVRFELEDADGLSAPVKYAETARALGVEPGDRVPLAAARETVLGLRSGKGMVLDPEDHDTWSAGSFFTNPILTEAECAAFHARVRERLGADAVPPAYPAGDGRTKTSAAWLIDKSGFTKGYGSGPARISTKHTLALTNRGEATTEDLLALAREVVAGVRDAFGITLVNEPVTVGVEL

SEQ ID NO: 12440 - protein, 342 aa, Streptomyces avermitilis
MEHVRDVSELPKAHLHLHFTGSMRPSTLLELADKYGVRLPDALTSAEPPKLRATDERGWFRFQRLYDAARSCLREPEDIRRLVREAAEEDIKDGSGWLEIQVDPTSYAPRLGGLIPAMEVILDAVDSAARETGLGMRVLVAANRMKHPLDARTLARLAVRYADRGIVGFGLSNDERRGMARDFDRAFAIAREGGLLAAPHGGELTGPASVRDCLDDLDASRIGHGVRAAEDPRLLKRLADRGITCEVCPASNVALGVYEKPEDVPLRTLFEAGVPMALGADDPLLFGSRLAAQYDIARRHHGFTDAELAELARQSVRGSAAPADVSRKLLSGIDDWLTSPAA

SEQ ID NO: 12441 - protein, 408 aa, Streptomyces avermitilis
MSAATPPTERRVSARVGAISESATLAVDAKAKALKAAGRPVIGFGAGEPDFPTPDYIVQAAIEACSNPKYHRYTPAGGLPELKAAIAAKTLRDSGYEVDASQVLVTNGGKQAIYEAFAAILDPGDEVIVPAPYWTTYPESIRLAGGVPVDVVADETTGYRVSVEQLEAARTENTKVLLFVSPSNPTGAVYTREQIEEIGRWAAEKGLWVLTDEIYEHLVYGDAEFHSLPVVVPELADKCIVVNGVAKTYAMTGWRVGWVIGPKDVIKAATNLQSHATSNVSNVAQVAALAAVSGDLTAVAEMREAFDRRRKTIVRMLNEIGGVLCPEPEGAFYAYPSVKALLGKEIRGKRPQDTVELAALILEEAEVAVVPGEAFGTPGYLRLSYALGDEDLVEGVSRIQKLLSEAKD

SEQ ID NO: 12442 - protein, 95 aa, Streptomyces avermitilis
VTDAVGSIDMPDAQDEAPESKKKTRKGGKRAKKGPLKRLALFYRQIVAELRKVVWPSRNQLTTYTTVVIVFVVIMIALVTVIDYGLNHAAKYVFG

SEQ ID NO: 12443 - protein, 287 aa, Streptomyces avermitilis
VSDPNLNDAIESVESVDDELDIVEGADVEDEFEAADADAGEPAEEAAVHVEDESGTDLEDDVDAADLAVSDEAEEAEEEAEPVDPVTALREELRTLPGEWYVIHTYAGYENRVKTNLEQRAVSLNVEDFIFQAEVPQEEVAQIKNGERKTIRQNKLPGYVLVRMDLTNESWGVVRNTPGVTGFVGNAYDPYPLTLDEIVKMLAPEAEEKAAREAAEAEGKPAPQRKVEVQVLDFEVGDSVTVTDGPFATLQATINEINADSKKVKGLVEIFGRETPVELSFDQIQKN

SEQ ID NO: 12444 - protein, 144 aa, Streptomyces avermitilis
MPPKKKKVTGLIKLQIQAGAANPAPPVGPALGQHGVNIMEFCKAYNAATESQRGWVIPVEITVYEDRSFTFITKTPPAAKMILKAAGVEKGSGEPHKTKVAKITQAQVREIATTKLPDLNANDLDAASKIIAGTARSMGITVEG

SEQ ID NO: 12445 - protein, 241 aa, Streptomyces avermitilis
VSKRSKALRAADAKIDREKLYAPLEAVRLAKETSTSKFDGTVEVAFRLGVDPRKADQMVRGTVNLPHGTGKTARVLVFATGDRAEAARAAGADIVGSDELIDEVSKGRLDFDAVVATPDLMGKVGRLGRVLGPRGLMPNPKTGTVTPDVVKAVNEIKGGKIEFRVDKHSNLHFIIGKTSFDDTQLVENYGAALDEILRLKPSAAKGRYIKKAAISTTIGPGIPIDSNRTRNLLTEEDPAAV

SEQ ID NO: 12446 - protein, 176 aa, Streptomyces avermitilis
MARPDKAAAVAELADQFRSSNAAVLTEYRGLTVAQLKTLRRSLGEDAQYAVVKNTLTKIAANEAGINTLDDLFNGPTAVAFITGDPVVSAKGLRDFAKDNPNLVIKGGVLDGKALSADEIKKLADLESREVLLAKLAGAFKGKQSQAASLFQALPSKFVRTAEALRAKKAEQGGAE

SEQ ID NO: 12447 - protein, 127 aa, Streptomyces avermitilis
MATKLSQEELLEQFESLTLIELAEFVKAFEEKFDVTAAAAVAAAPAGPVAAAEAAEEQDEFDVILTGAGDKKIQVIKVVRELTSLGLKEAKDLVDGAPKPVLEKVAKEAAEKAAESLKGAGASVEVK

SEQ ID NO: 12448 - protein, 1181 aa, Streptomyces avermitilis
VPQWGAGTRVVSPSPRKDPLLAASRTASTANTNNGASTAPLRISFAKIKEPLEVPNLLALQTESFDWLLGNDAWKARVEAALDSGQDVPTKSGLEEIFEEISPIEDFSGSMSLTFRDHRFEPPKNSIDECKDRDFTYAAPLFVTAEFTNNETGEIKSQTVFMGDFPLMTNKGTFVINGTERVVVSQLVRSPGVYFDSSIDKTSDKDIFSAKVIPSRGAWLEMEIDKRDMVGVRIDRKRKQSVTVLLKALGWTTEQILEEFGEYESMRATLEKDHTQGQDDALLDIYRKLRPGEPPTREAAQTLLENLYFNPKRYDLAKVGRYKVNKKLGGEAPLDAGILTVEDIISSIKYLVKLHAGETETVGDNGTSIVVETDDIDHFGNRRLRNVGELIQNQVRTGLARMERVVRERMTTQDVEAITPQTLINIRPVVASIKEFFGTSQLSQFMDQNNPLSGLTHKRRLSALGPGGLSRERAGFEVRDVHPSHYGRMCPIETPEGPNIGLIGSLASYGRVNAFGFVETPYRRVTDGVVTDEVDYLTADEEDRFVIAQANAPLGDDFRFEETRVLVRRRGGEVDYVPGDDVDYMDVSPRQMVSVATAMIPFLEHDDANRALMGANMMRQAVPLIKSEAPLVGTGMEYRCAVDAGDVLKSEKDGVVQEVSADYVTTANDDGTYTTYRLHKFSRSNQGTSVNQKVVVDEGARVIAGQVLADGPATENGEMALGKNLLVAFMPWEGHNYEDAIILSQRLVQDDVLSSIHIEEHEVDARDTKLGPEEITRDIPNVSEEVLADLDERGIIRIGAEVVAGDILVGKVTPKGETELTPEERLLRAIFGEKAREVRDTSLKVPHGEIGKVIGVRVFDREEGDELPPGVNQLVRVYVAQKRKITDGDKLAGRHGNKGVISKILPIEDMPFLEDGTPVDIILNPLGVPSRMNPGQVLEIHLGWLASRGWDVSGLADDWAQRLQAIEADQVAPGTNVATPVFDGAREDELAGLLQHTIPNRDGERMVLPTGKAPLFDGRSGEPFPEPISVGYMYILKLHHLVDDKLHARSTGPYSMITQQPLGGKAQFGGQRFGEMEVWALEAYGAAYALQELLTIKSDDVTGRVKVYEAIVKGENIPEPGIPESFKVLIKEMQSLCLNVEVLSSDGMSIEMRDTDEDVFRAAEELGIDLSRREPSSVEEV

SEQ ID NO: 12449 - protein, 1299 aa, Streptomyces avermitilis
VLDVNFFDELRIGLATADDIRQWSHGEVKKPETINYRTLKPEKDGLFCEKIFGPTRDWECYCGKYKRVRFKGIICERCGVEVTRAKVRRERMGHIELAAPVTHIWYFKGVPSRLGYLLDLAPKDLEKVIYFAAYMITYVDDERRTRDLPSLEAHVSVERQQIENRRDSDLEARAKKLETDLAELEAEGAKADVRRKVREGAEREMKQLRDRAQREIDRLDEVWTRFKNLKVQDLEGDELLYRELRDRFGTYFDGSMGAAALQKRLESFDLDEEAERLREIIRTGKGQKKTRALKRLKVVSAFLQTSNSPKGMVLDCVPVIPPDLRPMVQLDGGRFATSDLNDLYRRVINRNNRLKRLLDLGAPEIIVNNEKRMLQEAVDALFDNGRRGRPVTGPGNRPLKSLSDMLKGKQGRFRQNLLGKRVDYSARSVIVVGPQLKLHQCGLPKAMALELFKPFVMKRLVDLNHAQNIKSAKRMVERGRTVVYDVLEEVIAEHPVLLNRAPTLHRLGIQAFEPQLVEGKAIQIHPLVCTAFNADFDGDQMAVHLPLSAEAQAEARILMLSSNNILKPADGRPVTMPTQDMVLGLFFLTTDGALRNVKGEERSFASVAEAIMAFDAGELSLQSRVDIRFPVGTIPPRGWTPPAREEGEPEWQQGDTFRLRTTLGRALFNELLPEDYPFVDYEVGKKQLSEIVNDLAERYPKVIVAATLDNLKAAGFYWATRSGVTVAISDIVVPEAKKEIVKGYEAQDEKVQKQYERGLITKDERTQELIAIWTKATNEVAEAMNANFPKTNPIFMMVDSGARGNMMQMRQIAGMRGLVSNAKNETIPRPIKASFREGLSVLEYFISTHGARKGLADTALRTADSGYLTRRLVDVSQDVIIREEDCGTERGLKLKIAERGADGVLRKTDDVETSVYARMLAEDVVIDGKVIAPANVDLGDVLIDQLVHHGVEEVKTRSILTCESQVGTCAMCYGRSLATGKLVDIGEAVGIIAAQSIGEPGTQLTMRTFHTGGVAGDDITQGLPRVVELFEARTPKGVAPISEASGRVRIEETEKTKKIVVTPDDGSDETAFPISKRARVLVTEGEHVEVGQKLTVGATNPHDVLRILGQRAVQVHLVGEVQKVYNSQGVSIHDKHIEIIIRQMLRRVTIIESGDAELLPGELVERSKFETENRRVVQEGGHPASGRPQLMGITKASLATESWLSAASFQETTRVLTDAAINAKSDSLIGLKENVIIGKLIPAGTGLSRYRNIRVEPTEEAKAAMYSAVGYDDIDYSPFGTGSGQAVPLEDYDYGPYNQ

SEQ ID NO: 12450 - protein, 233 aa, Streptomyces avermitilis
VAARRRSRGAADRRAHTACTGLWGPCRDWSGTCAGNASLEHDGGIQPSGGGVPVSYPTPWQPWQGQNGPQPWQGQGAPAMLASHADRERAVDVLRAGFGEGRLEQAEFEKRVARAYAARTVGELAVLVGDLPQGPVPLSAASGPVPRTFLPAPPPATNGKAVAAMVCGVLTLMTAGVTGVPAVILGHTARSEMRRTGEGGEGFAMAGLVLGWLSVAGWALLLTVLIAAALASG

SEQ ID NO: 12451 - protein, 123 aa, Streptomyces avermitilis
VPTIQQLVRKGRQDKVEKNKTPALEGSPQRRGVCTRVFTTTPKKPNSALRKVARVRLTSGIEVTAYIPGEGHNLQEHSIVLVRGGRVKDLPGVRYKIIRGSLDTQGVKNRKQARSRYGAKKEK

SEQ ID NO: 12452 - protein, 156 aa, Streptomyces avermitilis
MPRKGPAPKRPVIIDPVYGSPLVTSLINKVLLNGKRSTAERIVYGAMEGLREKTGNDPIITLKRALENIKPTLEVKSRRVGGATYQVPIEVKPGRANTLALRWLVGYSRARREKTMTERLLNELLDASNGLGAAVKKREDTHKMAESNKAFAHYRW

SEQ ID NO: 12453 - protein, 709 aa, Streptomyces avermitilis
MATTSLDLAKVRNIGIMAHIDAGKTTTTERILFYTGVSYKIGEVHDGAATMDWMEQEQERGITITSAATTCHWPLEDNDYTINIIDTPGHVDFTVEVERSLRVLDGAVTVFDGVAGVEPQSETVWRQADRYGVPRICFVNKLDRTGAEFHRCVDMIKDRLGAVPIIMQLPIGAEMDFKGVVDLVRMKALVWSAEAAKGEMYDVVDIPATHAEAAEEYRGKLVETVAENDDEIMELFLEGQEPTEEQLYAAIRRITIASGKGDGVTVTPVFCGTAFKNKGVQPLLDAVVRYLPTPLDVEAIEGHDVKDPEVVVKRKPSEDEPLSALAFKIMSDPHLGKLTFVRVYSGRLESGTAVLNSVKGKKERIGKIYRMHANKREEIEAVGAGDIVAVMGLKQTTTGETLSDDKNPVILESMDFPAPVIQVAIEPKSKGDQEKLGVAIQRLAEEDPSFQVHSDEETGQTIIGGMGELHLEVLVDRMRREFKVEANVGKPQVAYRETIRKTVERVDYTHKKQTGGTGQFAKVQIAIEPITETDGPAYEFVNKVTGGRIPREYIPSVDAGAQEAMQFGILAGYEMTGVRVTLLDGAYHEVDSSELAFKIAGSQAFKEAARKASPVLLEPMMAVEVTTPEESMGDVIGDLNSRRGQIQAMEERSGARVVKGLVPLSEMFGYVGDLRSKTSGRASYSMQFDSYAEVPRNVAEEIIAKAKGE

SEQ ID NO: 12454 - protein, 397 aa, Streptomyces avermitilis
VAKAKFERTKPHVNIGTIGHIDHGKTTLTAAITKVLHDAYPDLNEASAFDQIDKAPEERQRGITISIAHVEYQTETRHYAHVDCPGHADYIKNMITGAAQMDGAILVVAATDGPMPQTKEHVLLARQVGVPYIVVALNKADMVDDEEILELVELEVRELLSEYEFPGDDLPVVKVSALKALEGDKEWGQSVLDLMKAVDENIPQPERDVDKPFLMPIEDVFTITGRGTVVTGRIERGVLKVNETVDIVGIKTEKTTTTVTGIEMFRKLLDEGQAGENVGLLLRGIKREDVERGQVIIKPGSVTPHTEFEAQAYILSKDEGGRHTPFFNNYRPQFYFRTTDVTGVVTLPEGTEMVMPGDNTEMTVELIQPVAMEEGLKFAIREGGRTVGAGQVTKINK

SEQ ID NO: 12455 - protein, 37 aa, Streptomyces avermitilis
MTTPADDATCRATTGREFSSVTAENVMKWEVTTAWRA

SEQ ID NO: 12456 - protein, 201 aa, Streptomyces avermitilis
MSTPPITGEHGFLLLHGWQNRRPAAHWQSWLADRLTARGHAVTHPQLPEPDDPDLDTWLGELRTHLTASRPRTVVCHSLACLLWLHAAARGLVPAPVDRVLLVAPPSGSVLKGYAEVAAFAPPPVTPAHLAAAATYTRLVAADNDPYCPDGAAAVYAEPLGLPVDVLPGEAHLDLDAGYGSWPSLLDWCLDPSNSTPVTPR

SEQ ID NO: 12457 - protein, 316 aa, Streptomyces avermitilis
MEPVRNSFTVDLRRLGVLRELERRGSLARTAEALHLTPSAVSQQLAALAREVGVPLIVRQGRGARLTGQARVLLEHAEVMAAQWERARADLAAWEEGRRGAVTVGAFSSAVSGLLPNALGRLAEHHPRVRVAVVEAEPPDLFTRLDAGEVDIAVAVDFAAAPPHTDRRYARTDLSTDVLDLALPRDHPCAGRPEVGLRELAGDAWIVGDARSCCGAITRSVCAANGFTPDIRHAVNDWQSLAALVEAGLGVALVPRLAQPLHRPGLVLRTPAGPSPTRHVFAAVRAGSDDDPVLTAVLASLRAAAAAAAAGQADRP

SEQ ID NO: 12458 - protein, 704 aa, Streptomyces avermitilis
VRFRAVPGHPIHRTTDPKGGTADTEPGPPGPLRRTTRRAVLLGGAVAAVAAAVGCGPSRSSGAATAAPSPASGKPAVQGRHALLMQVLAHPDDDLYFMNPDTQYAVAAGVPLVCVYVTAGEADGVNKIPGQPHPPADKAAYSSARHQGLRQSYAAQLGLPLFTPWNKSVAALPGGHLAEVNSLENEGRRVDLVHLNLAMHTPFGHMGVPALWRERGLALGTVVADGSPLSTVQSYDHDGLLDVLVGLFERYRPTLVHTLDPDPDIQHSDPVTRIHDSEQPGYSDHADHTAVASFTWAAMARWARTSAGGPPPFATVAFRGYYNHHWPDNLPPAVLRPKAAHLVPYGAAPHWECGNPAGCGDYNVGGERPLRNRKGWVRSTHYRYPGPRLALAEEADGRLTAYGVLGMRAVRWRETPEGTFGDAVDLGGGPLAPVLGAAALDDGRQLLFGLRLAAVEGRGGPDVREIVLLEQAARGGGFRAWTGLGNPEGDDDRGRRIGTPVAVTGRDGRVHLFVRNADHGVSTRVRGRDGRWSPWRDLGGGQIQDGLTAVVGSDGEVRVYAPGRDTVHQWTPDGPVTPGTSGTGSLPAPADAIAVSGDRLYYRPPASTSLIATDGPTVVFPGYGPVSAAGSYLLGRGVDGALRLLHDGRATRAVPARTTLDGPALRLTRRGPAAAGLSPDARPWLWRARRSGTGTGAGSSAQKV

SEQ ID NO: 12459 - protein, 102 aa, Streptomyces avermitilis
MAGQKIRIRLKAYDHEVIDSSAKKIVETVTRTGASVAGPVPLPTEKNVYCVIKSPHKYKDSREHFEMRTHKRLIDILDPTPKTVDSLMRLDLPAGVDIEIKL

SEQ ID NO: 12460 - protein, 214 aa, Streptomyces avermitilis
MAKQIKGILGEKLGMTQVWDENNRVVPVTVVKAGPNVVTQVRTNDSDGYESVQIAFGEIDPRKVNKPLKGHFAKADVTPRRHLVEIRTADASEYTLGQEITAETFEAGVKVDVTGKSKGKGFAGVMKRHNFKGLGAGHGTQRKHRSPGSIGGCATPGRVFKGLRMAGRMGNERVTTQNLTVHAVDAEKGLLLIKGAVPGPNGGLVLVRTAAKGA

SEQ ID NO: 12461 - protein, 221 aa, Streptomyces avermitilis
MSTIDILSPSGDNAGTVELPAEIFDVEKISIPLLHQVVVAQLAAARQGTHKVKRRGEVRGGGKKPYRQKGTGRARQGSTRAPQFAGGGVVHGPTPRDYSQRTPKKMKAAALRHALTDRARNARIHVITGVIEGETPSTKAAKSFLGKVSERKNVLLVIERSDEAALLSARNLPQVHILEPGQLNTYDVLVSDDVVFTQAAFESFVSGAPQSSAADTEGSEA

SEQ ID NO: 12462 - protein, 138 aa, Streptomyces avermitilis
MATRHPSIASKAAKAAKAARVAKAKRHEAEGKNTVETPLSKSFTDPRDVLVKPVVSEKSYALLDEGKYTFIVAPGANKTQIKQAVQAVFSVKVTGVNTINRQGKRKRTKSGFGKRADTKRAIVTLAEGDRIDIFGQAS

SEQ ID NO: 12463 - protein, 278 aa, Streptomyces avermitilis
MGIRKYKPTTPGRRGSSVADFVEVTRSTPEKSLVRPLHSKGGRNNAGRVTVRHQGGGHKRAYRVIDFRRHDKDGVPAKVAHIEYDPNRTARIALLHYADGEKRYILAPRNLQQGDRVENGPGADIKPGNNLALRNIPVGTTVHAIELRPGGGAKFARSAGASVQLLAREGAMATLRMPSGEIRMVDARCRATVGEVGNAEQSNINWGKAGRKRWLGVRPTVRGVAMNPVDHPHGGGEGKTSGGRHPVSPWGQKEGRTRSPKKASSKYIVRRRKTNKKR

SEQ ID NO: 12464 - protein, 93 aa, Streptomyces avermitilis
MPRSLKKGPFVDDHLIKKVDAQNEAGSKNVIKTWSRRSMIIPAMLGHTIAVHNGKTHIPVFVTESMVGHKLGEFSPTRTFRGHVKDDRKSKRR

SEQ ID NO: 12465 - protein, 115 aa, Streptomyces avermitilis
MEARAQARYIRVTPMKARRVVDLIRGMDATEAQAVLRFAPQAASVPVGKVLDSAIANAAHNYDHTDADSLFISEAYVDEGPTLKRFRPRAQGRAYRIRKRTSHITVVVSSKEGTR

SEQ ID NO: 12466 - protein, 275 aa, Streptomyces avermitilis
MGQKVNPHGFRLGITTDFKSRWYADKLYKDYVKEDVAIRRMMTSGMERAGISKVEIERTRDRVRVDIHTARPGIVIGRRGAEADRIRGDLEKLTGKQVQLNILEVKNPETDAQLVAQAVAEQLSSRVSFRRAMRKSMQSAMKAGAKGIKIQCGGRLGGAEMSRSEFYREGRVPLHTLRANVDYGFFEAKTTFGRIGVKVWIYKGDVKNIAEVRAENAAARAGNRPARGGADRPARGGRGGERGGRGRKPQQAPAAEAPKAEAPAAAPAESTGTEA

SEQ ID NO: 12467 - protein, 139 aa, Streptomyces avermitilis
MLIPRRVKHRKQHHPKRRGQAKGGTQVSFGEYGIQALTPAYVTNRQIEAARIAMTRHIKRGGKVWINIYPDRPLTKKPAETRMGSGKGSPEWWIANVHPGRVMFELSYPNEKIAREALTRAAHKLPMKCRIVKREAGEA

SEQ ID NO: 12468 - protein, 74 aa, Streptomyces avermitilis
MSAGTKASELRELGDEELLAKLREAKEELFNLRFQAATGQLENHGRLKAVRKDIARIYTLMRERELGIETVESA

SEQ ID NO: 12469 - protein, 94 aa, Streptomyces avermitilis
MSESNVTETNEQRGFRKTREGLVVSDKMDKTVVVAVEDRVKHALYGKVIRRTNKLKAHDEQNAAGVGDRVLLMETRPLSATKRWRVVEILEKAK

SEQ ID NO: 12470 - protein, 122 aa, Streptomyces avermitilis
VIQQESRLRVADNTGAKEILCIRVLGGSGRRYAGIGDVIVATVKDAIPGGNVKKGDVVKAVIVRTVKERRRPDGSYIRFDENAAVILKNDGDPRGTRIFGPVGRELREKKFMKIISLAPEVL

SEQ ID NO: 12471 - protein, 107 aa, Streptomyces avermitilis
MKIKKGDTVQVITGKDKGKQGKVIAAYPRDERVLVEGVNRVKKHTKAGPTAGGSQAGGIVTTEAPIHVSNVQLVVEKDGNKVVTRVGYRFDDEGNKIRVAKRTGEDI

SEQ ID NO: 12472 - protein, 185 aa, Streptomyces avermitilis
MATTTTPRLKTKYREEIAGKLQEEFSYENVMQTPGLVKIVVNMGVGDAARDSKLIDGAIRDLTTITGQKPAVTKARKSIAQFKLREGQPIGAHVTLRGDRMWEFLDRTLSLALPRIRDFRGLSPKQFDGRGNYTFGLTEQVMFHEIDQDKIDRVRGMDITVVTTATNDAEGRALLRHLGFPFKEA

SEQ ID NO: 12473 - protein, 61 aa, Streptomyces avermitilis
MAKKALIAKAARKPKFGVRGYTRCQRCGRPHSVYRKFGLCRVCLREMAHRGELPGVTKSSW

SEQ ID NO: 12474 - protein, 132 aa, Streptomyces avermitilis
MTMTDPIADMLTRLRNANSAYHDTVGMPHSKIKSHIAEILQQEGFITGWKVEDAEVGKNLVLELKFGPNRERSIAGIKRISKPGLRVYAKSTNLPKVLGGLGVAIISTSHGLLTDKQAGKKGVGGEVLAYVW

SEQ ID NO: 12475 - protein, 179 aa, Streptomyces avermitilis
MSRIGKLPITVPAGVDVTIDGRTVQVKGPKGSLSHTIAAPIEIAKGEDGVLNVTRPNDERQNKALHGLSRTLVANMITGVTQGYVKKLEISGVGYRVLAKGSNLEFSLGYSHSITVEAPEGITFKVEAPTRFSVEGIDKQKVGEVAANIRKLRKPDPYKAKGVKYEGEVIRRKVGKAGK

SEQ ID NO: 12476 - protein, 127 aa, Streptomyces avermitilis
MAYGVKIAKGDAYKRAAIKRRHIRIRKHISGTAERPRLVVTRSNRHIVAQVIDDVKGHTLASASTLDTTIRGGESDKSAQAKSVGALVAERAKAAGVEAVVFDRGGNQYAGRIAALADAAREAGLKF

SEQ ID NO: 12477 - protein, 201 aa, Streptomyces avermitilis
MAGPQRRGSGAGGGERRDRKGRDGGAAAAEKTAYVERVVAINRVAKVVKGGRRFSFTALVVVGDGDGTVGVGYGKAKEVPAAIAKGVEEAKKHFFKVPRIQGTIPHPITGEKAAGVVLLKPASPGTGVIAGGPVRAVLECAGVHDILSKSLGSSNAINIVHATVAALKGLQRPEEIAARRGLPLEDVAPAALLRARAGAGA

SEQ ID NO: 12478 - protein, 60 aa, Streptomyces avermitilis
MAQLKITQTKSYIGSKQNHRDTLRSLGLKGINTQVVKEDRPEFRGMVHTVRHLVTVEEVD

SEQ ID NO: 12479 - protein, 151 aa, Streptomyces avermitilis
MAENNPLKIHNLRPAPGAKTAKTRVGRGEASKGKTAGRGTKGTKARYQVPERFEGGQMPLHMRLPKLKGFKNPFRTEYQVVNLDKLTALYPEGGEVTVEGLVAKGAVRKNSLVKVLGQGEISVALQVTVDAVSGSAKEKITAAGGTVTELV

SEQ ID NO: 12480 - protein, 438 aa, Streptomyces avermitilis
VLTAFARAFRTPDLRKKLLFTLAIIVVYRLGTHIPIPGVDYKNVQTCIDSASKGNQGLFGLVNMFSGGALLQITIFALGIMPYITASIILQLLTVVIPRLEALKKEGQAGTAKITQYTRYLTVALAILQGTGLVATARSGALFGTCPVGNQIVPDQGIFTTITMVICMTAGTAVVMWLGELITDRGIGNGMSILMFISIAASFPSALWAIKQQGSLADGWIEFGTVIAVGLVMVGLVVFVEQAQRRIPVQYAKRMIGRRSYGGTSTYIPLKVNQAGVIPVIFASSLLYIPALIAQFSKDTSGWKSWIEQNLTKGDHPIYITAYFLLIVFFAFFYVAISFNPEEVADNMKKYGGFIPGIRAGRPTAEYLSYVLNRITWPGSLYLGLIALVPTMALVGFGASQNFPFGGTSILIIVGVGLETVKQIESQLQQRNYEGFLR

SEQ ID NO: 12481 - protein, 220 aa, Streptomyces avermitilis
MRIVLVGPPGAGKGTQAAFLAKNLGIPHISTGDLFRANISQQTELGKLAKSYMDEGNLVPDEVTIAMAKDRMEQPDAVNGFLLDGFPRNVKQAEALDEMLKSEGMKLDAVLDLEVPEDEVVKRIAGRRICRNDSAHVFHVSYKPPKQEGVCDVCGGELYQRDDDSEETVRRRLEVYHTQTEPIIDYYRAQGLVVTISALGPVEEVTQRAMDALKREDASK

SEQ ID NO: 12482 - protein, 278 aa, Streptomyces avermitilis
MVQIKTPEQIAKMREAGLVVAAVHAATSEAAVPGATTKDLDEVARKVLAEHGAKSNFLGYGGFPATICTSVNEVVVHGIPDDKTVLKDGDVISIDAGAIIDGWHGDAAYTAFVGSGHAPELVELSRVAEESMWAGIAAMKQGNRLVDVSRAIETYIRRQPKPGGGKYGIVEDYGGHGIGTEMHMDPHLLNYVERRRGKGPKLVPGFCLAIEPMVSLGTPKTEVLEDDWTVITTDGTWSSHWEHSVALTEEGPLVLTAPDGGKAKLAEYGITAAPDPLA

SEQ ID NO: 12483 - protein, 73 aa, Streptomyces avermitilis
VAKKQGAIEIEGTVVESLPNAMFKVELQNGHQVLAHISGKMRMHYIRILPDDRVVVELSPYDLTRGRIVYRYK

SEQ ID NO: 12484 - protein, 37 aa, Streptomyces avermitilis
MKVKPSVKKICDKCRVIRRHGRVMVICDNPRHKQRQG

SEQ ID NO: 12485 - protein, 126 aa, Streptomyces avermitilis
MARVSGVDIPREKRVEVALTYVFGIGRTLSQKTLAETGVNPNTRVRDLSEEELVRIREYVDNNFKTEGDLRREVQADIRRKVEIGCYQGLRHRRGLPVHGQRTSTNARTRKGPRRAIAGKKKPGKK

SEQ ID NO: 12486 - protein, 134 aa, Streptomyces avermitilis
MPPKGRQGAAKKVRRKEKKNVAHGHAHIKSTFNNTIVSITDPSGNVISWASAGHVGFKGSRKSTPFAAQMAAESAARRAQEHGMRKVDVFVKGPGSGRETAIRSLQATGLEVGSIQDVTPTPHNGCRPPKRRRV

SEQ ID NO: 12487 - protein, 340 aa, Streptomyces avermitilis
MLIAQRPSLTEEVVDEFRSRFVIEPLEPGFGYTLGNSLRRTLLSSIPGAAVTSIRIDGVLHEFTTVPGVKEDVTDLILNIKQLVVSSEHDEPVVMYLRKQGPGLVTAADIAPPAGVEVHNPDLVLATLNGKGKLEMELTVERGRGYVSAVQNKQVGQEIGRIPVDSIYSPVLKVTYKVEATRVEQRTDFDKLIVDVETKQAMRPRDAMASAGKTLVELFGLARELNIDAEGIDMGPSPTDAALAADLALPIEELELTVRSYNCLKREGIHSVGELVARSEADLLDIRNFGAKSIDEVKAKLAGMGLALKDSPPGFDPTAAADAFGADDDADAGFVETEQY

SEQ ID NO: 12488 - protein, 167 aa, Streptomyces avermitilis
MPKPTKGARLGGSAAHEKLLLANLAKSLFEHGRITTTEAKARRLRPYAERLVTKAKKGDLHNRRQVLQVITDKSVVHTLFTEIGPRYENRPGGYTRITKIGNRRGDNAPMAVIELVEALTVAQQATGEAEAATKRSAKDAEAKTEAPAEVVEDTKPADEAAEESKDA

SEQ ID NO: 12489 - protein, 285 aa, Streptomyces avermitilis
VSDEVQPGFVRVRLDLSYDGTEFSGWAKQAAGRRTVQGEIEDALRTVTRSGETTYELTVAGRTDAGVHARGQVAHVDLPGELWAEHQEKLLKRLAGRLPKDVRVWSLTEAPSGFNARFSAIWRRYAYRVTDNTGGVDPLLRSHVLWHDWPLDVDAMNEAARRLVGEHDFAAYCKKREGATTIRTLQELSLVRGDDGVITATVCADAFCHNMVRSLIGALLFVGDGHRGPDWPGKVLAVGVRDSAVHVVRPHGLTLEEVGYPADELLAARNKEARNKRTLPAAGCC

SEQ ID NO: 12490 - protein, 295 aa, Streptomyces avermitilis
MRPMSYGQGEPPWDPWKPGSQQPQWGNQTDQTPDWAALAEASESRNKRRRLLLIVGGAFATVAIGAAVAVAVVSANDGTEASNKPANLPATADIPSSSTAPAPSFDPTTAPPPLDPKDFISSAKKDTAPLSPDILFPSTELTIGGRAYQKGATASTTNCASAVQGTLPQALTSNGCTRVMRVTYSGKGGVAVTVGVAVFDTEAKASKAKTAADNKSIITSLPGQGVAAFCRTAVCRSTTNAYGRYAYFTLAGFTNGKDVTEKDAAVFTTGDDLAEYTFRQIRQRGEAQASAAANK

SEQ ID NO: 12491 - protein, 147 aa, Streptomyces avermitilis
VRTYSPKPGDITRQWYVIDAQDVVLGRLATTAANILRGKHKPIYAPHVDAGDFVIIINADKVHLSGNKKTQKLAYRHSGYPGGLRSVRYDELLAKNPEKAVEKAIKGMIPKNTLGRQVLSKLKVYSGDQHPHAAQQPVPFEITQVAQ

SEQ ID NO: 12492 - protein, 173 aa, Streptomyces avermitilis
VAETTVEQPVEETEVVDIESYTTESEVPVEGEYTSESVASRFGEPQPAAGLGRRKNAIARVRIVPGTGKWKINGRTLEDYFPNKVHQQEVNEPFKVLELEGRYDVIARISGGGVSGQAGALRLGVARALNEADVDNNRGALKKAGFLKRDDRAVERKKAGLKKARKAPQYSKR

SEQ ID NO: 12493 - protein, 452 aa, Streptomyces avermitilis
VGRLFGTDGVRGVANADLTAELALGLSVAAAHVLAEAGTFEGHRPVAVVGRDPRASGEFLEAAVVAGLASAGVDVLLVGVLPTPAVAHLTGALGADLGVMLSASHNAMPDNGIKFFARGGHKLADDLEDRIEAVYEEHRTGAPWDRPTGAGVGRVTSYGEGADQYVAHLMSVLPNRLDGIKVVLDEAHGAAARVSPDAFTRAGAEIITIGAEPDGLNINDGCGSTHLAKLRAAVVEHGADLGIAHDGDADRCLAVDHTGAEVDGDQILAVLALAMRERSALRSDTVVATVMSNLGFKLAMEREGLSFVQTAVGDRYVLEEMKEHGYALGGEQSGHVIILDHATTGDGTLTGLLLAARVAQTGRTLQDLASVMERLPQVLVNVPDVDRARVKTSAELATAVAEAERELGATGRVLLRPSGTEPLVRVMVEAADIEQARSVAGRLADAVKSALG

SEQ ID NO: 12494 - protein, 317 aa, Streptomyces avermitilis
MLHLRLITPSGTTDDVVRLIESTVGTTHLVVLPGAARNPAGDVVMCDVAREAGDELIAGLRRLGLDRTGSIAVENIDLSLSKRAADAEDEAPGEGADAVLWEHLEGATHEESTLSITYVAFLTLATMIAACGVVLDNAILIVGAMAVGPEFGPLAGFCTALVQRAPRLALRSLVALLVGFAVALLVTVGFTYLMDAVDLFSAVKLDAERPNTNFIYRPDAFSFVVAVLAGVAGTLSLTSAKSGALVGVAISVTTVPAASNAAVAFAYGEYHQAWGSTEQLLLNLLGIVLAGTLTLLAQKYFWTRQRQRHNAGRPSTP

SEQ ID NO: 12495 - protein, 329 aa, Streptomyces avermitilis
VISPVSSIPRSAHRSRPEATPYLDLTRAEWSALREKTPLPLNAEEVEKLRGLGDVIDLDEVRDIYLPLSRLLNLYVGATDGLRGALNTFLGEQGSQSGTPFVIGVAGSVAVGKSTVARLLQALLSRWPEHPRVELVTTDGFLLPTKELEARGLMSRKGFPESYDRRALTRFVADIKAGKDEVTAPVYSHLIYDIVPGQKLTVRRPDILIVEGLNVLQPALPGKDGRTRVGLADYFDFSVYVDARPEDIERWYLNRFRKLRATAFQNPSSYFRRYTQVSEDEALDYARTTWRTINKVNLLENVAPTRGRAALVVRKGPDHKVQRLSLRKL

SEQ ID NO: 12496 - protein, 85 aa, Streptomyces avermitilis
VASAMRIRDVHIRDLLRRTPACPQPDLAGKVCSELATDLPDEDLGEDLNDCLALYELGSKPRCEEVEYLGMVQDAIDRIARGDRE

SEQ ID NO: 12497 - protein, 615 aa, Streptomyces avermitilis
MCGIVGYVGSQSALDVVMAGLKRLEYRGYDSAGVAVPADGGMAAAKKAGKLVNLEKELVERPLPAGTTGIGHTRWATHGGPTDANAHPHLDNAGRVAVVHNGIIENFALLRAELAERGHDLASETDTEVVAHLLAEEFSASADLAEAMRLVCRRLEGAFTLVAVHADEPDVVVGARRNSPLVVGVGDGEAFLASDVAAFIAHTRSAIELGQDQVVELRRDGVTVTGFDGRPADVRSYHVDWDASAAEKGGYDYFMLKEIAEQPKAVADTLLGRIDAAGSLTLDELRISAAELREVDKVVIVACGTAFHAGLIAKYAIEHWTRIPCEVELASEFRYRDPILGARSLVIAISQSGETMDTLMALRHAREQGSKVLAICNTNGSTIPRESDAVLYTHAGPEVAVASTKAFLTQLVACYLVALYLGQVRGTKWGDEIQAVIRDLSRISNEVERVLETMEPVRELARSLADKKTVLFLGRHVGYPVALEGALKLKELAYMHAEGFAAGELKHGPIALIEEDLPVVVVVPSPRGRSVLHDKIVSNIQEIRARGARTIVIAEEGDETVVPYADHLIRIPATPTLLQPLVATVPLQVFACELATARGNEVDQPRNLAKSVTVE

SEQ ID NO: 12498 - protein, 123 aa, Streptomyces avermitilis
MSIIGVGIDVAEIDRFRASLERTPGLADRLFLERELLLPNGERRGIASLAARFAAKEAVAKALGAPGGLYWTDAEVWVEDSGRPRLRVTGTVAARAAELGVQSWHVSLSHDAGVASAVVVAEG

SEQ ID NO: 12499 - protein, 476 aa, Streptomyces avermitilis
MRTAYSVETVRSAERSLMARLPEGALMQRAAAGLAAACAQLLGRVYGRRIVLLVGSGDNGGDALYAGARLARRGAGVTAVLLAAGRAHASGLAALRRAGGSVTGTGPAEELIRRADLVVDGIVGIGGKGGLRPDAALLAESVERSGAAVVAVDLPSGVDADTGEVPGAAVRADLTVTFGTHKPGLLIDPAREYAGSVRLVDIGLELPDGPDLEALQHADVARLLPVPGAESDKYRRGVVGIAAGSARYPGAAVLAVAGALRGGAGAVRYVGPAGDAVLARFPETLVSDKGPKQAGRVQAWVVGPGAGDDAPVVAEVLAADVPVLVDADGLRLAGRDAVRGRTAPTLMTPHAGEAAALLGVSREEVERARLVSVRELAGRYGATVLLKGSTTLVADSGGGAVRVNSTGTSWLATAGSGDVLSGLAGSLLAAGLPALDAGSVAAYLHGLAGRYAADGAPMGAHDLAETIPEAWRDVRD

SEQ ID NO: 12500 - protein, 405 aa, Streptomyces avermitilis
MPLSGRPERGLSGRRAAWPAVAVPAGPYVRGWAGGCGGGRAVRAGPCRACGAVPCVWPTRRPGRTYLAAQVAGSGVRRGVRLRMGDIAARLPPAPRPAAFADCMISTRMACRGAAGLLAVATALPALTACGAVAQPPPPPAPGPGSELAALVPGVPPGPQQPWQVDTPDQALPPQVYTPHAEEDAGEPRDAARGADALVEYVPLGDAVAQQACSKRTGPYQRQVERWLKLKVDGKQSGADCVAVRAFQTRYKIKPAIGYAGPVTWAHMQLLSARKNPNAAGKCPVRTYRVACVDLARQLTWVQKGQKVVYGPVPMRSGRAGYRTRTGWFTVYWKHKNHVSTIYNTPMPYSQFFSGGQAFHAVYGDIYNPNGSWGCVNLRLADARTLWGVLKKNDRVYVWGRRAGT

SEQ ID NO: 12501 - protein, 391 aa, Streptomyces avermitilis
MTTRETAPLRARAEIDLAALRANVRTLRAHAPAAALMAVVKSDAYGHGAIPCARAAVEAGATWLGTATPEEALALRAAGLPGRIMCWLWVPGGPWREAIDADIDLGVSGLWALREVVEAAAGAGAPARVQLKADTGLGRNGCQPEDWPGLVAEALRAEAAGLVRVTGLWSHLACADEPGHPSIEAQLALFRQMVAYAERQGVRPEVRHIANSPATLTLPDSHFDLVRTGIAVYGISPSPELGVPADFGLRPVMTLAASLALVKHVPGGHGVSYGHHYVTPGATTLGLVPVGYADGIPRHASGSGPVLIGGKWRTVAGRIAMDQFVVDLGGDEPGAGAEAVLFGPGDRGEPTAEDWAKAAGTIAYEIVTRIGTRVPRVYVKVNNQQDGEANR

SEQ ID NO: 12502 - protein, 416 aa, Streptomyces avermitilis
VSESSAEAVEVAAAVASAASAASAAGNWRRAGIAGAAIGVVAAGAAAGVAIERLTVGRGMRRKARLALDSAAPYGTLRGTPAKAYADDGTALYYEVDDVEPDATLAPRRRRLFGRKAPAPVTVVFSHGYCLNQDSWHFQRAALQGVVRMVHWDQRSHGRSGRGVAQVQDGSPVTIDQLGNDLKAVIDAAVPEGPIVLVGHSMGGMTVMALADRYPELIRDRVVGVALVGTSSGRLGEVNFGLPVAGVNVVRRVLPQVLKALGQQAELVERGRRATADLFAGIIKRYSFASRDVDPAVERFAERMIEGTPIDVVAEFYPAFTDHDKTAALASFTELPVLVLAGVKDLVTPSEHSEAIADLLPDAELVLVPDAGHLVMLEHPEVVTDRLADLLMRSGAVPAGATVGGYGSTSSSAQPG

SEQ ID NO: 12503 - protein, 175 aa, Streptomyces avermitilis
VAMEAPAAARNPGEIVSVELIVNAPDQMRELGHRLAKLLRAGDLVMLNGELGAGKTTLTRGLGAGLGVRGAVTSPTFVIARVHPSLGDGPPLVHVDAYRLGGGLDEMEDLDLDVSLSDSVIVVEWGEGKVEELTDDRLNVVIHRAVGDTTDEVRHVTVTGLGERWATVDLGVLSA

SEQ ID NO: 12504 - protein, 58 aa, Streptomyces avermitilis
MPASERDEAPPRASAGVSMRDLLASCAAARAVSTPPRAPAPVSVSAVKPVELRRPEAA

SEQ ID NO: 12505 - protein, 184 aa, Streptomyces avermitilis
VAKGSSGFVAGLTVAAVAVVGFLAFQASANVPDTLGRSATSKSPSAVKSKAPRDKKNPVALPADSGKGERVVYSIDDDRVWLVGANNKVQRTFKVTPGTVDPLPATYAVTSRSNAVSGSDGTPIEHVVRFASNEGVTIGFSAAVDGSTPAPVPTKKLGGIRESRADGDAMWEFATISQKVVVIN

SEQ ID NO: 12506 - protein, 215 aa, Streptomyces avermitilis
VLLLALDTATPAVTVALHDGTSVVASSSQVDARRHGELLLPAVDRVLAEAGTRLDAVTGIVVGVGPGPYTGLRVGLMTADTFGLALGVPVHGLCTLDGLAYASGLDEPFVVATDARRKEVYWARYDNARTRVTEPAVDRPGDLDLRGLPAVGAGALLYPDAFPDAREPEHLSAAALASLAAEKLAAGEELEAPRPLYLRRPDAQVPKNYKVVTPK

SEQ ID NO: 12507 - protein, 160 aa, Streptomyces avermitilis
MRWWDIDPVFEMEKDLFPEDAWSRGMFWSELAHSRGAGATRRYVVAEEDGKIVGYGGLVASGEVGDVQTIAVDRDHWGTGLGATLLTELLRAATAFECAEVLLECRVDNVRAQKLYERFGFEPIGFRRGYYQPGNVDALVMRLQDPSTSVQGTQGTEING

SEQ ID NO: 12508 - protein, 374 aa, Streptomyces avermitilis
MADSRDEPLVLGIETSCDETGVGIVRGTTLLADAIASSVDEHARFGGVVPEVASRAHLEAMVPTIQRALKEAGVSAKDLDGIAVTAGPGLAGALLVGVSAAKAYAYALGKPLYGVNHLASHICVDQLEHGPLPEPTMALLVSGGHSSLLLSTDITSDVRPMGATIDDAAGEAFDKIARVLNLGFPGGPVIDRYAREGDPKAIAFPRGLTGPRDPAYDFSFSGLKTAVARWIEAKRAAGEEVPVRDVSASFQEAVVDVLTRKAVRACKDEGVDHLMIGGGVAANSRLRALAQERCEAAGIRLRVPRPKLCTDNGAMVAALGAEMVARGRAASDWDLSADSSLPVTDPHVPGRAHTHAHTHGHDHVHEVSKENLYS

SEQ ID NO: 12509 - protein, 85 aa, Streptomyces avermitilis
VTVALMWEARAVEGRGDELLAWVEKQDLPGRPLRREVLRAPQDRVLVITWWDAAYDAELPELPDPDGELVTRTVHRWRFESVGVS

SEQ ID NO: 12510 - protein, 280 aa, Streptomyces avermitilis
MAHDMGWSAQGGEPESSDSMKTFGGFVQGLREHAGLSREEFGARVHLSKHSVASIELGRRLADERFVELAEGALGDTGALRRAFRFMARQPGFAAWFKAWARLEREAVSLATYECRLVPGLLQPEPYARVVFGNSIPPLSDEQVEAQAVARMERQRMLRECPNTSFSFVIDEHIVRRRLGGVEVTRSLLDHMLGYAQLRNVEIQIMPLDCEVHAGLDGPLALLETPDGRRLAYSEGQKTGRLITDAKEAAVLHRRYATLRSQALSPLDSVGLLERIGGEL

SEQ ID NO: 12511 - protein, 83 aa, Streptomyces avermitilis
MSTTQLAWFKSSYSGTEGDNCIEVALNWRKSTYSGTQGDNCIEVAPTPTTIHIRDSKDLTRPHLALTPTAWGAFVTHAAAQAN

SEQ ID NO: 12512 - protein, 339 aa, Streptomyces avermitilis
VARESMKNKVTITEIARQAGVSVPTVSRVVNGRSDVSPQTRARVEDLLRHHGYQRKSSAPGDRAALIDLVFNDLDSPWAVEIIRGVEEIAHASGVGTVVSAIHGASGSARQWMTNLRARASDGVILVTSVLEPRMHEELRRLGVPLVVVDPAGSPSLDAPTVGATNWAGGLAATEHLLGLGHRRIGFIAGPPRLLCSRARLDGYRAALEGADIAVDDALIVPGDFYHASGFDGCTRLLDLAEPPTALFAASDQMALGAIEALRRRGLRVPEDMSVVGFDDLPEVRWSAPPLTTVRQPLAEMGKLATRTVLRLAAGEEPASPRVELATELVLRASTAPRG

SEQ ID NO: 12513 - protein, 434 aa, Streptomyces avermitilis
MRALGNTSLSRRGFLAASAATGVGAAALSACGSSDSGNSSGKTTIEWWNITTTEPAKKLWAQRAKEFEAAHPDVKIKIVTLENEAYKSKMTAQTASGKLPDIYHTWGGGVLEQQIDAGLVEDLTDRVSSWTDTYVPAALAAYRFDSRTYAVPFDIGAVGFWYNKALFKQAGIDTPPTTWSGFLDAVRSLKSAGITPIALAGKEKWPGMYYWAYLSMRVAGLDAMHKAATDADFTGDGFVKAGQHLKDLVALQPFQKGFLGAGYSTPTGEAAAMGNGKAAMELMGQWAPVVEKDAGKGLGKDLGFFSFPAVEGGKGALTEVFGGGGGHAVRKGAPEAAVEFLKFFGEKEFAGKLVKETGLIPVSKDARGALTDPNLTAVSDALNAATGFQLYLDQAYAPAVGQEINDSVAALVAGSKSPQQVTRSVTQVAKSEKS

SEQ ID NO: 12514 - protein, 350 aa, Streptomyces avermitilis
MTHSTPSPHSTSTPSPHSTSTPPAYVPDLGKSPDPGPVSPRAGGPAPASRRLRDWLGAFVFTVPALILFGLLVLVPMGYAIYISFFDWGGFGSPTDVTGFGNYTRLLKDPVFLGDLWRGGLLIGFSVVLQLPFALAMAVLLNQKLRGRAVYRMLFFAPYILSEVITGVLFGMIFAPGEGLADKVLGAVGLDGLGGDWFAGRNTVLPTLFLVMTWKYFGFHMMLHLAGLQGIPAELHEAGRIDGAGTWQRFRHITLPLLAPTLRISAFLSVVFSIQLFDLVWVITTGGPDHASETMAISMVQYGFKRYQMGYASAISVVMFLISLVFALAYQRFVLRRDTEGAITTMRANR

SEQ ID NO: 12515 - protein, 298 aa, Streptomyces avermitilis
MSAPTGPTTGPTTGPTTGPPTSVVRRRRLRALPVYAILWVVGVFMVTPLLYAIVSGFKSTDQLSGNPFGLPSPWVTSNYTSLLGSGAFWRSIGSSTVIAVGATLVTVVTAALAAFALARFAFRGREFMFTLFTMGLMFPFAVAILPLFILLRTFGLLDNPWGVILPEAAFGLPVTIIILRGFFREIPGELEEAATLDGCSPFGFFWRVLLPLARPALGTVSVLAIVSSWNQFLLPLLVFSEPTWWTIPVGIQQFQGQYASDVARIFAYLVLAMAPALAFYAVAERQLIGGITLGATKG

SEQ ID NO: 12516 - protein, 742 aa, Streptomyces avermitilis
MTHPWQDPALPAAVRAADLLARMTPQEKTAQLYGVWPGSDEAPGGDVAPLQHALSEGVDLAGLLPHGLGQLTRPFGTAPVDPAEGAARLGFLQERIRAANRFRLPALAHEECLTGFTAWQATIFPTPLAWGASFDPDLVKEMAAAIGASMRAVGVHQGLAPVLDVVRDPRWGRTEESIGEDPYLVATVGTAYVQGLQSSGVVATLKHLAGYSASRGARNHAPASLGPRELADVILPPFEMAVREGGARSVMAAYNDIDGLPAHAHHRLLTHLLRDEWQFTGTVVSDYFGVSFLESAHGLADSPAGAAALALAAGVDVELPAVRCFGAGPFDEELVDRAALRVLTQKCELGLLDPDWAPPATEAPVDLDPPHMRALARQLAQESVVLLANDRGLLPLAPGARRIAVLGPHADDPAAMLGCYTFPRHVLLDRPGVPMGVAVPTLLEALRTELPDAEFVTDPAAAEVCVVAVGDRSGLFGRGTSGEGCDAADLELPDGQGEVVDRALASGTPVVLVLLSGRPYALGRWADRCAAVVQAFFPGEEGGPAVAGVLSGRVNPSGRLPVSVPRGPAGQPWTYLAPPLGRHGEASNLDPTPLYPFGHGLSYTTYDWQAPSVDDASFPTDGETTLRLTVRNTGERPGTEVVQLYLHDPVGKVARPVVRLVGYARVPLEPGASGEVHFTVPADLAAYTGPDGERIVEPGALELRLGVSSADGDVRYTVPVTLTGPERVVGRERRLRCEVRVK

SEQ ID NO: 12517 - protein, 369 aa, Streptomyces avermitilis
MKPEKSERPGKPGNPEKPENPENPVQTQSMARSTQTATLAEIAREAGVSAPTVSKVLNGRADVAPATRARVEELLRSYGYRRRRAEATRSPLIDLVFHELESAWAMEVIRGVENVARDEGLSVVLSESAGRLTPGRTWADQVAARRPHGVILVLSGLDESQRALLTSRSIPFVVMDPAGDPGDDVPSIGATNWHGGLAATRHLVELGHTRIGAISGPSRMMCSRARVDGYRAALETAGLPVDPGLVKAGDFHHEAGYRLGLELLRRPDRPTAVFAGNDLQALGLYEAARELGLRIPQDLSVVGFDDLPVARWVGPPLTTVRQPLTEMAEAAAKLVLELGREAGASVATRVELATSLVVRSSTGAAPAPV

SEQ ID NO: 12518 - protein, 451 aa, Streptomyces avermitilis
MRSLKRSGLSPASLLTGIAALAALLAAAPAAHAADTPLRDLAAAKGKVIGTAVTGSKLTGTYGDIAGAQFNSLTPGNAMKWGSVEPTQGTYNWTEADQIVAFAQAHNQQVRGHTLVWHSQNPSWLTNGTWTPAQLGTLLQNHITTEVTRYQGKLAAWDVVNEPFNEDGTYRSTLWYNGLGSDYIAQALTAARAADPSAKLYINDYNVEGVNAKSTALYNLVKSLKDRGVPIDGVGLQAHLVLGQVPSTLQQNIQRFADLGVDVAITELDIRMQLPATDAKLTQQAADYKAVLDACVAVTRCVGVTVWGFTDSDSWIPDVFSGYGAATPYDENYAPKPAYHAIATALGGTSTPPTGACTATYSVTSQWNAGFTGQVRIACSGASLSAWKVSWTYGAGQQITQAWNATCTQSGTAVSCANASYNGTVPNGGSVTFGFNASWSGSNPLPTVTLG

SEQ ID NO: 12519 - protein, 361 aa, Streptomyces avermitilis
MFLRVTGEDERGDDNGGAVRRPGRRSRLLKGVGIALAGGLVLGAAGAGWAYWRLNHNIKSVDINSALGDDRPARSVTSPSPAASASASATPLPSGALNILVLGSDSRSGKANATLGGGDSSGARSDTAMVVHIDEGRTEATVVSIPRDTLVTRPSCPLTSGGTTAVAYNAMFNSAYAVGGPVCAVKTVESLTNIRMDHYLEIDFSGFAKLVNALGGVTVTTDEDIDDDKSHLHLKAGEHHLTGKQALALARTRHGIGDGSDLGRIGLQQKLVKALLDQIASTNLLTDPTGLYKVADAITGSLTTDTGLDSLGELMNLGESLKGLSSERVSTVMLPVATAPSDPNRVVAKEPAASALWTSLR

SEQ ID NO: 12520 - protein, 118 aa, Streptomyces avermitilis
MPRYLSLIQIDESTAPAEGPSPELMQRMGELLEEITKAGVMLDTAGLTPTAQGKRVHWAGGELSVTDGPFTESKEVVGGYALMQCKDMAEALEWTKRFLKVHEEHWTVTCEVREIAEG

SEQ ID NO: 12521 - protein, 424 aa, Streptomyces avermitilis
VEQQPTATAAIEATVETVFRIESPRIIAGVARIVRDVGIAEELAQDALVAALEQWPRDGVPDNPGAWLTATAKHRAIDLVRRRERYARKLEEVGRDLSSTAPHHLDEPADPDDIDDDLLRLVFTACHPVLSAEARIALTLRLLGGLTTPEIARAFLAPEATVAQRIVRAKRTLATKGVAFEVPYGPEREARLGSVLEVIYLIFNEGYAATAGDDLLRPALCEDALRLARVLAELMPKEPEVHGLAALLELQESRAGARTGPSGEPVLLKDQNRLRWNRMLIRRGFTALGRANAVATGGLGPYALQAAIAACHARAYAYEDTDWAQIVTLYGLLAARSPSPVVELNRAVAVSMAEGPGPALEIVDALAAEPSLRDYHLLPSVRGDLLARLGRTTEARAEFARAAALTRNERERELLLARAEGRGQ

SEQ ID NO: 12522 - protein, 390 aa, Streptomyces avermitilis
VNDLSFASLLTPEGRALLDEVRDTAPARELAVATRLRREHPAELVSAALGQARLRQRAAAKFAAEDAARMFFTPNGVEQSTRAAVATHRALRLRELGVTSVADLCCGIGGDAIALARAGIRVLAVDRDPLTAAVARANAGELGLTDLIEVREADVTEVDPGPYDAVFVDPARRGGRGRVFDPEAYSPPLSWAIGTALAAPRAALKIAPGIPHEAIPAEAEAEWISDGGDVKEAVLWFGTEPGLVRATLLPGPRVLRGRGLPDPAVRPLGRYLYEPDGAVIRAHLVAEVAQELDGGLVDETIAYVTADELRPTPYATAYEITDQLPFNVKKLRVLLREREVGILTVKKRGSAVEPEELRKKVKPHGPNSATVFLTRVAGAPTMLIGHPAVP

SEQ ID NO: 12523 - protein, 291 aa, Streptomyces avermitilis
VAPRAAVAVLALAALASGCAGADSPVRPAPGPQPLKAPPARALDSYASKLRLSLAARAAAAKRWGLTKTPLTAPAPPVKKPVITFRKGFEVTDGEGLPPVFTTVPTKDKVVFLTIDDGAEKDPAFLRMMSDLKIPYTAFLSNYLVEDDYGYFREMRRQGVTLNNHTLTHPYLPGLSYEEQEHEICGMQDIMEKRLGKRPALFRPPYGNYNGDTLRAARSCGIKYAPIWNEEVFVDHWEYRETDQSLHPGDIVLTHFRGKEDWQGTMPDMIRRFMEKVTDEGYAVARLEDYL

SEQ ID NO: 12524 - protein, 276 aa, Streptomyces avermitilis
VTARQLVAGLLAATLLTGCAQSVDPIERLGKKAAQKVRRPQEPGAQTYRRWGLSAPLAPAPAPDHPPFPVRTGHRALPPVVDRVATHDKVVFLTYDVTYDGGYYGAEKDPRFTDMVRELRLPVSVFVTDSEVGPGYAHVARLRSVGATVQNGTLGATSLRGLPYAGQRAGICGGRDRLRARFGRRPYFLRPPAGAYDRTTLRAAADCGVTAVVLWRASMRADGLSYRGRAHRLHRGDIVLAHPGNPDGDSLTTLTARLLRRVQAQGFTVGRLEDYL

SEQ ID NO: 12525 - protein, 102 aa, Streptomyces avermitilis
VTTASSKVAIKPLEDRIVVQPLDAEQTTASGLVIPDTAKEKPQEGVVLAVGPGRFEDGNRLPLDVTVGDVVLYSKYGGTEVKYNGEEYLVLSARDVLAIVEK

SEQ ID NO: 12526 - protein, 542 aa, Streptomyces avermitilis
MAKILKFDEDARRALERGVNKLADTVKVTIGPKGRNVVIDKKFGAPTITNDGVTIAREVEVEDPYENLGAQLVKEVATKTNDIAGDGTTTATVLAQALVREGLKNVAAGASPALLKKGIDAAVKAVSEELLATARPIDEKSDIAAVAGLSAQDSQVGELIAEAMDKVGKDGVITVEESNTFGLELDFTEGMAFDKGYLSPYFVTDQERMEAVLEDPYILIHQGKISSIQDLLPLLEKVIQANASKPLLIIAEDVEGEALSTLVVNKIRGTFNAVAVKAPGFGDRRKAMLGDIATLTGGQVIAEEVGLKLDQVGLDVLGTARRVTVTKDDTTIVDGGGSSDEVAGRINQIKAEIENTDSDWDREKLQERLAKLAGGVCVIKVGAATEVELKEKKHRLEDAISATRAAVEEGIVSGGGSALVHAVKVLEGNLGKTGDEATGVAVVRRAAVEPLRWIAENAGLEGYVITSKVAELDKGQGFNAATGEYGDLVKSGVIDPVKVTRSALENAASIASLLLTTETLVVEKPAEEEADAGHGHGHGHSH

SEQ ID NO: 12527 - protein, 249 aa, Streptomyces avermitilis
MGVFDRTRGAGGDVMTFLQLIDCKTSRFDEMNRLMDTWVERTKGKRTASHSVIGKDRSDASHIVEIVEFPSYEEAVRNSNLPETDSVFREMVALCDEMPTFTDLDVVRDEQLYAGTVRRFLLEVATEGELPPLNDVMAENYHDHDPANEQDAIGLDAMRREIEMWRRGFDFAFTVEDQLAEGDRVCTRWSWKGDHKGDFMGILATGKQVTMTGTTVFRCGEDGKIVEGWWQYDRLGLLAQLGALDELES

SEQ ID NO: 12528 - protein, 257 aa, Streptomyces avermitilis
MTTALITGSTAGIGAAFARRLAADGHNLVLVARDTKRLREQATELHDRHGIEAEVLTADLATDDGIETVAARLGDRKNAVDLLVNNAGFGNKGRYLDVSMADELKMLKVHCEAVLRLTSAAAEPMRERGRGGVVNVASVAAFVPRGTYGASKAWVVQFTQGAAKDLAGSGVRLMALCPGFVRTEFHQRAGMGTDNIPKWMWLDADKLVAAALADLARGKSLSIPDPRYKALMGLVKVTPRALLGGISSKTGRKYGPQ

SEQ ID NO: 12529 - protein, 222 aa, Streptomyces avermitilis
MMLLSLNVGRARAVEYTDQPEGVTGIDKRPVDGPVRISAPGPKGVGASGVAGDAVCDTRHHGGEHQAVYAVAREDLDGWERELGRALPNGVFGENLTTEGLDVSGARIGERWRIGPDVVLEVTSGRIPCRTFQEHLGERGWVKRFTHKGAPGAYLRVVEPGEIRAGDPVEIVHRPGHEVTVALQFRAVTTERELLPRLLAAAEALHPEALARAREYVEKYEA

SEQ ID NO: 12530 - protein, 298 aa, Streptomyces avermitilis
VIEARHLRVLRAVAATGSFSAAGRELGCTQPAVSQQMKALESSVGTPLLIRTGREMRLTQAGEALVRHAAGIIAGLTAAEEEVAAIAGLRAGRVRLVSFPSGSSALVPTALAALRAAHPGTRVSLEEAEPPRSVEMLREGDCDVALAFRYEGAAGAEEWDDLVVRPLLTDRLVGLVPEGHRLARTESVAIADLAADPWIAGCPRCRGQLVEVCESAGFTPRIDFATDDYPAVVGLVSAGLGVAVLPQLAIESVRPRGARTVAVEPPVRREIVALTLPDLAQVPAVAATLDQLAAAATR

SEQ ID NO: 12531 - protein, 109 aa, Streptomyces avermitilis
MADFSRLPGPNADLWDWQLLAACRGVDSSLFFHPEGERGAARSARENSAKEVCMRCPVRAQCAAHALAVREPYGVWGGLTEDEREELMGRARNRLVSAATNSRDTASNN

SEQ ID NO: 12532 - protein, 203 aa, Streptomyces avermitilis
MTSVLVCDDSPLAREALRRAVATVPGVERVTTAANGEEVLRRWGADRSDLILMDVRMPGLGGVETVRRLLSADPGARIIMLTVAEDLDGVALAVAAGARGYLHKDASRAELRATVTQALADPTWRLAPRRLRSAEMGAAPTLTAREIQVLEGMSHGRSNAEIGRELFLSEDTVKTHARRLFKKLGASDRAHAVALGFRWGLVR

SEQ ID NO: 12533 - protein, 191 aa, Streptomyces avermitilis
MRDDETTVIGALVHRAVDGDEQATHDLLARVHPLALRYCRARLSRLPGDARHFQEDLAQEVCVAVLLALPRYKDTGRPFEAFVFAIAAHKVADLQRAAMRHPGSTAVPSDEMPERPDDSLGPEERALLSSDAEWAKKLLANLPENQRELLLLRIAVGLTAEETGQMLGMSPGAVRVAQHRALSRLRALAEQ

SEQ ID NO: 12534 - protein, 502 aa, Streptomyces avermitilis
MTANVDGVPAKFATLGLTYDDVLLLPGASDMAPDQIDTASHVSKNVRVNIPLLSAAMDKVTEARMAIAMARQGGVGVLHRNLSIEDQANQVDLVKRSESGMVTDPITVHPDATLAEADAICAKFRISGVPVTDGNGKLLGIVTNRDMAFETDRSRQVREVMTPMPLVTGKVGISGNDAMQLLRRHKIEKLPLVDDAGILKGLITVKDFTKAEKYPNAAKDAEGRLLVGAAVGVAGDAFERAQALIEAGVDFIVVDTAHGHSRLVGDMVAKIKSNSGGVDVIGGNIATRDGAQALIDSGVDGIKVGVGPGSICTTRVVAGIGVPQVTAIYEASLAAKEAGVPVIGDGGLQYSGDIAKALVAGADTVMLGSLLAGCEESPGELLFINGKQFKSYRGMGSLGAMQSRGEQRSFSKDRYFQEGVASDEKLVPEGIEGQVPYRGPLSAVVHQLVGGLRQSMFYVGGRTVPELQDNGRFVRITSAGLKESHPHDIQMTVEAPNYSRSK

SEQ ID NO: 12535 - protein, 374 aa, Streptomyces avermitilis
VTEIEIGRGKRGRRAYAFDDIAVVPSRRTRDPKEVSIAWQIDAYRFELPFLAAPMDSVVSPATAIRIGELGGLGVLNLEGLWTRYEDPQPLLDEIAELDADTATRRLQEIYAAPIKEELIGQRIKEVRDSGVVTAAALSPQRTAQFSKAVVDAGVDIFVIRGTTVSAEHVSGAAEPLNLKQFIYELDVPVIVGGCATYTAALHLMRTGAAGVLVGFGGGAAHTTRNVLGIQVPMATAVADVAAARRDYMDESGGRYVHVIADGGVGWSGDLPKAIACGADSVMMGSPLARATDAPGRGHHWGMEAVNEELPRGKKVDLGTVGTIEEILTGPSHIPDGSMNIFGALRRAMATTGYSELKEFQRVEVTVADAQHKR

SEQ ID NO: 12536 - protein, 402 aa, Streptomyces avermitilis
MPADLAVIGLGHLGLPLAQAAVAAGIPTVGYKTGPEGGSLTAAELRRMLSGGFRTTTNPAELGRVRTAVICAPTPRGAAGALELSQVEAAARTLAARLRPHTTVILESPVHPGTTEEFLRPLLEEGSGLRAGRDFHLAYSPSRVDPGNRDFGSANTPKVIGGLTPACTESAAAFYGRLTDKVVRARGPREAETVQLLETNYRHVNIALVNEMAVLCNDLGVDLWDVIRCAETKPFGFQAFRPGPGVGGHAVPQDLTGHSGRTLRMVELAQQVNNHMPQYVIQRAATLLNEHGKSARGARVLLLGVTYKQDLADQQGSPAHEIALRLMELGASVSYHDPHVPAWSVLDRPIPRADSLYEAAADADLTILLQQHRTYDLQGLSVKAQLLLDTRGATPTGAAHRL

SEQ ID NO: 12537 - protein, 568 aa, Streptomyces avermitilis
VRTATLGPAERAESLAGMAERELDVLVVGGGVVGAGTALDAVTRGLSTGIVEARDWASGTSSRSSKLIHGGLRYLEMLDFALVREALKERGLLLERLAPHLVKPVPFLYPLQHKGWERLYAGAGVALYDAMSMAPGHGRGLPTHRHLTRSHALRVAPALKKEALVGALQYYDAQMDDARYVAMLVRTAAAYGAKAANRARVTDFLREGERVVGARVQDVEGGGEYEIHARQVVNATGVWTDDTQAMVGERGQFHVRASKGIHLVVPKDRIHSTTGLILRTEKSVLFVIPWGRHWIVGTTDTPWDLDKAHPAASSADIDYLLEHVNSVLSVPLSRDDVQGVYAGLRPLLAGESDATSKLSREHTVAHPVPGLVVVAGGKYTTYRVMAKDAVDEAVHGLDQRVADCVTEDIPLIGAEGYRALWNARARIAARTGLHVVRVEHLLNRYGSLAEELLDLVAADPSLGAPLQAADDYLRAEIVYAASHEGARHLDDVLTRRTRISIETFDRGTRSAREAAELMAPVLGWDKDQIEREIEHYEKRVEAERESQRQPDDLTADAARLGAPDIVPR

SEQ ID NO: 12538 - protein, 353 aa, Streptomyces avermitilis
MPKPRTARTPRTLLAIPVSLALLGFAPGGFQAPTTPATDALLPLLVTRGGAPAAALLAREESGIRFARAGRGIDRADHFRAGSITKTFIATVVLQLAAEHRLSLSDSVEDHLPGLVRGAGHDGRAVTLRALLTHTSGLADFTADTAGTVPVTPLQAVRIALTHPPADRGRFAYSNTNYVLLGMVVQQVTGHSYAVEAERRIVTPLRLTGTSFPGARTALPDPHGRAYAADGTDVTELDPRVAGAAGELVTTLADLDRFYAALLGGELLPAHGLREMLDTRTAHGSYGMGLYPVKLPCGTTVWGHNGRISGSYVRTAATVDGRRVLTFRVNTDGVSEPGLEPAVLAAEFCPRTS

SEQ ID NO: 12539 - protein, 726 aa, Streptomyces avermitilis
MSEAERAGASRQDKSGRLLAGRYRLGDVLGRGGMGTVWRAEDETLGRTVAVKELRFPTSIDEDEKRRLITRTLREAKAIARIRNNSAVTVFDVVDEDNRPWIVMELVEGKSLAEAIREDGLLEPKRAAEVGLAILDVLRAAHREGILHRDVKPSNVLIAEDGRVVLTDFGIAQVEGDPSITSTGMLVGAPSYISPERARGHKPGPAADLWSLGGLLYASVEGVPPYDKGSAIATLTAVMTEPLEEPKNAGPLRSVIYGLLAKDPEQRLDDAGARAMLNEVLHAPQPKEPEPVDATRVVALPPVPEEGTGKGSSGGSGAKRGEEAADRFRGALRSVRKAAGAATASAAARAKSGGTDVSGGTGAAGAGTSSAGSSASASAPAPGKPGAAAVGKPNPSSAGKPGSSAAATPAGTGSGVGQGTAVGGGGRESAVVGSNSGPVKPSSGWPVVPEPDRPPRSVPRAPLTDVVPRRTLVIVAVVVVLAVLGVVLALTLGGDDGSSKDNKGSSDTKAAASSGTSSGTTAGSSGTPKAGGSGSGSGGTHTDSGSKDNTGTGSDEQETDDSSSAGTASGSGGSDDSGSGSGDSSVKTYKSSQGFSIGLPKGWKYQSTGAAGARFTGPDGQKLLVGWTTTPKDDPVADWKNQEQYMVRSQYKRIRIEQVDYRGWNTADWEFTYTEGGTKYRSIDRGFVVNAHQGYALMYTAKASEWDSDLRKDTWQTLAKTFQPKS

SEQ ID NO: 12540 - protein, 893 aa, Streptomyces avermitilis
VDEYAGRVLADRYRLPLPPSDEYELAETRAFDTYSGQEVLVRQVPLPEVVEAEVLDADGLPAGFVARDGGTRRASARTATRRPAEPAVRRAIEAAQAAAQIPDHPRLDQVFDVFAEGGSLWIVSELVAARPLAALLADKPLSPYRAAEVASDVLMALRVLHAHGWVHRNITVRTVLVCDDGRVMLTGLAAGAAEEALCGYDPVPVRDFEPRGDDGGDGTGGNGRGAVRGAAAGGTPGIGSGPGAGSGRPGIGAGSGGPVGAAGGAVGAAAGGMSVAEAEAARRAAIEARAGGVGPVAGTPGGEVPARGARALEGGGDARAQRAGAIAAYRAGARAAARVQEAQRGGRAALPAPRPADAEGRAPQSPGHGVEHLPGALPGQIADPYGVARTNSWPGGFPGDVGGANVGGAYGTPGNGSGTYENGSVPHAPADAPVSTPTPADAVPPTHWDHLVSGSSAPSGPSAASVPRRGPTTALAAERARQARMAVIGPVTERWAPEQAGPVHENWQLAAPIGPATDLWALGALLFRAVQGHAPYPEENTAELVQLVCAEPPAFAEECGPLRPVVESLLRQDPTERLDFEEVRGWLRSLVRSAPEPEAGAHVVAAPPVDPRRLPIVRRRGELVRRRRARLPATTPHARHKRAKDGRPPRPKRLGRNLVLLILLVLAAAVAYAMVFMPKASPNSDSGSRSDGDRTGAAGGVSPAPEQSGGGSEPRPDQTSPGSGKSPSGSSGSTREQTTDPDVAQGFTLRKDPEGFRVAVATGWDRAPKNGRGRIVYSHGDFELIVVPGRDSTADHGSDPLTYQRETESELQPFRDSTWATSSGMRRIDVGGRTMAEGQFTWTDGQGRELFVRNLAIVVGGRYHVVQLRGPEAERDEVTRLYEQASRTYQVTG

SEQ ID NO: 12541 - protein, 547 aa, Streptomyces avermitilis
VNQMQGLLLAGRYRLVDSIGSGGMGRVWRAHDEVLHRAVAVKELTAALYVSESDRPRLLARTNAEARAAARINHSAVVTVHDVLEHDNRPWIVMELVEGGSLADAVKERGRVEPVEAARIGLWVLRGLRAAHSAGVLHRDVKPGNVLLATDGRVLLTDFGIAQVEGDTTITRTGEIVGSVDYLAPERVRGHDPGPSSDLWALGATLYAAVEGKSPFRRTSPLSTMQAVVGEEPGAPQYAGALAPVITALLRKEPAERPGSDEAEQMLAEAAEGRRPRAAQAYVGTLHGELRQGNTTTHVPRPQGAQGVDPADATPREPVTGSAFATASAAPAVPRKRRRGRTAVIALVLAALVGGGGAAAMKYADDWNKGTGQDKGSAAASTHPETTAGAVPDNWVPVTDPVGFGLSLPKGWKRQVYGIQGDLKQIDYTPDRGKHFIRIAIDDSPDFSDPYQHQIDLEQQLQRLVDYKRVGMEVNTYRDRRGSLWEYTWTALAKDIEFPGPRRAIEETYVSRDGVEYAIYMSSPAEDWATTRKQFTTVLQSWRPKSA

SEQ ID NO: 12542 - protein, 385 aa, Streptomyces avermitilis
MMGRMGTEGENVRVIAGRYRLDARIGRGGMGVVWRATDQLLGRQVAVKELAFDTSLSDEEARLQRERTLREARAVAQLSHPNIIVVHDVVVDDERPYIVMELIGGGSLADRISADGPVDAREAARIGIDLLGALGRAHGAGVLHRDLKPANVLLEADSDRVVLTDFGIAQVAGATTLTESGSFVGSPEYTAPERMSGVRTGPESDLWSLGALLCTVLSGESPFRRDSLGGILHAVVVDDIRPPAQAEPILPVVRGLLERDPDRRLDAAEAARLLREFLDTGRTPRVPTGAGYTPTQRDVPRAQALHADAPPRQEPEATPTAATAAQAARHSRRGVLIAAALVAAMAGAGVSAAALLMHKGVDGGGPGPTSSRPRTSVSTGPSRSA

SEQ ID NO: 12543 - protein, 129 aa, Streptomyces avermitilis
VPEGFTRVPQGERIFYMSPGQIFRIGIRTADPAVGGPLAVMRHADTKGPSTNPGYRDGRVTETTHGDHPAALWEFTWNGFSTAEGPRHTYDLCWEEGGRMYDVWVSAPVGKVREAKEYFDVAVDTFAVS

SEQ ID NO: 12544 - protein, 578 aa, Streptomyces avermitilis
MSNNGGVSYGADEPTSFGLQPPRPGVPHPGNPYAQPQPQPQPQPQPQPQPQPQPQPQPQPQSHAHAHAHPTQQMPPQAMPETPPGEPGTGRLIAGRYRLLAKLGHGGMGTVWRAKDETVDREVAVKEPRVPDHLPERERANVFERMRREARAAARLDHPAVVNVHDVAVVDGRPWIVMELVQGRSLGAALQEGTLGARETAKIGLEVLGALEAAHAAGILHRDVKPDNVLLGRHDRVVLTDFGIAQIEGETNLTDTGGFVGSPEYIAPERVLGQRPGPASDLWSLGVVLYAAAEGVSPFRRSNTPATLQSVLNATPAAPAAAKGTLAQVINGLLNKDPARRPNAAEVRRLLEDAARPPQQTQVVQIAGPGGKGFRVGRKALFGLGAAVVAAAVAAYLVIADPFAGPLPDTWKQREVPRLDATLAVPADYQVSRPEKSDTDKNWVTYSDWSGSIWIGLHLAKKSEDTSNQIKDSAAAEMYAENGEFKESGAYELSMPEKPKTRTAETSYQGKKAAENTVVYTTTDSQNPRPREVRIFYYKNSAGNMYKLTVSYPGKGDFTERGREVAKTAIANLDVDKL

SEQ ID NO: 12545 - protein, 267 aa, Streptomyces avermitilis
MHRPARSRAAVAVITSILSLSLATGCSGTKSDSADDGSGKGSRSTGAAKALSKPELAKSIIAQGDVKGYKVGSADRADAATTSKDDIKVVDEKCEPLAYVLSGFAPGDSTAYVNRQVTEKKAAPSAASDLSEDATEEEFEDALTEGMSVSVTIVSLSSYEGDGAEKATTSVSDALDACANGFKVSSDGDSQKFTKVAEEKSSGEGDDSVAFAVTGDMDGDTGTVHGEVVRRGSVVATYYTLNLGAMMSGKAYDIPAEIIAAQTSKIS

SEQ ID NO: 12546 - protein, 61 aa, Streptomyces avermitilis
VTELNWQKSTYSEEASSCVYLATTPTGTILLRESDEPEIVLNTGTRQLSALISALRNRAAL

SEQ ID NO: 12547 - protein, 283 aa, Streptomyces avermitilis
MPPRQTPTARQLRLGVELRKLREGAGLTAREAGEMIGANQAGISNIETGRFGLSEQRIRTLAHNYDCTDEPLIDALVAMAAHRERGWWEEYRDTLPPRFLDVAEMEHHARALRVAQVINIPGLLQTPEHARTLFRQVVPALRPHEIEYRISHRIKRQAVLYREQAPSYTAIVHEAALRMRFGGPEVSRAQLDHIIEVSEQPHITVRVIPFDGTVFPTVGHGLDYASGPVRALDTAQLDAAHGSELIDAPAQLTKYRLILDRMENATLEPDESRDLIHRIAHAA

SEQ ID NO: 12548 - protein, 162 aa, Streptomyces avermitilis
MVTVSPPKSEASPSWAYVLQLPHDRCAPRIARVTLRAVLAGHGLTGLTDTAELVTSELVTNAYRHTTGPATLRLRALAGARLRVSVWDANPHIPPPFDKRPGPPHPVHPAPVEADGGRGLFLVCHYADAWGGYPLGGGLFGRGGKLLWCEIGPPAADRVAAA

SEQ ID NO: 12549 - protein, 457 aa, Streptomyces avermitilis
VGVVLEERDHAAQRWAARGSLGAAVLAVVLPVVTAGVGSLLLVGAGLLGAVVTAAALWWVLTRRGVVRAAAAVLAVGSPVGVIVLFHAAQLLWVVVVSLVLWSVAVWAGKTALSSTRSHHVRVTEYETPAPERAFFLMNPRSGGGKVERFGLREKAERLGARVHLLDPERPEPEDVAALAREAVANGADLLGVAGGDGTQALVAAVAAEHDIPFLVVSAGTRNHFALDLGLDRDDPSTCLDALADGVELRVDLGFAGEHPFVNNASFGAYAAVVQSPAYRDDKVGTTLELLPDLLTGQRGPQLTARAQDAVIEAPQALLISNNPYRMDDPAGLGRRERLESGVLGVLGIKVESAAEAAGLLLGRHATGLTVLTAREVLVDADRPQIDVGVDGEALVLPTPVRCRIEPGALRVRVPRDRPGVPEAKPPLDWRRLRKLAATVGRTALPKGRARGAGTPR

SEQ ID NO: 12550 - protein, 543 aa, Streptomyces avermitilis
MTDSQAPEKTGTDDTTGTNPLAPAPAGARTAADVVTPELVAQLTKGVVGSGRTANHTPFTGEKLADLPESTPEDVATAFERARAAQIAWGATPVRQRAAVLLRFHDLVLARQAEVLDLIQLETGKARLHAHEEVQAVAVAARHYGRKAPAYLKPKRHAGAMPTLTRVTELRHPRGVVGQIAPWNYPLELSVGDALPAFVAGNALVMKPDTETCLTALWARDLLIEAGLPAEVFQVVIGEGPVVGPEVVKHADYVSFTGSTRTGREVAQGAAARLVGVSLELGGKNAMLVLEDADIDKAAAGAVRACFSSAGQLCISIERLYVHESVADAFAERFAARTRAMRLGTSLAYGADMGSLVGERQLETVTRHVDEAVAKGAKLLAGGVARPDIGPYFYEPTILDGVEAPMSVCTEETFGPVVSLYRFKTEDEAVELANSTPYGLNASVWTKDGRRGRAVAARLRTGTVNVNDGYAPAYGSVQSPMGGMKDSGLGRRHGSEGILKYTEAQTVAHQRLLPMAPSLGMDDEKYAEFMSRSLKAMKALRLR

SEQ ID NO: 12551 - protein, 601 aa, Streptomyces avermitilis
VPQENSAQPPVGYPYDYDVIVVGSGFGGSVTALRLTEKGYRVGVLEAGRRFTRESLPKNSWDIKNYLWAPRLGMYGIQRIHLLGNVMVLAGAGVGGGSLNYANTLYVPPKAFFDDPQWKDITDWQEELKPYYDQARRMLGVRLNPTMTPSDVHLKAAAGRMGVGDTFHMAPVGVFFGDGQDADGTAKAKPGGEVEDPYFGGAGPARKACTECGECMTGCRHGAKNTLNENYLHLAERAGAVVHPMTTVVAVTDDSQGGYAVQTLPTDEKRKGRGRTFKARRVVVAAGTYGTQTLLHRMKEGRQLPYLSGRLGELTRTNSEALVGAQTDSRRYRKAHGEPTVDFTRGVAITSSIHPDANTHIEPVRYGRGSNAMGGLSILQVPYAEGSSRLLAWLANAAKHPLLVARSLSNRRWSERTIIGLVMQSLDNSLTTYLKPKGAGKGLLTARQGHGAPNPKQIRAASQAATVIAEEINGFPGSNVGELMGTPLTAHFLGGCPIGDSPASGVIDPYHRLYGHPGISVVDGAAVSANLGVNPSLTITAQAERAMSYWPNKGEADPRPAQGAAYERLKPVEPRHPAVPADAFGALRLPFLGMPTVPPKE

SEQ ID NO: 12552 - protein, 253 aa, Streptomyces avermitilis
VRVGNVKSKVSRIAVAVSVAAALGLTAACGGGGGDGGKGAKPSKAKGSEAAQADPKASPAGSGALTRAELEKAALASGDVKGYGVKKTAASDIGLDSVPADPAACQPVADMFLFTSDPAARAAVGRSFAAKDDLDASVTSLALLAYGSGEAEQVLDGLRTSTGKCTKYEHTGYQYSGVKVLKDPGLGDESVAYRLLGSIEGASVPTTFTVVRVGTTVVTFTAMNMLDGDKVKVPSAIVDAQLKKLKKLKKATA

SEQ ID NO: 12553 - protein, 94 aa, Streptomyces avermitilis
MAEVLDRTGARTVEAADVISGARERIDSLDDRIIGLVQERMAVSAVIQEARIASGGRRVNLSREMEVLGHFRDALGKPGTSLAMTLLELCRGRI

SEQ ID NO: 12554 - protein, 181 aa, Streptomyces avermitilis
MGSGSTGLKDKPHGSVRRQFDQLTREIAKFGAVGGAGLLVNLLVFNLVRSVTGLQVVRASVIATIVAIICNYIGFRYFTYRDRDKSGRTKELTLFLLFSAVGLVIENGVLYVATYSFGWDSPLQSNIFKFLGIGLATLFRFWSYRTWVFRTLPAREAIASAESFLEEEPERPRPGSSPRIR

SEQ ID NO: 12555 - protein, 407 aa, Streptomyces avermitilis
MGGPGSGTLRYRNRPLWRGRYSWSVTFPVVGMVGGGQLARMTHEAGIPLGIRFKLLSDTPQDSAAQVVGDVVIGDYRDLDTLREFAKGCDVITFDHEHVPTEHLRALEADGIPVRPGPDALVHAQDKGVMRAKLDAIGVPSPRHRIVRDVDDVAAFAAEGDGFPVILKTVRGGYDGKGVWFVRSAEEAEDPFRAGVPVLAEEKVDFVRELAANVVRSPHGQAVAYPVVESQQVDGVCDTVIAPAPGISDELALEAEALALRIAKELGVVGHLAVELFETVTAEGDHRILVNELAMRPHNSGHWTQDGAITSQFANHVRAVLDLPLGDPRPRATWTVMANVLGGDYPDMYSAYLHCMARDPQLKIHMYGKDVKPGRKVGHVNTYGDDLDDVLERARHAAGYLRGTITE

SEQ ID NO: 12556 - protein, 177 aa, Streptomyces avermitilis
MTAPVVGIVMGSDSDWPVMEAAAQALDEFEIPYEVDVVSAHRMPHEMIAYGEQAAERGLKAIIAGAGGAAHLPGMLASVTPLPVIGVPVPLKYLDGMDSLLSIVQMPAGVPVATVSVGGARNAGLLAARMLAAHDAELLTRMREFQQELNDQATEKGKRLRAKVDGASGGFGFGSGK

SEQ ID NO: 12557 - protein, 397 aa, Streptomyces avermitilis
MSSPEQASLERARELLAEFPVVDGHNDLPWALRSQVRYDLDARDIATDQRAHLHTDLPRLREGGVGAQYWSVYVRSDLPGALTATLEQIDCVRQLIARHPADLRGALTAADMEAARAEGRIASLMGAEGGHSIDNSLAALRGLYALGVRYMTLTHNDNIAWADSATDVPAVGGLSEFGREVVREMNREGMLVDLSHVAATTMRDALDTTAAPVIFSHSSARAVCDHPRNIPDDVLERLPGNGGVAMVTFVPKFVLQAAVDWTAAADGNMRANGFHHLDTTPEAMKVHRAFEETHPRPVATVSTVADHLDHMREVAGVDHIGIGGDYDGTAFTPEGLSDVSGYPNLLAELLDRGWSSTDLAKLTWQNAVRVLGAAEDVARDLQAKRGPSNATLGQLDC

SEQ ID NO: 12558 - protein, 130 aa, Streptomyces avermitilis
MAAVTRFRSVVLDCPDPRELARFYAGIVGGSPEDEDPDWVVLQVPGGPLLSFQRAPGHTPPEWPRADRNSQQFHLDLDAGATWEEVDAAHERVLALGARPLDLEDDVKKDFRVYADPAGHPFCLCRIEES

SEQ ID NO: 12559 - protein, 447 aa, Streptomyces avermitilis
MALKITVIGTGYLGATHAAAMAELGFEVLGLDVVPEKIEMLQRGEVPMYEPGLEELLRKHVAGIEGSTGRLRFTMDFAEVAEFGDVHFVCVNTPQKHGEYACDMSYVDSAFEALAPHLKAPALVVGKSTVPVGSADRLAARLAELAPAGEDAELAWNPEFLREGFAVQDTLHPDRIVVGVRSERAEKLLREVYTTPVAEGSPFVVTDFPTAELVKTSANSFLATKISFINAMAEVCEAAGGDVVQLAEALGHDDRIGKKFLRAGIGFGGGCLPKDIRAFMARAGELGADQALTFLREIDSINMRRRGQMVEMAREALGGGSFLGKRVAVLGATFKPDSDDVRDSPALNVAGQIHLQGGQVTVYDPKGMDNARRLFPTLGYADSAVGAVRGADVVLHLTEWREFRELDPAALGEAASARVLLDGRNALDPQLWRRAGWTYRAMGRPTA

SEQ ID NO: 12560 - protein, 385 aa, Streptomyces avermitilis
LAGSADFDLYRPSEEHDMLRDAIRALAEAKIAPYAAAVDEEARFPQEALDALVANDLHAVHVPESYGGAGADALATVIVIEEVARVCVSSSLIPAVNKLGSLPVILSGSEDLKKRYLSPLAKGDAMFSYALSEPDAGSDAAGMKTRAVRDGDSYVLNGVKRWITNAGVSDYYTVMAVTDPTKRSKGISAFVVEKADEGVSFGAPEKKLGIKGSPTREVYLDNVRIPADRMIGEEGTGFATAMKTLDHTRITIAAQALGVAQGALDYAKGYVQERKQFGKAIADFQGIQFMLADMAMKIEAARQLTYAAAAKSERGDKDLTFQGAAAKCFASDVAMEVTTDAVQLLGGYGYTRDYPVERMMRDAKITQIYEGTNQVQRIVMARNLP

SEQ ID NO: 12561 - protein, 211 aa, Streptomyces avermitilis
MTPAPTRALGEPPFDAVLCDVDNVIRFYDPSGLTALERAVGLAEGTTAKVAFAPEAVRPVLLGRITPQEWVLSIVDGLTGLVSGTQAHELGKALIELPFGADGTVVSLLRRARTRMPLVLVTNATVQLEADLASLGLSDLADHVVSSARVGLVKPDPRIFELAAARAGVRLDRCLFVDDTRENVDAAAALGLRAVHFHEATDLERALAPLL

SEQ ID NO: 12562 - protein, 397 aa, Streptomyces avermitilis
MRQVQRGSGGPGPYQSAPPYGGGVPQQPSYVDGQGYDDGYDSGYNTGHVYGTPNGGGPQGPGGMGTRGPRPAPNWRRRIKWTAITLVTLMVVVSVSTYFWADSKLNREVDLSKVIDRPDTGEGTNYLIVGSDSRAGMSAEEKKKLHTGSAEGKRTDSMMILHTGDNGSTLVSLPRDSDVEIPTFKGSTSGKTYPGTGRHVKLNAAYAEDGPELLVRTIEYNTGLHIDHYVEIGFAGFANIVDSVGGVEMTLDKGFKDTFSGADFKAGKQTLNGEQALAFVRTRHAFAASDLERTKNQQKFLSALAHQVATPSTVLNPFKLYPTLSSGLDTLIVDKDMGLFDLADMFWAMKGVTGGDGTSMNMPISGSSGGNLVWDKAKVKALVNELKNDEKVTVSGN

SEQ ID NO: 12563 - protein, 207 aa, Streptomyces avermitilis
LSSRHKVEAMTHQATAAESEIPGAHQGAAPGEGPGEIPGKPTSASRTTLSHIMTHNDTNLLGTVHGGVIMKLVVDAAGAVAGRHSGGPAVTASMDEMVFLEPVRVGDLVHVKAQVNWTGRTSMEVGVRVLAERWNESAPATQVGSAYLVFAAVDADGKPRRVPPVLPETERDKRRYQEAQIRRTHRLARRRAIMDLREKRAAEGLDD

SEQ ID NO: 12564 - protein, 508 aa, Streptomyces avermitilis
MGLRCSRIPTPMPSRRCPPMPTPPRSPAARPPRRPRPSPARRPPVRPRRPRRPGWSMRMVTTLSVVVLASAGIGHAVVTSLDADIARVDPFKDMKNRPAAGTGMNVLLVGTDGRDKISAAERRKYRLGGAPCHCTDTIMIVHISEDRERASIVSLPRDSYAEMPTHTDGITGRRSRPQPIKLNAAYAQGGPNLTVRTVENMTHVKIDHYLEVDFTSFMKTVDVLGGVQICTPEPLKDSYTGLDLAAGTHRLRGGEALQYVRARHVDGASDLGRMQRQQRFLASLVEQTTSSGALLNPLKFRDVTRAVLGSVRADRGFGTDELLDLGRAMRNFSPSSSEFTTVPIRDMTHVVKGIGSTLKWDDAKAQKLFQSLRDDQPLVQHRSRSRTLRVDVAPQQIRVQVENATLTEGLGGRMDRALAATGFRTTRQPTKAAQTLKRTVVAYDPRWDRSARSLAAALPGCELRAVPGQGPTLKVLVGADHTKVQRVKAADQHQGEFGVVTGDQVVCP

SEQ ID NO: 12565 - protein, 342 aa, Streptomyces avermitilis
MSEKSDVQPPAVSVIMPVLNEERHLRGAVQAILAQEYDGEMEVVIAIGPSSDRTEEIAAELVREDPRVHTVPNPTGRTPAALNAAIKASRHPVVVRVDGHGMLSPNYIATAVRLLAETGAQNVGGIMHAEGENDWEHAVAAAMTSKIGVGNAAFHTGGEAGPAETVYLGVFRREALEQQGGYNEEFIRAQDWELNFRIREAGGLIWFSPELKVSYRPRPSVRALAKQYKDYGRWRHVVARYHEGSINLRYLAPPTAVCAIAAGVVVGLALTPWGLVVPGGYLAAIALGSLPAGKRLPLKARLQIPVALATMHMSWGFGFLTSPKALAKKVIASRRPAVLGSN

SEQ ID NO: 12566 - protein, 580 aa, Streptomyces avermitilis
MVQSSVRRKGARPRDRQTGEPGWDDSLYDDNGEPVQDGRGSGRGGGSAQGGGDGDGPPDEAKGHSRHGGGRRRGGKGDGGGGRPRRRRRVLRWSATVLAVLILGTAGAGYLYYQHLNDNIKKDDLYLGDDKDRAAKPKANAAGQTPLNILLIGSDARDSAANQKLGGAKDTYGGTPRADVQMLLHLSADRSNMSVVSMPRDTLLEIPKCTDPKTSHTYAAITYPTMTNNSLGRGGPGCTVATWEKFTDIHIDHFMMVDFAGVVSMADAIGGVPVCVDANIYSHTSTGHGSGLKLKDGTTSIKGKQALQWLRTRYGFEDGSDIGRTKAQHQYMNSMVRQLRENATLSNPNKLRKLAETATNALTVDDGLGTVSKLYDLSKELKKVPTSRITMTTMPWVYSSDGNRVLPKPNDAAKVFRLLREDIALDGKDKKKSPAQKAVAPAHADDKIAVQVQNGTRTSALAPVGGRANAMAQLLVGKGFTGAAADSSTVLSEDKTVIRYPSADLKGDAQRVAKSLGVPLSSVEKSASVSGVTLIVGGDWRSGTTYKAAEDDDTTPASAKLDKGSDTGACMHVDPDYTWS

SEQ ID NO: 12567 - protein, 507 aa, Streptomyces avermitilis
VPGPRRRRGVPDEPPPGRRRGRTKPKKSRTKKIVLWTGGSMAFVLVAVTAAGYLYLKHLEGNVQTTDVGDAAKSSFSKDDAFNILIIGTDKRTGAGNEGYGDKGSVGHADTNILLHVSKDRTNATALSIPRDLIVDVPDCETKQADGSKKVIGGSQNVRFNTSLGQGGRDAGCTMRTVKAVTGISPDHFMMADFNAVKTLTSAVDGVTVCVGKAVNDPDSHLKLPKGESTLEGEQALAFLRTRHSFGNQGDLDRIKVQQQFLGALSRKMTSSDTLTNPKKLLDLAEAATKALTVDTGIGKVSTLKDVALELKKVPPKNITFTTVPVIDNPAEKVHATVVVNQTTAPQVFSMIKDDVSFTAVKQEKKKEKAAVAARLKGSRSAASDVRVDIYNGGAPSGAAQETLSWLQNTEGVTKSSQLGNAGKTLSKTTLEYSPDQADQARKLADLMGLPAAQMKPGKSEKNAQGLPAIVLTLGKDFKGAGEPLTTPSKAPENIQKATADKQVCST

SEQ ID NO: 12568 - protein, 416 aa, Streptomyces avermitilis
MRGWTAVTDTAGTPSGDGPEQAAVPGPGGGASPIGAGLVRRRRRWLRHTAFGVAALVLGAAGAGWAVYEKLNSNITADEAAAAELARYEKERPTSLVRDAQNILLIGSDSRSGDGNSQYGRDTGTERSDTTILLHLPANRHSATAVSLPRDLMVDIPSCRRPDGTRTAPTFAMFNQAFETGGSACTIRTAEKLTNVRIDHHMVVDFSGFKEMVDAVDGVEVCLKDPIDDKDAKLRLPAGKQLLDGEQALGYVRARKSIGNGSDTDRMDRQQRFLGALVNKVQGNDVLLNPVKLYPVLDAATSSLTTDPDLASLRGLYELVRGMRNIPPERVQFLTVPRTSYVNNANRDQLVEPDAEKLFARLRADAPLEVAKDYAGYDEQSGGDGTLSGKPLDTPAGTPDPTPTFRGNTAAEDGCE

SEQ ID NO: 12569 - protein, 254 aa, Streptomyces avermitilis
VNATDRTPADLLRSALAADPARPLVTFYDDATGERVELSVATFANWVAKTANLLQGELSAEPGDRLALLLPAHWQTAVWLLACASTGVVADVGGDPAAADLVVSGPDTLDAARACSGERVALALRPLGGRFPKTPDGFADYAVEVPSQGDRFQPYAPVDPEEPALIVAGAEHTGAEVVERARAEAAGLGLTGPGSRLLSGLGYGTWEGLSAGLYAPLASGGSVVLCRHLEQLGEDALAKRIESERVTATRRHAS

SEQ ID NO: 12570 - protein, 458 aa, Streptomyces avermitilis
MRDYLASSIGVTCAAALVLPLTLTAPAQARPSASATGSDRTGAAADVAGPAADRAGPAADPAGSPVATEATVPGSTQSLPLAPLSGTRAVGAAAEQGLTPRNVRRFSLVGVVWNDPATELHGRVQVRTRAEGTTHWSGWQDVETHSHEHAPDPDTAEGSSHRARGSTAPLWVGDSDGVEVRVRAEGDRAAAPDTRALPGGLRLELVDPGAQPAAGTPKGSSRAGLAPQAATEIPALSKEQTERELLAEQGSAPRTQPYIGPRPRIITRHGWGADESLRARSFVYTSKVKAAFVHHTASGNKYSCSQAPSVIRGIYRYHVLSSGWRDIGYNFLVDKCGNIYEGRAGGVTKAVMGAHTLGFNSNSMGIAVLGTFSSTKPAAAAVNAIAKLTAWKLGLFGANPRGKTYLKSAGGNLYRKGKNVRLNVISGHRDGFATECPGKQLYGKLGSARSTSARYQGR

SEQ ID NO: 12571 - protein, 360 aa, Streptomyces avermitilis
VTEAILLVGGRGTRLRPLTVHTPKPMVPAAGVPFLTHQLARARAAGVDHIVLATSYLAEVFEPYFGDGSALGLHLEYVTEEEPLGTGGAIRNVASRLHSGPDEPVLIFNGDILTGLDIRALVHTHETTAADVSLHLTKVTDPRAYGLVPTDETGRVTAFLEKPQTPEEIVTDQINAGAYVFRRSVIDTIPAGRPVSVERETFPGLLSAGAHLQGMVDSTYWLDLGTPAAFVRGSADLVLGRAPSPAVPGRCGDRLVLPTASVASDAKLTGGTVVGEGAFVGEGARIFGSTLLSGAVVEPGAVITDSLLGARSRVGERSILTGAVIGDGAVIGADNELRDGVRVWCDARIPAGAVRFSSDQ

SEQ ID NO: 12572 - protein, 336 aa, Streptomyces avermitilis
VAGRFSPRPTRTTVRGGHVVVPGASGAVPRPAPATGLRRGWTPPWPLDLGIVLGPLRRGPGDPTFRTTPDGAVWRASRTPAGPGTLRVALRGGAVEAEAWGPGAEWLLHQLPEMLGSADDPDAFEPRHRLVAVTRHRRPGLRLTRTGLVLESLIPSVLEQKVTADEAYRAWRLLVRKFGEPAPGPVEGRMHVMPEPRTWALIPSWEWHRAGVDNKRASTILRAVRVAARLEQAMGMEPAQAQARLEVVSGIGPWTSAETVQRSHGAADSVTVGDLHLPRIVGYALAGDRDADDAAMLELLAPYAGQRHRAARLILLSGRTPPRRMPGMPRTDIGKL

SEQ ID NO: 12573 - protein, 423 aa, Streptomyces avermitilis
VPGLPEVAPGDDLAKLIAAVEPGLVDGDVLLVTSKIVSKAEGRIVRADDREAAIDAETVRVVARRGALRIVENRQGLVMAAAGVDASNTPSGTVLLLPEDPDASARAIRDGLRDTLGVDVGVVVTDTFGRPWRTGLTDVAIGAAGVRVLDDLRGGTDAYGNPLSATVVATADELAAAGDLVKGKAAGLPVAVVRGLPHVIAGDDEAGARAMVRGGRDDMFRLGTSEAVREAVTQRRTVRAFTDEPVDPGAVRRAVAAAVTAPAPHHTTPWRFVLLESAESRTRLLDAMRDAWIADLRGDRKTEESIAKRVRRGDVLRNAPYLVVPCMVMDGSHSYGDARRDAAEREMFVVATGAGVQNFLVALAGERLGSAWVSSTMFCRDVVRRALGLPESWEPMGAVAVGHAAEEPRDRPARDAGAFIEVR

SEQ ID NO: 12574 - protein, 319 aa, Streptomyces avermitilis
MRIVVLAGGIGGARFLRGLQRAAPDADITVIGNTGDDIHLFGLKVCPDLDTVMYTLGGGINEEQGWGRADETFHLKEELAAYGVGPEWFGLGDRDFATHIVRTQMLGAGYPLSAVTQALCDRWKPGVRLIPMSDDRIETHVAVDMDGERKAVHFQEYWVRLRASVPAVAVVPVGAEQAKPAPGVLEAIAEADVVLFPPSNPVVSVGTILAVPGIREAIAEAGVPVVGLSPIVGDAPVRGMADKVLAAVGVESTAAAVAEHYGSGLLDGWLVDTVDASVVERVEAAGIRCRAVPLMMTDLDATAQMAREALALAEEVRTP

SEQ ID NO: 12575 - protein, 175 aa, Streptomyces avermitilis
MNSDSDLQIAGDILEVPHLLQPPREHPATVAEFVGLARSIAADRSQWEHLVQYDATSRWYHRLRTGPGYEVWLLSWVPGQGSGLHDHGRSSGVLTVLEGALTERTERGTRALGAGAQRVFAPGYVHEVVNDALEPAVSLHVYYPGLTEMPMLPRSEPSSAGETPIAHCASVPTTA

SEQ ID NO: 12576 - protein, 87 aa, Streptomyces avermitilis
MTELVQQLLVDDADEELGWQERALCAQTDPESFFPEKGGSTREAKKVCLACEVRSECLEYALANDERFGIWGGLSERERRRLKKAAI

SEQ ID NO: 12577 - protein, 1225 aa, Streptomyces avermitilis
MSVHSHTAAQYDAATAPFDPASPPEFPRHVVTAVLVSHDGARWLPDALAGVLGQERPVQNAVAADTGSADASAQLLTDALGADRVLHLARRTGFGQAVEEANRAAAVLTPDDLPYLKRPSGWDPVTRSWRDDAYDLPDLPHGEPEQWLWLLHDDCAPDPDALAHLLRIVENEQELGREVAVVGPKLRGWYDRRQLLEVGVTIANSGRRWTGLDRREQDQGQHDHVRPVLSVSTAGMLIRRDVFEELGGFDRRLPLMRDDVDLCWRATAAGHRVLVAPEAVVRHAEAASRERRAVDCVGRTSASPHKVDKAGAVYTLLVNARTAQLPWILIRLVLGTLLRTVAYLVGKVPGQAVDEIRGLLGTLLRPERIIAGRRRRGRPQVDKGELRPLFPPPGATVRATVEQFAGNLTGNSDPEASSAGRHGGAVESGPGGDDADFLQVEQFARLKRIARKPGPVLFVVLLLVSLVACRALFGGGALAGGALLPAPADASELWSRYLDGWHPVGVGGTQSAPPYLALVALLASVLFGSTGLAVTVLLVCSVPLAGITAYFASRPLVESRLLRAWVSVVYAFLPAATGALAGGRIGTAVLAILLPLIARAGIAAGGLAHASGTRGSWRATWAYALLLTFTTAFTPIVWPIALVLGLALLVVRRGEITAYGLRFIAQFGTPLLVLAPWSLTLLPFGFFTEAGLKFGAGAASVTDLLGAGPGGPGTVSGLMLIGIVLAALAALLRSERQPGIWTAWAVALVALVFAVLSNRSAWAGPATLVYGLALLAAAALGADGARARVAEQSFGWRQPVAALIAFSSAAGPLLVAAGWMIGGADGPVERRDPVQVPAFVAEESGTRDQARTLVLNSTSPARVGYTLVRGSGARLGDAELAAAGGENKRLDKVVANLVAGSGADQADELGGFAVRYVLVRKGAPREVSRVLDATPGLSRLSQGDGSALWRVDRQVSRAAIVTGSGEPEPVAAGPVELHTTLPPGAAGRVLRIADTADEGWTATLDGKPLTRTTVDGWAQGFELPASGGKLDVTFDAPLGHTGWLWAQGALAVVLVVLALPGRRRDVDDDLPEEEAIPAQETAGEGRRARRLRAQAEAEAEQAAADGSTAPPSPEEAPAHAAIPQQQPYDEWDAASYGGAEYGTYGGDQYQAAPQYPAGTYEQPYQADPYQGGQYDPYAYGGTSTAYDQNYTQGYDPTAYDPANPPHPPHPPHHGTDSERPDGSQQ

SEQ ID NO: 12578 - protein, 502 aa, Streptomyces avermitilis
VNRTTLSLIAGATALAAVTGFAALSTPDTSGDSTAKAAAQLPVERTSLLCPEPSSSDLAETSYTAFTPVTKGAGGSGKAELAAANGQSADGSTAGKSGKSGKKNTGAPVVRPKEPGKPVTGTAEGAETPGLIGTATGRFAPGWTVQETTQVAAGTGRGLLGTNCTAPDSEFWFPGAGTADGRTDYVHLTNPDDSAAVVDIELYGKDGALKSTLGEGITVQPHSSEPILLSTLTDETDTDVTVHVTVRSGRVAAAVQALDDKLGGDWLAASADPAGSLVLPGIPKDATDVRLVAFTPGDSDADLKLRLASPTGQITPAGNETLHVKAGMTAAVDLGDVTRGEAGSLLLTPSDTSVPVVAALRVVRGKGDKRETAFIPATAPVGTRATVAGNRSKGTTLALTAPARTTQVKVTASAGSGGGTPVTKTYTIKAGTTQNVDAPVPSGLKGTYALTVEPVSAGPVYAARTLEAAGEGLPAFTIQTLPDDRGAVAVPEAEQDLSVLQK

SEQ ID NO: 12579 - protein, 190 aa, Streptomyces avermitilis
VDAGPSEVPPKPRAGGVGGRPREPPRGGRARGPGEDYASSVMDNPVPPRAAAPGPRRRDRHGRGMRGPIAPPQVPLAASRAEVFADLVQDSVERLERRWAQLADIDFLILEVPRLDGPGGGWGEDSVPLGGTIAAREGHPARVVVYRRPIEIRTKGRDERAALVHEVVVEQVAELLGLTPETVDPRYGED

SEQ ID NO: 12580 - protein, 157 aa, Streptomyces avermitilis
VFGGVCGACHSTTRWSDPGESRRGPLKSAVPSNIVSPVRRCSRTACGRPAVATLTYVYADSTAVLGPLATYAEPHCYDLCAEHSERLTAPRGWEVVRLLDGSAPARPSGDDLEALANAVREAARPQQRAADAGGARRADPMEVARRGHLRVLRSPDN

SEQ ID NO: 12581 - protein, 538 aa, Streptomyces avermitilis
VYVQELEPVAGSLGLSALVATLPLVIVLVLLGGVRMKAHRAGLIGQAAAALVARLAYGMPLGQTLSSAAQGAVFGLFPILWIVVNALWVYRMTVRTRHFDILRRSFGRLSDDPRIQALVVAFCFGALLEALAGFGAPVAICSVMLVALGFDPVRAAVVALVANTAPVAFGAMGTPVVTLAQVTGLPLDTVASVVGRQTPLLALVVPLVLVGLVDGRRGLRETWVPALVCGVAFAAAQFAASNYVSAQLADIGAALAGAGALVAVPHARRPAAEPVRAAVLTGVRSEDLDEEDPRPEVLRAYAPYALIVTIFSVAQIPVGKDWLAGATRTFDWPFLNVVGQDGKPVGGNVFIWPIVSTGGTLVLLAGLCTVAVLGMHARVAVEEWLATVRELRFAILTVTSVLALAYVMNLSGQAATIGHFVAAAGAGLAFLSPVLGWFGVAVSGSDTSANALFGALQVSAAHESGLSPELLAAANSSGGVLGKMISPQNLTIACAAVGLAGREGDLLRKVLPWSVGLLLVMCLIVAGQSSPVLDWMLP

SEQ ID NO: 12582 - protein, 455 aa, Streptomyces avermitilis
VTADLSQLVKAYDVRGVVPDQWDESLAELFGAAFAQVTGARAIVIGHDMRPSSPGLSRAFARGAAARGVDVTEIGLCSTDQLYYASGAFDLPGAMFTASHNPAQYNGIKMCRAGATPVGQDTGLAEIRELVESWLDSGAPAASDATPGTITQRDTLEDYAAYLRSLVDLTSIRPLKVVVDAGNGMGGHTVPTVFAGLPLTLVPMYFELDGTFPNHEANPLDPANLVDLQERVREEGADIGIAFDGDADRCFVVDEHGKPVSPSAVTALVAARELARHGGKGTVIHNLITSWSVPEVVRENGGTPVRTRVGHSFIKAEMARTGAIFGGEHSAHYYFADFWNADTGMLAALHVLAALGGQEGPLPQLVAEYDRYAGSGEINSTVDDQQGRLAATKAAYEGQDGVELDELDGLTVSAADWWFNVRPSNTEPLLRLNVEARDETRMAKVRDEVLAIIRG

SEQ ID NO: 12583 - protein, 56 aa, Streptomyces avermitilis
MPLEAGLLEILACPACHAPLKEAESELICTGQDCGLAYPVRDGIPVLLVDEARRPA

SEQ ID NO: 12584 - protein, 375 aa, Streptomyces avermitilis
MLDESLLDAPEALAEADRRGLLRGAAEAGARVRTAVRLAAEAGITELKPDGRPRAVLIAGPGTAPAGVADLLGALAGVGCPVTRIHPTGVAPAAGALRWELPGWAGPVDLLLVATPDGSEPGLSLLVDQAYRRGCTVVAVAPARTPITEAVDGAHGLFAPMATAPYDQDAPLAASAPGVLWALLTPLLALLDRAGLLAAPPEALQKVADRLDHVAERCGPAIATYNNPAKTLAADLADALPVIWTEGPTAGPAGRRFTAALAELAGRPALTAELPEALAAHSVLLSGALAAGADPDDFFRDRVEEAQALHARVVLLRDRPTGGLSAAPAARELALSHDTAISELEPEEGGELETLAEMIAITDFAAVYLALASGA

SEQ ID NO: 12585 - protein, 383 aa, Streptomyces avermitilis
MDRLDNTVRPYAWGSTTAIPGLLGVEPTGEPQAEMWMGAHPGAPSGTARGPLNEVIDEAPERELGPAAVARFGPRLPFLLKILAAGAPLSLQVHPDLEQAREGYEDEEHRGIPIDAGHRNYKDANHKPELICALTEFDGLCGFRAPGAAAELLAGLDVDSLKPYVDLLHAHPEEAALREVLTAVLSADREEMAHTVTEAAAACARLGGDYAPYADIAHHYPGDPGVIAAMLLNYVQLQPGEALFLGAGVPHAYLNGLGVEIMANSDNVLRCGLTPKHVDVPELLRIVRFEASDPGVLRPEAFPDGEEVYETPIDEFRLSRYVLPEGATPHDLTRPTPQILLCTAGSVQAGEHQLAAGQSVFVPAGEKAEVSGDGTIFRATVVA

SEQ ID NO: 12586 - protein, 327 aa, Streptomyces avermitilis
MSASGGTRAIVAALGANLAIAVSKFVAFLFSGSSSMLAEAVHSLADSGNQFLLLLGGKKAQREATPQHPFGYGRERYIYAFLVSIVLFSVGGMFAVYEGYEKIRHPHELEHWYWPVGVLVFAIIAEGFSFRTAIRESNELRGKLSWTQFIRRAKAPELPVVLLEDFGALIGLVLALGGVGLALITGDGIWDGIGTLCIGILLILIALVLAAETKSLLLGEAAGVDDVKKIEAAIVDGNTVTGIIHMRTLHLGPEELLIAAKIAVQHDDTAAEVAHAINAAEARIREAVPIARVIYLEPDIYSEAEAAKGPDREATPGGPAPTQPTGH

SEQ ID NO: 12587 - protein, 485 aa, Streptomyces avermitilis
MTTVDNRQDFKVADLSLAEFGRKEITLAEHEMPGLMSIRKEYAEAQPLAGARVTGSLHMTVQTAVLIETLVALGAEVRWASCNIFSTQDHAAAAIAVGPNGTPDNPQGVPVFAWKGETLEEYWWCTEQALTWPNTPTGGPNMILDDGGDATLLVHKGVEYEKDGKVPSVDTAESDEHRVILELLHRTITDGSQKWTQLASEIRGVTEETTTGVHRLYEMHRDGTLLFPAINVNDAVTKSKFDNKYGCRHSLIDGINRATDVLIGGKTAVVCGYGDVGKGCAESLRGQGARVIVTEIDPICALQAAMDGYQVTTLDEVIDKADIFVTTTGNKDIIMASDMAKMKHQAIVGNIGHFDNEIDMAGLAQIPGIVKDEVKPQVHTWKFPDGKVLIVLSEGRLLNLGNATGHPSFVMSNSFADQTLAQIELFTKPDEYPTDVYVLPKHLDEKVARLHLDSLGVKLTTLRPEQAAYIGVEVEGPFKSDHYRY

SEQ ID NO: 12588 - protein, 204 aa, Streptomyces avermitilis
MPRGRYSLHDPHDHTPLGEEHFHCAPGPSGWRYVSQLTTPSGDHAGSVDLALDDLGRPIRLELHAASWQVRGAALEGVTWVRTDPTGTHATEGNVRAHAFTGTSPAFLVATARLLRLTPSSAATRVRLVAFTDPVLAPRTVDQSWALISREAHATDNGPLTVDEYQVTALDTGEQHTVHISGDVVLAAPGIELEHLESPPSASA

SEQ ID NO: 12589 - protein, 335 aa, Streptomyces avermitilis
VSELVTGEAVALELRPAKLPSRALAVLLDLTVAVLAYVLVTIALVASTAGLDEAARFAVSAAAFVLVLVGGPIAVETLSHGRSLGKLACGLRVVRDDGGPIRFRHALVRGAVGVIEILMTFGIVACIASLVSARGRRLGDVFAGTLVVRERVPTGRAAFVPPPPPWLAGRFSGLDLSAVPDGLWLAIRQYLTRMQQLDPQVGWTMAERLAADLAACTGTPAPPEVPPAAYLAAVVQERQAREARRAFGAGAGMGEGVAGSAAPAVGGPVAQGPGAGHTAGRRLTVPADPSYPSLSSVQPATPTQPQAHARPHAPSSDPAQDKRPDRPATGFAPPA

SEQ ID NO: 12590 - protein, 335 aa, Streptomyces avermitilis
MDLDVYVSAHRAEWDRLDDLLRRRRRLTGAEADELVALYQRTATHLSVIQSSAPDPQLTGRLSQLVARARSAVTGTRRASWRDVTRFLAYGFPAAVYRARHWWVPTALLSTVTAVLLGWWIGTHPEVQSSIAAPSELRALTRPGGEYETYYSSHPAASFAAQVWTNNAQAAAMCLVLGIFLGLPVLWILFQNMLNLGVGLGLMSSAGRLDTFLGLVLPHGLLELTAVFVAAGTGLRLGWTLIDPGPRSRRTALAEEGRAALGMAVGLALVLFVSGAIEGFVTPSGLPTWARIGIGIAAELAFLTYVYVLGGRATRAGDTGDIEAAERSATVPTAA

SEQ ID NO: 12591 - protein, 436 aa, Streptomyces avermitilis
MALTGRAALLAALGTLPVGIWEPSWAGILAVNAPLALGCACDFALAAPVRRLGLTRSGDTSVRLGETVDVTLTVTNPSGRPLRARLRDAWPPSSWEPGTEVAASRHRLTVPPGERRRLTTRLRPTRRGDRQAARVTIRSYGPLGLFSRQGSHKVPWTVRVLPPFTSRKHLPSKLARLRELDGRTSVLIRGQGTEFDSLREYVPGDDTRSIDWRATARQSTVAVRTWRPERDRHILLALDTGRTSAGRVGDAPRLDASMDAALLLAALASRAGDRVDLLAYDRRVRALVQGRAARDVLPSLVNAMATLEPELIETDARGLTATALRTAPRRSLIVLLTSLDAAPIEEGLLPVLPRLTQRHTVLVASVADPYIAHMATARGNTDAVYEAAAAAQAQTDRHRTAEQLRRHGVTVVDATPDDLAPALADAYLALKAAGRL

SEQ ID NO: 12592 - protein, 330 aa, Streptomyces avermitilis
MMAPTTDNAGFAGDAGTARSSLEALRTEIAKAVVGQDPAVTGLVVALLCRGHVLLEGVPGVAKTLLVRALASALELETKRVQFTPDLMPSDITGSLVYDARTAEFSFQPGPVFTNLLLADEINRTPPKTQSSLLEAMEERQVTVDGTPRPLPEPFLVAATQNPVEYEGTYPLPEAQLDRFLLKLTIPLPSRQDEIDVLTRHAEGFNPRDLRAAGVRPVAGPADLEAARAAVAKTAVSPEITGYVVDICRATRESPSLTLGVSPRGATALLATSRAWAWLTGRDYVIPDDVKALALPTLRHRIQLRPEAEMEGVTADSVINAILAHVPVPR

SEQ ID NO: 12593 - protein, 379 aa, Streptomyces avermitilis
VWTRARGVVLALVILLAAAVAIAAIRSGDQHGRLDPRSADPYGSRAVAELLADRGVSTRVVTTLSEARTAAGPGTTLLIAVPDLLTHRQQSLLYAATESSGGRTVLIAAKSPSIGTLAPGVTADPALSFDSKLTPGCGLPAARRAGAADTGGIRYTTSVSHADSCYPSDGLPTLVRVPAASGNGDTVVLGAPDILYNDRLDEQGNASLALQLLGSRSHLVWYLLSLSDDSATDTGDRTFMDLLPSGWLWGTLQLFIAAALAALWRARRLGPLVPERLPVAIRASETVEGRARLYRKANARDRAAAALRSTTRTRLAPLVGVPVAQAHAPEALLPALSAHLRDDGQALHALLFGPPPRDDAALIALADQLDALEREVRRP

SEQ ID NO: 12594 - protein, 239 aa, Streptomyces avermitilis
VPALPRAAGTVVRTLLPSGDEPPVTIPRDPAREAARRELSKRMYHKNDPSLFERALNAFWDWVDRLFNAASTATPGGALGLLVIVLAVLAVGGALWWRLGTPGRAPLPAAALFEDRPRSAAEHRAAAEAHAAQGHWNQAVQERMRAVVRSLEERALLDVRPGRTADEAASEAGRTLPVHAERLRAAARDFDDVTYGGRAAGEGTYQRLAALDADVDRTRPVLMSNAHSTAHSARQGAAE

SEQ ID NO: 12595 - protein, 449 aa, Streptomyces avermitilis
MKDTPGWASPGSASSDGQEPDASGAAQPPEQPSDQSGADQSQPPSNWSKEQPPPGQWTAPHPQGPGQAPPPPPPGPGWGGRHPGGPGGHGGQSGAWGGPGYGGPGGPAGWGGNWGGPPPAAKPGVIPLRPLGVGEILDGAVSTMRMYWRTVLGISLAVAVFTQILVILLQGLVLDDSAGTDTLNDPSATVSELSRAMGEALLNSGVVLLITLLGTIVATALLTTVTSRAVLGKSVTTAEAWRDARPQLLKLFGLTFLLPLIGLAIIAVGALPGVLVVLAGATDAGASLAVLGGLAAAVCALWVMIRFSLASPALMLERQSIRKSMSRSAKLVRGSWWRVFGIQLLATIIANIVASIVVIPFAFLAAALSGDGISGILTSGTGGLGWTFLIVSGVGSVIGAMLTFPITAGVTVLLYIDQRIRREALDLDLARAAGVQDYGSTAPGTTAGS

SEQ ID NO: 12596 - protein, 382 aa, Streptomyces avermitilis
MADQYAQSGEDNRPTEIPAIRWDEPPEGPVLVLLDQTRLPAEEVELVCTDAPALVEAIRTLAVRGAPLLGIAGAYGVALAAARGFDVDEAAQALSGARPTAVNLAVGVRRARAAYRDALAGGGDPERAAAAALQAARALHREDAEASARMAEHGLALLDELLPGGGHRLLTHCNTGALVSGGEGTAFAVALAAHREGRLRRLWVDETRPLLQGARLTAYEAARNGMAYTLLTDNAAGSLFAAGEVDAVLIGADRIAADGSVANKVGSYPLAVLARYHHVPFIVVAPVTTVDPDTPDGASIEVEQRAGHEVTEVTAPQVPVAGAEAGGGIPVAPLGTQAYNPAFDVTPPELVTAIVTEEGAVSPVTASALAELCARSRQVTIS

SEQ ID NO: 12597 - protein, 229 aa, Streptomyces avermitilis
MMSFMKGRVLVVDDDTALAEMLGIVLRGEGFEPSFVADGDKALAAFRESKPDLVLLDLMLPGRDGIEVCRLIRAESGVPIVMLTAKSDTVDVVVGLESGADDYIVKPFKPKELVARIRARLRRSEEPAPEQLGIGDLVIDVAGHSVKRDGQSIALTPLEFDLLVALARKPWQVFTREVLLEQVWGYRHAADTRLVNVHVQRLRSKVEKDPERPEIVVTVRGVGYKAGPS

SEQ ID NO: 12598 - protein, 692 aa, Streptomyces avermitilis
MSRDSAASAPGQPGARSGRPVGRKMTGSRWGRFMEGGLLQGGVQGSPVLRLVMRWVRRPLLPVMRLWRRNIQLKIVVTTLLMSLGVVLLLGFVVIGQVRNGLLDAKVKASQSQAVGGFTVAGQRADSTASASGGDENAGAAGTPVQNVSGWMTDLVASLSSGGQGAFDVVTLSTRAADNENRGLGPRASGGVEPSLSVPEGLRKRVDAGLGVAQSYTRIVYTDHGREAQPALIIGKQVNDPNGDPYQLYYLFPLTQEEKSLSLVKGTLATAGLFVVVLLGAIAWLVVRQVVTPVRMAAGIAERLSAGHLQERMKVTGEDDIARLGEAFNKMAQNLQLKIQQLEDLSRMQRRFVSDVSHELRTPLTTVRMAADVIHEARVDFDPVTARSAELLADQLDRFESLLADLLEISRFDAGAAALEADAIDLREVVRRVVSGAEPLAERKGTHIRVVGDQQPVVAEADARRVERVLRNLVVNAVEHGEGKDVVVKLAAAGGAVAVAVRDYGVGLKPGEATRVFSRFWRADPARARTTGGTGLGLSIALEDARLHGGWLQAWGEPGGGSQFRLTLPRTADEPLRGSPIPLEPKDSRRNRGLNGAGLPLGGSGKLATVPVQPAGENAPPQMPPRAPMAPRLATATPTADPTALPGNGARVVPRPAGGARKQNDTPPASGGRSTQEPPESGSGQGEAFRGR

SEQ ID NO: 12599 - protein, 610 aa, Streptomyces avermitilis
VGAEGGGRRRALRLGAYVGCGAVLLTGCASMPDSGDLRGVESTPRQDAQVRVFAMPPREDAAPAEIVQGFLEALTSDDPQYETAREYLTGDASKQWRPYKSTTVLADGPNPEPERTRNRETGDDFAYTLTGSRLAKVDGQHAYAPDSGDYTGTVHLTLQRKTGQWRIDALPQGVVMGKSDFERNYKSVNKYYFASNVPAGTSGQLGTVADPVYVRGKVDPVTAMVTELLKGPTRWLAPVARSSFPTDTGLKKGVTSLAPDDQNKLTVPLNKKADRVGRAQCTKMAAQLLFTLKDLTPTGVDEVELQRSDGSTLCDLGEAEAESIASHGTGKSGEYEYFIDGEQRLVRLSGSSNGKDPDPVPGALGEGAKKLRAAAVSRDEVTAAGVSFDGSSLYVGSLVSGASLGEAVVHSAGTTEKDRLTTPSWDGGGDLWVADRDPAKSRLLLLQKGSGEPLEVRTPRLDGRIDAVRVAADGVRIALIVERDGKTSLQIGRIERETKADERADVSILELHSVTPQLEEVTAMSWAGDSRLVVVGREKGGVQQMRYVQVDGSTPSGSAPASLTGVQQIAASEDERLPLVAYSEDGIVRLSSGAQWQKVMKEGTAPVYPG

SEQ ID NO: 12600 - protein, 339 aa, Streptomyces avermitilis
LSQVRGHSRLPRHRPSPVWVTACGDGGRLSTGSCPQVWQDSAGIGTVVGMRGWWQDLTDLVLPAECGGCGKPRTVLCPECRAALHGAAPCRVRPEPEPSGLPVVHASAAYEGGVRAALLAHKERGALALAGPLGTALAGAVRAGLGSARPWCGDGPVRPGGGVVRESVLLVPVPSSRRVVRARGHDPARRIALAAAGELRRAGTVARVAAVLRQRRFVADQSGLNARQRLANLAGALEVAAGGARLLAGGGRVVLVDDLMTTGASLAEAARAVRAAMADTQVYGEGTRETTGERMVGATVTEPERTEAVRRMARTSDAGDGVRAAVVAASPDAFEINWN

SEQ ID NO: 12601 - protein, 286 aa, Streptomyces avermitilis
VPRVFCNHPHRWGGDLAHGGGGGGRHRVRGSGAHRGLVQKGDAPPGMRSDPGTEFCVDIVVKGRKTEVPERFRKHVAEKLKLEKIQKLDGKVISLDVEVSKEPNPRQADRCDRVEITLRSRGPVIRAEAAASDPYAALDLAADKLEARLRKEHDKRHTRRGAGRLSAADVADTVPGAATLNGSGGIVSEAESDGIPTKKIGSLEVKGEGPLVVREKTHVASPMSLDQALYEMELVGHDFYLFVDSETKEPSVVYRRHAYDYGVIHLSTDPMVAQAQSADAGGALGG

SEQ ID NO: 12602 - protein, 248 aa, Streptomyces avermitilis
MADSFGPMRDDDADGGVVGMGPDADSPGKEPIRVLVVDDHALFRRGLEIVLAAEEDIQVVGEAGDGAEAVDKAADLLPDIVLMDVRMPKRGGIEACTSIKEVAPSAKIIMLTISDEEADLYDAIKAGATGYLLKEISTDEVATAIRAVADGQSQISPSMASKLLTEFKSMIQRTDERRLVPAPRLTDRELEVLKLVATGMNNRDIAKELFISENTVKNHVRNILEKLQLHSRMEAVVYAMREKILEIR

SEQ ID NO: 12603 - protein, 400 aa, Streptomyces avermitilis
MPSLPRPTAELSADDARRIALRAQGFLGAPDRRAGVRGVLRHLGAVQLDTISVLARSHELIPYARLGAVGRKTVERAYWTTASADASPAHPHAFEYWSHAACILPIEEWPHFAFRRRAYRARPHWNHELPDGTYDQVIKQLRTEGPLTATELGGAKKTSEWWDWSGTKVAVERALMYGEVVCVERRGWKRVYDLAERAVPKTLLHDELDDTECLRRLVRLAGQSLGVGTRADIADYHRLKGEQFDAVIADSGLVPVAVEGWSKPAWADPAALETAPRGRHRTTLLSPFDSLVWERARTERIFGFTHRLEAYVPKPKRIYGYFAMPVLAGGQLIGRVDPAREGSTLVAKQVTLDGPTAVPGVAQALVEAATWVDCTDVRVERVDIPELREPLVRELARTLG

SEQ ID NO: 12604 - protein, 189 aa, Streptomyces avermitilis
MEPATLTTDRLVLRTVGTQDTDAVYEAAQDPEIQRWTTIPSPYLPEHAASFTDQLVPEGWANGSMFTFGVFLPSGELAGMLALSMRALGVSEVGFWATKEHRGNGYITEAVLAASHWAFTRMSIDRVEWRAQVGNTGSRAVAERAGFTIEGTLRSAINNKGVRRDCWVGSLLPSDLGLPSTAPYLPTPR

SEQ ID NO: 12605 - protein, 939 aa, Streptomyces avermitilis
VSVLSKIMRAGEGKILRKLHRIADQVNSIEEDFVDLSDAELRALTDEYKQRYADGESLDDLLPEAFATVREAAKRVLGQRHYDVQMMGGAALHLGYVAEMKTGEGKTLVGTLPAYLNALSGDGVHLITVNDYLAERDSEMMGRVHKFLGLSVGCILANMTPAQRREQYGCDITYGTNNEFGFDYLRDNMAWSQDELVQRGHNFAVVDEVDSILVDEARTPLIISGPADQATKWYGDFAKLVTRLKKGEAGNTLKGIEETGDYEVDEKKRTVAIHESGVAKVEDWLGIDNLYESVNTPLVGYLNNAIKAKELFKKDKDYVVIDGEVMIVDEHTGRILAGRRYNEGMHQAIEAKEGVDIKDENQTLATITLQNFFRLYNKLSGMTGTAMTEAAEFHQIYKLGVVPIPTNKPMVRKDQSDLIYRTEVAKFDAVVDDIAEKHEKGQPILVGTTSVEKSEYLSQQLSKRGIQHEVLNAKQHDREATIVAQAGRKGAVTVATNMAGRGTDIKLGGNPDDLAEAELRQRGLDPEEHIEEWAAALPAALERAEKAVKAEFEEVKELGGLYVLGTERHESRRIDNQLRGRSGRQGDPGESRFYLSLGDDLMRLFKAQMVERVMSMANVPDDVPIENKMVTRAIASAQSQVETQNFETRKNVLKYDEVLNRQREVIYGERRRVLEGEDLQEQIHHFMDDTIDAYIEAETAEGFAEEWDLDRLWGAFKQLYPVKVTVDELEEAAGDRAGLTAEFISESIKDDIHEQYEQRETQLGSEIMRELERRVVLSVLDRKWREHLYEMDYLQEGIGLRAMAQKDPLVEYQREGFDMFTAMMDGIKEESVGYLFNLEVQVEQQVEEVPVEDEKPSLEKEDAVPAQAGARPEIRAKGLEAPQRPDRLHFSAPTVDGEGGIIEGDFSSDDDEEPVRSEADGLTRAERRKQSKGGRRRKK

SEQ ID NO: 12606 - protein, 89 aa, Streptomyces avermitilis
MLRHTAGRAYDELAWLAERGPLRARGTNPVVRDIGYYVPRPGAIEAFARIGAGDQLRAMAFRLEYGPDNRWRCTAVELGGPRMPHMDDD

SEQ ID NO: 12607 - protein, 171 aa, Streptomyces avermitilis
MRVYVPLTLSGLAEAYKTGELGAGPFVAYAVTPALREWYLSEDIEELEYAALNRAALASLRLLAADPGAVRRRVVVAVDVADGAASADPDLGLDPAALGEVRVAGAVPLAKAAAVHVDSGDAEADVTAAVEALAAADGGDDAAQFVVDGAEDHELLWYARQEIPNLVGLEG

SEQ ID NO: 12608 - protein, 224 aa, Streptomyces avermitilis
MGMHGAAHIVWDWNGTLFHDNAAIIGATNAAFAELGLEPITLERYRALYCVPVPKFYERLIGRLPTDAEWEIMDEIFHRYYAEHRVGCGLTEGAAELLVEWQSAGHSQSILSMYVHDELVPLVRGFGIEPHFIRVDGRTGPSGGSKAEHMVRHIGALAGVAGVDPARTVVIGDAADDAVAALHVGAQAVLYTGGSHSRASLEGVGVPVVDTLAEAVEEAGRLAA

SEQ ID NO: 12609 - protein, 1645 aa, Streptomyces avermitilis
MQTKLDEAKAELLERAARVAENSPVGGHLPTGTTGDGIPDRDTVLAFLRRYYLHTAPEDLADRDPVDVFGAAFSHYRLAENRPQGTANVRVHTPTVEENGWTCSHSVVEVVTDDMPFLVDSVTNELSRQGRGIHVVIHPQVVVRRDLTGKLIDVLAPPPAGELPHDAALESWIHVEIDRETDRADLKQITADLLRVLSDVREAVEDWEKMRDAALRMAEELPKEPTADDLRDQEVEEARELLRWLSADHFTFLGYREYELRGDDSLAAVPGTGLGILRSDPHHAGDDSHPVSPSFERLPADARAKAREHKLLILTKANSRSTVHRPSYLDYVGVKKFDENGEVIGERRFLGLFSSAAYTESVRRVPVIRRKVEEVLKGAGFSPNSHDGRDLLQILETYPRDELFQTPVDELRSIVTSVLYLQERRRLRLYLRQDEYGRYYSALVYLPRDRYTTGVRLRIIDILKEELGGTSVDFTAWNTESILSRLHFVVRVPQGTELPQLSDADKERIEARLVEAARSWADAFAEALNAECGEERAAELLRRYGNAFPEGYKADHTPRAAVADLVHLQKLTSDQSKDFALSLYEPVGASPSERRFKIYRTGEQVSLSAVLPALNRMGVEVTDERPYELRCSDRTTAWIYDFGLRLPKSASGNGDSLGDDGRERFQEAFAATWTGEAEIDGFNALVLSAGLNWRQAMVLRAYAKYLRQAGSTFSQDYMEDTLRNNVHTTRLLVSLFEARMSPDRQRAGVELTDALLEELDAALDQVASLDEDRILRSFLTVIKATLRTNFFQEALGGKPHEYVSMKFDPQAIPDLPAPRPAYEIWVYSPRVEGVHLRFGKVARGGLRWSDRREDFRTEILGLVKAQMVKNTVIVPVGAKGGFVAKQLPDPSVDRDAWLAEGIRSYQTFISALLDITDNLVAGEVVPPADVVRHDEDDTYLVVAADKGTATFSDIANEVAESYNFWLGDAFASGGSAGYDHKKMGITARGAWESVKRHFRELGVNTQTEDFTVVGVGDMSGDVFGNGMLLSEHIRLVAAFDHRHIFIDPKPDAATSYAERRRLFELPRSSWADYNTELLSGGGGIFPRTAKAIPVNAHIREALGIEAGITKMTPADLMKAILKAPVDLLWNGGIGTYVKASTESHADVGDKANDAIRVDGADLRVDVVGEGGNLGLTQLGRIEFARSGGRINTDAIDNSAGVDTSDHEVNIKILLNALVTEGDLTVKQRNKVLAEMTDEVGHLVLRNNYAQNVAIANALAQSPDMLHAQQRFMRHLVREKHLDRALEFLPSDRQIRERLNASQGLTGPETAVLLAYTKITVSDELLGTSLPDDPYLQSLLHAYFPTALRTKFREQIDTHALRREIVTTVLVNDTVNTGGTSFLHRLREETGASLEEIVRAQTAARAIFESSAVWDAVEALDSQVDADVQTRIRLHSRRLVERGTRWLLNNRPQPLQLTETIAFFKDGVKQVWDELPKLLRGADQEWWQKIYDELTAAGVPDELATRVAGFSSAFPALDIVSVADRMGKNPMAVAEVYYDLGDRLSITQLMDRIIELPRSDRWQSMARAAIREDLYAAHASLTADVLAVGNGTSTPEQRFKAWEEKNAAILGRARTTLEEIQGSDAFDLANLSVAMRTMRTLLRTHS

SEQ ID NO: 12610 - protein, 162 aa, Streptomyces avermitilis
VNLSERRPQVAHRAAVIPAPPPASARLRKLALEVARFGVVGGSGVAVNFLVFNLALHGMKWAPMAATVLASVIAMGTNYIGFRCYAYRDRASRTRRQIALFFAFSGLGVVMESVLFYVGYHGLGMSGPIGSNLAKALSIVLASAFRFLVYRTWVFQHDARRG

SEQ ID NO: 12611 - protein, 498 aa, Streptomyces avermitilis
MRVAVRASLGAVRTSLWAAVPLLVVLLLLVIVRLPWNGDLGMHAATVERLRHHLLDPGNPLVDADTPSPYYSPWTVLLGCVAKVTGLSVFVVLRLGAVVGLGLLVTGIWRYARTLSGHRFAPPLAVLCVLFLWGTQLFNWSGFLGLNSLALTVAYPSVFALGLAFHFWALLTRALKASPDAGWEVYLGLGLLWAVILLSHQFTGVVASLGALATVIGARVGRHVWLRLGAAAAVGVLLLVVWPYYDFFALFRVGGLEDIHRALYRDLLARYGLALVGVVALGVRARRDPRDPLVVFFLLGAAVFALGGLTGHYSWGRVLPAALIPAQVAAAVEVAGASRGAVRAAGAVVLACALAVGVWTQIGTLGYVVGRGALPEAVAAKYREPWAGYHWITPWVRYGDVVLAKTFPSRQIPAYGAYTVAPGYPDFFLSDEARREAAVRRYFAAGSSRDERLGVLREYGVRWVVQRPGDGGLAAGGGPGLRRVAAGPGGQVLYAVVR

SEQ ID NO: 12612 - protein, 566 aa, Streptomyces avermitilis
MTTTPTTPATPTTPNAPTPDVTITVIVYNDAERLPRAVASLLRQTHPAIEIIISDDHSTDATPSVARELEASDPRIRYLRLPENSGGCSAPRNRALEIARAPYLMFLDSDDELPENAVALLLAAHREREVDFAMGAVERIRVDTGHRSTWMAHLVDERRTVDGIEAEPGLLFEHLATSKMYTRDFLDRHALRFPEGIHYEDQLFSAQAYCLAKSFTVIPQPVYRWYIAPYVAQDAASISNQRHKLSNVSDRIHVQTLIDDFLAESGHESLRQDKDYKFLKHDFRMYAGDLPYRDEDWLTGFARIVTPYLETLSPGAYALLPRAERVVLQLVRDGRLSEAQLAARGLGHSVAPRETTADDSGCLYWGPRLPSSDWARRELDVTELGLDSRPFPSAQFRHEITSVTPGRGMTVDLTIRTYDPGLRLPVGPQRASVVVAPGRRRLMVPFRLDPVRPGVFEGRVRVDLAAAPLPVQGFDGVRHPLLRLEQQGLANTGVLLAPLTFPTLRATRPGSLRHEVTVEPEGKAAGRLQIRWRPVGVTARVAGPVARKVAGPRVRRAARLVRSALR

SEQ ID NO: 12613 - protein, 740 aa, Streptomyces avermitilis
VQPGLSVIVHGPNEQGHLGELLDSLGAQPFAAAEVVVAAVGDWARQEAERHAARDPRIVPLALPEGTGEGAARAAGAARATGRWLHFVHARDGLPAGALRMVADATADAPDTADLVVFDHIRSSWNKTGAPSGDGWIFARTGRRSLDLAGFPNLLHLAPLLGNRAIRADFWRDHDLADEAFAHDESYLAQATLLHARQVACLDQVAYEVRQLRAQSLPPVGAEERYAVVSRHEALQRLAAGRDLAERPRAVLYEVMVRECLRTFARSGMPEPVAREFFRRASRAAVQWRPRNHRRPAGFEGIRRSLLEENAYAKYRAFQAANHKRRDLKSAVVARKRRVGAKLSDHHYRRALSGPVDPGLAVFSAYWDRGVSCNPAAIAAKLAELAPHIHPVWVVARNKAALLPPGTDHIVPGTRRYWEVMARAKYLVNNVNFPNSVVKRPDAIHLQTHHGTPLKRMGLDQREFPAASKGLDFGALLARIDKWDYSVSANSHSTRMWERAYPSHYISLDHGYPRNDVFYSATADDIRAIRDRLGIPPGRRAILYAPTHRDYEAGWTPRLDLASLADRLGEETVLLVRGHYFYGGAASPLAGLRRSGRVIDVSTYDPVEELCLAADALVTDYSSIMFDYANLNRPIVIYADDWETYAKTRGVYFDLMAEGPGQVTRTQDELAAVFESGAWRDEGARKALSAFRRRFCEFDDGRAAERVVRRVFLGQSEEALPSVIPVDERTPAPSPEEAAR

SEQ ID NO: 12614 - protein, 329 aa, Streptomyces avermitilis
VAENTENTTSTASTATTATTEKIPTVIADGVDVVYRVNGTGAGRGTATAALNRMLRRGQAEKAAGVRKVHAVRNVSFTAYRGEAIGLIGTNGSGKSTLLKAVAGLLPVENGRIYTDGQPSLLGVNAALMSDLTGERNVHLGGLAMGMSREQIRERYQEIVDFSGINEKGDFITLPMRTYSSGMAARLRFSIAAAKDHDVLMIDEALATGDRSFQKRSEARIRELRKHAGTVFLVSHNNKSIRDTCDRVLWLERGELRMDGPTNDVLREYEAFTGGTDKTTKTTRTAKTPKLPNPTKEPKESMQPESPKSLKSPKQEQTQPKAENASLPS

SEQ ID NO: 12615 - protein, 319 aa, Streptomyces avermitilis
VSQALHTPPSPPSTGATTPTGATGATAAAPAETPAQLAARYGLAVSGARPSLPGYLRRLWARRHFITAFATAKLTAQYSQARLGQLWQVANPLLNAAVYYFIFGILLSTKKGVPDYVPFLVTGVFVWTFTQSSIMAGTRAISGNLGLVRALHFPRAALPISFALQQLQQLLFSMCALVVILLCFGVPLSFSWLLVVPALALQFMFNAGVAMIVARMGAKTPDIAQLMPFLLRTWMYVSGVMWSIEKVMHNKDLPHAVLLALQCNPAAVYIDLMRFALIDSFHADQLPPHVWAVATGWALLAGVGGFIYFWKAEETYGRG

SEQ ID NO: 12616 - protein, 212 aa, Streptomyces avermitilis
MLVRMTTNADASQVTPRRRAPAGAAVLREDVTEAIRAAVFEELAAVGYARMSIEGIARRAGVGKTAVYRRWRSKLHLVLDLVSAVAVQGLPAPDTGSLEGDLRLLYEVTSRALRHPVAGQIIPDLQAEAARNPDIAEAMQKALREGQQSVASGIVAAAAERGEIREGIDTELALDVISGPLYWRAVVVRGPKLPMGYLPSLARATAAALKAL

SEQ ID NO: 12617 - protein, 351 aa, Streptomyces avermitilis
MTAADAHPPHNVRAPGPTAHDATAPAPPRVTAAGPAPHDITAPDFTPHAVATVLGSAVGDALGAPFEFGPGGAFSARFPRAGHGSEMCGGGGWDPGEATDDTQMAVLVGESLLECGGLELPDIFRRFQRWAAARPKDIGLQTEDVLTNGEPWDRAAALHFQVNQRAAGNGALMRAATSAVHFAGRGRDATMDAGRRIAALTHGDRAAWEGTAIFHEVVRVALAGGDPLTALPDTLAAVHPDHRARYATVLAPDWHPDQATEFNGAVWPCLGSAVWALRTTDSYEEALRAAVDIGGDTDTVAAVTGGLAGAVYGPDAIPRRWTEPLHVPLPGFGDRVLGAAELAGLARRLAA

SEQ ID NO: 12618 - protein, 207 aa, Streptomyces avermitilis
MATQTRRYHHGDLRAALLTRAEETLRERGPAALSLRELARDLGVSHAAPSRHFKDKQALLDALALTGFGRLAASMAASRESAGETFAERLATMSRAYVDFATANAELLDLMYSIKHDPQASEALVTASQQWAEQLVELIGAGQRRGEVREGPLERVGLPIFATLHGYASLAVSGMLPADAVEHGLADVIAHMLRGCAPDQAAAPLVP

SEQ ID NO: 12619 - protein, 322 aa, Streptomyces avermitilis
MPKTQSGTSNRTRSTTAGGSARGKWNAGDIPDQTGRTAVVTGANSGLGIATVEALARAGAHVVLAVRDLERGEAAAAGVHGSVEVRRLDLADLASVREFAAGWQGDLHLLINNAGVMNIPEASTKDGFEMQFGTNHLGHFALTNLLLPRIKDRVVTVSSGAHRMPGSPYIHFDNLNLTGEYAPLTAYSQSKLANLLFTLELQRRLAEAASPVRALAAHPGWAATNLQSHDGSALRRALMRVGNRFIAQDNRAGALPTLYAAVQDLPGASYVGPDGFGEMRGGPTLVGRSAAAGDPVSARRLWTASEDLTGVTFPRLTAAVSA

SEQ ID NO: 12620 - protein, 326 aa, Streptomyces avermitilis
MTWLITGGAGYIGAHVVRAMREAGDRAMVYDDLSTGIAERVPDGVPLVVGSTLDGGLLRRTLAEHAVTGVVHLAAKKQVGESVELPLHYYRENVEGLRVLLEAVTDASVPSFVFSSSAAVYGMPDVDLVREETPCVPMSPYGETKLAGEWLVRATGRATGLSTASLRYFNVAGAATPELADAGVFNLVPMVFEKLTEGAAPRIFGDDYPTPDGTCVRDYIHVVDLAEAHVAAARALEASPGAGLTLNIGRGEGVSVREMVDRINALTGYDTPPTVVARRPGDPARVVASADRIAVELGWKAKYDVQDMITSAWEGWVRLHPGATRG

SEQ ID NO: 12621 - protein, 531 aa, Streptomyces avermitilis
MPPHASQVSVVVIGYDDAAHVTDAVRSALAQGPAVREVIAVDDCSSDGSPGLLDALAVEDTRVRVLRREVNSGGCGTPRNDGIDAATAPYTMFLDSDDMLPPGAVEALLAAADRHGAQVAAGLCVRRELPSGREVPWQPELYTEPALVPHPARLRRLVHDTLCVNKLYRTDFLREHAIRFPDGRFPYEDFVFSARVLAAGPRMALVPDTVYVWHVRRSAERLSISLDRAGIDNWQARMAAAAQAYDILLGAGEKRLARAARAKFLDHELRMYTRELDLRGTEYRREWWTLTRAYLSAFDAAEFALAPAPGRVIARVVLAAEEPRDLPRLKELAARPARLHPPYARAADGTPVWSADLPQVPLDHVLVRPMHLLPVAVDAELRPRARGTRLRLRLHELYGRVADAGPASVNLEFVHREGGRVGTAATAPLLADPEFDTWSAEVPVDLAALGSGTWDLRLTLRFHDGTSRDTTAHAVAGPGLLRRGVVPSGRHGVLLVQPYATHSGALALRVATGIQGVTSVMGRRLRRLLHW

SEQ ID NO: 12622 - protein, 422 aa, Streptomyces avermitilis
MRTLKRHPLLLLGAAWLATRALMLWLLTHERLALLGRGGVSSEVRNLYFRWYGVLSHGTYPAGDHLWQYPPGAGPVLLSPALLPALTYFQAFVVLTLLTDAVIMLFLARAGTRPGGRSLHGAALWTAGLPLLLHLPLARYDVQVTAFAVISLLTLSRSPRACGAFAAIGALVKVWPALALIGTPTGRTTRRAWTSAAVTGAALLTLLTALFRNPFDFLLQQGGRGVQIESLGGTALAFARRAGWPGRARYQFGAMEFAGPHVRAVAAVSLGLTVAAFGLLLLWRLRARRWTPATPYDAALAAVLLFTVTSRVISPQYMVWLIGLAAVCLTSRHTTQRPVALLVLAASAASTVAYPAYYGEVINSTWTGCLLMLLRNGLLATAAGLSFVRLWRATTKDPESGTPRPELRPDPVRLPHKTLTAS

SEQ ID NO: 12623 - protein, 520 aa, Streptomyces avermitilis
MSSLCKDRPPVARTCTRTRAEVASALLPVPVHVLVSVLAPVLVMLALGLWGLDRGGMWRDEAVTFEVAHRSVPQIWRLLHGVDAVHGLYYLVMRTVLSGWAAFARPDEVVLRLPSVLGAAATAGLVAALGVRLCRPRVGLWAGLLYAVTPMAGHYAQEGRSYALVSAGVAGSTLLLVRAVRGGGWWPYGAVAGVTCVLHEFAVLALLAHACALALARVRGRVWRAWGCAVGGVAVVLLPVVVVSQGQAAQVAWLAVPDLGAAGRLLEGFAGAPGLLLVPCLVLAGVGVRRGPRGELSLGGVALPLVAVPPVVLLAVSQVRPLYDERYVLYALAGMPLLVASGADRVAGVMGRLRAGGHFAPARTPLLGVLAIALVLASRLPVLQADRSADRRPDNLAAVSRVAGRETRPGDPLLFLPAFGRRAALTYPDDFRRTRDVALSVPAPVDGSLYGREVGADELRRRLGRLDRLWVVAQTYALRPGWSSRSPVERLKRAVLDEEFVPRAEFVQKGSTVRLYVRRP

SEQ ID NO: 12624 - protein, 167 aa, Streptomyces avermitilis
MSAIPTPSTEAPADENYLRLDRQICFSLNAASRAFNGVYRVVLKDLGLTYPQYLVMMVLWEHGALPVKKVGEHLRLDSGTLSPLLKRLETAGLVRRERSAKDERSVYVHLTEEGTALRERALLVPVRIATATGLGLGEIEDLRTRLDRLTTALDEAALEETPGCAQG

SEQ ID NO: 12625 - protein, 137 aa, Streptomyces avermitilis
MDALYTAVATATHGREGRAISSDGKLDVQLAPPAELGGNGQGTNPEQLFAGGYAACFASALGLVGRQAKVDVSDAAVTAEVGIGKQGEGFGLKVTLRIELPDSVDEATGRKLVETAHQVCPYSNATRGNIEVELVVE

SEQ ID NO: 12626 - protein, 440 aa, Streptomyces avermitilis
VRALPRPTRTNARTWVVVLAAVFAVLQLANVTGRDTPDTKNYLSYALSLRGDSKRESAATAIDYVCAGRASAARREQSVDVNRFQAPNPTRRVTEKCRRDLWAGVDRRLRAGQTSGHIAPFTSERFMRIFEARPGYPMLLLPFVTVFGVTWGIWLSSVLVTVAGGVLAFLILRTLRAPTGVALTGQALFYVLPCGTTAMRPMTEGLLLALTLVALWGCALTLRGNRPGTGVLLVTAALVLLFAVKHSQALFLALCLAGACAVVGVRRRGRGRLPGQPLVVLGAVAGCAVAGILLAAQALHYPSESESVQDLLTDHFARPDRARPWPEFLGLEGNFWLEWLRRQFWEPLFLTSLVASAWGALKQRPAFGVFLLAAAFTGLVTHAAHPDITVYGGRLIVMAWLLPVVGLPLLLERAVRVWAPPGAVPVPRPLMHESGTHSMR

SEQ ID NO: 12627 - protein, 732 aa, Streptomyces avermitilis
VPRFSIIVPVFKVQGYLRECLDSVLGQSYRDLEVIAVDDCSPDGCGAILDAYAARDPRVRVLHLPENVGLGRARNAGMPHATGDYLFFLDSDDTLTPGALRALADRLDELPGPDGPDVLVFDYARTYWWGGTRRNVLARVLAEAGAGTFTAAERPEILDLLMVVWNKVYRRDFVEKHGFRFPPGYYEDTPWTFPTLLGAERIAVLDRICVAYRQRRTGSILSTTSRKHFDIHDQYERVFAYVDSRPELSSWRPCLCHKMGEHCLDVLAKPDRLPESDKEEFFRRTAELFRKHKGGPTPPGLRVLEGGFTRYRAVRAARSLDLRARQVRAAAVVRLKRGWSNVHGHRPLDPHLAVYSAFSHRGVLGDPAAVHRAARELAPHIRGVWVVRADQVPSLPPGVEYVVPDSLRYHQVTARATYFVNNVNWPGTLAKRPGSVHIHTHQGTPLKYMGADLLHKPGARHGLDVPQMLRRADRWDYSLVANRHSELVWDRAYPCRFTSVRTGSPRNDVLVRARPGDGADVRARLGIPAGHTVVLYAPTRRDYVRGGHVDRIDLARFAEDLGEGHSLVVRLHPSLADGPARGMGLAELHRRGVLVDATTEPHVEELMLASDVLVTDYSALMFDYANLDRPIVIHADDWGTYTASRGAYFDLTADAPGHVTRTHRELAWLFACGGWRDEESAALRAGFRARFCEFDDGRAAERVVRTLMLGEQDLPLPVPAPAQAARDLLASS

SEQ ID NO: 12628 - protein, 729 aa, Streptomyces avermitilis
MPRFSIIVPTHDVAGRLSRSLDSVLTQSFGDFELIPVRDAPGSPAGAVVAEYTGRDARVVPVVSPPSGGLSAARNTGLAAATGTYLLFLDGDDVLAPGALAALDARLKETGEVDAVYFGHERVHWWEAEKTNTPPLGRAPHGAFAPAEAPHLTGVTLPAWSAAYRRAFVTEHRLAFPAGLFTDIGWGGLVTLAAERVALLRSVCVRHLLRRQGSRLAVPGEHQLELLDQIDLVLTRAAELGLPAYRSGPLFGQLFAAVLKTAARPERLPARRRRAFFRRAGRLYRRHRPAAFQPPPGSVGVQHRLLAAGAYSAFWALRGANRSVAKAAERIPRPRMPRTRTRYALGLRRPLDENLAVYCAYWGRGYACNPAAIHAKARELAPHLRSVFLVEADAVGELPPGVEHAVIGSQGYWDVLARAKYLINNANFADGVVKRPGSVHLQTQHGTPLKKMGVDQSTYPVVAAATGSFAKLLTRVDRWDYNLSANRHSTEMWERAFPGTWEALEYGYPRNDVYYTATADDVARVRRELGVPDGKTALLYAPTHRDHSAGFEARLDLEAFCEALGEDFVVLLRAHYFYDEGDRGGGGRIIDVTRHRSSEDVCLAADALITDYSSIMFDYANLDRPIVVYADDWEVYRETRGVYFDLLEGPPGHVARTPEELAGLFADGSYADAGSAVLRARFRERFCQFDDGRAAERVVRRVLLGQPPQAIPPVVPLAERTPAPALVRS

SEQ ID NO: 12629 - protein, 778 aa, Streptomyces avermitilis
MPAPTHGCPLPRFSVIVPAYKVQAYLHECLESVLEQSFPDLELIAVDDCSPDACGAIIDEFAARDTRVRPVHLPQNTGLGRARNAALAEATGDYLIFLDADDSLTPGALQAVADRIKETSEPDVLVYDYARTFWSGETVRNREAGQLTEQGPAPFRLDDRPGLLNVLMVVWNKAYRREFVEREGFTFPPGLYEDTPWTYPALMAAETVATLDRVCVHYRQRRRGNILGTTGRGHFDIFGQYDRVFAYLDGHPELAHWRPVLFRRMVDHVATVFTRRGRLPRGSHAEFLRRARAHYRRHRTPGPPARPRFRLRHVLVRLGSHRTYRLLSLASRTRVRTARSATAVLGRLAGVALQAHYRLQRRLPVRADRAVFASHQGQGHGCNPGALEAAFRTLAPHIRTAWIARPEHHHTVPAATRRVRPGSAAYWTALARSKYLVSNADFDRRLRKRPGQIVIQTHAGTPLKRMGLDLQDRPAAARDTDFAQVLRGADQWDYCLSANRHSTLVWERVFPSGFTTLEYGQPRNDRFQQATSADVTRLRESLGIPHGSVAILYAPTYRDYRRSQRHLLDLERVLRQLGPRYVVLTRAHPSYGAPLTRSDGARLIDVSGHPSVESLCLASDALVTDYSSLMFDYANLDRPIVVYADDWEAYEAARGTYFDLRAFPPGAVARTEEELIDIFATGHWRGSRAAQLRAAFRARFCPYDDGRAAERVVRRIVLGEGAREGERNSEGDGGATGLPPVVPLAGRHPVPSAAAALARPPLATVPHPAGPVPVVDSP

SEQ ID NO: 12630 - protein, 293 aa, Streptomyces avermitilis
VSALDTSVRAKRSLAARVASGAAGGVLRVFLLLVALFWLVPAFGLLVSSFREPTDIAASGWWKVFTAPSQLTAKSYRSLLENGDVTHALFNTVWITVPATLLVVVIGAMAGYAFAWMDFKGRDWWFMVVVALLVVPVQVALIPLSDLFGKVGIFGDIIGVVLFHVGFGLPFAIFLLRNFFAEIPRELLEAARLDGAGEARLFATVVLPLGAPAIASLGIFQFLWVWNDMLVALVFSDSSSQPLTVALQQQVRQFGSNIEILAPGAFISMVIPLAVFFAFQRQFVSGVMAGAVK

SEQ ID NO: 12631 - protein, 426 aa, Streptomyces avermitilis
VTGTRLWVAVLFLLPALVLLGALVVYPIGYSVWRSLYDADGSGFVGLQNYGEIFTDSRTLTAVRNTAIWVAVAPAIVTVLGLIFAVLTERVRWGTAFKLIVFMPMAISMLAAGIIFRLVYEQDPNQGVANAVVTSVHDAFVDSSVYPKARPNAQVSDLKASSGGSFTTTGTVHAGTPALLPLVGIAPNRLPGTPADAEEPSGSGVTGTVWLDFKLGGGGTKGKVDPGEKALKGVTVEAVKDGTVVASARSGADGTFSLPDRADGARLRLPGSNFAAPYNGVDWLGPTLVTPAIIGSYVWMWAGFAMVLIAAGLAGVDRNLLEAARVDGANEWQVFRKVTVPLLAPVLVVVLVTLMINVMKIFDLVYIIAPQPTQDDANVLALQLFLSSFGGGGNYGVGSAIGVILLLLVLPVMFVNLRRLRKERER

SEQ ID NO: 12632 - protein, 463 aa, Streptomyces avermitilis
MNGAIMRSTARTRRSAQAAAAVVSAALALTLTGCGSSDKKSDDTTESSGGKESGATVQLPKLDGQTLEVAAVWTGPEQKNFTKVLDEFEKRTGAKVNFVPTGNNTSTFLGTKIEGGKPPDVAFLPQVGVLHQFADKGWLKPLGADAQAQLDKNFSTGWKDLGAYKGKQYGAYVKAANKSLVWYNTQAFDAAGITRMPKTWKDFLATAQTLSDAGSPAVSIGGADGWTLTDWFENIYLSQAGPEKYDQLAAHKIKWTDPSVKEALTTLAQLWGKDDLIAGGRSGALQTEFPKSVTQTFSGDTPAAMVFEGDFVTANINADTKAKVGTDAKVFPFPAAGAKAPVVSGGDVAVALKGGAGAQALMTFLASTDAAEIWAAQGGVISPNKAMDTATYKDAVTRDIAKALLAAGDDFRFDMSDQAPAAFGGTQGVGEWKDLQDFLKNPKDVAGTQRKLEADAAKAYKNS

SEQ ID NO: 12633 - protein, 1422 aa, Streptomyces avermitilis
MQIRLTVVDPLGPPSEPRARAASCDVLVTAPAGTALAAVASGLASAVAGDGGAAQPERSRESGGGPVVLYAGAERLDAQRCTLGEPPLTDGAVLSLGAPVEPGPDVAAVTAELHVVAGPDAGGVHLLHGGQIQIGRSADADVPLDDPDVSRLHCAVTVAEDGRVSVADLGSTNGTTLDGRRVGDRAVRFAPGALLRLGESALRLAPPGGVEAVGTAPDGEGHVRVTDGGAPGLGGFRLAWGPGGARGLPEVRRPVWAVPHARGGGGAGRGAPSGGASAAASGDGRPSGETHHAFGASAWGAAGGAPSAPAGGAPGAQEHGPVEPRFPAPVVPGQGGAPRIESRRTPESGGTGPDGRPVAGPGGASAGRPRDVPGADTRDLRGGNARDVPGRDPRDLPGQGPGEGRDRGRREVPGQGPGGVPGHGHGEAHGRGPGEGHGRGPGEAHGRGRRDAPDRGPGDVPGRGSGHDSGGVPGQGPGDGHPLGSAEGPDRGPREGYGARPGEVPGPDDLRGGIPGAGPRKGTPLRGTDVPQGARRRGGFSAWARRLTGGRGEPAGDGPQAYDEDTARVPEPAVTGAQAPEKWPDPAALLLTALGPGPRLWERGPGHPEALTVRLGTADRTAPDGSGLLPAVPVTAGLREAGALGLAGPRARLAGLARAVVAQLAALHSPDTLEIVLISGDRSRPVEERTAEWSWLGWLPHLKPAHGQDCRLLLAYDRDQTAARTDELLRRLEDHLADTDHTRNAPQDLPRPADTPDTALRGGARRPSWARDDQQDGDDTFTGPYTVVIVDGDPGGADVREAVVRLVQDGAQAGIHVICLAETAAASPSSPVTETYEAACAVSPAFRECGAVALLSGDVATALRLLRVAPGEPPRHAQEQGQEQGQEQGQRQGQRPTTDHARGPATGQSQGPDAGHTRDTAATRGRHGSAGAGAPRPRSGPGADERTHHDHTGRALRDSLDRAPAGRADHGSATRAHRGPVGHGTVAAVDAVSSAWAERFARALAPLRTDGSGDRHARVSAPLPQAARLLDELGLARATPASLMARWADAADDPETRGGRAAAVLGAGPRGPVGVDLVAEGPHLLIEGPAGSGRTELLRALAASLAAAERPDRLGIVLIDGRDRGAHGAGAGDGLRVCTDLPHVTTHLAANDPVRMREFAQSLSAELKRRAELLGRLGFAEWHAQRAVPARIVPQRTSRIRPAPRDPGTSGAPGAPGAPGTSDPAGAADLDTPPSSTLRLRPAATRERTESGPPARLVVVVDDLDALLSPALGSPGRPAAGSVVRALEAVAREGERLGVHLVTASSLEGRTAQTEPARAAALRITLEAVSPGVDEPAPGRGQLTFADGRVIPFQGGRVTGRIPRTATLRPTVVPLEWHRMGDPPARRPVRELGNGPTDLALLASALERAARSVSATEVPSLL

SEQ ID NO: 12634 - protein, 573 aa, Streptomyces avermitilis
VRPVGSKYLLEEPLGRGATGTVWRARQRETAGAEAAVAGQPGETVAIKVLKEELASDADVVMRFLRERSVLLRLTHPNIVRVRDLVVEGDLLALVMDLVDGPDLHRYLRENGPFTPVAAALLTAQVADALAASHADGVVHRDLKPANVLLKQDGGQMHPMLTDFGIARLADSPGLTRTHEFVGTPAYVAPESAEGRPQTSAVDIYGAGILLYELITGRPPFAGGSALEVLHQHLSAEPRRPSTVPDPLWTVIERCLSKNPDRRPSAENLARALRVVAGGVGVHASAAQIAAAEGVGALLAPDPTPATVPGVPGAADPTQVLPQGAGAYDPNAATSFLPHTSGDADPTSVLPHRGAADPTAVMPPVPQHQPGGPNGQSGPEEPHPWQNQLRAARDRNEQTQVQSYLDPSEDPLRRRPQRQVARPQQQPQQQPGPGYGYPQQQPQQYAPQGQPQRQPRRQPQPQQYAPAPQQQPQRQPQRHQPQPRQPAPRPEPEPRQPRQRGANPMKIPGLGCLKGCLFTVIILFVAGWLVWELSPLQEWIGTGRGYWSELSHWFNKVSGWIGDLGGGSDKTSN

SEQ ID NO: 12635 - protein, 413 aa, Streptomyces avermitilis
LARKIGSRYTANQILGRGSAGTVWLGEGPEGPVAIKLLREDLASDQELVGRFVQERTALLGLDHPNVVSVRDLVVDGNDLALVMDLVRGTDLRTRLDRERRLAPEAAVAIVADVADGLAAAHAAGVVHRDVKPENVLLDMQGPLGPGGSHPALLTDFGVAKLIDSPRRTRATKIIGTPDYLAPEIIEGLPPRASVDIYALATVLYELLAGFTPFGGGHPGAVLRRHVTETVVPLPGIPEELWQLLVQCLAKAPASRLRASELGARLREQLPLLAGMPPLDVDEPDTEPEEESPEAEDPPGETVTGARVRRGSVPLVPGAKPDSNRDTHTSMRVPGPDELAGGARGTARAPRTPGAPRPGSARHRATARRRRITLGVAAVVLVVAAAVGTWAATSGDDAGATPSDTRNSAPESP

SEQ ID NO: 12636 - protein, 368 aa, Streptomyces avermitilis
VAVVDVSEELKSLSSTMESIEAVLDLDKLRADIAVLEEQAAAPSLWDDPEAAQKITSKLSHLQAEVRKAEALRGRIDDLSVLFEMAEEEDDPDTRAEAESELTAVKKALDEMEVRTLLSGEYDSREALVNIRAEAGGVDAADFAEKLQRMYLRWAEQRGYKTEIYETSYAEEAGIKSTTFAVQVPYAYGTLSVEQGTHRLVRISPFDNQGRRQTSFAGVEILPVVETTDHIEIDESELRVDVYRSSGPGGQGVNTTDSAVRLTHLPTGIVVSCQNERSQIQNKASAMNVLQAKLLDRRRQEEQAKMDALKGDGGNSWGNQMRSYVLHPYQMVKDLRTEYEVGNPEAVFNGEIEGFLEAGIRWRKQQEK

SEQ ID NO: 12637 - protein, 276 aa, Streptomyces avermitilis
MTKKTRIRVARIAAGAVIAAGASLTAAGAASALGVGVGVGIGEGGVSADVSVTTAGDADGGTSDGGTSVGVTDGGTSAGTTDGGTTDGGTTDGGTTDGGTTVGATDGGGVSIGGTTDGGTTDGGTTDGGTTDGGTTDGGTTDGGTTDGGTTDGGTTDGGSTDGGSTDGGSTDGGSTDGGSTDGGNTDGGNTSGGSSTGGTDTDGGGNKPVEQGKGSSALTDTGSDTSAQGKSDGELAETGAGETAFLLIGAATMIAGGIGFRMLPRLVNGRGAAAA

SEQ ID NO: 12638 - protein, 229 aa, Streptomyces avermitilis
VIRFDNVSKVYPKQTRPALRDVSLEVERGEFVFLVGSSGSGKSTFLRLILREERCSHGQVHVLGKDLARLSNWKVPQMRRQLGTVFQDFRLLPNKTVAENVAFAQEVIGKSKGEIRKSVPQVLDLVGLGGKEDRMPGELSGGEQQRVAIARAFVNRPKLLIADEPTGNLDPQTSVGIMKLLDRINRTGTTVVMATHDQNIVDQMRKRVIELEKGRLVRDQARGVYGYQH

SEQ ID NO: 12639 - protein, 305 aa, Streptomyces avermitilis
MRAQFVLSEIGVGLRRNLTMTFAVVVSVALSLALFGGSLLMSDQVSTMKGYWYDKVNVSIFLCNKSDAESDPNCAKGAVTTEQKKQIKSDLDKMPVVEKVTPESADDAYKHYKEQFGDSPLASSLTPDQMQESFRIKLKDPEKYQVIATAFDGRDGVQSVQDQKGILDNLFGLLNLMNRAALALMALMLIVALLLIVNTVRVSAFSRRRETGIMRLVGASGFYIQAPFIMEAAVAGLIGGGVACLFLVVGRYFTIDHGMALSEKLNLINFVGWDAVLTKLPLILAASVLMPGLAAFFALRKYLKV

SEQ ID NO: 12640 - protein, 389 aa, Streptomyces avermitilis
MSGPDPFCEPRRFGRGAALTLLFASVLVAGAATGSFDEPDDSGRKASSARPAPASHREDVAEAAAEAAADGKSPVEAAERAVSRSGDRWGAVYSQGEYEEFEEALDGQYTGVGLWARRERDGRIEVSRVQSGSPAAAAGIREGDRLRTVDGENVAGKPVTDVVSLLRGDAGDAAAGTRVRLGLARGTHAWDETVRRARLSTDPVTVRRLADDVTVIKVAAFTKGSGDRVRAAVADAPHADGIVLDLRGNSGGLVTEAVTAASAFLDGGLVATYDVNGEQCALHADSGADTTRPLVALVDGGTMSAAELLTGALQDRGRAVVVGTRTFGKGSVQMPSRLPGGSVAELTVGHYRTPSGHSVDGRGITPDLEADTEALERAGTVLSGLGDPS

SEQ ID NO: 12641 - protein, 177 aa, Streptomyces avermitilis
MYVPKESQPKQGGGASGKVKDGKRKIVAQNKKARHDYAIIDTYEAGLVLTGTEVKSLRQGRASLTDGFVQIDGNEAWLHNAHIPEYSQGTWTNHTVRRKRKLLLHREEIDKLASKSEETGHTIVPLALYFKDGRAKAEIALARGKKEYDKRQTLREKQDRRESDRAIAAAKRKQRGE

SEQ ID NO: 12642 - protein, 209 aa, Streptomyces avermitilis
VERFTAFDFGASWVMSFFHQDWTYDGPTAADVVAKHLSESADELALAVRRDARTLLDNLPSETLEVLWNAGAQYMASFEGTSGSEWTRTVIGLCDARLAAKADVRPLTGADTEDGWACQDAVIAEVERAEFLDTEVREALVDCARRCTPDLAFRVLLSTIVNASDRSLSPHQYTRMQAIGSALHYGEFLVDSVEFLVEEEPPPASVPSH

SEQ ID NO: 12643 - protein, 98 aa, Streptomyces avermitilis
VVQGFTAAADRHDLSSSVHPREAAPAAARRVAEQPLRERPALTGVVVHNEPVLKPLIDASNNSAWAFRATSPSRQSAPTNWRRAPASRSPRSLSRPRR

SEQ ID NO: 12644 - protein, 303 aa, Streptomyces avermitilis
MGERSDSRLAAMRTDELNIDVVLVQRLVAGQFPRWAGLGVEAVDSGGTSNAMYRLGADLVVRLPRRAGAEGDVAKEHRWLPWLAPRLPVAVPVPLGQGLPAGNYPFRWSVYRWLDGATPDVGHLVAPGLLAEDLAGFIDALHRVDPAGGPDSYRSEHLAVRDTVTREAIEELRGVVDADAARAVWETALRAPVWAGPPVWIHADLQPGNVLVDRGRLGAVIDFGCLGLGDPAVDLIVAWYVLPGDVREAFRAAVAADDASWARGRGWALSIALVELRYYRDTNPVMAGHARRVIREVLDGRER

SEQ ID NO: 12645 - protein, 473 aa, Streptomyces avermitilis
MAAVTAAGAAQAPIVAGHPLLGSMNDLLNDPLATYLRARRDHGDVVRFRAGPPGLRADIYAVFSAEGAQQVLATESGNFRKDNVFYGELRDSVGNGLLTSQDATYLRQRRLVQPLFTRRRVDGYAGQVADEAAGLAEAWRGIPGGGVELVGEMHRFALRVVGRILFGTDMETTFEVIERTLPLLQEYALKRGLAPVRTPRTWPTPANRRAARTQAELFALCDGIIDSRRNRKNEGDGGEESGEDLVTLLVRAGNAEDGSLDAAELREQVLIFLLAGHETTATALAFALHLLARHPEQQRRVRDEADRVLGGPGGRAPTAADMEALPYLTMVLKEAMRLYPSAPVIGRRAVADAEVDGVRIPAGADLFVSPWVTHRHPDYWPDPERFDPERFTPEAEAGRPRYAWFPFGGGPRACIGQHLSMLESVLGLAVLIREFEFEAVGEEEVPLGAGITLLAKGPARCRVIPRSSGPRSS

SEQ ID NO: 12646 - protein, 418 aa, Streptomyces avermitilis
MGMFSVSAVVMIAGSRGSYALAGAVTATGLAATALVAPLIARLIDRHGQARIAVPATAVAALGSLALLLCVRYGTPDWTLFAAYAATATTPNTGGMSRARWAHLFKGDPAAVHTANSFEQAADELCFMLGPVLAAFLCGTFFPEAGTLVGAVLLMSGVLVFAAQRSTQPPPGGRTKARSPLRSPGMPPLLLGFLAIGAVFGAMEVVTIAYADARGHKSAAGVVLALQAAGSCAAGLLYGALKPAGPAERRYPWCLTAMAALLILPLLAARLTGSLLALAGALLLAGMATAPTMVTAMTLVQQRTPESRLNEGMTLAVTGLLGGIACGSATGGWVVEQVSATAGYGVPVAAAALALLICLASPAVRARRTMRVRRAVRTKRAVRTKRTERAKRTERAKRTERVRRTVRVKRTAGPTTGG

SEQ ID NO: 12647 - protein, 321 aa, Streptomyces avermitilis
MSVDPRLLCAFVAVAEELHFTRAAVRLYVAQQALSRDIRRLERELGTELFLRTTRQVTLTADGTRLLPYARRVLAAQDALLAAFGRGEAGRPLFVDVNSPGLFSTRILARARELAPDSELMARFESGLTGAAAEILAGRIDASFGRFAGLDPALRSRLEQQPVRYEPMAVILPEDHRLAGLDEVPLDALAGETVYAGAGNPRTPEWTDLARLLFEGRGIEVAPPAPLALGPEEFERIMAKTRCPVLAVVDFPAMPHAVLRPLVDPVPLSPVSLVWRKGVTHPGIDALRCAATELATEEGWLLRPAEGWIPARDALIMMNRS

SEQ ID NO: 12648 - protein, 506 aa, Streptomyces avermitilis
MKCTQARRRARARYLSRGGMYVRVKNWRKGAQRDRRGVDQPLGPETDPSPGREADSPPGGETGPSGGRESHRSGGRESGPSGGRETDPTGGRETDPSGGRGTDPLDRVVAGRAAGPEPVVWPEAGGATAAWLTAGASGRSNAGSGTGRSVGSGTGRSVGSVTGRSAGSVIARSVGSVIGRSAGASAGSAAGPRPRTAAEPDRDRVLDPGREPERVPTPPSGHVDQVDHVPVAPSRPTVPSTVWERSGAPGHSHDPHEVTVQLDGSGRQLDEPLVERGGGLVGDGGQDSDGPVFVDESGRRRRRLRRLGMVVGIACAVYAVVIVATLLSGNSNAPWLPVPRQKDDTPAARVDTSPPPSHRAHPSAPAAFPPSAGATGDAGKRPSKGGAGSTHGPSARVSAPAASTDPRPSASTAKPKPGSSSTKNPAPGPSDPVDGSSPAPTPSGGVTPDPSPSTATGGPGPVANGSAGNVPVANGSVENAPVANGPVGQPSGEPPAAGPSPSESVL

SEQ ID NO: 12649 - protein, 750 aa, Streptomyces avermitilis
MAPRTNRPRTNRPRTGRPPAPDAPAAPDAPTAPDARRRRLPMRFLLPSLLLLAVMAMLMLRGFVHSEILADHRIRPPAATDQVPEKILDGGPVIDTRGGRTTSLSLPDHRLVLTFDDGPDPQWTPKVLDVLKKHHAHAVFFVTGTMTSRHPDLVRRLVAEGHEVGVHTFNHPDLAYQSKKRIDWELSQNQLALAGAAGIRTSLFRPPYSSFADAMDNESWPVTEYIGTRGYITVVNNTDSEDWQKPGVDEIIRRATPRGGKGAVVLMHDSGGDRHQTVQALDRFLPELQRRGYEFENLSEALGAPSAHTPVTGVDRWKGNAWIFLVQAADRITGMLVVGLAVIGGLVLTRFGLMLLLSGTHARRVRRPDFRWGPAPVTEPVSVLVPAYNEAKCIENTVRSLTASEHPVEVIVVDDGSSDGTARLVESLRLPDVRVVRQHNAGKPAALNRGLANARHDLIVMMDGDTVFEPATVRELVQPFADPRVGAVAGNAKVGNRDSLIGAWQHIEYVMGFNLDRRMYDLLRCMPTIPGAVGAFRRSALERVGGMSDDTLAEDTDITMALHRDGWRVVYAEKARAWTEAPESVQQLWSQRYRWSYGTMQAIWKHRRALVERGPSGRFGRVGLPLVALFMVVAPLLAPLIDVFLLYGVIFGPTQKTVLAWLGVLAVQAVCAAYAFRLDRERMTHLVSLPLQQILYRQLMYVVLLQSWITALVGGRLRWQKLRRTGVVEAPGSIPQQRTAGSESERRPVG

SEQ ID NO: 12650 - protein, 418 aa, Streptomyces avermitilis
MTAHEYPATSASASVPASVPVPAPAPAPAPSPEAAPQRPGRDRYFDLLRSLALVRVVVYHLFGWAWLTILFPSMGVMFALAGSLMARSLKRPAPSVIRGRIRRLLPPLWAFSAVLLTLMFAGGWNPAKDPDLGGTWGVVELFDYLVPVGAPPYPWSLGSDSGLLESTWAEQAVGPLWYLRAYLWFVVASPLLLWALRRVPWATLLAPLALTAVLGTGLVTIPGETGNAVTDFAVYGGCWVLGLAHQEGVLRRIPRYAAVSCATLLMAFGLWWASGHQGPEGWDLNDIPLAQATWSFGFVAILLQYSPSWQELPGRLARWDRLVTLSNNRAVTIYLWHNMLIMATGPLIDRAYDLPFMQNEQAVAALDSTYTFWMFVLVWPLIGLAILAFGWIEDIAAKRGPRLWPNGKKRGRPRARQV

SEQ ID NO: 12651 - protein, 182 aa, Streptomyces avermitilis
MIRSPDCVENSKLVEYLPSEVETVRQCPSTSLPTRLNCRSTHSGIKPNQKRKGTGKATRNKHTHARASIRKSWHAPPASRRPTSRVVPFGAVRFSTTGQSFDYVDGPVPQRLDTVRLDSQLRQADPHHVDDQPGLPPAERSAGAPMKTRHPTGGSARKTERAKTTADPTRTDWKIDMKADGP

SEQ ID NO: 12652 - protein, 148 aa, Streptomyces avermitilis
MAGQFEATVEISRPVEEVFAFLADGRNDPEFSPRVQEITKTPDGPTAVGTVFTSTVKDAGMKTGRKFRITEFEAPRRIRWTEISKNVVTADEGGYDLESTGAGTTRVRIFNVLEGHGVGKLLVGFALGAARKDANAFGQRIKAAVEAS

SEQ ID NO: 12653 - protein, 463 aa, Streptomyces avermitilis
MTAPSTAPAASPPSRKGRWIEEWDPEDEAFWEEKGEKTARRNLLFSVLSEHVGFSIWTLWSVMVLFMGPEYGLTPADKFFIVSMATLVGAIVRVPYTFAVALFGGRNWTIVSASLLLIPTIAAFVVMEPGTSFTTFLVCAMLAGIGGGNFASSMTNINAFFPLRKKGWALGLNAGGGNIGVPVVQLVGLAVIGASGGPRVLLGIYIPFIVLAAGLAAVKMDNIASLKNDTGAAREAVKDAHTWIMSFLYVGTFGSFIGYSFAFGLVLQTQFGRTPLQSAYVTFIGPLLGSLIRPVGGWLADRYGGAKITLWNFVGMAAATGVIVIASMQKSLPLFTTAFIALFVLSGLGNGSTYKMIPGIFHAKAVAKGLEGEEAAAYGRRLSGASMGLIGAVGALGGLGINLAFRQSFLSVGSGTGAFVSFLAFYAACFAVTWAVYLRRQAGAEAHATAASGAKPQLSYVEV

SEQ ID NO: 12654 - protein, 386 aa, Streptomyces avermitilis
MYDEQQLPAQQDHGPLAGFTVGVTAARRADELGALLQRRGASVVHAPALRIVPLADDSELLAATKGLIEQAPDVVVATTAIGFRGWIEAADGWGLGEDLIERLRGVELLARGPKVKGAVRAAGLTEEWSPSSESMAEVLDRLLEEGVDGRRVAIQLHGEPLPGFVEALRAGGAEVVGVPVYRWMPPEDITPVDRLLDATVTRGLDAITFTSAPAAASLLSRAEERGLLSDVLAALHHDVLPACVGPVTALPLQARGVDTVQPERFRLGPLVQLLCKELPGRARTLPIAGHRVEIRGHAVMVDGALRPVPPAGMSLLRALARRPGWVVARAELLRALPGAGRDEHAVETAMARLRTALGAPKLIQTVVKRGYRLALDPAADAKYADA

SEQ ID NO: 12655 - protein, 184 aa, Streptomyces avermitilis
MTQNSTGRRTTAGGVLGAATVATGLIAGVFYVFACAVMPALARSDDRVYIEVMQNINDVIQNPVFFLSFLGALVLSALSAWQLRGSPGRWWVFAALIAYALVFLFTVVVNIPLNNDLAHAGAPAGVADPAAVRARFEGPWVAWNVVRALLSTLALALLVRALFLRGRAHASAYLASAAGSRASR

SEQ ID NO: 12656 - protein, 195 aa, Streptomyces avermitilis
MASGTATASYELRFDSGRICLDLLATTHPEERLDSADRLRAWATGSGLVPPGTPLPEADASWPVRFRELRGQIGQLVHGELEGRPVDAALARVNAVALGSPPPLCAVRADDGVLVRRLPAAPGCGELLAAIARDTVELLTDPAARASLRHCEGDNCPLVYLDTSRGRRRRWCSSETCGNRERVARHRRRAALARA

SEQ ID NO: 12657 - protein, 198 aa, Streptomyces avermitilis
VGVRKDSAVADERRSRARHRMSPSSSSPSPEPDEELMRALYREHAGPLLAYVLRLVAGDRQRAEDVVQETLIRAWKNAGQLNRATGSVRPWLVTVARRIVIDGHRSRQARPQEVDPSPLEVIPAEDEIDKALWLMTLSDALDDLTPAHREVLVETYFKGRTVNEAAETLGIPSGTVRSRVFYALRSMKLALEERGVTA

SEQ ID NO: 12658 - protein, 272 aa, Streptomyces avermitilis
MYGGYGSGTGGPGSARGTAGAQGPGDVHETVGAYALGILDDAEATAFEAHLATCDWCAQQLDDLAGMEPMLAALADLPSSQGTPAIGESLSARPSPRLAERLVDEVSERRALKRRRSFFMLAAAAAMIIGGPLVVMAVNGDGGGKEPVASATSPAKDAFMHMSKKISATDSSTKVNAVIAMDSKDWGTHSVLQLKNVKGPLKCSLIAVGKNGERETVTSWAVPKWGYGIKDAKTEQAKNPLYVHGGAAFKPNEIDHFEVMTFDGKRLVEVNV

SEQ ID NO: 12659 - protein, 836 aa, Streptomyces avermitilis
VAAQVQQETAFGPVDESSVQDSASDSAQDSVRDREISVEQEHLDRVYRRLEEKIHEAEFLMQDAAQRGQVGTPGALAERDAQVFRAGIHLNRLNNEFEDFLFGRIDLLLGKDGKKGPDGAYTAVEPAEGVVRDDNTADIAETLHIGRIGVLDAEYAPLVIDWRAPAAAPFYRSTPVDPGRVVRRRVIRSKGRKVLGVEDDLMRPELTASLNDEPLAVIGDGALMAALGQARSHTMRDIVASIQAEQDLVIRAPAASVTYVEGGPGTGKTAVALHRAAYLLYQDRRRYAGGILIVSPTPLLVAYTEGVLPSLGEEGQVAIRAIGSLVDGAEATLYDSPSVARAKGSHRMLKVLRKAARGALELGPSVAGPATRGQFAGGSSAGANGSRTGGAGRSSASAERPLADAEQLAFGDDDTGHQAPAEPPTRLRVVAFGRRLELEARELDRIRETALSGTAPVNLLRPRARKLLLDALWAHSGAGTRHNDPELAAELRSSFDEDVTSEDSFIGFLDAWWPELTPRGVLAAMADERRLGRWARRILNPGEVRRVARSLRRDGLSVHDVAMLDELQAILGQPARPRKRRELDPLDHLTGLEELMPVREESQRERAERLAQERTEYAHVIVDEAQDLTPMQWRMVGRRGRHATWTVVGDPAQSSWSDPDEAAEARDEALGSRPRRRFTLTVNYRNPAEIAELAAKVLALAMPGSESPAAVRSTGVEPRFGVVRGSLAQTVREEAARLLDRVDGTVGVVVAMNRREEAARWLAGLGDRVVALGSLEAKGLEYDATVVVSPAEIADESPAGLRVLYVALTRATQQLTVVSGDRDEPDASGVPDLLRD

SEQ ID NO: 12660 - protein, 477 aa, Streptomyces avermitilis
MATAPSVSYSMTVRLEVPASGTAVSQLTTAVESHGGSVTGLDVTASGHEKLRIDVTIAATSTSHADEIVAQLRTIEGVTLGKVSDRTFLMHLGGKIEMQSKHPIRNRDDLSMIYTPGVARVCMAIAENPEDARRLTIKRNSVAVVTDGSAVLGLGNIGPKAALPVMEGKAALFKRFAGIDAWPLCLDTQDTDAIVEIVKAIAPGFAGINLEDISAPRCFEIEARLREALDIPVFHDDQHGTAIVVLAALTNALRVAGKAIGDIRVVMSGAGAAGTAILKLLIAAGVKNAVVADIHGVVHADREDLVNAAADSPLRWIADNTNPEGLTGTLKEAVRGADVFVGVSAPNVLDGDDVAAMAEDAIVFALANPDPEVEPAVARQTAAVVATGRSDFPNQINNVLVFPGVFRGLLDAQSRTVNTEMMLAAAAALADVVTEDELNPNYIIPSVFNEKVAGAVAGAVRTAAKAAGVTESDSKDA

SEQ ID NO: 12661 - protein, 93 aa, Streptomyces avermitilis
MNRSELVAALADRAEVTRKDADAVLAAFAETVGEIVAKGDEKVTIPGFLTFERTHRAARTARNPQTGDPIQIPAGYSVKVSAGSKLKEAAKGK

SEQ ID NO: 12662 - protein, 448 aa, Streptomyces avermitilis
MTVNGSDDVLLVHGGTPLEGEIRVRGAKNLVPKAMVAALLGSEPSRLRNVPDIRDVRVVRGLLQLHGVTVRPGEEPGELVLDPSHVESANVADIDAHAGSSRIPILFCGPLLHRLGHAFIPGLGGCDIGGRPIDFHFEVLRQFGAKIEKRADGQYLEAPQRLRGTKIQLPYPSVGATEQVLLTAVLAEGVTELANAAVEPEIEDLICVLQKMGAIIAMDTDRTIRITGVDSLGGYTHAALPDRLEAASWASAALATEGNIYIRGAQQRSMMTFLNTYRKVGGAFEIDDEGIRFWHPGGQLKSIALETDVHPGFQTDWQQPLVVALTQATGLSIIHETVYESRLGFTSALNQMGAHIQLYRECLGGSDCRFGQRNFLHSAVVSGPTKLQGADLVIPDLRGGFSYLIAALAAQGTSRVHGIDLINRGYENFMEKLVELGAKVELPGKALA

SEQ ID NO: 12663 - protein, 193 aa, Streptomyces avermitilis
MSGMTEVSSLTGRLLVATPALADPNFDRAVVLLLDHDEEGSLGVVLNRPTPVDVSDILEGWADLAGEPGVVFQGGPVSLDSALGVAVIPGGASVDGAPLGWRRVHGAIGLVDLEAPPELLAKALGSLRIFAGYAGWGPGQLEDELVEGAWYVVESEPGDVSSPSPERLWREVLRRQRNELAMVATYPDDPSLN

SEQ ID NO: 12664 - protein, 98 aa, Streptomyces avermitilis
MSTLEPETQPQRGTGTGTLVEPTPQVSHGDGDHERFAHYVQKDKIMASALDGTPVVALCGKVWVPGRDPKKYPVCPMCKEIYESMGAGGDKDKGGDKK

SEQ ID NO: 12665 - protein, 446 aa, Streptomyces avermitilis
VPLARTARTPRPPRTAVSLAALAVAAVLTVTATACAPQSSGNSSSGKDEKTGTLRVWLFQEVDNKPKQQVVDETVAAFRKAHKGTEVNVEYIPVETRAQRVKAAFNDPKSAPDVIEYGNTDTAGYVRDGGLADVTRDFTGWSESKDTDPTAKQSVTVDGRIYGAPYFVGVRALYYRTDIFKELGLEVPRTQAELIATAKQIRAAKPDLYGLAVGGAYTYGAMPFIWSHGGELAQGKGGSYSSTIDSAAARKGIKAYTSLFGDDNCPAAKCAGMGGNDTVTAFASGKAAMAIGGDFSHQAIEAGKVKGAYAVVPLPGLKPGDIAPAFAGGNNIGVLKSTTHRTLAVDLMKRLASKKTQSELFDAMGFLPTFSDVREQVAAKEPFVKPFVRTLAAGAKFVPASPAWAGIDSSLVLPTMFQQVISGKKDVAAASEEAAKKMNDAFSSAG

SEQ ID NO: 12666 - protein, 320 aa, Streptomyces avermitilis
MTTHNTALGERTGGAVADKAVGAHPGRRPRGAARTPWIYLAPALVVLGGLLVYPVYQLGLISFLEYTQAQVSGGEPTTFQGFGNYATLFGDEQFWQVLLATVVFAAACVVSTLAVGCALAVLLTRVRALPRLALMLAALGAWATPAITGSTVWLLLFDPDFGPVDRMLGLGDHSWTYGRYSAFALVLLEVVWCSFPFVMVTVYAGIRAVPAEVLEAAALDGASQWRIWRSVLAPMLRPILVVVTIQSVIWDFKVFTQIYVMTNGGGIAGQNLVLNVYAYQKAFASSQYSLGSAIGVVMLVILLAVTLVHLRLLRGQGEEL

SEQ ID NO: 12667 - protein, 281 aa, Streptomyces avermitilis
VTSIRGLVRRPWRLAAEASALLIAVVVAFPLYWMVLSALKPAGEIESTRPRPWTLSPSLDSFRRVFEQQEFGRYFLNSLVVACSVVVVSALIAFLAATAVTRFRFRFRTTLLIMFLVAQMVPVEALTIPLFFLMRDFGQLNTLGSLILPHIAFSLPFAIWMLRGFVKAVPDALEEAAYIDGASRARFLWQILFPLVFPGLVATSVFSFISAWNDFLFAKSFIISDTSQSTLPMALLVFYKPDEPDWGGVMAASTVMTIPVLVFFVLVQRRLVSGLGGAVKD

SEQ ID NO: 12668 - protein, 577 aa, Streptomyces avermitilis
VTDVTDVMALIPAPRHVGACGEGFFELGPDTRLAAGAGTERTARWLRGTIGAATGFPLAPGDGGIRLSVHPTVTRDLGEEGYRLAVTPDAVHLVGGGPAGLFWGAQTLRQLLGPGAHRRAPLPGGQWRLPLTHIQDSPRFPWRGVMLDVSRHFMPKDGVLRHLDLMAAHKLNVFHFHLTDDQGWRIEIKRYPKLTEVGSWRARTKFGHRASQRWEEKPHGGFYTQDDIREIVAYAAERHITVVPEIDIPGHSQAAIAAYPELGNSDVIDTTSLTVWDDWGVSKNVLAPTDNTLRFYEGVFEELLELFPADAAAFSAFVHIGGDECAKDQWKQSPAVQARIEELGLTGEDALQAWFVRHFGTWLAARGRRLIGWDEILEGGSRAAGTRAEATRAAGTRAPGGETADIGLPEGAAVSSWRGYQGGITAARAGHDVVMCPEQQVYLDHRQDGGADEPVPIGYVRTLEDVYRFEPVPPQLTEDEARHVLGTQANLWTEVMEDHARVDYQAFPRLAAFAEVAWSALPAPAERDFADFERRMTAHYGRLDALGVAYRPPTGPLPWQRRPGVLGRPIEGPPPNA

SEQ ID NO: 12669 - protein, 306 aa, Streptomyces avermitilis
VGQREGAAGLTTHAPQAAQAVTLPGSLDEAVAALAAMPTAVPVAGGTDLMAAVNSGQLRPAALVGLGRINEIRGWQYQDGHALLGAGLTHARMGRPDFAALIPALAAAARAAGPPQIRNAGTLGGNIASAAPTGDALPVLAALEATLIIAGPGGARREIPVSHLLAGMEMLRGGELIGYVRVPLLHAPQVFLKATGRTGPGRATASVALVLDPARRGVRCAVGAIAPMPLRPLEAEQWVAQLIDWDNSRTIVPEALTAFGDYVAAACIPDPVPAEDGSVEQLPAAVLHLRRTVAALARRALGRALS

SEQ ID NO: 12670 - protein, 520 aa, Streptomyces avermitilis
VTDDQHGEGTPQGRTHGAWERLPQGDYDDGATTFVQLPEGGIDALLASDTPLAAPGHGYVPPPITAAPGADADPSAPGAWGAPVEGVQWPDPGPASPDVAQDAFMYNPGGTGQWAFEESARGDAASGHDVTGQWSIPVADGDLPDESGEFSASSLVEQWGGTPPATLPGGAAAPWATEPAGQLWSPESEEAAGHPGPELPAEAPVEPSGGPYTGFGAGADPGAPEAAQEAPEPSGALDATETHETAGAAEAADAPDAEPAAEEPPVAGDPQAAVEPPAAEPSGSGPDPSAASQAQGASAEETGADDPASAHHHDEHPVASYVLRVNGADRPVTDAWIGESLLYVLRERLGLAGAKDGCSQGECGACNVQVDGRLVASCLVPAVTAAGSEVRTVEGLAVDGRPSDVQRALAKCGAVQCGFCVPGMAMTVHDLLEGNPAPTELEARQALCGNLCRCSGYRGVLDAVREVVAEREAHTEAESAQDADEARIPHQAGPGAGGVNPSAFDPPDAHHRYGQDGGQA

SEQ ID NO: 12671 - protein, 768 aa, Streptomyces avermitilis
VSNEAATATTAAAAAAPEPLPHGLGVSLPSADARAKTEGTFPYAADLWAEGLLWAAVLRSPHPHARILSIDTTHAREMPGVRAVVTHEDVPGQVPHGRGTADRPVFASEVVRHHGEPLAAVAADHPDTARMAAAAVIVEYEVLDPVTDPEQAFEAEPLHPDGNLIRHIPLRHGDPDAAGEVVVEGLYRIGRQDPAPIGAEAGLAVPRPDGGVELYVASTDPHADRDSAAACYGLEPDRVKVVVTGVPGATADREDQGFQIPLGLLALKTGCPVKLTATREESFLGHVHRHPTLLRYRHHADADGRLVKVEAQILLDAGAYADTSAEALAAAVSFACGPYVVPHAFIEGWAVRTNNPPSGHVRGEGAMQVCAAYEAQMDKLAKKLGIDPAELRMRNVMATGDVLPTGQTVTCPAPVAELLQAVRDFPLPALPKDTPEEEWLLPGGPEGAGEPGAVRRGVGYGLGMVHMLGAEGADEVSTATVKVHDGVATVLCAAVETGQGFTTLARQIVQETLGIDEVHVAPVDTDQPPAGAGCRGRHTWVSGGAVERAAKMVRTQLLQPLAHKFGMSTELLQITDGKITSYDGVLSTTVTEALDGKELWATAQCRPHPTEPLDAVGQGDAFVGLAFCAIRAVVDVDIELGSVRVVELALAQDVGRVLNPAQLAARIEAGVTQGVGIALTENLRTARGLVRHPDLTGYALPTSLDAPDIRIVKLVEERDVVAPFGAKAASAVPVVTSPAAVAAAVRAATGRPVNRLPIRPQAAVVTAP

SEQ ID NO: 12672 - protein, 396 aa, Streptomyces avermitilis
MSTTEAGGVITLTEADLDPYVTHARTRQWLTGPGLPADSALLGFDALREATTPPRPGLRRVADLVDDAEKLAGELRDQLVIGALRTFDRDLESVVLDGATGAVSTTYFHGSASLMDRSPLAPSLEALVRFAAATEELAGSRGQFAAYEGRHGPKAVAAASEQLSAVFTSTAGDDVAPYWRMAALIRPLARIAGPGAGLALDLPPRLLDEEFGAFGIVRFEDVDFPAALTHEPTRRFLREVGLPENGYWFEVDTDVPLPTLAEHYADELSGAFTDGELPAGADHLIRLGHLLEDTSLVVDGATGAVLCWSEPDGMLRPLNTDISTLAFTAWLLHREKALDADHDLTGSYEQLAATMAQTLALVDPMACDPTPVTPQDDGLRYWPDAFEDQAGGGLYA

SEQ ID NO: 12673 - protein, 484 aa, Streptomyces avermitilis
MSALEPRDAAVADTSAADASAVPPAPDGEGVLGRSYRALSIGIVSVVLLIAFEATAVGTAMPVAARELDGVSLYAFAFSGYFTTSLFGMVLAGQWSDRGGPLGSLTAGIAAFAAGLLLSGTAGTMWLFVLGRAVQGLGGGLVIVALYVVVGRAYPGRLRPAIMAAFAACWVIPSIVGPLASGAVTEHLGWRWVFVGIPVLVVFPLALALPRIRRRAGRPAAGVAAPFDAHRIRLALGISLGAALLQYAAQDLRALSLVPAVAGAALLVPAALGLLPRGTYRAARGLPSVVLLRGVAAGSFVAAESFVPLMLVTQRGLSPTLAGFSLAAGGGTWALGSFVQARARVEPYRDRLMTLGMVLVAAAIAAAPSVLIDAVPVWTVAVAWAFGCFGMGLVISSSSVLLLHLSAPEEAGANSAALQISDGLSNVLLLSAGGAAFAALGGGTVTDAATAASGSHPAAFAAVFLPMAAVALVGAWVTTRLRER

SEQ ID NO: 12674 - protein, 598 aa, Streptomyces avermitilis
VTTTAASASSHHLSPAFPGRAPWGTASKLRAWQQGAMERYLQEQPRDFLAVATPGAGKTTFALTLASWLLHHHVVQQVTVVAPTEHLKKQWAEAAARVGIKLDPEYSAGPLSKEYDGVAITYAGVGVRPMLHRNRAEQRKTLVILDEIHHAGDSKSWGEACLEAFEPATRRLALTGTPFRSDTNPIPFVTYEEGNDGIRRSAADYTYGYGSALGDGVVRPVIFLSYSGNMRWRTKAGDEIAARLGEPMTKDAISQAWRTALDPRGEWMPSVLRAADRRLTEVRKAIPDAGALVIASDQESARAYAKLIREITGTKATLVLSDDTGASSRIDEFSHSDDRWMVAVRMVSEGVDVPRLAVGVYATTISTPLFFAQAVGRFVRSRRRGETASVFLPTVPDLLTFANEMEVERDHALDKPKKEGEEDPYAESEKEMEEANREEDEDTGEQEQFSFEALESEAVFDRVLYDGAEFGMQAHPGSEEEQDYLGIPGLLEPDQVQLLLQKRQARQIAHSRKKPDEEADLVELPAERRPVVTHKELLELRKQLNTMVGAYVHQSGKPHGVIHTELRRVCGGPPSAEATAGQLRQRIAKVQEWATRMR

SEQ ID NO: 12675 - protein, 213 aa, Streptomyces avermitilis
VTAETSQTLDRGLRVLKLLADTDHGLTVTELSNKLGVNRTVVYRLLATLEQHALVRRDLGGRARVGLGVLRLGRQVHPLVREAALPALRALAEDIGATAHLTLVDGTEALAVAVVEPTWTDYHVAYRAGFRHPLDRGAAGRAILAARQAPVTEPGYTLTHGELEAGASGAAAPLLGVTGVEGSVGVVMLVDAVPERVGPRVVDAAREVAEALR

SEQ ID NO: 12676 - protein, 264 aa, Streptomyces avermitilis
VLSRLSRLSRPKAVAVCAVPVVALLATAVFAPLPFSVAQPGMTANVLGENQGDAVITISGAATRKTTGQLRMTTIEATGPDADVFLGDVLDGWFRTDRAVMPRDSVYPSGNSVKEIEQHNAAEMQQSQDTAAQAALSYLNEKNVKVTLKLADVGGPSAGLLFSLGIIDKLDGDGSGGDLTGGRTIAGTGTIDANGKVGAVGGVALKTQAARRDGATVFLVPKAECADAKSELPKGLRLVPVTTLKGAVDALTNLEKGKDSVPAC

SEQ ID NO: 12677 - protein, 212 aa, Streptomyces avermitilis
LQQSLCNAIFVRMTEEQERPQKPQQQYRTLDARSLRGLAHPLRMQLLSALRQRGPATASQLAERLGESSGATSYHLRQLAAHGFVVDAPEHGKGRERWWKAADEGLDFDDALLKDPDPAVRGAADVFLHEVATTHARELSTWLGTRNDWSRQWIRATDMSDMTLRLTPDLARELIREMHDLVESYRALAPAEGTPDAEQVRIHTHAFPFTTN

SEQ ID NO: 12678 - protein, 320 aa, Streptomyces avermitilis
MRRGCLLLAGVLVAAAGCGLTSGSPMVDDVRPGSIGKGEPLKGAHLTVTSKEFTEQLILGAIMGIAFQAAGADVLDRTGIQGSVGAREAVKNGDADGMYEYTGTAWITYLGNSEPITDPLKQWQAVRDADLKNGVTWLAPSTLNNTYALAMNQANFKKYGTKTLSDVAALAKRDPKAVTLCVESEFANRADGLPGMEKAYGMKLPAADITQMDTGIIYTQVAKGSCTYGEVFTTDGRIKSMNLVVMRDDKKFFPNYNVAPEINTKALKKYPAIAEVLDPVTRKLDNTVAQDLNAKVDVDGQDPHQVALDWMKEEGFVKGG

SEQ ID NO: 12679 - protein, 276 aa, Streptomyces avermitilis
VTTPRLDEDGTARREEDGAEAAPAPPAKPRTARLTWQKLTVLPTVLTALLLATWVWFQQARLDPLSENALSNGQVSKALWQHIQLTAISTFFVLIIAIPLGILLTRRAFRKATPIAMTIANMGQATPAIGLLALLVIWLGTGQKAALIGIIIYAILPVLANTIAGLKANDPTVLEAARGIGMSSPGVLTRIELPLAVPLILAGVRTALVLNVGTATLATFGGGGGLGVLITTGITNQRMPVLVLGSILTVSLALLVDWLASLAEVLLRPRGLEVET

SEQ ID NO: 12680 - protein, 437 aa, Streptomyces avermitilis
VPDVSGTSTETPADEGPTAGAPATGAPAPTSGATIELENLTKRYPGSHEPAVDSVNMHIKAGELVVFVGPSGCGKSTTLKMINRLIEPTGGRIRIGGEDVTDMDPVKLRRKIGYAIQSSGLFPHMTVAQNIALVPKMAGWPGSRIKARVEEMLDLVGLDPAEFHGRYPRQLSGGQQQRVGVARALAADPPVLLMDEPFGAVDPITRDHLQDELIRLQYELHKTIVFVTHDFDEAIKLGDRIAVLRERSHIAQFDTPEAILTNPADDFVSGFVGAGAALKRLNLTRVRDVEIHDYPAVTVDDPLQEIFGKLRSSGTNEILLLDRRRRPYKWLRRGDLMRAKGSLARAGTLVSDTVTRDATLRDALEAVLTDNAGRVAVTGRRGEYTGVVDMETLINSVHEMLEADRLDAMEHQHELEEARAQQTHAEQEGVDAGEEKA

SEQ ID NO: 12681 - protein, 215 aa, Streptomyces avermitilis
VNFLEYLGSHRQQLLTDAYQHASAVFQCMVVATAIGVVVGVVTYRSEWAGNLATTTTSTILTMPSLAMIGLLIPVVGLGVPPTVIALTLYGLLPIVRNAIVGLRGVDPSLVDAATGIGMSRAARLLRVELPLAWPPVLTGIRVSTQMLMGIAAIAAYASGPGLGNEIFRGLASLGSKNALNQVLAGTIGIIILALLFDAAYVLIGRLTIPRGIRA

SEQ ID NO: 12682 - protein, 170 aa, Streptomyces avermitilis
MYRMTTGGAAVAIDHLDGRLLVLLAREPRIGVLEMSRRLGVARGTVQARLDRLQSNGVIRGFGPQVDPAALGYPVTAFATLEIRQGQGPDVRAHLTTVPEVLELHTTTGSGDMLCRLVARSNADLQRVIDRVVGFDGIVRAATAIVMENPVPLRIIPLVEQAAEDRDRRE

SEQ ID NO: 12683 - protein, 381 aa, Streptomyces avermitilis
MTQTTHHTPDTARQADPFPVKGMDAVVFAVGNAKQAAHYYSTAFGMQLVAYSGPENGSRETASYVLTNGSARFVLTSVIKPATPWGHFLADHVAEHGDGVVDLAIEVPDARAAHAYAIEHGARSVAEPYELKDEHGTVVLAAIATYGKTRHTLVDRTGYDGPYLPGYVAAAPIVEPPAHRTFQAIDHCVGNVELGRMNEWVGFYNKVMGFTNMKEFVGDDIATEYSALMSKVVADGTLKVKFPINEPALAKKKSQIDEYLEFYGGAGVQHIALNTGDIVETVRTMRAAGVQFLDTPDSYYDTLGEWVGDTRVPVDTLRELKILADRDEDGYLLQIFTKPVQDRPTVFFEIIERHGSMGFGKGNFKALFEAIEREQEKRGNL

SEQ ID NO: 12684 - protein, 529 aa, Streptomyces avermitilis
MEIEQQQPLPSERGLSPVARRALIGAITGCFVLGGVLMLLPPAGREPAAPPAPAAGPMAGPVAQAKAAVGAGVPVALPALAALVTDHETHLRAHPRDARSWAVLGAAYVAQGKGTADAAYFPKAEEALRTSLNVAPRRNAEALGALAALANARGDYREAKQWGEAAVKMAPKQWPAYAQLIDAYDGLGDYKATGKTLDKLLGLRAGPAAAARAAQVYRARGWREDAAAAIADATARAGSPAEQAVYWQQAGELAWERGEPEQALRYFETALRTDPDRHAALAGQGRALAALGRTSDAVNAYRAALAKQPLAAYAVELGELYESQGLGGAAQVQYYLVRERVRQDAAGGVNNRLVVGQFEADHGDAEVAVRELREEWKRQPSIRVADALGWALHRAGQDQEALGFATKAMDKEHGGGVRSALYAYHRGEIERALDQLAPARRHLAEALRINPHFSPWFAPMAKETLAELGEPPAEGLPGDEEVEAAEAEAAEAAEAAQTPEAAESVDPAQTEQVPPPGASTPVPQEPEAR

SEQ ID NO: 12685 - protein, 471 aa, Streptomyces avermitilis
VIMSRSETSPDEDPPATGNLVDRLLSGLPAEALLTDPDVTASYANDMASFCAAGTPAVVVLPRTVEQVQHVMRTATELRVPVVPQGARTGLSGAANASDGCIVLSLTKMDHILEISPVDRIAVVEPGVINATLSRAVGEHGLYYPPDPSSWEMCTIGGNIGTASGGLCCVKYGVTAEYVLGLDVVLADGRLMSTGRRTAKGVAGYDLTRLFVGSEGSLGIVVRATLALRPQPPQQLVLAAEFASTAAACDAVCRIMAGGHVPSLLELMDRTTVKAVNAMAHMGLPETTEALLLAAFDTLDPAADLAAVGALCEAAGATQVVPADDAAESELLLQARRLSLTALEAVKGTTMIDDVCVPRSRLGAMLEGVERIAEKYALTIGVCAHAGDGNTHPTVCFDAADPEESRRARESFDEIMALGLELGGTITGEHGVGVLKKEWLAREIGPVGVEMQRAIKTTFDPLGILNPGKLF

SEQ ID NO: 12686 - protein, 536 aa, Streptomyces avermitilis
MSAPTPAPGDDRPREGYYPDPSIPGYVRYWNGTAWVPGSSRPAPSDGEPLAPPPGARHAPASVEETGPHFFDEDPEPAADSRRVSPAEAQHGSRPEPASAWGAERARQTGFGGDPDRRVSWGAPQGADPRVPRAADPADAAPRPDGRAGHPDGTARTDGTATIPPAEADGSGSAQPPASAGTVVFRRPGHGDGDAGPRDTSGHQGTGPAEGTMTFRARSPRTGEQDGSTPPAAAEQPFAASPPSAQAAARQALGLDPEAPPAGPQQAGPPPQRAASAPRPGGPQPSAPQPALPPQQAGSHSQQPAGSLSPQPSPTVPPQAGGGAFSATPMTSGDGGGQPSWAQQVHRLAGPEGEQPVAPWKPPVDDIFQAAARAHAAARPAGLGKRLAARLVDTLVLATVTGVAAVPLGTKAIDHINDKVDAAKLSGETVTVWLLDGTTAVYLGIVLGVLLLFGVLYEALPTAKWGRTLGKKLCGLEVRDIEGHEPPSFGLALRRWLVYSVPGLLGIGVVGVLWCLFDRPWRQCWHDKAAHTFVAG

SEQ ID NO: 12687 - protein, 148 aa, Streptomyces avermitilis
MPPLADSGKRVLARIIDMILVGIVVVLLSWAFGFSPYSLNADRMTSAGAFGREVIAAVLYIAYDTFLISKSGQTLGKKLLNLRVANLDNGATPSMQTSLIRAAVLWIPFAFCCACIWTAIAGGWSFFDKPYKQGLHDKAAKTVVVSTG

SEQ ID NO: 12688 - protein, 94 aa, Streptomyces avermitilis
MAMPRPTAAQLAYGSCTVIFSTLAMLLLSQTSSGLGIAVIALAALALGLLVALTVPVPKPAPAAVVSRPATPEERVPVQRETASVAAGAEPTGS

SEQ ID NO: 12689 - protein, 781 aa, Streptomyces avermitilis
VTSRPWTFRATAIGVALAAATATFSTFAVAQADDAKATTSVDRRDPQPAKTKVDHDLDGPLSKTRAAQRQEALNQVISGDAKVQNRGGSQVVKLKSKKGDSKYVELGREQTDQIFTVLVEFGDKIDSTYGGTAGPLHNKIAAPDRKKDNSTAWQADYNQKHFQDLYFGTGKKTESLKKYYEKQSSGRYSVNGKVSDWVKVPYNEARYGSNKCDTCAWNAVADGVTAWVAAQKAAGKSDAAIKATLAQYDQWDRYDFDGDGNFNEPDGYIDHFQIVHAGEDESAGGGAQGEDAIWAHRWYAFGTDAGATGPAGNKLGGTQIGDSGIWVGDYTIQPENGGLGVYAHEYGHDLGLPDEYDTSGGGENGTGFWTLMSAGSWLGTGKNAIGDLPGDMGAWDKLQLGWLNYAKAKAATKSTHKLGVAEYNTRNKQALVVSLPDKAVKTEVVAPAQGATQWWSGSGNNLKNTLTRSVDLTGKSKATLDLDGWWDIESGYDYLYAEASTDGGANWTALDGTANGTAIPRDGSDKPALTGSTDAYKKLSYSLDAYAGQKVDVRFRYQTDGGAAQKGFAADEISVTADGTALFSDNAETADAAWTASGFSRIGASFTKDYAQYYLAENRQYVSYDKTLKVGPYNFGFSTTRPDWVEHYPYQNGLLVWLWDTSQADDNTSVHPGQGLILPVDAHAKALKWANGTVLRNKIQAFDSTFSTYKTDAFTLHNADVALKIKSHKGVPAFDDRKGSYYDAANPFGSVKVTDTNTKIKIVKEPKDGSTITVQVGKSTK

SEQ ID NO: 12690 - protein, 127 aa, Streptomyces avermitilis
MAAGGFCKLPNGSVVVALNLPSPPGSGTAVALGAGAAMGTATDCVRVLVLAQNRARALTRLRNLGMRAVYLRGNAAPPTPDEITAVLHHPDGLLWRTAPDSGVTPPGPTTELWHPIRALLRRPAPQA

SEQ ID NO: 12691 - protein, 194 aa, Streptomyces avermitilis
MRRALIVVDVQNDFCEGGSLAVAGGADVAAAITELIGQAPAGYRHVVATRDHHVAPGGHFADNPDFVHSWPAHCVAGTEGVGFHPNFAPAVASGAIDAVFDKGAYAAAYSGFEGVDENGVSLGDWLRAREIGEVDVVGIATDHCVRATALDAAREGFRTQVLLDLTAGVAEESTERALEELRSAGVELSGKPVV

SEQ ID NO: 12692 - protein, 442 aa, Streptomyces avermitilis
VNPADLGLPVDVPSTALFTDQYELTMLQAALAAGTAERRSVFEVFTRRLPEGRRYGVVAGTGRVLDAVENFRFDAALLGFLRERRIVDEPTLEWLASYRFRGDIWGYPEGEVYFPGSPLLRVEGSFAECVLLETVILSILNHDSAIAAAASRMSSAAGARPLIEMGARRTHELAAVAAARAAYVGGFATTSDLAAGFRYGIPTVGTSAHAFTLLHDTERDAFRAQVDSLGRGTTLLVDTYDVAEAVRMAVEIAGPELGAVRIDSGDLLLVAHRVRQQLDDLGATETKIVVTSDLDEYAIASLAAAPVDAYGVGTQLVTGSGHPTCSMVYKLVARAHSADPAAPLEPVAKKSTGGKTSIGGRKWAARRLDEHGVAEAEVIGTGPVPAGLEGRQLLVELIKGGQVVARESLDVVRDRHAAARAGLPLSANQLSRGEPVIPTEYV

SEQ ID NO: 12693 - protein, 105 aa, Streptomyces avermitilis
MGRVTAPAPLEIEKTESAEEVFAVPEPDVPWVTIVHNDPVNLMSYVTYVFQTYFGYSKDKATKLMLDVHHKGRAVVSSGTREEMERDVQAMHGYGLWATLQQDRK

SEQ ID NO: 12694 - protein, 201 aa, Streptomyces avermitilis
MPGHFEPLPGGGAAVALDEVEISIIRSLAVQLLELIGPGPAEDAAADPLAELFAEGPSEPPSDPVLQRLFPDAYGGPGGEGGSPEEAEEQRAHSSEFRRFTENDLRAGKRENALVVIRTLDGMTVAGEGGAVLKLSPEESRQWLGSLNDLRLAIGSRLDVVDEEDTDLLYRLPDEDPRKPMVMAYLWLGGLQETLIETLMS

SEQ ID NO: 12695 - protein, 483 aa, Streptomyces avermitilis
MTSSQVDKQYDGNGAVGGDAPEEGYERGLGSRQVQMIAIGGAIGVGLFLGAGANIAKAGPSLILMYALAGVIIFFIMRALGELLLYRPVSGSFAEYSREFLGPFFGYFTGWTYWLMWVVTGMAELTAAAIYVHYWFPAVPQWVTALVFLVVLFVANLISVKLFGEIEFWFSMVKVTALIGMIVIGLGVLTFGFSSAGDTASVANLWQFDGFFPKGIGSSLMTLQGVMFAYLAVELVGVTAGESEDPEKTLPKAINTLPWRIALFYVGALTVILCVVKWTEFAPGVSPFVKAFAMIGIPAGAGIVNFVVLTAALSSCNSGMYSTGRMLRTLADNGEAPRVFSKLSASKTPAFGITISVLFMGIGVILNYVVPEKAFGYVTSVATAAGIWTWLMILVSHVLYRRAVDAGRLPASSFPAPGGAKCSWVAIVFLLFVTGLIAYDADSRVCLYVMAVWAAALAIGWYVLKARNPQVAERHEPKFEKVG

SEQ ID NO: 12696 - protein, 140 aa, Streptomyces avermitilis
MLTITQALVDQIVAHARQDHPDEACGVVAGPEGSGRPERFIPMLNAARSPTFYEFDSGDLLKLYREMDDRDEEPVIIYHSHTATEAYPSRTDISYANEPGAHYVLVSTADADDAGPFQFRSFQIVAGEVTEEEVKVVEAY

SEQ ID NO: 12697 - protein, 95 aa, Streptomyces avermitilis
MAIEVRIPTILRTYTDGAKAVDGTGETLAELFTDLDTRHAGIRARIVDEEKGGELRRFVNVYLNDEDVRFLDGISTKLTDGDNVTILPAVAGGMV

SEQ ID NO: 12698 - protein, 316 aa, Streptomyces avermitilis
MRYDSPLAAVGNTPLVRLPRLSPSEDVRIWAKLEDRNPTGSVKDRPALHMIEQAEKDGRLTPGCTILEPTSGNTGISLAMAAKLKGYRIVCVMPENTSQERRDLLGMWGAEIVSSPAAGGSNTAVRVAKELAAEHPDWVMLYQYGNPDNAGAHYATTGPEILADLPSVTHFVAGLGTTGTLMGVGRYLREQKPDIKIVAAEPRYDDLVYGLRNLDEGFVPELYDASVLTTRFSVGSADAVTRTRELLQQEGIFAGVSTGAALHAAIGVGNKAVKAGETADIVFVVADGGWKYLSTGVYTAATTEEAIATLQGQLWA

SEQ ID NO: 12699 - protein, 148 aa, Streptomyces avermitilis
MDTSWWLALAAVVLLALVATLVDGWGRRGRRPSGRTRPPGHPGAPGRPQPAEIWWANVPYEEGAGVKDRPCLVLAVRGGRATVAKITSKYHDERAGVIPLPPGAVGDAHGRASFLETDELRDVPLREFRRRVGVVDPVLWDQVRYLAG

SEQ ID NO: 12700 - protein, 250 aa, Streptomyces avermitilis
MKLTVVGCSGSFPSAESACSSYLVEADGFRLLLDMGNGALGELQRHCGLYDLDAIFLSHLHADHCIDMCAYFVARYYRHDGGRCAPIPVYGPEGTEQRLTTAYADTPSASSMSEVFDFHTVKPSTFDIGPFTVHTEKVRHPVEAYAIRIEHGGRSLTYSGDTGVTGALDELARDTDLFLCEAAFTHGKESIPDLHLNGREAGETATRAGARRLVLTHIPPWTDPQVNLADARETFTGPVELAAPRLSYEI

SEQ ID NO: 12701 - protein, 422 aa, Streptomyces avermitilis
VSTASAAPAAEQKKKGSGAMAVLQRIGRSLMLPVAVLPAAALLVRLGNADMLGRPSFPSFFTKIAGFMSAGGNAILDNMALLFAVGIAIGFAKKSDGSTALAAVVGYLVFKNVLATFTDKNLPKVATAVDGKVVMVDAPVDAKVLGGVVMGIVVALLYQKFYRTKLPDWAGFFGGRRLVPILSAFAGLLIGIVFGYIWPVLGTGLHNFGEWLVGSGAVGAGIFGVANRALIPIGMHHLLNSFPWFQAGEYHGKSGDIGRFLAGDPTAGQFMTGFFPIMMFALPAACLAIVHCARPERRKVVGGMMFSLALTSFFTGVTEPIEFTFMFIAPVLYAIHAVLTGVSMALTWALGMKDGFGFSAGAVDFGLNLGIATNPWGLVLVGLCFAAVYYAVFRFAITRFNLPTPGRESDEELAELQKAEAK

SEQ ID NO: 12702 - protein, 428 aa, Streptomyces avermitilis
MSADSAAAPARPRWSHLFQGLQKMGRSLQLPIAVLPAAGLLVQLGQPNVFGPEGLGWTDVSKVMMGAGSALLDGSLGLPLLFCVGVAIGMAKKSDGSTALAAVAGFLVYYNVLRQFPQDCASGAKAVVTGCRAADGTMVAFTYQNPGVFGGIVMGLLAAFLWQRYHRTKLVDWLGFFNGRRLVPIIMAFVAVAFAVVCLWVWPPIGAALEHFSDWLDGLDAWGAGVFGVANRALLVVGLHQFLNVPIWFQFGSYTKPDGQVVHGDINMFLAGDPNAGQFTSGFFPIMMFALPAAALAITHCARPNRRKEVGGLMLSVALTSFVTGITEPLEYSFLFAAPLLYAVHALLTGVSMAVTWGLGVHDGFSFSAGLIDYVLNWNLATKPWAIVPIGLCFAAVYYAIFRFAITKFDLTTPGREPEEEVEDITKA

SEQ ID NO: 12703 - protein, 77 aa, Streptomyces avermitilis
MATKAEKIVAGLGGIDNIEEVEGCITRLRTEVVDPSLVDEAALKAAGAHGVVKMGTAIQVVIGTDADPVAADIEDMM

SEQ ID NO: 12704 - protein, 244 aa, Streptomyces avermitilis
MSRIDGRTPEQLRPITIERGWSKHAEGSVLVSFGDTKVFCTASVTEGVPRWRKGSGEGWVTAEYSMLPRATNTRGDRESVRGKIGGRTHEISRLIGRSLRAVIDYKALGENTIVLDCDVLQADGGTRTAAITGAYVALADAVAWAQGRKLVKAGRKPLTGTVSAVSVGIVGGVPLLDLCYEEDVKADTDMNVVCTGDGRFVEVQGTAEAEPFDRKELNALLDLAVSGCDELAVIQRAALEATTR

SEQ ID NO: 12705 - protein, 138 aa, Streptomyces avermitilis
MSRGRNRSMAARHRRRTAAFAVVAALVAVPAVVGCDAVSKALDCVQAADSIADSVTDLQQAVENAADDPTQTDQSLDAIEKNLDKIGDKTDNADVNKAVDDLEKAVSNVRDAVKNGDETPDISPVTDAAGELTKVCTP

SEQ ID NO: 12706 - protein, 200 aa, Streptomyces avermitilis
MTRLILATRNAGKITELRAILADAGLTHDLVGADAYPDIPDVKETGVTFAENALLKAHALARATGLPAVADDSGLCVDVLGGAPGIFSARWSGRHGDDRANLDLLLAQLSDISEAHRGAHFACAAALALPDGTERVVEGQLRGTLRHTPTGTNGFGYDPVLQPEGETRTCAELSAEEKNAISHRGKAFRELVPVVRELLG

SEQ ID NO: 12707 - protein, 327 aa, Streptomyces avermitilis
MNLPPTHLPTPEGPGSVSQVPNLPARFTETFTSRYVDTGELRLHAVTGGQGPALLLLAGWPQTWYAWRLLMPALAQDFQVVAVDPRGVGLSDKPLGGYDTGTLARDMVALMDALGHQRFAMVGHDVGMWTGYALAADHPDRLDRLAVAEAAIPGLSPSPPLFGSRVANDRLWHFAFNRLTDVNEQLVSGREHLYFGRQFATKSAKPLPDHAVQHYVGILAADPEALRSSFEFYRALDTTIAQNQRRQARRLSLPVLAIGGAENMGASVSETMKLAADDVESLVLPECGHYPAEETPEAMLAALTAFLAPYRDGRTAADIPTARGTDA

SEQ ID NO: 12708 - protein, 203 aa, Streptomyces avermitilis
VSGRKQFDVSAALDQAMRVFWQRGYADASLDALGAATGLGRGSLYGAFGNKDALFGQCLDRYASIYGAQYEQALAAHPGDPVRAVEAFFDVILGRIADPSVPVGCLIAQSAAQSLTLKEESGVHVRGLLDTQRQRVRAALADSSAAPRTLDELATFVIAVNQSLAVLSRAGTSDAELRSVTRLACTTVADTLARVASENVAQA

SEQ ID NO: 12709 - protein, 502 aa, Streptomyces avermitilis
MAATEPGPVEAAAGPEAVKRHRRLFRAVARRRNPPLRRTDITVTDERAVKRAVKAASLGNAMEWFDFGIYSYLAVTIGHVFFPSGNGTVQLLSSFATFAVSFLVRPLGGMVFGPMGDKVGRKKVLALTMILMAIGTFAIGLIPPYATIGFWSPVLLILFRLVQGFSTGGEYGGASTFIAEYAPDKRRGFFGSFLEFGTLAGYVGAAGLVTVLTTVLGSGGMESWGWRVPFLVAGPIGLVGLYLRLKLDETPAFQKLEDNSARKATDAASTVETTAKGDLAKIFRNHWPTLILCVCLVGAYNITDYMLLSYMPTYLSDEMGYSETHGLLVLIVTMLLLMLVISQVGKLSDRYGRKPLLMAGMLGFLVLSIPAFLLVKQGSLVAVSAGMLMLGLSLVCMLGTMSAALPALFPTQVRYGSLSVGYNLSASLFGGTTPLVITALISATGTDMMPAYYAMAAALVGIITVACMKETAQQPLAGSPPSVETPEEAAELVESRTPMPRP

SEQ ID NO: 12710 - protein, 155 aa, Streptomyces avermitilis
MSERLQPGDTAPAFTLPDADGNEVSLADHKGRKVIVYFYPAALTPGCTKQACDFTDNLELLAGAGYDVIGVSPDKPEKLAKFREQENLKVTLVGDPDKQVLEAYGAFGEKKLYGKTVVGVIRSTVVVDEEGKVERALYNVKATGHVAKIIKDLGI

SEQ ID NO: 12711 - protein, 112 aa, Streptomyces avermitilis
VADTSSTPDTRTPAQIEADIRRRRDTLAETLDEIGVRVHPKTIVGDAKAKVVSHIDNTLGRAYVGVNRAVSDVKGQLVTKEGAPRLERIVPVALVVVGVVGLVAVGSRRRKR

SEQ ID NO: 12712 - protein, 118 aa, Streptomyces avermitilis
VSAKLHKHSTHDDKLPIRMLHDRVLVRQDTSEGERRSGGGILIPATAAVGRRLAWAEVVAVGQNVRTVETGDRVLYDPEDRAEVEVRGTAYVLMRERDLHAVAADRFEGSEDSTGLYL

SEQ ID NO: 12713 - protein, 748 aa, Streptomyces avermitilis
VLGTFVGVVLILVGLFVLGYNLVKIPPANTTATKQSNVYLYADGSQLARDGEVNREIVTLAQMSKGAQHAALAAEDRDFYTESAVDPKAMIRAAWNTATGKGKQSGSTITQQYVKNYYLAQEQTVSRKVKEFFISIKLDREKSKDAILEGYLNTSYFGRNAYGIQAAAQAYYGVDAKDLTVGQGAYLAALLNAPSEYDVVAHPENKSAALARWNYVLDGMVKKNWVTQSARDKVKFPQPKQAVVAAGMSGQRGYLVRAVKDYLTEHKIIAEDTLDTGGYRITTTLQKPKQDAFVKAVDDQVMDKLDKKNRKVDNYVRAGGVSIDPATGKVIAMYGGIDYTKQYVNNATRRDYQVGSTFKPFVLTSAVQNGSVTQDGRTITPNTGYDGTNRRPVQGWTGGTYAPENEDGVSYGPISVREATDKSVNSVYAQMAVDVGPSKVKQTALKLGLPENTPDLNPYPSVALGTATASVLDMAEAYATLANHGKHGTYTLVEKITKDGEGVQLPKQAAKAAVSREAADTTTSVLQSVVQNGTATAALAAGRPAAGKTGTAEEDQAAWFAGYTPHLATVVAVMGQDPESGKHKALYGAMGLPRINGGGAPAQIWAQFTKAALKGKPVADFDLRLQAGAQEQQPLPTGPGDEPGTGGQDNGGTTSDGGQTSEPTTEGQTDGGTPTTGGTTDGGTPTTGGTTDGGTTDDGGTTDGGTTDDGGTTDGGTTDGGGTTGAGGTTDGGDATGAGGTTAGLFGR

SEQ ID NO: 12714 - protein, 266 aa, Streptomyces avermitilis
VGTGRLYAAVAAGGFRRYATYRTATAAGVFTNTVFGLILAYTYIALWDERPHLGGYDQAQALTYVWIGQALLMTLAIGGGGFEDELMERIRTGDIAIDLYRPADLQLWWLAGDLGRALFQLLGRGVIPMVLGAFFFELALPADPLRWAAALVAVFLAMLVSFAIRYLVALTAFWLLDGAGVTNMAWITGMFCSGMVLPLNAFPGALGEVVRALPWASLLQAPADALMGRAGLPATYAFQGAWAVALLAAGRLLQSVATRRVVVQGG

SEQ ID NO: 12715 - protein, 299 aa, Streptomyces avermitilis
VARSRVAGSKEAGPKVAGSRSRAAGQGRVGARLADGLRAYRMIAGMWIRSTMAYRASFVMTTFGNFGATALDFVAILLMFSQVDALGGYTLPEIAFLYGVAGIAFGLADLAIGSMDRLGRRVRDGTLDTLLVRPAPVLAQVAADRFALRRLGRITQGLLVFGYAVAALDIAWTPLKVLMVPFMMLSGGAIFAAVFVAGGAFQFVAQDASEVQNSFTYGGQTLLQYPPTVFAADLVRGVTFVVPIAFVNWLPALYVLGRPYPLDLPTWVAFTPPLVAAACCALAGLAWRAGLRSYRSTGS

SEQ ID NO: 12716 - protein, 335 aa, Streptomyces avermitilis
MPDGDFITLDRVEKVFDVRRKTGFLRSERRRVRAVDSLSFTVARGEMVGYIGPNGAGKSTTIKMLTGILTPSGGRLRVAGIDPSRERTRLAARIGVVFGQRTTLWWDLPLIDSYRLMHRMYRIPDGRYRENLDRCVELLELGDLLDVPVRQLSLGQRMRGDIAAALLHDPEVLYLDEPTIGLDVISKARVREFLRELNAERGTTVLLTTHDLQDIEQLCGRVMVIDHGRLMYDGPLAGLHEVGDSERTLVVDLARELPPIEAAPARVVKVEGPRQWLAFPASESAAPLVARIAAAYPLVDLSVREPDIEAVIAKMLQSMGDTPQPPPEQAEHVVS

SEQ ID NO: 12717 - protein, 300 aa, Streptomyces avermitilis
MTDEEPSELRASDADRERVAEQLRDAVAEGRLDMEEFEERLEATYKARTYGELTPITRDLPAAGVGAPPVSMVKQPAPSGSWAERIVGGDGSSSWAVAIMAGFQRKGRWTVPKRFNSFAFWGGGEIDLREAYFADREVVVNCVAIMGGMNVVVPPGVEVVVRGIGVMGGFDHREEGVPGEPGAPRVIVTGFAFWGGVGVERKLTRAERLRLKEQRRQEKLERRAARKELQGSGSDGRDVRDTLDELDDVYDTAREALEEHRDLVRERHEERRERHAQRHELHRERREARREDRDRRRHRD

SEQ ID NO: 12718 - protein, 464 aa, Streptomyces avermitilis
MTHHGVITSEPRAPIARGDTHRMTKRHGYALLAAICTLIVAISAAIYIGAGADDGQDQSALADDRPPRNSAAPASTGTWVGAWSASPAGAEPGTETDGLAGRSVRNVVHAGIGGTGARVTLSNLFGQQPLTITHATIAVAATANSAAASTGTMRRLTFDGATSVIVPAGQQVLSDAVRVTIPHDSDVLVTTYSPTPSGPVTYHPQARQISYAAQGDRVEDVTATAYTEQTTYWRYLTALDVLSNESSGTLVAIGDSLTDGVTSTVGTNSRWTDILSDRLRASAGTGDVPRYSVVNQGISGNQVLAAGLGRPAENPSGLSRFGRDVLDRTNVKAVVIDLGVNDILRNPGRADPDRIVAGLRTLVRQAHARGLRVVGATLMPFQGHRGYTPYRETVRQAINAQIRAGQVYDAVVDFDKALRDPYNPRKLRSDYDSGDHLHPSDKGYRTMADAIDLADLTGAVPAEL

SEQ ID NO: 12719 - protein, 455 aa, Streptomyces avermitilis
VYKVTERVERMERTNTEELGAAGQHARPGAATNRAMTSFSPADEEKRRGVRRMKATATAMLLFVALVYVVAKWASHQGAGPWAGYVAAAAEAGMVGALADWFAVTALFRHPLGLPIPHTAIIPTKKDQLGVSLGEFVGENFLSSDVVRSRLRAVGIGSRLGAWLAEPEHADRVTAELATALRGALTVLRDSDVQAVVGEAITRRADAQEVAPGIGKMLERIVADGGHRRVVDLVCARAHDWLVLHDEQVMDAVQGGAPGWTPRFVDKKVGERVYKELLRFVTEMRDAPAHPARGTLDRFLTDFASDLQSDTDTRVRVERLKGEVLGRGEVQDLIASAWTAVRSMIVSAAEDERSELRLRVRASLLKLGARLATESKYQTKVDGWLEGAAVYVVTTYRDEITSLITDTVASWDAEHTTKKIEAHIGRDLQFIRINGTVVGSLAGLLIYTVSRLLGA

SEQ ID NO: 12720 - protein, 501 aa, Streptomyces avermitilis
MSASAPQAHGPAATGTVTTDVPARLDRLPWSRWHWMIVIGLGTVWILDGLEVTTVGNIAGRLSEDGSGLSITSAQVTGVAAALYVAGACAGALFFGWLTDRFGRKKLFMVTLVVYLSATALTALSFNSWWFFTFRFLTGFGIGGEYAAINSAIDELIPAKYRGRVDLIINGSYWLGAIGGALLSIVMLDTSIFPKDLGWRLTFALGVVLGLVILLVRRHVPESPRWQFIHGRGEDAEALVSSVEREIEQEKGEPLPRAESEITIEQRKSIGFGLIAKTVFGRYPKRAVLGLALFIGQAFLYNAITFGFGAILTTFYDVPTGGTGYYFAVIAAGNFIGPLLLGKLFDTVGRRIMIASTYLLSGLLLFGTAWLFDRGSLSAMTLTACWCAVLFFASAGASSAYLTVSEVFPMETRAMAIAFFYALGTAAGGISGPLVFADLTESGVVGDTVLAFQIGAGLMCAAGLVAAFLAVNAERRSLEDIAEPLSVAQTTAPAPASASGT

SEQ ID NO: 12721 - protein, 159 aa, Streptomyces avermitilis
VTLVRMTEKLLSPLHTRPWPERWLTRVLGAALASAAYLLCLPWDLNNRAPSPGAVEETTPVTGVGVVALAVILLALAAYFGHRDSLGWPVLLVAVPPAALLYVSLRTHPGPPDGFAGVWPLVWGFFTLLIGVGVLVAAAVAREFRADLVDEELSLAHRR

SEQ ID NO: 12722 - protein, 169 aa, Streptomyces avermitilis
MYAQQEQSTPGAYLTFVERQLSADGCTTRWEDWAGVPVLVGRRADFRLSWMATRLHLFTVAAAVPEVTVPVISTFTDQVMKYAKDTKGGLPVGLQNGVGAFPVLVSDRIDPAAVQWAEEQQRLKFACMTRPVVVDSARRYVAMYRGKPALGRVYASHFIEKGSQYFYGQ

SEQ ID NO: 12723 - protein, 149 aa, Streptomyces avermitilis
VTKFLLAVHVIAAIVAIGPVTVAASMFPPTARKALAAPDDAQALATTRLLHSICRVYATVGVVVPVFGFATASSMGVLGDAWLIVSIALTALAAVVLGALVLPRQSAIMEGAGDRAATVQLAMFTGIFNLLWATVTILMIIRPGSTTGA

SEQ ID NO: 12724 - protein, 341 aa, Streptomyces avermitilis
MHTVAVLALDQVIPFDLSAPIDTFGWARLPDGRAAYRIRVCSASADDEVSAGLFALRAPYGLEALAEADTIILPGVADPTVPLPPGVAEALCAAAANGTRIASVCVGAFVFAATGLLDGLRATTHWVAAQDLAARYPAVTVDPNVLYVDNGQFLTSAGAAAALDMCLHMIRMDHGSAVAAHAARMSVMPLEREGGQAQFIVHDQPPVPAGTTMEPLLGWLEENAGRDLTLDDIAAHAGMSTRTLNRRFREQTGTTPLQWLHLARVRRAQYLLEATTYPVERIASQAGFGSPTAFRERFRRVVGTSPYAYRKAFRGADDGRPGPRGALAAPGAHSSSGSSST

SEQ ID NO: 12725 - protein, 101 aa, Streptomyces avermitilis
VMAKVPTAVVAASGLVGGYGVARWTKKRQLGGVVLATAGAAAAQQWRRQAGGKAAGALTAAYVAAFAGSHPLAKKVGAWPAVFGVAGAVALASWAVADRRA

SEQ ID NO: 12726 - protein, 242 aa, Streptomyces avermitilis
MAARGQRYTPQPRVASARSEETNPYGLLGPRKAAADGYGIVGEYLYLRSSPPPSGDESRAPAWRRALTGTAKHRVSVRLPDGSRVEYFADGCVARARAEVYGADWDRTEPVVAALSTRVLAAVEKDPDYRAAIRRWSACMAETGHPADDPQASRARLNGRLAKAAADPTSLRALGREEIRTATADARCQARAELAKTIGRVQRSVEKRVLSAAERGVVARHVAAKRDVLKASMTSGASRSGR

SEQ ID NO: 12727 - protein, 124 aa, Streptomyces avermitilis
MHRILVRSGIALGGAALAAVGALATAGPANAAWSDCPAGSLCAYLGTNGSGDPGTVSGDNNNLLQYNKFNNAESLYNHGNSCNVRIFSGLNKTGSSYVLDRGYTNPTLAGTVYWHNVASNDWCV

SEQ ID NO: 12728 - protein, 157 aa, Streptomyces avermitilis
MRRLKEVSGLSFSKLAARTHYSRSSWERFLNGKKPVPRAAVEQFASALGDEAGSLLLSGGSAPEAAPESAVAGRGLTADSPADEGPAHDRGRNRGGARGRPVTLGAFVAGVAVGALAAAVTGLLSERGAAARRPCDGCICPSAVPRFPIWQSRTYHV

SEQ ID NO: 12729 - protein, 64 aa, Streptomyces avermitilis
VDLANADIVLQSYIADDRTRTECVGNTAPGHDKGIPEHETVIRLPVHLVPLLREACDAAERAAL

SEQ ID NO: 12730 - protein, 177 aa, Streptomyces avermitilis
MPQNELRFDDLLEAARHSAVHLEMRDAYGVGDEDADFNEWQRSGNRDSDPSSPYWAPWVDLISRARDRGVTVRRARIVSEPVTDYIRYEHAGTPVNIQAGEQVRWLSRRNASDLMLPGCDLWIFDGAQVLFNHFTGSGDWADPPLELRTEPGIVKQCADAFEAVWERAIPHDQYEIH

SEQ ID NO: 12731 - protein, 283 aa, Streptomyces avermitilis
MPISPSSSAQEARKNVASRLRELRKEAGLTVVELAGRCGWHHAKTSRIENAKTPPSPMDIRRWCSACRAENRADDLIAASRDAESMYMEWQRQVRQGLRQLQDSYVKLYRSTHLFRVYSPTLVPGLLQTEGYAQAVLSTNAQLLDVPNDAEQAAAARLERSQIIHEPGRRFVMLIEEAVLYYQLGDGDAMAAQLGYLLTAGALPAVSLGIIPRATPARALWPQELFHVYDDSLVSVELLSAQVNITQPSEVELYLKAFERLRGMAVYGADARALILQAIEALQ

SEQ ID NO: 12732 - protein, 158 aa, Streptomyces avermitilis
MGASGWEYVTAYEGSVEESLEALHAQVFEELYGDDDDYRSLAELWEDEEFMGEEGTHSILDIDRVVHTTAAPSEHSDKDYGTLRPLGRERLVHHFGTDRPSPARFQELLEQAEAALTGPSSSEETLLDECRMRWTGVYVVLYTDEKPTHLGIFGCSGD

SEQ ID NO: 12733 - protein, 70 aa, Streptomyces avermitilis
VSIAESKVDDSSMWFTSSYSNGAGGECVECASSDDNALIRDSKRLGGPVVGVPGLAWHAFVRALKRGELG

SEQ ID NO: 12734 - protein, 282 aa, Streptomyces avermitilis
MAGSPTARRRRLSIELKKLREKGALTCAQVGEALDWSGSKVNRMETGSGRVQPSDIDALCRFYDTSDELREFLMSLARQAKTRGWWQVHGAGVPEWFNIYIGLEQDASTFRQYQCELLPGLMQTAAYAGELHKTGAHLSAEVIDRAVRVRMERQAMLTRSDAPDAWFVVNEGALRNVIGDSSLMREQLERVLDAADLPSVTLQVLPFDSGTYPATGSFTMLGFPDQEDPDIVYRDGITDAVYLEGEHHVREYTRAFDGLRAAALSPQRSSRLIKSVLKEYAR

SEQ ID NO: 12735 - protein, 220 aa, Streptomyces avermitilis
VIQEACMSRKPWDLAFTAEPEEVAGLRRVMRLHLRAWGLYELIDEAQLCVSELVSNVITHVGRGTPATLAVSMNGTHLRIEVHDPDTRALPTLVQAEADSEGGRGMALVEAVADRWGVQLQPDRKVTWCELSTNLSSPHGHSGGVRVARAGAMLGLYRAAQLPRITGSSALGVGVAVAEETAINVIADVLRWLQAHGRDVDEALDRAQMHCEAEPGGGAE

SEQ ID NO: 12736 - protein, 973 aa, Streptomyces avermitilis
MASLAADTAAPPWPNTSDAVELIADGPRQLLAVAEQEAPGVYAVRPLTPLSETALITNSPEDPSLGSELRAELATADRIDLLCAFVKWYGLRVLEDSLRAAKERGVPIRVITTTYIGATDRHALDRLVRDFGAEVKVNYEIRSTRLHAKAWLFRRNSGFDTAYVGSSNLSKAALLDGLEWNVRLSSVATPAVLNKFEATFDAYWNDSAFEAYNPDDDGERLDQALSQAGGTSSTADLRINLSGLEVRPFPHQRDMLERLRVEREIRGRNHNLLVAATGTGKTVMAALDYRALCQKHDGGAPRLLFVAHRKEILNQSLRMYQEVLDDASFGELLYTGEDPRRWQHVFASVQSLNVQRLEQLAPDHFDIIVIDEFHHATAATYRRVIKHFKPKQLLGLTATPERMDGLNVQDEFFEGRIAAELRLWEALENDLLCPFHYFGIPDGTDLTSIGWKQGAYADRDLGNLYTGNHARARIVVKQIQDKVSNPGAMRALGFCVNKAHAHFMADFFREAGFQAAALDSDSPAGVRAQALSDLRNGKLQVIFSVDLFNEGLDIPDVDTLLLLRPTGSATVFLQQLGRGLRRTESKPVLTVLDFIGQHRAEFRFEEQFRALTNLSRNRLVDHIEHDFPQLPSGCQIILEGKSKDLVLDNIRTQLGATVKTLVKEVKDYGTPRLSDYLRESRREIKELYKSDNSWTTILRRAGLIDAAAPSGETELLKRVHSFLHVDDPDRARAYLRLLADDAPPYESLTPTEQTYAAMLFFNLWDNAGGFTSFQQGLESLRAQRVFRDELRQVLSYVMEQSDHFPIPLSGPHSSVPLKVHSSYNRSEILAALGVARFGGQMPRSFAQGVQWVEEIKTDALLITSEKNEKDFSPTIRYKDYALSPTLFHWESQNAIAANSRTGLRYQQHEQQGSHVLLFMRRYKSTDIGKSQPWMLLGPATYVEHTGSKPMAITWRLQHELPADVWTYSAITPG

SEQ ID NO: 12737 - protein, 177 aa, Streptomyces avermitilis
VEQQIADLLDEQEELDLPQEQLEAAEGESEEESEEESSQGEKFPKTRAARIQRLVRDAAVSRNVKDLYGGECQACGLRLVGPDGRPYSEGAHIRPLGKPHCGPDVEPNVLCLCPNCHVRLDIGAIIIEDDWSIIVRAGELGGNVLSKLKRKKEHHVHLDYVRYHREWWLEKGDPSQE

SEQ ID NO: 12738 - protein, 337 aa, Streptomyces avermitilis
MRPDTPAENVDHHAEAARLERTAGLYPEDAEHLLLQAAAHLELAGHRPRATSLYDSLLSSSTPLENPHLVRALKASNLWEYGHEAEARAIIDGIRAASPRDPAPWVIVAEALEQHDELEAAQETFTQGVTLLLTDVPEPPYSTLPLLFGRHRVRRMLGAPHDEWDTRADTLNSSSVSLDELHDPKRIWSLGSNNPAELEAEISRLRAELGVYREALSRPFPVAVLHWPAQELTELLAAFPSLSAEYPSHEQHLATIEASLRELSASGTPNLGIVTGTVPSYEAFAASEASSPADGSLLPQYATTLAARGLAVAWPPQRTGECWCGSGRVYGECHGAE

SEQ ID NO: 12739 - protein, 491 aa, Streptomyces avermitilis
MIRRRTLLAAAGGTFLGSALATGTARADATIAVNPSTTYGKWEGWGTSLAWWANVFGARDDFADLFFTTKSVTYNGRTLPGLGLNIARYNLGACSWNSVSGESMVASANIPAFKQIEGYWQDWNNEDPTSSAWKWTADAAQRTMLVKATARGATTELFANSPMWWMCLNHNPSGASGGGNNLQSWNYRQHASHLAAVALYAKSNWGVNFATVDPFNEPSSSWWTATGTQEGCHMDASVQAAVLPYLRSELDRRGLTGTKISASDETSYDLARTTWGSFGSSTKALVNRVNVHGYQGSGGRRDLLYTDVVTTAGKALWNSETGDSDGTGLTLASNLCLDFRWLHPTAWVYWQVMDPSSGWAMIAYDASTLQPGAVQTKYYVMAQFSRHIRAGMTIVDTGVGYAAAAYDATARRLVIVAVNTSTSAQTLTFDLSRFSTVTGGTGGLVRRWNTVTGGGGDLYAAHSDTYLSGKSLSVPFAAGAVQTLEVDGVTV

SEQ ID NO: 12740 - protein, 272 aa, Streptomyces avermitilis
MRAPGVPVVQQRTRRRRDLRRRTLWTGGELLVTVGVVLLLLVVHQLWWTNRQAQRDAERGVRALEREWGSPSAPESASTAAADGDRSGRDGGDGGDGSASAGPSRDGNAAHATPAPQPRPSQAYAVLTIPRLSLRVPVAEGIGKASVLNHGYVGHYPKTAQPGRAGNFALAGHRNTHGEPFRYLNRLRRGDTVEVETRTATYTYVVDRTLPQTSASDGGVIARVPRSTVRPAYGYRSPGYYLTLTTCTPEFTSRYRLVVWGKLASMRPRAPR

SEQ ID NO: 12741 - protein, 111 aa, Streptomyces avermitilis
VRAGGEGQFMIRTWVAMRPAAVLLVLLLELAVLDAGSLSAAVAFAATAAAGSALAACALIAARCAPAVPRTRVRTAIRDREQRTAFLPQRDPDASGRTRPRAPGHALLTAA

SEQ ID NO: 12742 - protein, 243 aa, Streptomyces avermitilis
MSVFAGLVEQLADVLQPLFHASAAAAAIVLFTALVRLLVHPLSRASARGQRARARLQPQVAELRKKHGKNPEKLQKALLELHAEEKVSPLSGCLPGLFQLPAFFLLYHLFSNTTIGGEGNELLTHTLFTAPLGDRWADALGDGGPFGTQGLVYLGLFAIVAAVATFNYRRTKRTMAANPLPVGDGEQQVPGLGAINRFMPLMSFFTLFTVAFVPLAAALYVVTSTTWSAVERAALYPVPERSS

SEQ ID NO: 12743 - protein, 285 aa, Streptomyces avermitilis
MKLLRVGTAGAERPALLDAEGTLRDLSGIVPDIDGALLADDAALGRIRSAAQAGELPALDAAGLRVGPPLARIGKVVCIGLNYHDHARETGAEPPTEPVIFFKAADTVVGPQDTVLVPRGSAKTDWEVELAVVIGRTARYLESHEEALAHVAGYAVAHDVSERAFQIERGGTWDKGKNCETFNPLGPWLVTADEVPDPQDLALRLWVNGELKQDGTTAEQIFPVAEVVRYVSQFMTLYPGDVINTGTPAGVAMGRPEPKPYLRAGDVVELEIEGLGRQRQEFKDA

SEQ ID NO: 12744 - protein, 163 aa, Streptomyces avermitilis
VTEAAKPPTIPELEAQERRLTLPHFTYDDAWAFGNLLVELARRRCAPVAVDIRRGGQQLFHAALPGSTPDNDAWIDRKRRVVERYGSSSYLVGCRFRAKGTTFEESSRLDPDKYAAHGGAFPITVEGAGVVGTVVVSGLPQVEDHALVVEALEQFMTRPWSSS

SEQ ID NO: 12745 - protein, 364 aa, Streptomyces avermitilis
MTGTASGSGTPLRVALVGYGLAGSVFHAPLIAATEGLALDTVVTTSPERQEQARAEFGDSLRFAATPDDLWSRADELDLVVIASPNKTHVPIATAALKAGLPVVVDKPIAGTAAEARELAALADERGLLLSVFQNRRWDNDFLTLRKLLEEGELGDAWRFESRFERWRPQPKGGWRESGDPAEIGGLLYDLGSHLVDQALALFGPAASVYAESDVRRPGAETDDDTFIAVTHTNGVRSHLYASATAAQLGPRFRVLGSQAGYVKYGLDPQEAALREGDRPTGDGDWGVEPESLWGRVGAGESPLSGGGTPVPTLPGAYPAFYDAVAKALREDGPNPVTAYEAADALDVLEAARRSARDGETVIV

SEQ ID NO: 12746 - protein, 428 aa, Streptomyces avermitilis
MAYVNRSNEESGGTAGARPAVASETGAGVKPGAKSGVKAGVNLLGLRGHNAALVLDLLRTAGPAGISRLELAERTGLTPQAVSKITARLRADGLVAEAGRRASTGGKPRTVLCLVPGAGHAVGLHLDRDELRALLCDLTGAVVAERRAPLDLGAGAETLVEGAAREVEALLAAGGSVSVLGVGVALPGPLDHVHGVLHRVTGFPEWDGFPLREALARRLGVPVVMDKDTNAAALGLAVGGVVEGDHEAYGAYGVNGVYAPPWGSAESSGPASSSASFAYLHLGTGLGAGLVIGGAVHRGARTGAGEFGHQVIQLDGPPCGCGNRGCIEALCLAAVARGAVDEAARVLGAGAANLAGLLDIDLVLLGGRTVAAHPKAFVRGVGAVLDERARREGTTAAVPVRIAPGGERGVAEGAAQLLLAPLFGRADG

SEQ ID NO: 12747 - protein, 339 aa, Streptomyces avermitilis
VDPESAAHESAARRSTALASAGPRPAALVSAVSSPAPFSPAVTNPVASSPVATSLAVPLPADRSPTCTTPVVGAFPLATRIHGGPGSYEAGGAEGTWFIDLKNTTAHPCGNIHPVVVLVDEKRVLTVTQPRLEFFEGARPHPVTFERTDQDELVGVFDDGFPGFTVAPGRTLTVKVRLTVAAGTVPDAVVANAAIVQRRGADGDWVGQSNDYRFQVVVDAGNGDGNASDGNESEGNASEGNGDGTGSGDGTENGDGNLSGDGNTSGDGDTSSDDSNAGDGSASPAPTGSPLPREDGAEELARTGPRAPHGLGAVFGTLLLVVGGVLLAAAGPLLHRNRR

SEQ ID NO: 12748 - protein, 259 aa, Streptomyces avermitilis
MAERKPIESWLTDMDGVLIHEGVPIPGADAFIKKLRESGKPFLVLTNNSIYTPRDLHARLRRMGLDVPVENIWTSALATAQFLGDQRPDGTAYVIGEAGLTTALHDIGYVLTDHEPDYVVLGETRTYSFEAMTQAVRLINKGARFICTNPDETGPSAEGPLPATGAVAALITKATGKKPYFAGKPNPLMMRTGLNTLGAHSETSAMIGDRMDTDVLAGMEAGMQTFLVLTGLTGPDQVENYPYRPSKVVDSIADLVDWI

SEQ ID NO: 12749 - protein, 215 aa, Streptomyces avermitilis
MGSLRLTVCTGAVVAAALTPTSYAAASTGVGVSPASPAPGSDIRLAARGCDGRTGTAASDAFVADTPLVGKDGVLVGESRVRTLLAPGSYDVLISCDGRDDKVRAALTVAGASPATPAEAPTAPLSPAAPLSSAVPPSPAAPLSPVEPLSSVAPLSSAAPASPVAPVNAGGGGTAHLASEKARETGAGNVLVGLALAGIAACAVRGAARRNRGTN

SEQ ID NO: 12750 - protein, 221 aa, Streptomyces avermitilis
MSDRERSSGNGRLLMGISWAVLLLGLWLWGRQVTDVPPGMSARTTGDVAAVGRPLEVELPHSAEPLGEALPQRVDIPAMGVQAPVVARGLDGHGAVQPPPFDQPGVVGWYAAGVKPGAAGTALFVGHVDTETRPAIFYKLSTLRPGDAVRVVRDDGRVAEFTVDDVQVLARDRFDAQQAYGPRKPGRAELRMITCGGSFDRDSGGYTANVVVNAYLTGSGP

SEQ ID NO: 12751 - protein, 338 aa, Streptomyces avermitilis
MYGKRGAGALAAVALAGAALLLAGCSAPEDNSKKGGGGADIAQRPKGSDPFWVNPEGNAAEQLATYARAGRKDDAEQIRKIAEQPTGEWIGPENPEAEARGYTEAAEKADRTALLVLYNIPHRDCGQFSQGGAADGDAYRAWIDGVTKGIGDRNTTVVLEPDALLHIVDGCTPDEFHEERYDLLKGAIAKLGALKNTKVYLDAGNAGWGHPDQIFQPLQRAGVDRADGFAVNVSNFYTTRDSIAYGKQLSAKVGDKHFVIDTSRNGNGPYTAGKADENWCNPPGRALGETPSTKTADPLVDAYVWVKRPGESDGTCKGGPKAGEWWSDYALKLARASK

SEQ ID NO: 12752 - protein, 645 aa, Streptomyces avermitilis
MKDQAGRRRARRIAISGAVVLALAGMNGPWLYRFGTEKYHQYTINKPEYKAANGHWDVIDFPEEYRLNTIHAALLHTGKILLIAGSGNNQDNFDAKKFDTRIWDPEKRTIKKIPTPKDLFCTGHTQLANGNLLIAGGTKRYEKLKGDVTRAGGLMIVHNENPDKPITLPAGTAFTGKRNGKTFVSKDPVLVPRAKKVFDKATGRFLRNDPGLGRIYVEAQRSGQKYETGTQDNYRIGGLAGASARNTYGIAQKLALDKKDFQGIRDAFEFDPVAEKYIKVDPMNEARWYPTLTTLSDGRVLSLSGLDEIGQLVPGKNEVFDPKTKKWTYTKGVRQFPTYPAISLMQNGELFYSGANAGYGPDDVGRDPGVWDLASNKFTKLPGLSDKNMLETAGTVLLPPAQDEKYMVVGGGGVGESKLSSNRTRLIDLKAKNPRFVDGPTLEKGTRYPQSSILPDDTVLVSGGSQDYRGRGDSNILQARIYDAKTNGFKRVADPLVGRNYHSGSILLPDGRVMFFGSDSLYADKANTKPGVFEQRIEIYTPPYVYRDSRPSLSGGPGTLARGASGTFKSAHASSIKTARLIRPSASTHVTDVDQRSIALDFKKSKDGITVTVPKNRNLVESGWYMLFVTDDQGTPSKAQWVRVP

SEQ ID NO: 12753 - protein, 664 aa, Streptomyces avermitilis
MTSTPTGARQNFDPSETTQLRVPGHRSGNTGSFRRIKKNLPRYDYEHYSRLAGPLTQPDPHQPYKVQYRTLLSQEPHRLRAALMLGAAPLLSLVLLGWLLQPEHWTERDYPAYDFLPALDIVMLVSIGLIEFFRCMNVLSNAHATLVARDPIPVVPETGTRVAFLTSFVPGKEPLEMVTKTLEAAVRLRHRGLLHIWLLDEGDDAEVKAVCERLGVHHFSRKGVAKWNQAKGPHRAKTKHGNYNAWLEAHGDDYDYFASVDTDHVPLPNYLERMLGFFRDPDVGFVIGPQVYGNYDNPITKAAESQQFLFHALIQRAGNAYGAPMFVGTSNAVRIKALKQIGGLYDSITEDMATGFEIHRHKNPATGKKWRSVYTPDVLAVGEGPNAWTDFFTQQLRWSRGTYETILKQYWKGFYSLPPSKLFNYTMMIIFYPMSALNWILAALSCALFLGLGASGVNIDPTVWLMLYGNASALQIGLYVWNRRHNVSPHEPEGSGGVAGMIMSALSAPVYARSLMDAVLRRKSKFVVTPKGDSASPDTLFGTFRIHLFFILVFAGSIAAGLFLGHAHPAMITWASFALLITASPILAWRWTLRQAKRRPAAVADPAEPPDAPVTPPQPAPAHARPKPSWAADAGNATGSAGSADSTAAGNDQTMQIALGGHKK

SEQ ID NO: 12754 - protein, 240 aa, Streptomyces avermitilis
LAGYPLAMARDLQERIKKLIIDRRLPSGAVLPTEPELMKLLGASRNSVREALKALQAMGIVEIRHGFGTYVGPMSMAPMIEGLAFRTVAGHRRGEDSLLQLLELREAMETGLVSRLAGRVAPRDLVELDGLVDRMEREAAEGAGLAETDRAFHATLYRGLGNVLLSEVLEAFWDAFHRVRTDLADVPQDPRVTCRQHREILDAVRSGDSIRAEEAIREHFGNIRTRLASTEPIAPTRRPN

SEQ ID NO: 12755 - protein, 399 aa, Streptomyces avermitilis
MATPEFEEFDPASGCDCPGCVHWHRAGGAPSGGRPRAGESPFALSGQLVRPAARGALVLAAVAGAVLGASHSMPAVAAAHGPVRPGVPAGDEPQNPQGGKAPLHGPGGRPATVKAPPTTRAAIIDRARTWTAAEIPYSMSAYWSDGYRQDCSGFVSMAWNLGDNEWTGSLDKFGVRISKEEIKPGDILLFHNPDNPEKGSHVVLFGGWTDYTHTEYLAYEETPPVARMQATPYAYWSNSDSYVAYRYMSVLEDVGVSGSPAAVPLEVVPDYPGDAYFGPGADNRYVTQLGRLLVDRGGARFYATGPGPRWSDADSRATQAFQEAQGWQGAGADGLPDPTTWAYLLERKGRDIPPADSSGVTGSPVGDRRSVEAFPRAKGRRGGAADGHPGPEAWRRLFA

SEQ ID NO: 12756 - protein, 398 aa, Streptomyces avermitilis
MTTTTSNTPESEGPPHNGAPRPARLIHNESTTEIPVHLLFRDDPDPDPDPVSVPPAPAVVGRRRGTGEQPRLRRSVPVRERPVPVVDPELVERPARVLPGAAGVLAGVCGVAGCVVTSWWSGVLPPVAARVLQSLSGDVAHQLGGALPWYEGAGLGPAQWAAYAGAGALGLFGFGGLARGCTGRAWVLGLFGRYRGTIRRTGLMWVNPLLLRRRVDVRLRHWRSEPMPAVDANGVPLRVVVLVTWRVKDTARALLGIDDHQTYLRECVESALARVLPQVPAEAPVVKDTVSLRNVDAVGDTLTRLVAADAAPVGLEVFSAQPTRIEYAPEVAARMQRRRIAALDAQHRDTVLTSVVDSVQDTVTRLTMRGLVELDDYERKALVKDLTVAFYTGHRESS

SEQ ID NO: 12757 - protein, 218 aa, Streptomyces avermitilis
MRIRTTRKEPRRATGKAAGKAKVYAAVIGLATAGTFVLSTGPAGAHGYTDQPLSRQKMCATGGSVANCGDIQWEPQSVEGPKGFPAGGPADGQICSAGHSNFGQLNQPKTPAGTAWPTTRVTGGQSYSFRWQFTASHATTDFKYYVTKAGWNQNHALTRADLNTTPFLTVPYNNQRPPSTLSHSGTLPTGLSGHHVILGVWTIADTANAFYSCADVTF

SEQ ID NO: 12758 - protein, 156 aa, Streptomyces avermitilis
MDVIFYAIPSLIIAGVLAMATVVVRRSLQLRSNWNSGLVAEARCLRAYTTTSGGGGDTSVSTTQHHVYEFTSGDGLTIRFDEANGPGTTVPGDIVTVHYTAERPDRATAHAPARGLALAGTIGILVFLGVVAVSCVGFMVTYTEVFAGDGGFSTMP

SEQ ID NO: 12759 - protein, 546 aa, Streptomyces avermitilis
MRRTVAELVRERWGDHRPGLWFEGRVLSHHQMAAGAAARAELLAGLLASGAEPHVGVLLDNTPEYPLWLSAAAVAGAAVAGLNPTRRGPELARDIRHTECRVVVTERAHLPLLDGLELPGVRLLVTDTDAYEELLAPYADAEPDASRATPDDRLLLYFTSGSTGAPKAAICSQGRLAAAGHSLVGHFGVRPDDVHYVCMPMFHGNAVIADWAPALAAGAGVALRRRFSASGFLPDVRAYGATYFTYVGRAVQYILATEERPGDRDNPLRLGFGTEAGAVDAAAFERRFGVRLVEGYGSSEGGAAIQWRPGTPPGAVGRAAPGDDLAVLDPDTREECPPAEFDAAGRLGNGAEAIGELVNRGPNPFEGYWRNPEADAARRRAGWYWTGDLFYRDADGFLYFAGRTDDRLRVDSENLAAATIENILARYEGAAAVAVYAVPDPVAGDQVMATVAGDFDPLGFAAFLLAQPDLGTKMAPRFVRVVERMPVTATNKIHRAGLRREGFRCADPVWWRPPGERCYRRLTGADVAGLVDEYRARGREELLTRA

SEQ ID NO: 12760 - protein, 283 aa, Streptomyces avermitilis
LSTPALFTPLGGYRGHSQAVRKRPTKAQGETVALKHEPTAPNHSAQDALRVLETVARHSTGVTDTELARRTGLGTERLTALLRMLRREGYVEQVADGEYVPGASLSRLGSTHGHDQALREKLQHTLDRLRDSVGAAIYISRYIDGEVHVTQCAEGPTTPAVHEWVDFRSSAHASAVGKSLLGQLDLNGRRDHLARHKMARLTSRTITSERVLLSRLDAQPPTVPVLDLQEYAVGTVCAAVPITAGSSVGCLALSLPIEHAHRLRQAAETLNKGAAPVLLSLAI

SEQ ID NO: 12761 - protein, 271 aa, Streptomyces avermitilis
LPADTTPSTQTAGPTVDGDELIRFEKVTKSFGSHTVLDSLDFSVDSGKHVTLIGPSGSGKTTILRLLMTLTKPDSGTIRVNGDYLTHEEKNGALVPAGEKHVREVRKNIGMVFQQFNLFPNMKVLRNVTEAPVTVLGLAKDEAEQRARELLDLVGLADKADAYPTQLSGGQQQRVAIARALAMRPQVLLLDEVTSALDPELVAGVLDVLRDIARSTDITMLCVTHEMNFARDISDQVLMFDAGHVIESGSPEKIFGDPDHERTREFLSAVR

SEQ ID NO: 12762 - protein, 216 aa, Streptomyces avermitilis
VNWNWSTLGDFMPRFWDGVLVTLEALVLGSLIAFALGLVWALAQRSSLKAVRWPVLAVTEFIRNTPLLVQLFFFFYVLPEWGITLSALATGVIGLGLHYSTYTAEVYRAGIDGVPVGQWEAATALSLPRSRTWTAVILPQALRRVVPALGNYVIAMLKDSPMLMTIGVLEMLGEARQFGSRTFHMNEPIVLVGVAFIVIAYPASLLLRALERRLAR

SEQ ID NO: 12763 - protein, 249 aa, Streptomyces avermitilis
MSEISAGLWELLLKGVWITVQLTVYSAALGAVVAFTVGLARTHRLWVVRFLSGAYFEVFRGTSALVLMLWVFFVVPLTLGWQLVPMWAAVLTLGCTYGAYGSEIVRGAVAAVAPAQREAGIALSFTPAQRLRKIILPQAWPEMVPPFNNLLIELLKGTALVSVLGVGDITFAAQLVRNATGQSAPVYTVILVMYFVLAFLLTRVMRLVERRAKAGIGQSPAGGAAVTQKTGLGPQQDFARSWSGPGGAS

SEQ ID NO: 12764 - protein, 308 aa, Streptomyces avermitilis
MASPQGNTSGSMPRDRLRRRSLLAGAAALATVGTVGATSGCSRVATADTGDGGHLLEQLRARGTVRLGIAGEQPYGYIGKDGRVTGSAPVIATRIFNELGIDHVEPFPTDFGSLIFGLNSLQFDVVAAGMYITPERCGQVVFADPEYQMKDAFIVRKGNPLKLRTYADLGRSKARVATGIGYAEIDYIKEAGVRKVDTLPDQLAGLLAVEQGRVDVFVGTAVTVRNVVKETGSSKAEATAEVTPYLDGKPVTDVGAFAFRRPERNLRDAYNRELRKLKRSGELLEIMRPFGFTKAQMTTITAEEKCTP

SEQ ID NO: 12765 - protein, 162 aa, Streptomyces avermitilis
MADRYLEVALDKRAVRCTARLLDDRAPLTCQAVWDALPLGSDVYHAKYARNEVYALFPPFAAQEPPLENPTVTPIPGDLCYFTFSGAELGTKAYGYGKAQQETVVDLALFYERNNLLLNGDVGWVPGIVWGQVVEGLDAMAEACNDLWRSGAQGETLSFRRA

SEQ ID NO: 12766 - protein, 480 aa, Streptomyces avermitilis
MTELTELTAVQLVDGYRKGEFSPVDAVRATLERAERIQPAVNAFVLPHALDSARAERFPPAAHEALARAAESADRWRRGEPAGLLDGVPVTVKDIILQRGRPTLRGSKAVDPQGAWGEDAPSVARLREHGAVFIGRTTTPEFGWKGVTDSPLTGVTRNPYDTSRTAGGSSGGSAAAVALGAGPLSLGTDGGGSVRIPAGFCGIFALKPTYGRVPLYPASAFGTLAHVGPMTRDAADAALAMDVISGPDARDWSGLGPVGGSFTQALAGGVRGLRVAYSPSLGGQVAVRPEVASAVRRAVQGLAGLGAYVSEADPDLTDPVDAFHVLWFSGAARVTQHFGPQQREVLDPGLREICGIGARFSALDYLAAVDVRMDLGRRMGRFHESYDVLVTPTLPITAFEAGAEVPAGSGLRRWTGWTPFTYPFNMTQQPAATVPVGVDGDGLPVGMQVVAARHRDDLVLRVAHALYEAGVAGIGAPTEV

SEQ ID NO: 12767 - protein, 319 aa, Streptomyces avermitilis
MSGPPSEATLLVLDAEPPPRLGTLTGRVRIEHADESTLAERLPSADVLLVWDFTSHAVRRAWPGEGPRPRWVHTASAGVDHLMCPELAASDTVVTNARGVFDQPIAEYVAALVLAMAKDLPRTWDLQRQHEWRHRESQRVAGTRACVVGSGPIGRAIARTLKALGIRTALVGRTPRTGIHGPDDLDRLMARADWVVSAAPLTKATHGMFDARRFGMMQPSARFINVGRGQLVVEEALAEALSKRWIAGAALDVFAHEPLVRESPLWEVPGLIVSPHMSGDTVGWRDELGAQFLELFERWQAGRPLPNVVDKQRGYVPGH

SEQ ID NO: 12768 - protein, 267 aa, Streptomyces avermitilis
MDVSFLGGPRPQRGVGVVAPFDFALDRELWRWVPDDVSLHLTRTPFVPVEVSLDLARLVSEHETLGEAVRALNAVAPEVVAYACTSGSFVGGIAGERAMCEAMTRAGAVPSLTTSGALLAALAELRARRIALVTPYTVSVTQSLEDYLVGGGVRVTGRAFMGLTRHIWKVPYRDVVDMARQAVGGRLPAGGTADALFISCTNLPTYDVIPQLEAELRIPVISANQVTMWAALRHLGTRAVGPYQALLDESARPVPGPVLPEEQEGWA

SEQ ID NO: 12769 - protein, 244 aa, Streptomyces avermitilis
MTALGFLYPGHSAEDDYPRIEQLLGSDIRLPLVHTDIGEDAHRVDALLEMGSAARLAAGVEELRLSGAEAVVWACTSGSFVYGWQGAHDQVRSLARTAGLPASSTSFAFAHAARELGVRRVAIGATYPDDVAALFAAFLKDAGVEVVAVRGSGIITAAEVATWDEEQVLALARAADHPEAEAVLLPDTALHTASHIQALEAALGKPVLTANQVTVWEALRLADRRVNAPRLGTLFTKEPLVQVH

SEQ ID NO: 12770 - protein, 383 aa, Streptomyces avermitilis
VTADETAGDTTAKTADETAAETADEIRGTAQGTAPVPLSVLDLVTVGAGRTATDALRTSVRISRLAESRGFHRYWVAEHHSMPGVASSSPAVILAHLAAHTDRIRLGSGGVMLPNHAPLVIAEQFGTLEAMAPGRVDLGLGRAPGTDGATAAALRRTDRLNEGADDFPEQLAELTRFLDDDFPDGHPYARIHAVPGPIQSTSPGGVQSPHRPPIWLLGSSGFSARLAGILGLPFAFAHHFSAQNTVPALDLYRESFRPSEVLDAPYALIGVSALATDDEKEARRQVLAAALNMVRLRTGRPGLVPTPEEAEAYEFSPMEREFVATWNSNVIHGTADEVRAGLDDLQKRTGADELMITGNAHSGDVRLRSYELIADAYGLPTAG

SEQ ID NO: 12771 - protein, 620 aa, Streptomyces avermitilis
VSGTSEGPAPTADLIRPAVTERHIDTPPRTTTTSASPSSTGAAFAAAPLAMAVVDREGLVVTANETLGTLLGTDADALAGKTAADLVDLSSDPRAWHAYREVLRGRQARLRCTRRLKHPDGRSFWVQVTVSPLPEEERAILLSVADISAGRELQARLRHLQMHDPVTRLPNRTLFFERLSAALEAEAYEESGTGRIGLCYLDLDGFKAVNDTLGHRIGDRLLAAVAERLTRCAEEAGYARPSAPLVARLGGDEFALLVEDSTGTDQLADLAESVLKALQAPFDLSGQRLSVSASIGVVERHAAGTTATGLMQAADTTLYWAKADGKSRWTLFDPERNAHRMTRQALSSGLRPAIEHGEFVLEYQPLVGMEDGRLRGVEALVRWNHPQFGMLTPNRFIGLAEEDGSIVQLGRWVLATACRQARRWQLEHPDAPPLFVSVNVAVRQVWDSDLVTDVAEILAETGLAPHLLQLELTESAVMGSAGRPLQALQALSDMGVHIAIDDFGTGYSNLAYLSRLPVSVLKLDGSFVRGFQYDTSEKHDGTDARPNPADEVVVEAMIQLAHRLGLTVTAECVETSAQASRLRGIGCDTGQGWLYSRPVAPDRISELLRTPARRSRSEPI

SEQ ID NO: 12772 - protein, 507 aa, Streptomyces avermitilis
VSREPHPEVDLPRQLPLKGCVRDGGLRWRSTAAVFTSMAALAATSLVTGPALAEPGAACELRRTGAHHSEGVDTWNAAYPRPTRPLDAVMVFLSFPDSAPLTAPSELTADYFPATSQFFERASYGRFTLRPHALPGWIRMPHASTSYAMRRDWNAEHRAAYLRDALSVADGQVDFSRYDVVYFVADPDAPGVDSDATKVVNLDAPLRADGKDIRRVVTVFEKHPPDHLVLAHETGHVFDLPDLYHRPTDGKGDWDTYVGDWDLMGSQFGLAPDLFAWHKWRLGWLDPHQVVCVRSRGSTRLTLEPLGVGPAPAAAAGATPTPEVASAAASAAGVEPVVGAKPVAGVEPVVGAKPVAGVEPVAGSASPGAGLLGAGISSDAVSHGPEVPAPATAFGVGRGTKLAVVRTGPDSALAFEARGPVGNDGSTCSQGILVYRVRSEAESGAGPVQVVDAHPHSESCWGDSVYPPLADAPVGLGESFTVPGEGVKVEVEDRTPSGAWTVQIATG

SEQ ID NO: 12773 - protein, 215 aa, Streptomyces avermitilis
MSSEPHPAADPLPDRFDVTGVTAEGAAWLASAGTYPRSTLALWEERPTAPVVLPCGTAFDVVSAPTIFGRRMLDRLWDEGPGSGPVAAYRCRMLLFAAPGTAQRLPSLLDWEEWGAGGAAGPGRSAGIPPLLCHGPGDAVTVPALGTDLGEGAAGRPESRWLVAPDTRRPWLPGPEILVWAAVRAARAAASAAVRISIFPPADQDAKVYDVSRRR

SEQ ID NO: 12774 - protein, 121 aa, Streptomyces avermitilis
MAEPTPRRNEPRLRPAPLLFEPTEAAGDPEHFFDLESIDDPRALLARATELTHAFRAAADRAVEFQAVAAAQLADPRRFDRLTPADIAERAEWTEDYAKKMVEFGRDLLRGREGNGPADML

SEQ ID NO: 12775 - protein, 439 aa, Streptomyces avermitilis
VTTAFDSGAAREPGGGFDPGAAATRATDAILRDTLHGTHRGVVVDSPPGAGKSTLVVRAALELASAGRPLMVIAQTNAQVDDLVLRLAEKDSELPVGRLHSSDPDPYDKALDDLANVRKSTKAGDLAGLDVVVSTAAKWAHVKDVEPWRHAIVDEAYQMRSDALLAVAGLFERALFVGDPGQLDPFAIVGSEQWAGLSYDPSASAVTTLLAHNPELPQHRLPVSWRLPASAAPLVSAAFYPYTPFRSGTDHGDRRLAFGVASDGSGPDRVIDEAAESGWGLLELPARHTPRTDPEAVRAVAQVVRRLLDRGGAAVSERSARPVPLTPDRIAVGTAHRDQAAAVRTALADLGVADVTVDTANRLQGREFDVTVILHPLSGRPDATAFHLETGRLCVLASRHRHACIVVCRAGLPELLDDHPSTEPVQLGVTVKFLMAGRR

SEQ ID NO: 12776 - protein, 531 aa, Streptomyces avermitilis
VSLISALARLEAAQTGRAQPAATVRHRHLSEHPLVFVPLTTAGEAGAPLGALVGTDRHAPRLLVVPQPRDRDLRFAFLAELADIVLPYLDGYADVVEAAERSETDPETGKRVKVEVELCADAPQLIVPSRAGVEFVRLLGRSMRFRRTAEQEPEAPHPAPPRVPLLGRWLTHFGERARVPGSSLLLALTEVLGRHWATGQSSLEDQHLGALLAWIEPPAGESGATAALRAELQRDSGGQLLCPPAGPATDPAFDNKLLAPAIERYDRARTRLAAAEDGLEADDRLGELTSAEREIRALVAGLTRPTWDAVWRGLDLLRALPEGAHVDDRWTRDRWSFTGHRDRVTAGEPPQPRRDDAVTAANKLATREREQARLDAQEALDDPLVMAGRRLAGEAFAGEVTDVVMAYSEGKRPSPRPLVTVRTEDRPHLGERTKVFRPLGGKPQAAEFVGYEDDGTLVVLRIVDKMGRGKEPEAGSVPEKGDRLCFTLFEHEQRGGAKLPDPEATPWTHGGPPGDPEAVPLPDPVTEEDVL

SEQ ID NO: 12777 - protein, 346 aa, Streptomyces avermitilis
VNKAVLADALGSPSAFGQSQFAFMRGNAFEARVKADGGAELLRLVHEKLDPGAEPPTDSLVPDLTAGGPEGRAARTALALREATGAGAWTLLDHPMLALDVAGSPAFLEPDAVVVHPDGSWTVVEIKSFPVLDGSADPAKVGAAARQSAVYVLALEDVAARLDPAPPVRHRVLLVCPKDFSNLPTASAVDIRKQRSVTRRQLTRLTRVEEIADALPEGTCFAPDLPRGELTAAVESVPAAYAPECLAACELAFHCRDHARAEGAVTSLGRSLRAELGGLATVDDVLAAAHGTAGDPDDPAVAALRRAARLRAEALDAAGPTATGPGTGYAGAEGLGAERPEGAPCR

SEQ ID NO: 12778 - protein, 318 aa, Streptomyces avermitilis
MPQTVTPGIERAVPKTRLRWWTELPLIVLVYASYSAGRLLARGDVSTAVDHGLAILRIEKALHLNAEHPLNRLFTREAWLGVPADFWYASLHYLVTPALLIWLFRSRAVRYRAARTWLLTSTFIGLIGFTLLPTCPPRLLSQGHGFVDTMAQYSSYGWWGGEASAPRGLGGMTNQYAAMPSLHVGWALWCGVMLWRYGRTPAAKVAGIAYPLLTTIVVMGTANHYFLDAAAGAAVMGAGLLLTPAMMRLADLAKERLSARSAPVAAASQGAGSSIVSGECQTSPGERIPRQRVSRHGPGAEPGATPADAGDGAPAAAR

SEQ ID NO: 12779 - protein, 205 aa, Streptomyces avermitilis
MAPRILLARHGQTEWSLLGKHTGRTDIPLLEEGRRGAKLLGERLHRAPFDGLFDAEIRTSPLARARETCELAGFGDRATSWDPLMEWDYGAYEGMTPAEIQKVRPGWFIWRDGVPEGETLAQVSARADEVVAWARAEDRDVLVFAHGHILRSIGARWLGLPIDFAARIRLSPTSLSVLGWAYGEPAIESWNDLGHLVHQGEQRIA

SEQ ID NO: 12780 - protein, 530 aa, Streptomyces avermitilis
MASSTVTSSQPPTPPRPNLAFRQLRGQRSPGEFASAVRRAAREIGERVSCDARYIGRVEAGEIRCPNYAYERVFLHMFPGRTLTDLGFAPRSAVRGRGAARTTDDAPPPRTESPLRASHEMEGACETYDMPDPSHETQAPQDPYDPYDPLNPQHAPDPFNPQPTPDPYDTHHTSDLYDTHEYHDQNHEESDVQRRAFMTGGTATVAAASLGPFGLTFGSPAAAAGRPGHRAGSSEAGALEEAVRRIRLLDDRHGADGLYRRASAPLRTAYALLDAGTTRQSTADRLYMGAGELAISVGWLAHDSGRFDDARSHYAEALATARMAGDPGLEAHAFCNTAFLARDAGRPREAVRAAQAAQRAARPLGSPRLMSLLALREAGGWAGLADRAGCEQALARAQALFERGPSETDPEWMTFYGEAELEGLEAQCWSTLGDWPRAARHARRAAHLQDPHFTRNIALYTAELADDLARGGRPDEAAMAGLRVLELLGQVQSSRVQTMLAGTARVLLPHRRASEVSAFLERHASLPRMA

SEQ ID NO: 12781 - protein, 144 aa, Streptomyces avermitilis
MQTRQSTEFRTSSTAQHRPTPESSAPPRPESACDLVTVPARQGLEAVDILRRGAGDSVGPVLHDNDCDTLGFLVPPGTADAWDVPGSTCTQTGGRGQSLVPEPPVEGSDWLLPPGDAELATDPAVLRAALGEAARLIEAADNCR

SEQ ID NO: 12782 - protein, 297 aa, Streptomyces avermitilis
MARAKKKRSDDGRGGRRGQTAAEAVVEPVDGGLAELIPDRDRARAWTLFIDGAPQSHVDLDDPAFLSFEYQRRLGHVIDLVAPPGRPVHVVHLGGGAFTLARYAAATRPRSTQQIVERDAALVQLVRRELPLDPNARIRVRSLDAREGLAKVADDWADLVIADVFSGARTPAHLTSTEFLTEVRRVVKPDGVYAANLADGPPLAHLRGQIATAAVVFPELALVADPTVLRGKRFGNAVLVGSGHPLPIAELTRRAASDPHPARVEHGKELTDFTGGAVPVLDAVAVASPPPPPSVFR

SEQ ID NO: 12783 - protein, 176 aa, Streptomyces avermitilis
MTGMRRGLVHVLAWSLATGAAVTLSWWGVHTVMAGTAYDPPRALPITAGDAATRKPEPLASSTERAQPSKSPSKGPSHRRAPSGKPAPTPSRTASSSPSPTTSGQVKSYDTDGGRVVFDLGRTSATLVSATPGSGWSMQVWKTETWIRVEFSSGADRVTVFCTWHDSAPRVDVQNY

SEQ ID NO: 12784 - protein, 247 aa, Streptomyces avermitilis
VPPMASVLVVEDDQFVRSALIRHLTEAAHTVRSVGTALEALREVAHFSFDVVILDLGLPDLDGSEALKMLRGITDVPVIIATARDDETEVVRLLNAGADDYLTKPFSVEHLAARMAAVLRRARSAAGEAPPSTVIRVGGLAIDPLRRQAELDGVRLDLTRREFDLLAFLAGRPGVVVARRELLAEVWQQSYGDDQTIDVHLSWLRRKLGETAAKPRYLHTLRGVGVKLEPPRGEPSWGARSQGEPLP

SEQ ID NO: 12785 - protein, 457 aa, Streptomyces avermitilis
MRWALVKVCVAVTTMVVVAFAVPLGLVIKEMARDRAFSNAEREAAAVAPALSITTDRDQLERVVASAASDEGMAVHLPASDGKAASDIGRQRAADKDITTTRKLGRASTAEVAGGSTLLQPTALSSGEIAVVEVYVPESEVSNGVGTAWAVLAAVGVALIIGSVAVADRLGVRMVQPAQRLVEGAHELGEGKLGARVPEEGPTELRLAAVAFNSMADQVVQLMANERELAADLSHRLRTPLTVLRLNTASLGDGPAAEQTRAAVAQLEREVDTIIRTAREAKPQTAAPGFGAGCDAAEVVRERMDFWSALAEDEGRKVRVAGADRPVRIPVARADLAAALDALLGNVFRHTPEGTAFAVDVHNGEDAVIVLVSDAGPGIPDPEAAMARGRGSGSDGSTGLGLDIVRRLAESTGGDVRIGSSVLGGTEVRIWIQLDGRAPVRRGHRGSVRRRWRMAAR

SEQ ID NO: 12786 - protein, 489 aa, Streptomyces avermitilis
MSSTHRRKVSGRNKAIGGIVAAAVVGGGALLFTGTAQAASVGAAYTKTSDWSTGYTAQYVITNDTAQTKADWTLQFDLPSGTKLSSLWNGESSVSGQHVTVKPPTWDKNGLAAGKSVTVGFVVNGSANPTGCLIDGVKCSADDGATPEPSGRPTQSATPTPTPTPTPTATASQSTKPTPTPSASETPGSGTTTSAGFAPYVDTSLYPAFDLLAAAGATGVKDYNLAFITDGGGCTPKWGGVTDLGSDGVAAQIGDLRAKGGDVRVSFGGASGSELATTCSSADALATAYEKVVNAFKLTKVDFDVEGGALPNTAANTRRAQAIAKLEKAHPGLDVSYTLPVMPEGLTQDGVNLLADAKSNGVSINTVNIMAMDYGPAYSGDMGTYAEQAATATQAQVKSVLGLSDSAAWKAVAVTPMLGVNDVASEIFKVDDATQLVNFAKSKGLGWLSMWSATRDKQCAGGAKPSADATCSSIVQDANAFSKALGAYK

SEQ ID NO: 12787 - protein, 482 aa, Streptomyces avermitilis
VASAETSAAPVSPVTFPPAFLWGAATSAYQIEGAVREDGRTPSIWDTFSHTPGKTAGGETGDIAVDHYHRYRDDVALMAELGLGAYRFSVSWSRVQPMGRGPAVQRGLDFYRRLVDELLAHGVKPALTLYHWDLPQELEDAGGWPERDTAYRFAEYAQIVGDALGDRVEQWITLNEPWCSAFLGYGSGVHAPGRTDAAASLRAAHHLNLAHGLGTSALRAAMPARNTVAVSLNSSVVRTVSDSPADVAAGRRIDDLANGVFHGPMLHGAYPAGLFAATASVTDWSFVQDGDLEAVNQPLDALGLNYYTPTLVSATESAPAGPRADGHGASSFSPWPGADDVVFHLTPGERTEMGWSIDPTGLHELIMRYTREAPGLPLYITENGAAYDDKPDPEGRVHDPERIAYLHGHLTAVRRAITDGADVRGYYLWSLMDNFEWAYGYGKRFGAVYVDYATLARTPKSSARWYAQAARTGTLPGATAAE

SEQ ID NO: 12788 - protein, 307 aa, Streptomyces avermitilis
VTTTLTPPADSADNAADAAKAPRRSRRPRSARAGGTLHGGPIAYAILILFTLGSLFPLVWTAIAASRDNNRLAQTPPPFWFGSNLFRNLDVAWTDANLGEAFFNTTFVAGVSAAAVVIMSTIAGFAFAKLRFRGRGALMLIVIGTMMVPPQLSVIPLYMMVAKLDWTDQLQAVILPSLVSAFGVFFMRQYLIQALPDELIEAARVDGASSWRVVWHIVFPAARPAMAVLGMLTFVQTWNDFLWPFLVLTQTGNPTVQVAVAGLGRGYTPDQSLIMAGALLGTLPLLLVFAIFGKQIVGGIMQGAVKG

SEQ ID NO: 12789 - protein, 338 aa, Streptomyces avermitilis
MATRHDTAAPPVKEGGAAPARASADAAPTEAEQRHRARLSRRWQRDIRWSPYAFVSPFFLLFLAFGLFPLIYTGWASLHQVELTAPTDMEWVGLRNYTRIFDDDFFWNAAKNTLTIGIIATVPQLLMAMGLAHILNYKLRASTFYRVAMLAPYATSIAAASLVFVLLFGRDYGMINWALHQVGIGAVDWQNDKWPSQFAVSSIIIWRWTGYNALIYLAAMQAIPQDLYESAALDGASRWRQFLHVTLPALRPTILFTVVVSTIGASQVFGEPLLFDANKGASGGAEHQFQTLGLYLYEQGWVNQHLGRASAIAWTMFLILILVGIVNYVISRRLRASS

SEQ ID NO: 12790 - protein, 453 aa, Streptomyces avermitilis
MRAFTLPPSRLRSSGGTPIVRRAVVLAAVASLGAGLLAGCADDSGDGASDGSSSDGKGKTTLTLGLFGTQGFKEAGLYTEYEKLHPDIKITDNVVERNENYYPALLNHLTTNSGLMDVQAVEVGNIAEIVATQADKLVDMSKVSGVDKSKWLDWKWAQATTKDGRTVGLGTDVGPMAICYRKDLFEKAGLPTDREEVGKLWAGDWSKLVDAGEKYKAKAPKGTTFMDSPGGLINAILSSEKEKFYDSSGKVTYKTNPAVKSAFDLTAKAAEEGLVGAQTQFQPAWDTTIAHSKFATVACPPWMLGYIKGKSKPESAGKWDVAAAPKSGNWGGTFLAVPKSGKHVKEAEAFITWLTAPEQQAKLFKVQGSFPSAPSAYSSSAVTGAKNEMTGDSPIGTIFAKAAQSSPVQTIGPKDQIIQQGLTDNGVILVTKGKSPEEAWNTATKTIDNNLDK

SEQ ID NO: 12791 - protein, 351 aa, Streptomyces avermitilis
MAGHGARGRSGGRPTLEEVAARAGVGRGTVSRVINGSPRVSDATRAAVEAAVAELGYVPNTAARALAANRTDAIALVVPEPETRFFAEPYFSDMLKGVGSALSETEMQLLLIFAGSDRERQRLAQYLAAHRVDGVLLVSVHADDPLPDLLAQLEIPAVISGRRSAEETLPSVDSDNFGGGRVAVEHLIDQGRRNVVHLAGRLDVYGAQRRVDGYREALRDAGRPVDESLIVAGDFTEEGGRRAMTELLARCPALDAVFAGSDVMAAGARQVLREAGRRIPDDVALVGYDDSAIARHMDPPLTSVRQPIEEMGRAMIDLLLDEIADRRPAVSRGLERRQLVLPSELVRRASS

SEQ ID NO: 12792 - protein, 202 aa, Streptomyces avermitilis
MPAHPEPAEPPEPPGPAASVGTTGTTGTTGTTGTTGTARIIRTARLDLLPLRVEHAEEMAQVLGDPALHAFIGGVPDTPAALRARYARLAAGSPHPGVRWVNWVLRRRADACLVGTVQATVTGEVAEIAWVVGTPWQGRGFASEAAQGLVDRLTRQSGSVRIVVAHVHPDHHASASVAAAAGLSPTDREQDGEIRWELTVRA

SEQ ID NO: 12793 - protein, 160 aa, Streptomyces avermitilis
VGGRSRGMDSFHPAPSPLSPCSPAPGGLSVLRSARGRVVTTVLAATALLLGAQGTATAAAQRANTEGGYALWNADPDGATPGDSVRACDTTTDGWGIEARLDINRDGTIDRTASTRGRTAPYCTAWKSGDIPEGAPVAVYAVTVRGDDTKDKGGLIWSHA

SEQ ID NO: 12794 - protein, 200 aa, Streptomyces avermitilis
MNDRMVWIDCEMTGLSLSDDALIEVAALVTDSELNVLGEGVDIVIRPPDAALETMPEVVRTMHTASGLLDELAAGTTLADAEAQVLAYVREHVKEPGKAPLCGNSVGTDRGFLARDMSALETYLHYRIVDVSSVKELARRWYPRAYFNSPEKSGNHRALADIRESIAELRYYREAIFVPQPGPDSETARTIAAKHVLPAQ

SEQ ID NO: 12795 - protein, 426 aa, Streptomyces avermitilis
MSHDSTAAPDAAARKLSGRRRKEIVAVLLFSGGPIFESSIPLSVFGIDRQDAGVPRYRLLVAAGEEGPLRTTGGLELTAPHGLEAISRAGTVVVPAWRSITSPPPEEALDALRRAHEEGARIVGLCTGAFVLAAAGLLDGRPATTHWMYAPTLAKRYPSVHVDPRELFVDDGDVLTSAGTAAGIDLCLHIVRTDHGNEAAGALARRLVVPPRRSGGQERYLDRSLPEEIGADPLAEVVAWALEHLHEQFDVETLAARAYMSRRTFDRRFRSLTGSAPLQWLITQRVLQAQRLLETSDYSVDEVAGRCGFRSPVALRGHFRRQLGSSPAAYRAAYRARRPQGERPVDPDSVVGPPPALPQEAPVPMQTRRTAAASSLGPAASLSTEPGKHGSHGSHGSHGSHGSHGSHGSELYAAGRPSLPGQRSAP

SEQ ID NO: 12796 - protein, 145 aa, Streptomyces avermitilis
MPVSRTSPTSRTSPDDLRRTPAQGAPPSPARPSAAPPSDTASDVVRWAVFSCALVPVVLVWYGTSLAGAAGTALGLAAVTGVCRMLLRQSERGAARLSDEAARQRVPHRGRHGRSGWQGTGGAHGKSGSGAHRGGRHTAGNTPVD

SEQ ID NO: 12797 - protein, 175 aa, Streptomyces avermitilis
MAGHEFFEPADRKRPVADPTAAEPLAAEEPRHSCDPAFKHGVVVGFDGSTSSERALAYAIGMAHRSGSGLIIVHVANRLPTTVWAGCEPPVFVDVPDHRTEVLGLELACAEYLAEVPWILVERGGDICHELEEVGREYEADAIVVGSTHGIVGRLFGSVAGRLAKRAQRPVIVIP

SEQ ID NO: 12798 - protein, 188 aa, Streptomyces avermitilis
VDNDVSAGSTTTVVGRLTLGITLLAFGLGYADVIDGVTAADAVSVAHYVGGVALFVAGLLALRERDAASGTAFSALGALWFTWAVTAGSRMSDNAAGLFLLLFALVALSLTLGAAGGVLDQGAYGLFAVSLLLLAIAHFAGNDGLGRIGGWFAVAAGAVAWYAATAALAHWPTALPRRAAGRGVTAAG

SEQ ID NO: 12799 - protein, 605 aa, Streptomyces avermitilis
MCGIVGYIGKRDVTPLLLEGLQRLEYRGYDSAGIVVTSPKTAGLKMVKAKGRVRDLEAKVPARFKGTTGIAHTRWATHGAPSDLNAHPHMSQDNQVAVVHNGIIDNASDLRKKLEADGVEFLSETDTEVLTHLIARSQQEKLEDKVREALRVIEGTYGIAVMHADFPDRIVVARNGSPVVLGIGEKEMFVASDIAALVTHTRQIVTLDDGEMATLKADDFRTYTTEGTRTTAEPTTVEWEAASYDMGGHDTYMHKEIHEQADAVDRVLRGRIDDRFSTVHLGGLNLDAREARAVRRVKILGCGTSYHAGMIGAQMIEELARIPADAEPASEFRYRNAVVDPDTLYIAVSQSGETYDVLAAVQELKRKGARVLGVVNVVGSAIAREADGGMYVHAGPEVCVVSTKCFTNTTVAFALLALHLGRTRDLSVRDGKRIIEGLRKLPAQISEILDQEDEIKKLAAQYAEARSMLFIGRVRGYPVAREASLKLKEVSYIHAEAYPASELKHGPLALIEPALPTVAIVPDDDLLEKNRAALEEIKARSGKILAVAHQEQEKADQTIVVPKNEDELDPILMGIPLQLLAYHTALALGRDIDKPRNLAKSVTVE

SEQ ID NO: 12800 - protein, 85 aa, Streptomyces avermitilis
VHDELVDHLTRSTPLNRGEALRVIQDVLAYFDETTEEYVRRRHRELQAQGLVNATIFERIEADLKYRAVAPPELTLRQLRRIVYG

SEQ ID NO: 12801 - protein, 508 aa, Streptomyces avermitilis
MAEQHEYLRARFSRRNMIRGGAVTLGAVAGGAFVPGATARAAVPAQRAAASAEKVDGALVAPFGRHLAYGTDPRTEMTVSWQVPVAVKKPYIRIGAHPWDLSRKIEAEVRALHTPAGVGASGDHTQYYLHARLTHLRPGRTYYYGVGHDGFDPAAPHLVGTLGTFTTAPAHSEPFTFTAFGDEGVGYHGLANDALLLGQNPAFHLHAGDIAYADPAGAGKTGDTGFDSRIWDQFLAQTESVAKSVPWMVSYGNHDMEAWYSPNGYGGEEARWQLPENGPDKANLPGVYSFVHGNTAVISLDANDVSFEIPANLGISGGTQTKWLEARLKKYRAAKDIDFIVVFFHHCAYCTSTAHSSEGGVRQEWVPLFEKYTVDLVINGHNHQYERTDVIKGDEVTKKLPIGGTAYPETEGVVYVTAGAAGRSLYAFTAPDSYEGHENDVESVSAFVNLKGGKQNETVAWSRVRYLDYSFLRVDVTPAAKGRTATMRVRGIAESGVEIDHFTVARRV

SEQ ID NO: 12802 - protein, 529 aa, Streptomyces avermitilis
VRQHHRTPRLLGTLLLVAAAGFSVAGSAPAAAAKTASPLGQVVPAPASVDPGGSPYRITRDTRIRVDDSREVRQVGEYLAGILRPSTGYRLPVASQGGGGIRLRLGERSLGDEGYRLDSGRNGVTITAAAPAGLFHGVQTLRQLLPAAVEKNSVQPGPWLVAGGTIKDTPRYGYRGAMLDVSRHFFDVGQVKRYIDELALYKVNKLHLHLSDDQGWRIALDDWPRLTTYGGSTQVGGGRGGFYTKAQYTEIVRYAASRHLEVVPEIDMPGHTNAALASYAELNCDGTAPPLYTGTDVGFSSLCVGKPVTYDFVDDVIRELAALTPGRYLHIGGDEAHSTSHADYVAFMDKVQPVVAKYGKTVIGWHQLTGATPAKGALAQYWGLDDTSAAEKAQVVKAAQNGTGLVLSPADRIYLDMKYTADTPLGQDWAGLVEVRRAYDWDPGTYLAGAPGASIRGVEAPLWTETIVTGADIDYMVFPRLPGVAELGWSPASTHDWDTYKVRLAAQGPRWEARGIRYYRSPQVPWPGA

SEQ ID NO: 12803 - protein, 590 aa, Streptomyces avermitilis
MTQSDAVAHLSPERWERANRLLVRKALAEFAHERLLTPEAAGDGAYVVRSDDGLTRYRFTARLRSLDHWQVDAESITRHRDGAELPVAALDFFIELKKSLGLSDEVLPVYLEEISSTLSGTCFKLTKPQIPVAELAEAGFQAIETGMTEGHPCFVANNGRLGFGVHEYLSYAPETASPVRLVWLAAHRSRAAFTAGVGIEYESFLREELGEQTLNRFAATLRDQGLDPDDYLLIPVHPWQWWNKLSVTFAAEVAQRRLVCLGEGDDEYLAQQSIRTFFNKSAPEKHYVKTALSVLNMGFMRGLSAAYMEATPAINDWLAQLVDNDPVLKSTGLSVIRERAAVGYRHLEYEAATDRYSPYRKMLAALWRESPVPALQEGESLATMASLVHVDHAGASFAGALIERSGLSPVEWLRRYLRAYFTPLLHSFYAYDLVYMPHGENVILVLKDGAVQRAIYKDIAEEIAVLDPQAVLPPAVERIRVEVPEDKKLLSIFTDVFDCFFRFLAADLADEGVLGEEDFWRTVAESVREYQESTPELADKFRQYDMFAPEFALSCLNRLQLRDNKQMVDLADPSGALQLVGNLKNPIAGL

SEQ ID NO: 12804 - protein, 183 aa, Streptomyces avermitilis
MSTPDIGTFTVRPLDPTRDAELLHGWVTHPKSAFWMMQEARLHDVEREYMAIAASEYHDAFLGLLDDEPVFLMEKYDPAHVELVGLYEPEPGDVGMHFLVAPTDTPVHGFTRAVITAVMEHLFADPATRRVVVEPDVGNKAVHALNEAVGFVPEREIQKPEKKALLSFCTREQFAAAVRGAAV

SEQ ID NO: 12805 - protein, 423 aa, Streptomyces avermitilis
MEKTSAGKTYDFVGIGLGPFNLGLACLTEPIAELEGVFLESKPDFEWHSGMFLEGAHLQTPFMSDLVTLADPTSPYSFLNYLKESGRLYSFYIRENFYPLRVEYDDYCRWAASKLSSIRFGTTVTEVTYEDDVYVVRTEAGDLYRARHLVLGTGTPAYLPEAVQGLGGDHIHNSRYMQHKQELQAKESITLVGSGQSAAEIYYDLLSEIDVHGYRLNWVTRSPRFFPLEYTKLTLEMTSPEYIDYFHALPEPTRYRLTAEQKGLFKGIDGDLINEIFDLLYQKNLGGPVPTRLLTNSALNGATYENGTYTLTLRQEEQEKEYELRSQGLILATGYRYAEPEFLKPVRDRLRYDAQGNFDIARNYAIDTTGRGVFLQNAGVHTHSITSPDLGMGAYRNAYIIRELLGTEYYPVEKTIAFQEFAV

SEQ ID NO: 12806 - protein, 505 aa, Streptomyces avermitilis
MSGRCALSPAPLLCSARTVPSEDPHMRSHLLNDTTADRYRRSVTEGIERVAAKLATTASPFTGITVDALAPRIERIDLDRPLHDTTAVLDELEEVYLRDAVYFHHPRYLAHLNCPVVIPAVVGEAILSAVNSSLDTWDQSAGGTLIERKLIDWTNERIGLGPAADGVFTSGGSQSNLQALLLAREEAKSDDLARLRVFASEVSHFSVKKSAKLLGLSADSVVSIPVDHDKRMQTVALAHELDRCKRDGLLPMAVVATAGTTDFGSIDPLPEIAELCAQFGAWMHVDAAYGCGLLTSLKHRDRIDGIERADSVTVDYHKSFFQPVSSSAVLVRDASTLRHATYHAEYLNPRRMVEERIPNQVDKSLQTTRRFDALKLWMTLRVMGADGIGQLFDEVCDLAAEGWKLLAADPRFDVVVEPSLSTLVFRYIPAAVTDPAEIDRANLYARKAIFASGDAVVAGTKVGGRHYLKFTLLNPETTADDITAVLDLIAGHAEQYLGESLDRAS

SEQ ID NO: 12807 - protein, 290 aa, Streptomyces avermitilis
MTTAVAAPFRFFSLQVVRTRRLGPSLLRVTFTGADLHAFASDGRDQSLSLFLPHPGQTEPAVPIELGDNWWQGWRELPDDVRAVMRSYTLRALRQDAHGNTVEIDIDFVLHGVEPGAAAPAGPASRWASRATAGDRVLLLGPAVADNRAIRFRPPEGTDLVVVWADETAVPAASAILEWLPAGTRAKVWLEVHDAGDIQDLTTEADAEITWLVHSERETRGEGSPMALDAVRAAAFPPAERPYAWIAGESGCVKELRRHLVRERGIDRRQVTFVGYWRQGLSEEQLREQE

SEQ ID NO: 12808 - protein, 349 aa, Streptomyces avermitilis
MSNARATHLTRRGILAAGGAFGLGAALAACGDDKAKDSGSDSGTAAAKSGPWSFKDDRGQTAKADKTPSSIVAFTGVAAALYDYGVDVKGVFGPTKTKDGKADVQAGDLDISKVTILGNEYGQFNIEKYAALAPDLLITTMFDDAGSLWYVPAESKKKVLAVGAPSVGISVYDRQLTEPLQRMLALAKSLGADTSSATITKAKKRFEDAAARLRAATKANPDIKVLAGSASQDIFYVSTSNLSIDLEYFKALGVNFVEPSASALKASGGWFENLSWENVDKYKADVIIMDNRSSTIQPADITKATWKKLPAVKAGQVTARNPEPILSYDKCAPLLEDLAEAIEKAKKVS

SEQ ID NO: 12809 - protein, 386 aa, Streptomyces avermitilis
MDHRLTPELEELRRTVEEFAHDVVAPKIGDFYERHEFPYEIVREMGRMGLFGLPFPEEYGGMGGDYLALGIALEELARVDSSVAITLEAGVSLGAMPIHLFGTDAQKAEWLPRLCSGEILGAFGLTEPDGGSDAGATRTTARLDESTNEWVINGTKCFITNSGTDITGLVTVTAVTGRKPDGKPLISSIIVPSGTPGFTVAAPYSKVGWNASDTRELSFADVRVPAANLLGEQGRGYAQFLRILDEGRIAISALATGLAQGCVDESVKYAGERHAFGRNIGAYQAIQFKIADMEMKAHMARVGWRDAASRLVAGEPFKKEAAIAKLYSSTVAVDNAREATQIHGGYGFMNEYPVARMWRDSKILEIGEGTSEVQRMLIARELGLVG

SEQ ID NO: 12810 - protein, 315 aa, Streptomyces avermitilis
MSTPESGLPMVVPAQDLPARVRIHEVGARDGLQNEKGTVPTEVKAEFIRRLADAGLTTIEATSFVHPKWVPQLADAEQLFPLVSDLPVALPVLVPNERGLDRALVLGARQVAVFASATESFAKANLNRTVDEALAMFEPVVTRAKAADVRVRGYLSMCFGDPWEGAVPIHQVVRVCKSLLDMGCDELSLGDTIGVATPGHVQDLLAELTEEGVPTRAIGVHFHDTYGQALANTLAALQHGVTTVDASAGGLGGCPYARSATGNLATEDLVWMLQGLGIDTGVDLARLTATSVWMAERLGRPSPSRTVRALSHKEQ

SEQ ID NO: 12811 - protein, 700 aa, Streptomyces avermitilis
MFDTVLVANRGEIAVRVIRTLRALGVRSVAVFSDADADARHVREADTAVRIGPPPAAESYLSVERLLEAAARTGAQAVHPGYGFLAENAGFARACADAGLVFIGPPADAISLMGDKIRAKETVQAVGVPVVPGSSGSGLTDAQLVDAAREIGMPVLLKPSAGGGGKGMRLVRDERLLADEIAAARREARASFGDDTLLVERWVDRPRHIEIQVLADGHGNVVHLGERECSLQRRHQKVIEEAPSVLLDEATRAAMGEAAVQAARSCGYEGAGTVEFIVPGGDPSSYYFMEMNTRLQVEHPVTELVTGLDLVEWQLRVAAGERLPYGQRDIELTGHAVEARICAEDPARGFLPSGGTVLALHEPQSDVVRTDSGLSEGTEVGSLYDPMLSKVIAYGPDRPTALRRLRAALAETVTLGVQTNAGFLRRLLAHPAVVAGDLDTGLVEREVDGLVAQAVPPEVYAAAALLRHAALGPQASGTSDSSGSFGTSGSPGTSGASGSSGASAWVDPFSVPDGWRLGGERAWTAHHMRPAGQDPVTVRVRATADGGVELLLDDGLPPLRGTLPVAVAARGGAASRFAFRLDGVTHTFAALPDGTWLGRDGDSWHLRDHDPVAASLTGAAHSGVDSLTAPMPGTVTVVKVAVGDEVAAGQSLLVVEAMKMEHVISAPHAGTVSELDVTPGTTVAMDQVLAVITPAEEETA

SEQ ID NO: 12812 - protein, 543 aa, Streptomyces avermitilis
MQEAPELTSAADPASEAWRANEAAHRTLGEELRAKLAAARLGGGERARARHTARGKLLPRDRVDTLLDPGSPFLELAPLAADGMYEGQAPAAGVVAGIGRVGGRECLVVANDATVKGGTYYPMTVKKHLRAQEVALENRLPCVYLVDSGGAFLPMQDEVFPDREHFGRIFYNQARMSGAGIPQIAAVLGSCTAGGAYVPAMSDEAVIVRGQGTIFLGGPPLVKAATGEVVTAEELGGGEVHARVSGVTDHLAEDDAHALRIVRNIVSTLPARGPLPWAVEPSVEPKVDPYGLYGAVPVDSRTPYDVREVIARVVDGSRFAEFKAEFGQTLVTGFARIHGHPVGIVANNGILFSESAQKGAHFIELCDQRGIPLVFLQNISGFMVGRQYEAGGIAKHGAKMVTAVACTRVPKLTVVIGGSYGAGNYSMCGRAYSPRFLWMWPGAKISVMGGEQAASVLATVKRDQLEARGESWPVDDEEAFKDPIRAQYEQQGSAYYATARLWDDGVIDPLETRQVLGLALTACANAPLPQKDYTAPGFGVFRM

SEQ ID NO: 12813 - protein, 196 aa, Streptomyces avermitilis
MATRTDAPTRREQILKEAARLFAERGFHGVGVDEIGAAVGISGPGLYRHFAGKDAMLAELLVGISGQLLTGGKRRAAEAEGDPEALLDSLIEGHIDFALDDRPLITLHDRELDRLRDSDRKLVRQLQRQYVELWVEVVRNVYPGLDEPAARSAVHSVFGLLNSTPHLGRPGALPGRAGTAALLHRMARGAFGAAGA

SEQ ID NO: 12814 - protein, 385 aa, Streptomyces avermitilis
VRRTVFNEDHEAFRETLRAFIEAEVVPVYDEWFAAGQAPRDFYYKLAELGVFGIRVDEEHGGAGIDSYKFEAVLYEETARAGISFGGSGVHVLLGLPYIKLLATDEQKKRFLPKFVSGEEMWAIAMTEPGTGSDLAGMKTTAKLSDDGTHYVLNGAKTFITGGVHADRMIVCARTSAPTKEDRRHGISLFVVDTKAEGYSVGRKLDKLGLKTSDTAELAFVDVKVPVEDLLGEENKGFYYLGHNLASERWGIAFGAYAQAKAAVRFAKQYVQERVVFGQPVAAFQNTKFELAACQAEVDAAEAVVDRATEALDAGELTPAEAASAKLFATEVAHRVIDRCLQLHGGYGFMNEYPIARLYADNRVNRIYGGTSEIMKTIIAKDMGL

SEQ ID NO: 12815 - protein, 290 aa, Streptomyces avermitilis
MSQALESLLDLLDLERIEQDIFRGQSRSAVVPRVFGGQVAAQALVAAGRTVPEDRLAHSLHAYFLRAGDPGAPIVYTVDRIRDGRSFTTRRVVAVQHGQPIFHLSASFQTYEEGMEHQADMPPAPAPETLPTAAEMLPRYAHLFTEPVVIDRLLEAREAVDLRYVDAPPFGTVGEPREPRSQVWFRTNGKLVDDPLLHVCLATYVSDMTLLDSVLLAHGRGGWVTGDVVGASLDHAMWFHRPFRADEWLLYDQESPSASGGRGLGQARIYTQDGQLAISVIQEGVVRVPR

SEQ ID NO: 12816 - protein, 262 aa, Streptomyces avermitilis
MPITGTPSRAELVDHLVRTRIAGDVATPRENNLSHYRKLANGDRNYWLGLELGDRWSDEQDVLAVMAERCGVNDDPEYRYGQDTIDPELTVDALDRMAARLRKAAAGRQRVLFATGHPGGLLDVHRATAAALRTAGCEIVVIPEGLQTDEGYVWQLADVAMLEHGASLWHTHSGEPMRAVLNGLERAGRPLPDLVVADHGWAGCAGQLGVDSVGYADCNDPALFLAESEGTVQVTVPLDDHVKSPRHYDPMTAYLLSGAGLA

SEQ ID NO: 12817 - protein, 537 aa, Streptomyces avermitilis
MPDPSAPSASSASSAPKTTAAPGTPAAPKTSAAPGTPAVPPTPPVPLAALLAREDLALRQIAGPTDRDTVIHWAHTSEMADPYPYLLGGELLLSAGVHIPEAAGSGTYFEDYVSRIVAAGGAALGFGLAPVHDTVPRALVAACDAYELPLLEVPPQTTFSGVARAVWQLMAQARLAELRRVTEAQRSLAAAAARPDPVPSVLRQLAQRVGGWAALYGPDGAELARAGRIPEAPDTPTAQALAELAAVVRPSEPSASPASPAPAPSPTPSSATDSVGGVHLAAYALGTGQGFVLGVASARRDSGDHTIASVAAVLLSLLTGEHQSGSGAARSAALVRLLLGAAPEAVAPLLGGERWVVVHARPVADGPAPDAVAASALGAALGSALVDAGGDVVRVLVPGDRAPAAQSGWTLGASVAVAPHEWAAADTQAARALARARATRSPLVRHGERPGLTDLVAPADAAAHARTLLAPVADTPALTETLRTWLSLHGSWDRTAVALSVHRNTVRQRITRCAALLGADLDDPDVRMELWFALRHG

SEQ ID NO: 12818 - protein, 486 aa, Streptomyces avermitilis
MAVDYTVIVVYLAGMLAMGWWGMRRAKSKSDFLVAGRRLGPAMYSGTMAAIVLGGASTIGGVGLGYKYGLSGAWMVFAIGLGLLALSVFFSARIARLKVYTVSEMLDLRYGGRAGVISGVVMWAYTLMLAVTSTIAYATIFDVLFDMNRTLAIILGGSIVVAYSTLGGMWSITLTDMVQFVVKTIGVLLLLLPIAIVKAGGFSAMKAKLPTEYFDPLGIGGETIFTYVLIYTFGMLIGQDIWQRVFTARSDTTAKWGGTVAGTYCLVYALAGAVIGTAAKVLYPTLPSADSAFATIVKDELPVGVRGLVLAAALAAVMSTSSGALIACATVANNDIWSRLRGVSSRKGDDHDEVRGNRLFILVMGVAVICTAIALNDVVEALTVAYNLLVGGLLVPILGGLLWKRGTVHGALASVIVGGLAVIGLMATFGILANEPVYYGLLSSLAAYVIVSLATPATDAAVLAAWRERLAGRTPEPLAEPVPAPQ

SEQ ID NO: 12819 - protein, 322 aa, Streptomyces avermitilis
MSSNETPRGPVDSSRVPRYAGPATFARLPRLDEVGTADVAVVGVPFDSGVSYRPGARFGGNAIREASRLLRPYNPAQDASPFALAQVADAGDIAANPFNINEAVETVEAAADELLGTGARLMTLGGDHTIALPLLRSVAKKHGPVALLHFDAHLDTWDTYFGAEYTHGTPFRRAVEEGILDTEALSHVGTRGPLYGKQDLTDDEKMGFGIVTSADIYRRGADEVADQLRQRIGDRPLYISIDIDCLDPAHAPGTGTPEAGGMTSRELLEILRGLASCNLVSADVVEVAPAYDHAEITAVAASHTAYELTTIMSRQIAEARNK

SEQ ID NO: 12820 - protein, 561 aa, Streptomyces avermitilis
VTHDHDLVLRPTAAETSAALNPPPGRNGGDLVVETLTGLGATTVFGLPGQHALGMFDALRRSDLRYIGLRVENNAGFAADAYGRITGEAAPLLLSTGPGALTSLAALQEAAAASAPVLAISSQIPTAGLGGGRHGYLHELPDQQASFRGVVKSVHTVRTQSQIPSAIAAAWESALTVPHGPVWVEIPQDVLLAETSLPVVTALDATPEDVVPRPELTAVAAHLLSNAARPAIIAGGGVVRADAAGKLRALAEKLDAPVITTFGGKGAFPWEHPLSLQSWLEDRHTTDFLEDADVLLVVGSGLGELSSNYHTFKPRGRVIQIEADLGKLESNHPALGIHADARLALSALLETVGERTDPTAADRVRTVLTRVRERIAAQELTLEQDVLASVRRALPDDSPSFWDMTILAYWAWSAFDPRGSNSMHSAQGAGGLGYGFPAALGAAAADPTRPVLAVSGDGGALYSIAELATAKQYDLNVTWLIVDDGGYGILREYMTDTFGEATATELSRPDYVALAESFGVSGVRTTRETLEVDLAKALATPGPSVVLLPAVLRMFAPTHLG

SEQ ID NO: 12821 - protein, 475 aa, Streptomyces avermitilis
MSRARRRTRSARLTAPLAAAVLLAGGVGAWALTGASAQAATGTADAQDDFNGDGYADLVVGAPNATVSSKAKAGYVAVTYGSASGLSAADKKIVSRSTSGVPGAATASQRFGSTFTKGDLDGDGFSDLVIAGGTAGSVVLWGSASGLTGGTSIAGYGDSPQAGDFDGDGKTDLALFAHQQVEGDDPPSGAATVWKGPVSRAGKPTATLPVLATSAGSISGPIKSSQAGDINGDGKDDIVQWIYTGDGTWGNRLLYGGGSKGFTGGWVPGDGVGDLTGTGIGDVNGDGFDDVVVGADGWNSKVRVALGSASGLSESRVQSFDQDLAGFPGAQEEGDELGASVSVGDVTGDGYADIALGIPGEDVGTIADTGSVALVHGSASGVTGAGTQVFHQDTAGVPGVAEQDDRFGVAAALLDVDGNGHPDLAAASTAENASNGAVWVLRGDAAGLSAKSAFAFGPKTLSAPYTNALFGSFLR

SEQ ID NO: 12822 - protein, 217 aa, Streptomyces avermitilis
MDADVRRRDGTLGYCLEMSTGDMRDVMRLLTAVERTPEQERALGIVREGCAKTDARFREQGIGLDVSVEQALHELIEGVPGGARGAAYTYAFHEVVAAHFSDPTDLGVWSRPSWFFALDDELARHGIPADLLPGSFLFSGPPLRLPHPGDAFPQIGVLPTPRAAPLATAYEAVADRLGPDYRATARKFAELMRFEAEEWESAQQLGQTLDSIFFWFR

SEQ ID NO: 12823 - protein, 268 aa, Streptomyces avermitilis
MPATTHIRRWKTLALTTSAVLVGLTLPTLTAAPASATTTAYDSTYYKNAVGKTGTSLKSSLHTIISSQTKISYSAVWNALKVTDQDPNNSNNVILLYSGVSRSKSLNGGDVGDWNREHTWAKSHGDFGEATGPGTDLHHLRPADVQVNSIRGNLDFDNGGSTVTGGGGSLVDSDSFEPRDADKGDVARMILYMAVRYEGDDGWADLEPNEKVNNGSNPYIGKLSVLKQWNDEDPPSAFEEKRNQAIYDTYQHNRNPFIDHPEWVEAIW

SEQ ID NO: 12824 - protein, 775 aa, Streptomyces avermitilis
VTSATDPLSSAPAPAPGRSTTPGAPAAEPAQEPSPSPATPRWSLPALVAIMILAAVLYSWNLSSSGLNSFYSSAVFSGTQSWKAWFFGSLDAGNFLTVDKPPLALMVMGLSCRVFGFGTWQMMLPMIVAALGTIWILHSSVKRVFGHAAATIAAFVLALTPITVAINRDNNPDTLLVLLMVAAAALGLRATRDGRLLPLLGSAVCFGLAFNTKMLQGYIALPAVFAVCLYASGLSWAKRIRNLSLAAVALAVSSFWWATAVSLVPADDRPYIGGSTDGTAWNLIFGYNGLGRVLGGEGNGGGGGGGGGGGFSGTAGLGRLFNDILGGQISWLIPFAGIALVGGLVLCGRAPRTDRTRAALVLWGGWLLLHYVTFATAEGTMHPYYTTAVAPGIAALCGGGGVLLFRAFRGGDVRWSWVLPAGLAVTGIWAVVLLRRADGWNTWLWPAIAVVMATAVVGLLVFRSGTRVRLLAASLAAAIVAALAGPAAYSFAVPAGAGGAGGGMGGTNPTAGPSTGNGGFGGGRGGPGGNAGGPGGGMPGGTQQGGQAAGQEGGQQGGPTAPGGGGTCELPSGAPQGGGNGGFPGGGTGEGPGGGTGGENGTAPGGTGGQRGGGGGMGGGMGGETSSELISYLEKHQDGAKWLLAVSNSQSAGQLILSTHKPVISMYGFTGTDKGMTVAKLKELVKKGELHYIQVGGSGMGGGMGGGNSVSAAVTAWVQKNATAVKESAYSKTTTSESSATTNSDSNAGTNSDSQNGQSAQSTSTLYRLDPSDVG

SEQ ID NO: 12825 - protein, 159 aa, Streptomyces avermitilis
VPSAEQQFAGFLLSLDRFQKQLAEFMLGAYLACDFGGDSGDDGDSALSPQVRLDVVDGAPQVTLDHAVIWMDLARDQEPNEYRLAVTLTFTEAGIALEAFVRLDLDRDMGEWPAGVHVPYRQQADGLGLDEALAFVEARVEEMCRRYDDVTRLGLTPRH

SEQ ID NO: 12826 - protein, 636 aa, Streptomyces avermitilis
MYLHVKQKIVTLATALCLTVGAGVGTAAAAGPAPKREPEPTLLEIAAKVAKYSDCGSQPLLERPACLKEFALKSAKLGLGVGVFLYVTRDAMKDEGTSFKGLEKELTELHKLKPLLLLDPDKETDPEKKKQIYEQTVKALKAAKPHVDKLRTDVVKASRILDAHTESVEALAVLAVAVGDYYPDPKPVDDRPPKDTWDIAGFFKDINKSLDQINAGFDKMNGALDDMNKATAEVNRGLDKANKGIEKANRGMDKLNEGIKEANKGLNETKKAVDGIGKAASKLHEVPEFDFDFSGIADKIGSKDTTPGERAAQERRMSMLLNLLPGIGDGKGVIEAITGTDLATGEKVSSTDRVLGSLAVMRWLKYGGKLLPEDIRAARKGDKVPDCNSFPAGTRVLMGDGTTTLPIEQITVGDSVLATDPEAGTTGSRPVDDTIYTPDDEDFTGVTLAGDAADGPPALTATDRHPFWVENRGRWADARDLNSGDTLRTPDGTGVRIDKVTHWKEPQGAYNLTVNDLHTYYVLAGTVPVLVHNAGLCTEKIDSVFHNPSGRSSQDQFEYHWEKHAKARGVTREQYLQDAKGWATGIARPGGKRGLNASLEELADGSRGIKYVDPQTGKGGIIGPDGKVVTFWYGAD

SEQ ID NO: 12827 - protein, 190 aa, Streptomyces avermitilis
VWAAHRQFMRQNRDTLVQGGSQGMYEIRGYVNGAPPGMLDRSDETQVPAVSAFRMYLRVVSESLQPEEISARLGTGPDEATAIGSRRRPQSPPRAHATWIRHVLAAGGPGRPEDLEPVVLGWGPEFAAALGRLAGSGEADVCLVVVQEFTDPEDPQQKGIFLSAALLAWLAEAGASLDIDQYVYLDRDDQ

SEQ ID NO: 12828 - protein, 73 aa, Streptomyces avermitilis
MADQIIPNAATLRGWRKSSYSNSEGGSCLEVLDGHPSGVPVRDSKVPHGPALVFSPADWASFVTAVKDGEFPA

SEQ ID NO: 12829 - protein, 266 aa, Streptomyces avermitilis
LAMTSTYGDWLKQQRETAGLTQQQLADAAVMTRSHIAHIEAGRRTPSKEDARRLDEVLNTGNVLSSFLPREDAAVADYFEAALLLEQQAVRINEFALSFVPGILQTERYARAVLSKSFPPASDEECDRLVVTRLERAKILDAPGAPVVWATLDEAVLRRVVGGREVMAEQLMHLVCLAECRRVRVHVLPFALGFHPLMESMLSLMWFEDQPPVAYSEGLRMGKVHDSPSVVQELQGRYALALSDALPLKESVALLRATAKDYGHHG

SEQ ID NO: 12830 - protein, 145 aa, Streptomyces avermitilis
VSGSPHKARPPRPSDRSGGVAINEPNGVDDMSHRIARLFEPLLRLLLPGTGRRRRAVTAPAHRRPTPSYAPGRTARRDGSRPLRGEDNAMVRPYLVAHERSEEARRQRARRRALWLAVHGIDVGPRIIHGIDIGPRIIHRVEVPA

SEQ ID NO: 12831 - protein, 112 aa, Streptomyces avermitilis
VTSDRTETVRLLPWSGPEGKPCYVVGDGTGYVSRMADSVESVQLGMAAQILDHAADMLADHKATAAQLRFLAARMAEALRDVRRIAESRGARLPGPAGEGPEDDTESPATDV

SEQ ID NO: 12832 - protein, 310 aa, Streptomyces avermitilis
MTHRMSRGARVLAVSLGAGMLIPLAAAATPAAAVGTPQVSCTSEKAGLAAKLQSDITAALANRKGTIAVGLYDRTTKTSCTLRSSTAYDSASVVKVTVLATLLWDAKKHNRYLTSRETDLATDMITKSDNTATSTLWRQLGVTKVKGFLAAAGMTQTKPGADGYWGLTQITVRDEQKLLALVTAKNSVLTDNSRAYILKLMGKVVSSQRWGTPAGAPSSVAVHVKNGWLSRATHGWRVHSVGTFNGGGHDYTMTVLTHGNSTMDYGVDTIQAVAKAIHKDLVPATSSASVQRYVPTDTPKEAFPAVPATG

SEQ ID NO: 12833 - protein, 1257 aa, Streptomyces avermitilis
MDGRKGTGVTAHEGETAHEGEPRGWAYRLAGYAWRYPKDVVLALGSSLAGMAVMALVPLITKVIIDDVVGNHTRDMAPWAGALIGAAVLVYASTYVRRYYGGRLALDVQHDLRTAMYGTITRLDGRRQDELSTGQVVGRATSDLQLIQGLLFMLPMTIGNVLLFLISLGIMAWLSLPLTLVALAVAPALWFVARRSRSRLHPATWYAQAQAAAVAGVVDGAVSGVRVVKGFGQEDQETGKLREVGRRLFAGRLRTIRLNAKYTPALQAVPALGQVAMLALGGWLAVRGQITLGTFVAFSSYLAQLVGPVRMLAVVLTVGQQARAGAERVLELIDTEPSIEDGKKTLPSDAPATVEFDDVLFGYEEGRPVLDGLSFEIRPGETLAVVGSSGSGKSTVSLLLPRFYDVTHGAVLVGGHDVRELTTESLRAAIGLVPEDSFLFSDTVRANIAYGRPDATREQIETAARAAQADRFIAELPDGYDTKVGEHGLTLSGGQRQRVALARAILTDPRLLVLDDATSAVDARVEHEIHEALQQVMRGRTTLLIAHRRSTLNLADRIAVLDAGRLADIGTHEELQERSSLYRRLLTDPDELGGVSPGHAQPFPVREDTSVRDELDAEFDAERGVTPHLWTGDREPKDTALAGMPATPELLAQVEALPPAGDRPDIDEARAVTPEQSYGLRRLLRGFGAPLLISLGLVAVDAVMSLLLPVLIRHGIDQGVTRMALGAVWAAAGLGLFTVLVQWAAQIGETRMTGRTGERVLYSLRLKIFAQLQRLGLDYYERELTGRIMTRMTTDVDALSTFLQTGLVTAFVSVVTFFGIMVALLVIDVQLALVVFVTLPPLIIATFFFRRASVKAYELARERVSAVNADLQESVSGLLILQAFRRERSGRQRFADGSDSYRRARIRGQWLISVYFPFVQLLSSVAAAAVLIMGAHRVDAGTLTTGALVAYLLYIDLFFAPVQQLSQVFDGYQQATVSLGRIQELLQEPTSTKAADEPLEVLSLRGDIVFEDVDFAYGDDEEALREVSLAIPAGQTVAFVGETGAGKSTLVKLVARFYDPTGGRVTVDGADLRALDLTSYRHRLGVVPQEAYLFQGTVRDAIAYGRPDATDAQVEAAARAVGAHDMIATLDGGYLHEVAERGRNLSAGQRQLIALARAELVDPDILLLDEATAALDLATEAVVNQATDRVAGRRTTLVVAHRLTTAARADRVVLMDHGRIAEDGTHEQLLQLGGRYAQLWRTFVGAAEPGEPVASSA

SEQ ID NO: 12834 - protein, 482 aa, Streptomyces avermitilis
MRKALRWLLALAVLIGTLSTAGAATAAQPEATGSASAADTDIKDRLLAIPGMSLIQEKPYTGYRFFVLNYTQPIDHRHPSKGTFQQRITVLHKDTSRPTVFYTGGYNVSTTPSRREPTQIVDGNQVSMEYRFFNPSRPDPADWSKLDIWQAASDQHRIFKALKAVYGQKWLSTGGSKGGMTATYYERFYPRDMDGVVAYVAPNDVVNDEDSAYDRFFANVGTKECRDKLNAVQREALVRREPLEKKYAAYAADNGYTFTTIGSLDKAYEAVVLDYVWGFWQYSLLSDCDAIPADAAHATDDAIWDSVDTISGFSAYADQGLETYTPYYYQAGTQLGAPTIHFPYIEKKLVRYGYQPPRNFVPRSIPMKFQPGAMRDVDGWVRHHARHMLFVYGQNDPWGAERFRLGAGARDSYVFAAPGLNHGANVAGLVADEKALATARILEWAGVASTAVQADPSAAKPLAKYDAKLDRRDVDREPTLRP

SEQ ID NO: 12835 - protein, 210 aa, Streptomyces avermitilis
MRARPALPGGLLTAVLTLLSAAVVSGCSQQSGGQAGQPTQGTTSTRPSGYGAVFLAVDECSSFGTTSFTEVPCTSERAAARVIARYDGKPSDGPACPATTDFVLHISETRPASDEDGDGAVPRGYACMRNLEPPHPGDPGGGGGPRTIVGDCVYGAGRGEVRETSCDGKGRKPPEYRVTSAVPKRSDCPRSTALYVQLGGPTPVGCARPV

SEQ ID NO: 12836 - protein, 616 aa, Streptomyces avermitilis
MRDSGTGSTGNTGNTGNTAQPSRRTVLAATAGAGAVLAVSGTAHAGPSGDRKLRALISRMTLEEKVGQLFVMRVYGHSATAPDQADIDANLKELGVRTAAELIATYRVGGIIYFTWAHNTRTPHQIADLSNGIQKASLDQPRGLPVLIATDQEHGIVARVGKPATLFPGAMAIGAGGSRSDARTLGRIGGAELRALGILQDYSPDADVNVNPANPVIGVRSFGADPDAVAGLVAAEVKGYQQSGVAATAKHFPGHGDTAVDSHFGFPVITHSRELWGELDAVPFRAAVRAGIDSIMTAHIMVPALDASGDPATLSRPILTGILREELGYDGVVVTDSLGMEGVRQKYGDDRVPVLALKAGVDQLLNPPSIDIAWHAVLNAVRGGELTEARLDESILRVLRLKSKLGLLHDPYVTERGVDRTVGTPEHLRAADRIADRTTTLLINKQGLLPLSRRTRPRVLVVGADPASPSGTDGPPTTVLAAALTELGFTATALSTGTAPSTATIAKAVAAAGSADAVVVGTYNVTAGSSQRTLVNKLVATGVPVVAVAIRNPYDVAQLPDVGACLASYSWTDVELRAAARVIGGRVTPRGKLPVAVQRADAPEQVLYPIGYGLTY

SEQ ID NO: 12837 - protein, 308 aa, Streptomyces avermitilis
VLDLQRLRALHAVSVHGTVGAAAAALGYTPSAVSQQIAKLERETRTVLLERQGRGVRLTEQAEQLAATAQELLAIVERAETELEERRGLPAGRLTVAAFASAARGLMPGVLADLAARHPSLDTRLTEVDPHLSVDLVAKGAVDVAVAHDWDIAPLPAPPGVEQAVIGDDLCDLLVPAGHPLAGRASVRRAELAGQRWICQPPGRVCHDWLVRTLRAAGCEPDIVHQADENPTLVALVAAGLGIALIPRLGRGPLPDGVVAVPLAPMPVRRLYALWRAGAARRPAIAETVRTLQAHWTEERTPAHQGDV

SEQ ID NO: 12838 - protein, 306 aa, Streptomyces avermitilis
MRPAHICLAVLVAAVWGVNFTVIEVGLAHFPPLLFSALRFLAAALPAVFFVGRPKVAWKWIVAVGLVLGVAKFGLLFIGMDAGMPAGLSSLVLQIQAVFTALIAFAALGERPTGIRLAGMAVALCGVGLAAVDEGTGGPLGAFALVIGAAVCWGASNVLTRKASPPDPLNFMVWVSTVPVVPLLGLSLLTEGPSADLNALGSLDWQGAGVILYVAWITTVFGFGAWGWLLHRHPASTVAPFSLLVPVFGMSSAALFLGEPIGPMRWGAAALLAGGVALTSLAPGKERSGGPNTLDLRGVGIHEAGR

SEQ ID NO: 12839 - protein, 169 aa, Streptomyces avermitilis
VMCGLRTVHGSGNAPRGGVPMKAVEMKAVEMKAVAMKAVLPIGRTGSVWMLPAALLVTMSVACTSSDGGASASSCAYLVEYQSRTYAGSAARDFTLGDELGAATLPPCDDTPNDDSDGRTTPTSTTAYAIEGVDPAIAIALEQSSDDVIFIDVDSDWTLPEIKKMIHGT

SEQ ID NO: 12840 - protein, 583 aa, Streptomyces avermitilis
VPADHVGIVKRNFGAAHSDPSFKEVNPDNARGVRARTLLPGGFHWLTPLLYSVECVPRLHIPAGMLGLVSATEGRTRTEGRPLGRHVACNSFQDGEAFLRGGGEQGVQVTTLSGGQSYYINTRLFRVETVPRTYVPPGTVGLVQAQAGAVRPPDQRFGRHVECNSFQDGEAFLLGGGEQGRQLAILGGGAYYDINPELFDVITVDNVTASRDGLTEAHLQDVSIEEGCTGVVITLDGAEPRQDTTGTVAPRVEGHGSFRRPWVFLAKGGERGIQEETLGEGTTYSLNPWFVRVMLIPTRVLYLTWHNKRESESDNYDADLGQITVNVQGFDLDVDLTQNLQIPRGVAPRLVSQFGGVRTSGLGGLVDDPTPMQRFVRNVLGNTVAGYFNEIAVTSSVLEFLGTYQDIRKDLTDQVTHALEKWGVGMQGTALGRFIPRDPSLLEKLKEKFAEQARLANLEVGVEQAKLKDLIDTYEALAEARRVGLELQKEVELLGRENVTLIRVVGEFAKFDVPQYVGGGGDISEYVQMLPLTVKQDLLARLRNLHGGRPVDPGQERPVLTKESDAMDDDTDDTIDGDVRLVD

SEQ ID NO: 12841 - protein, 542 aa, Streptomyces avermitilis
VTTGRKERLLPYLGRSPEPTTRSDRRAQEVQRLNDVFLSYAAADAVWATKLAEHLAGHGLSVFFDQWSIEPGQVVIHELEAALLASTNGIAVISPASVRSAPAMNEYAVLAGASATHGLRFIPVLLGQVAAPPFAAQRVWRDFSDATGQEFTDKVAELAAVIARRPAPTGAGAASSRDNLAAVHPSPPRPLTAPEEPAFVVCCAPADAAYGGRLTEQLRAAGLPVWSTGDLRPGDAQFWTIRQQLRYAVAVVVVMTPQSQDSDDVTRMILEGQVHGRAFVPVLLDGEVNYHLAATWHVDARHGGLLDEAELGLLRLLHEDVTQGRPARLPEAAPARGSAPAVRMTTPAVGMAPPAVRMTTPAVHTTAPEIRTTAPAARMTAPAALERLRAHLAEDEYEHADLLTTRLVLETAGRLGEGWLSERHAAALPLELLAGIDALWTAHSHGRQGFGRQRALAPMDRGGRGSRFPDLGAALGWRDSAEAAVPRLYQDFARRAGPGRRAGFFPTLRDPGRENNPDWYDRWSSTVLAVHARLREWKAAPC

SEQ ID NO: 12842 - protein, 328 aa, Streptomyces avermitilis
MVVTRPWRLPRSTEVREVRRGRYGRTVLARLDGEAGEVGEVGDLVAVRYIPAGLLIHRPRAEAFWTDVARLTGLEAPEAVPFRQYVHAPGFTAAYTRSAGAVEAVGGALVSDAVEGVTLSRVLDRHGALPPAAALLVVHRALRALAAAHGRAVVHGDLRPAKVLIDADGVPAVTGLGLAALTTGAAGLRAPELWRGGGAATPGGDVYGTACVLHLCLTGELPFPVRQLFSLMARHTTAQVPMEAVPGPLRAPLAAGLTKDPALRPGAEALLAHLERTARTALGRDWEERGGSALRTLAAPLTEALPLTSPSAEDRPHADSSHEGVLMM

SEQ ID NO: 12843 - protein, 185 aa, Streptomyces avermitilis
LPRWRPRTSPGFRCGTGAVPAGAAVATRAPTPRPAPPLRHRRHRRRARTTCSCRTRTRRPNAAERLAERLREAGVSVFLVRWVEPGLVPLLETERALVGATLGVLLFGPGTMADSRIREEYAVLLQRVHGGGFRFVPARAGSVELPPFADIRRPVDLREPGTPRYDGEVARLADTALRLRRRTDV

SEQ ID NO: 12844 - protein, 266 aa, Streptomyces avermitilis
MKLAFSTLGVPGLPVPDVVRLAATHGYHGVELRAHPEEPVHPGLGPAERAEVAAAFRAGGIEILGLAGYARVAAPGDDDPVLTEIRGLLDLARDLGAPFVRVFPGAVAEQSRAEADATAARRLGTAAEYAADVDVRILLETHDSHRTGADAIRVLGPVGHRHAGALWDVMHTWLGGEQPSSTYAALAPHLGYVQVKDIASAEDTTPLPLGTGVLPLAECVELLSREGWDGWLCWEYEKRWYEQAAPLPGLLRAGRNHLARLLNESA

SEQ ID NO: 12845 - protein, 310 aa, Streptomyces avermitilis
MTVHDIRSFNRFYTNVIGALDYGRHLYAPYTLTESRVLYELAHSPRTDAADLRTELSLDAGYLSRILNKFEDDGLIRRSPSERDPRRRHITLTARGRDAADLLAERARASVGALLSTVPAADHPRLTEAMRTIQELLSAGRPPRREDVLLREPAPGDLGWIVQRNAAVYAAEYGWNTDYEGLVARIVADFAQDHDPHLERVWIAEVDGRPAGCVMCVRDEAPGAARLRLLLVEPDARGLGIGDRLVSAVVEFARGAGYREVLLWTNDVLSAARHIYQRHGFVLLAEKPHRSFGADLVGQDWRLDLHEAHE

SEQ ID NO: 12846 - protein, 346 aa, Streptomyces avermitilis
MTVTLADVAARAQVSPATVSRVLNGNYPVATSTRERVLRAVDELDYVLNGPASALAAATSDLVGILVNDIADPFFGIMASAIQSEIGGPGGRAGGERLAVVCNTGGSPERELTYLTLLQRQRAAAVVLTGGAVEDTAHAAAVSAKLRKLAEAGTRVVLCGRPPAPEAVALTFDNRGGGRQLTEHLIGLGHRRMGYIAGPEERTTTRHRLEGHREALEAAGVEDDPRLTVLGRYDRRSGYEATLELLRRDPSLTAVVAANDTVALGACAALRDSGLRIPEDVSVAGFDDLPFAIDAVPALTTVRLPLTEAGARAGRIAMGREEPPPGGIATVRGELMVRGSTGAPRG

SEQ ID NO: 12847 - protein, 383 aa, Streptomyces avermitilis
VTRKTVRIAMNGVTGRMGYRQHLVRSILALRDQGGLDLGDGTVLWPEPVLVGRREHALKAFAERHGLEHWSTDVDQVLADDSIDIYFDAQVTSAREEAIKKAVAAGKHIYTEKPTATGFEGALELARRANAAGVKHGVVQDKLFLPGLLKLKRLIDGGFFGRILSIRGEFGYWVFEGDWQAAQRPSWNYRAEDGGGIVVDMFPHWEYVLHELFGRVTSVQALTATHIPQRWDEQSKPYDATADDAAYGIFELEGGAIAQINSSWAVRVNRDELVEFQVDGTEGSAVAGLRNCRVQHRSATPKPVWNPDIPATYSFRDQWQEVPDNTEFDNGFKAQWELFLKHVYADAPYHWDLLAGARGVQLAELGLRSSAEGVRLDVPEISL

SEQ ID NO: 12848 - protein, 383 aa, Streptomyces avermitilis
VTIRLPGVGGELRTYVPRTEPLAPTAGAPFTSRTVFSAAHVVADPYADTTPDSPAAVDWDATLAFRRHLWSHGLGVAEAMDTAQRGMGLDWAGAAELIRRSAAEAKAVGGRIACGVGTDQIAGGTPAEVRAAYEEQLALVEESGAQAILMASRALAASASGPEDYLEVYGQLLRQATEPVILHWLGPMFDPALAGYWGSSDLDAATDTFLEVIAAHPDKVDGIKVSLLDARREVELRRRLPRGVRCYTGDDFNYPELIAGDEKGFSHALLGIFDPLGPLAAEAVRVLDTGDVKGFRELLDPTVDLSRHLFRPPTRFYKTGVVFLAWLAGHQDHFTMVGGLQSARSLPHLAKAYELADGLGLFPKPELAEARMKTLLSLYGVSR

SEQ ID NO: 12849 - protein, 277 aa, Streptomyces avermitilis
MSAALERFSINQMTVKQLDLPELVDACLESGVPGVGLWRAPVQSYGVEATAKLIRDAGLSVTTLCRGGFLTAIEPAERARALDDNRLAVDEAATLGTDTLVLVSGGLPAGSKDLHGARERIADALGELGPYAASRGVRLAVEPLHPMYASDRCVVSTLAQALDIAERFPAEQVGVTVDTYHIWWDDTAPAQIARAGASGRIHTFQLADWTTPLPEGVLNGRGQIGDGAIDMREWKGYVEAAGYSGPIEVELFNDALWARDGREVLAETAARFAEHVG

SEQ ID NO: 12850 - protein, 129 aa, Streptomyces avermitilis
VKKAGILNRHLAGALAELGHGHGVLVCDAGMPIPVGPRVVDLAFRAGVPSFAEVLDGLLDELVVEGATAAREVREANPGATALLQTRFPALELVPHEELKSLSANARLIVRTGEARPYANVLLRCGVFF

SEQ ID NO: 12851 - protein, 299 aa, Streptomyces avermitilis
MYDYDLLVVGSANADLVIGVERRPAAGETVLGSDLVVHPGGKGANQAVAAARLGARTALLARVGDDAHGRLLLDSQRRAGVDTVGVLVGGAPTGVALITVDPSGDNSIVVSPGANGRLAPRDVRAADSLLRSAAVVSAQLEIPLESVVEVVRNLAPGTRFVLNPSPPRPLPEEVLAACDPLIVNEHEARVIAGGELDGSPEDWAAALLALGPRSVVVTLGAEGALVASAEGTARVPSVRVDAVDTTGAGDAFTAALAWRLGLGESLVRAAAYAARVGASAVTRSGAQASFPTAEEVAAL

SEQ ID NO: 12852 - protein, 648 aa, Streptomyces avermitilis
VATDTLKSTTGASGASAVRRLLLDNGALTALIVLVVAMSALSGDFLTTDNLLNIGVQAAVTAILAFGVTFVIVSAGIDLSVGSVAALSATVLAWTATSHGLPVVVAVALAVATGVACGLVNGFLISYGKLPPFIATLAMLSVGRGLSLVISQGSPIPFPDSVSHLGDTLGGWLPVPVLVMIVMGLITALILGRTYIGRSMYAIGGNEEAARLSGLRVKKQKLAIYALSGLFAAAAGIVLASRLSSAQPQAAQGYELDAIAAVVIGGASLAGGTGKASGTLIGALILAVLRNGLNLLSVSAFWQQVVIGVVIALAVLLDTLRRKAGATPVAGASSGGKGKQAMTYVIAAVVAAAVVGAMSFLHNGSSASPTQKMGLSLSTLNNPFFVQIKTGAQEEAKKQGADLTVTDAQNDASQQANQVQNFTSSGVGSIIVNPVDSDAAGPAVRSANKADIPVVGVDRGVNKADTAALVASDNVAGGRLGAKALAEKLGGKGRIVILQGLAGTSASRERGAGFAEGLKAYPGIKVVARQPADFDRTKGLDVMTNLLQAHPDVQGVFAENDEMALGAIKALGAKAGKSVSVVGFDGTPDGLTAVKSGTLYASVAQQPKELGRIAVQNALRAAEGKKVDKTVKVPVKVVTAKNVAAFGG

SEQ ID NO: 12853 - protein, 522 aa, Streptomyces avermitilis
VSNADELLRIEGIRKTFPGVVALDGVDFDLRRGEVHVLLGENGAGKSTLIKMLSGAYRPDGGRVLVEGEEVRIHGAQDSEALGIATIYQEFNLVPDLTVAENIFLGRQPRRLGLIDRKKMEADAAELLARVGVQVSPRARVRELGIARLQMVEIAKALSLNARVLIMDEPTAVLTSEEVEKLFAIVRQLREDGVGIVFITHHLEEIAALGDRVTVIRDGKSVGQVPASTSEDELVRLMVGRSIEQQYPRERPDSGAALLSVEGLTRDGVFHDVSFEVRAGEVVGVAGLVGAGRTEVVRAVFGADPYDRGSVQVAGARVPRHDVSAAMSAGIGLVPEDRKGQGLVLDASVEENLGLVTMRAATRGGLVDLKGQRDAAARVAGQLGVRMAGLGQHVRTLSGGNQQKVVIGKWLLADTKVLILDEPTRGIDVGAKVEIYQLINELTAAGAAVLMISSDLPEVLGMSDRVLVMAQGRIAGELGADEATQDSVMALAVSTNQYKPDKSDKPDASAGKTDQKEAPRGH

SEQ ID NO: 12854 - protein, 354 aa, Streptomyces avermitilis
MASIKDVAAAAGVSVATVSRVLNDHPSVSDDARARVLAAVQELGYRPNAVARSLRTDQTRTLGLVISDVLNPYFTELARSVEEEARAHGYSVIIGNADERPELQDHHVRTLLDRRIDGLLVSPTDGGSPLMLDAARAGTPMVFVDRWIPGVDVPVVRSDGRAAVRDLVAHLHGLGHRRLAIIAGPAATTTGSERVEAFREAMAEYGLPLPDAYIGQGDFQAESGRRATERFLDLAEPPEVVFAADNLMALGALDAIRARGLRVPEDIALAAFDDIRWFVHTDPPITAVAQPTGELGRAAVRALVDRIEGRPPQSVTLPARLVVRRSCGEPASQEQTSQEPTSQEPSPVTNRSQS

SEQ ID NO: 12855 - protein, 110 aa, Streptomyces avermitilis
MKFDMGSQVLSTLISNSRGSSDDLGTLIRQLVQAAQPLEGKFNGAGRVAFDSFKGRSDEITASLNSALSGILGGQSGMESAFGSGDQEQGENARTQEAAANFDGARFSGR

SEQ ID NO: 12856 - protein, 105 aa, Streptomyces avermitilis; identical to SEQ ID NO: 11630

SEQ ID NO: 12857 - protein, 132 aa, Streptomyces avermitilis
VVPGWDLKPQGIQGVLKTTGETASHIETHAKSYGEHLTSAATNAGTISAEGGGGGGGEKAAGGLVALALSQYAEHAATDLKFIAARAGKSLQGAVDATTAYLNGDQEMAAEAQRKALSAPDLDPMKPGVQTS

SEQ ID NO: 12858 - protein, 900 aa, Streptomyces avermitilis
VIKPEAIPQYTGDLALLESAYGDLKTDASHIRSTGKDVHSQFQGLAAYYTAPEAEQLFASTKPVADRADGFADDLEKVSGALSSYGTEIRPLVDKLKQLKIDATNFVSSVKDDDDWEYDEDKIDKHNKIRDDVTATVAAFWAAERTCHNAITKLFGGTQMVAGDGSDRKDQYGFNADDLKNAKLPWGDPMEEKHHVWEVGHWVKSFVWDGLIVDGVWGTIKGLGTLVGFGGWDAMGQAWKGLAQLATGLAISSIPGASALFWTLPDDKLPSWLRDSRTAMKETGKALVAWDEWGKNPGRAAGAVTFNVLTTVFTGGAGGAAAGAGKAGAVAKVLSVAGKAGKFIDPMTYITKGAGAGLSKIGDIAKGLKGIGNIEIPKLPDNAITLPEGALKLPDGSVHIPEGAAIPEGAVKLPDGNFQLPHDTPAFPEGTTKLPTEPGAPAQYLDPKGNILDHQGNVVDNVDHAPTDVVDKPTGGNPAAGSDVPHTPSPIKEPALVGAGSHTADNAAHVGDNAGQTVRLGDSLDNNLGDVGRTGDNAGTPTVHAGDNLPGQAGHDLPGGNVGDNLPGGRAADNLPGGSADHLPGGTAGDHLPGGRADDLGTGPSASHEPPTGGHTDGHTGGETGSHGDGSSPGSHEGPTTGGDGPGGDGPGGPHDPGGPHDPGGPHDPGAGGADDAGGWEKAEDSGPFERGGETEQQIRDQLRGSNVKPADLDRVLANLAENPAGKEIADTMASGRFNGLKNYDQVISSLSHADKMSGGIEQLRLGNRLYESGVHDISFELKGGSEIKPGVRAGEGTDLDVMARDAEGKVHGYQFKEVQNPKRLVKKIFDNMKQMESSGADFNTFVVDTKGTLADHLALRTEQRLTDVYGKSGIQFVIRVEDGVLTIPPGGKFMPEGTL

SEQ ID NO: 12859 - protein, 335 aa, Streptomyces avermitilis
VIATTPVARWTWGREHQEQDNVVACLHELLAAYEVLNAHELMIGIPKVSVAVHEAGKPNSYLFQGTVELDATAPPGEVARQMAARIAAAAHPGEVGSVYADAKSDGIVMRAGEAIREEGLFRLGASALLDYVSVELVTYSDVWMPYDLEGRAQPSVFAENGSRLSAALRDLSEALDTETDPDDPTYFGKPSETGVENYFEEDGSASDVWSRFEIPYRYQEFTHAPGFGRIGYKRTATGEVQYMPVHAEQTLLGHIWASDVENAASFEPVDVGDEEAYKAGLLWLERLRAAHDRGLAPSAALDELSRLPDENGTGKVDTTTEQRRASLADLRERTP

SEQ ID NO: 12860 - protein, 120 aa, Streptomyces avermitilis
MRRIDIDGPEVDMDMGQRLLYRGELFTGEVVEYQRGALVSLNTYKDGVEDGPTREWYMDGTLRSEGVMRDGVPVGELQSWHPNGRLAARMTMSDNGLRQLALFEWDEDGNLTKEWHAERN

SEQ ID NO: 12861 - protein, 230 aa, Streptomyces avermitilis
MACRAQLTADGRGELKRMSALMRAPEECASWFWDLEDYAPPGLRSALVTAAHMSAVLLKHDLMKPASLEWYWVVPELGGAIAKTRLRLLWPLDDEQVAQRVEALRPVGFPQAEFSGFLVTGPGMWLDEHGAQRHENRLVELTVSSEPLGLSADVSVFHDIWGPFDFRGTPHPEVHQQNAPRLAVALKELDALVGVAAEPGEPTYFGRAEGHGVGTPDAEDGRGPDLTDQL

SEQ ID NO: 12862 - protein, 120 aa, Streptomyces avermitilis
MRRIDIDDPEVDMDPGQRLLYRGELFTGEVEERLGGAVVSLETYADGVLHGPNQEWYKDGTLRSEGMARGGRPVGITRDWHPNGTLAAEREFAEDGLTMLSDREWDETGQPTRAWRKDGD

SEQ ID NO: 12863 - protein, 758 aa, Streptomyces avermitilis
MASGASRAAQPGTGERHLAVLEGVLERITYANEENGYTVARVDTGRGAGDLLTVVGSLLGAQVGESLRMEGRWGSHPQYGKQFTVENYTTVLPATVQGIRRYLGSGLVKGIGPVFADRITQHFGLDTLQIIEEEPKRLIEVPGLGPKRTKKITEAWEEQKAIKEVMLFLQTVEVSTSIAVRIYKKYGDASISVVKNQPYRLATDVWGIGFLTADKIAQSVGIPHDSPERVKAGLQYALSQSTDQGHCYLPEEQLIADAVKLLQVDTGLVIECLAELAAPSEEDGEPGVVRERLPGPDGGDPVTAIYLVPFHRAELSLSAQLLRLLRTDQDRMPGFHDVAWDKALDWLKGRTGAELAPEQEEAVRLALTQKVAVLTGGPGCGKSFTVRSIIELARAKRAKVVLAAPTGRAAKRLAELTGAEASTVHRLLELKPGGDAAYDKDRPLDADLVVVDEASMLDLLLANKLVKAVPPGAHLLFVGDVDQLPSVGAGEVLRDLLADGGPIPAVRLTRVFRQAQQSGVVTNAHRINSGRHPLTDGMKDFFLFVEDDTEEAGRLTVDVAARRIPAKFGLDPRRDVQVLAPMHRGPAGAGTLNGLLQQAVTPARPDLPEKRFGGRVFRVGDKVTQIRNNYEKGENGVFNGTVGVVTSLDLDEQRLTVLTDEDEEVAYEFDELDELAHAYAVTIHRSQGSEYPAVVIPVTTGAWMMLQRNLLYTAVTRAKKLVVLVGSRKAIGQAVRTVSAGRRCTALDFRLSPRPLAP

SEQ ID NO: 12864 - protein, 429 aa, Streptomyces avermitilis
VSDNSVVLRYGDGEYTYPVIDSTVGDKGFDIGKLRAQTGLVTLDSGYGNTAAYKSAITYLDGEQGILRYRGYPIEQLAERSTFLEVAYLLINGELPTVDELSTFKGEITQHTLLHEDVKNFYRGFPRDAHPMAMLSSVVSALSTFYQDSHNPFDEKQRNLSTIRLLAKLPTIAAYAYKKSIGHPFVYPRNDLGYVENFLRMTFSVPAQDYDLDPVVVSALDKLLILHADHEQNCSTSTVRLVGSSQANMFASISAGISALWGPLHGGANQSVLEMLEGIQTSGGDVDTFIRKVKNKEDGVKLMGFGHRVYKNFDPRAKIIKAAAHDVLSALGKSDELLDIALKLEEHALADDYFVERKLYPNVDFYTGLIYRAMGFPTEMFTVLFALGRLPGWIAQWHEMIKEPGSRIGRPRQIYTGEVLRDFVPVEGR

SEQ ID NO: 12865 - protein, 750 aa, Streptomyces avermitilis
MSSTTAEAPIGPASQVELTIGGMTCASCAARVEKKLNRMDGVTATVNFATEKARVSYPAEVEVADLIATVVKTGYTATEPPPPRPEAPEEPQPSRASEEDPELTSLRGRLTVSVLLALPVVLLSMIPALQFDNWQWLSLTLAAPVVVWGALPFHQAAFTNARHGAATMDTLVSVGTLAAFGWSVWALFWGHAGMPGMRHGFDFTVSRGNGASTIYLEVAAGVVAFILLGRYLEARSKRRAGAALHALMELGAKDVAVVRNGREVRVPVTRLTVGDRFVVRPGEKIATDGTVVEGDSAVDASMLTGESVPVDVTVGDTVTGATVNAGGRLVVEATRVGADTQLARMAQLVEAAQNGKAEVQRLADRISGVFVPVVLLIALGTFGVWLAVTDDTVAAFTAAVAVLIIACPCALGLATPTALMVGTGRGAQLGILIKGPEVLESTRRVDTVVLDKTGTVTTGRMTLQEVYVAEGAAEKEVLRLAGALEHASEHPIARAITAGAQERAGALPAPERFENVPGLGVRGRVEGHEVLVGRLPEVALPEGLARAKATAEAEGRTAVVVSRDGVALGVLTVADAIKETSAEAVRELRALGLTPVLLTGDNRAVAESVARAVGIDEVIAEVLPQDKVAVVERLRGQGRTVAMVGDGVNDAAALATADLGLAMGTGTDAAIEASDLTLVRGDLRVAADAIRLSRRTLSTIKGNLVWAFGYNVAALPLAAAGLLNPMIAGAAMAFSSVFVVTNSLRLRTFS

SEQ ID NO: 12866 - protein, 79 aa, Streptomyces avermitilis
MTAETETPGSTTTVYQVSGMSCGHCEGSVSSEIAEIAGVSSVKAVASTGEVTVVSAAPLDDEAVRAAVDEAGFELAGRA

SEQ ID NO: 12867 - protein, 232 aa, Streptomyces avermitilis
VPESQQSEEQRPNTSDEQDTSEEQRPGDKDRPRRRQARGERRIVQLLEAAASVFCRAGYTGASTNAIAREAGVSPGTLYQFFPNKEAIAVGLSDRLLHDWRESHGQALAAENIGLPLDEMLDAVLDPLIAFNVENPAFGVLMHGPDTPCRITEEKGVLGGAILTRVEEIIAGYLPDAPPDERTRTATMTVTLFKAGLDLVMSHEGAERDAYIAELKTVMYRYLKPLVEDTAG

SEQ ID NO: 12868 - protein, 772 aa, Streptomyces avermitilis
MSEVNSADDGERPDRGGGPGRDPGGGVRLGGWTRFVTARPRLSLLVALLLTALAVVAGGGVADRLGSGGWEDPAAQSTYATKVLEREFPGSQPNLLLLVDSGRRSVDAPSVAAEAKRLAARLAAEPGVTGVGSYWQSGAPTLRAEDGHEALVAARITGDEKTASETLDRLAPTYRGAHGPVKVKVGGPVAVRHEMQTTIREDLTRAELIALPVTLVLLVMVFGSAVAALLPLGVGIVAILGTNAVLRGITEFTDVSVFAMNLTTALGLGLAIDYALFIVRRFREELATGAEPPAAIAATLRTAGRTVLFSALTVAVSLAAMLLFPQYFLRSFAYAGIAVVLLAAGAALILLPAALVLLGHRVNSLDLRRVFRRGKSRETTGAGAAGERTAAGERTADGGAAWGRMASLVMRRAPLFAVATTVGLVVLGLPFLGVKFGTADDRQLPSSAEAHVVQQHIREGFPGSPGGGLEVLAEGRATETQYTAYKERIAALPEVRRVDGPLVKGDTAYFAVQPKGEAVDEGAQRLVGELRATDAPFDTSVTGTAAVLVDSKHAIADQLPWAAGFIAVVTLFLVFLLTGSVLIPVQAVLLNALSLTAMFGAVVWVFQDGHLSGLLGFTSSGSIETTLPVLMFCVAFGLSMDYGVFLLSRIKEEYDRTGDHRDAVRFGLQRTGGLITAAAVILAVVMVAIGTSRVTNTKMLGLGIALAVLMDAMVVRSLLVPAVMRLTGRATWWAPAPLRRFHERFGLSEGEPPAAPEEKEADQERDKVAAPG

SEQ ID NO: 12869 - protein, 347 aa, Streptomyces avermitilis
MRAVVFERFGEPAEVREVADPEPSEHGVVVRVEATGLCRSDWHGWVGHDPDITLPHVPGHELAGVVEAVGTRVSGWRPGDRVTVPFVCACGSCAACAAGDQQVCERQAQPGFTHWGSFAQYVALEHADVNLVAMPDELSFGTAAALGCRFATAFRAVVAQGRVAAGEWVAVHGCGGVGLSAVMIAAASGARVVAVDVSPQALDLARKFGAAASVDASRVEDTAAAVRELTGGGAHLSLDALGSPVTCVASVNGLRRRGRHVQVGLLPSSTGSTPVPMARVIGLELEVLGSHGMAAHAYPPMLELVRAGVLRPDLLVTSAIPLDTAPIALAAMGTAPGAGVTVIEPWR

SEQ ID NO: 12870 - protein, 92 aa, Streptomyces avermitilis
VIASAASGSPDGRPGRRRGARGEVPLMTDRRLWSYKEIAAHIRVQPDTVRSYRKHGLLPPPDHVEGGKPYWYADTVRAWVASRPGNRGRRDL

SEQ ID NO: 12871 - protein, 302 aa, Streptomyces avermitilis
LSPQSSLSRIRVGSAPDSWGVWFPDDPRQVPWQRFLDEVARSGYEWIELGPYGYLPTDPAVLTEETARRGLKVSAGTVFTGLHRGPDVWESTWAHVSDIAALTQAMGASHLVVIPSFWRDDKTGEVLEPSTLTAEQWRHLTTGTERLGREVRERYGLEIVVHPHADTHIDSEENVTRFLDGTDSSAVSLCLDTGHYAYCGGDSVKLIETYGERIGYLHLKQVDPEILADVRAGEVPFGPAVARGVMCEPPSGVPALEPVLAAAQKLDVDLFAIVEQDMYPCEPDKPLPIAQRTRAFLRSCGA

SEQ ID NO: 12872 - protein, 316 aa, Streptomyces avermitilis
MAYDLITMGRIGVDLYPLQTGVPLPQVTSFGKFLGGSATNVAVAAARLGRSTAVVTRTGDDPFGTYIHEALRGFGVDDRWVTQVAGLPTPVTFCEIFPPDDFPLYFYRQPKAPDLEIDAHELDLDEIRAARIFWMTGTGLSEEPSRTATLAALAHRAKSGTTVFDLDWRPMFWADPAQARPFYTEALRHTTVAVGNVDEVEIATGERDPHSAARALLAAGVELAVVKQGPKGVLAVHRDGTTAEVPPLPVKVLNGLGAGDAFGGSLCHGLLDGWDLERLMRYANAAGAIVASRLECSSAMPTPAEVEDALTAGAVL

SEQ ID NO: 12873 - protein, 344 aa, Streptomyces avermitilis
VRAGQVGGGRHGDEQGAGDGGAPARGSDGPARARSGDGPTHARVGDGTPHARVDVAHLVRTRTHHPEAIAEAAARRPRRALLGNDTGRLMIVAADHPARGALAVGDRTLAMANRADLLERLCLALSRPGVDGVLATADILDDLLLLGALDRKVVIGSMNRGGLAGASFELDDRFTGHRPQDIERLGFDAGKLLLRIDYDDPGSLNTLESTARAIDDMAARRLPVFVEPFLSRRGADGKLRNDLSAEAVIKSIAIAAGLGGSSAYTWLKVPVTENPDDMARVMETSTLPAVLLGGDVGEDQEGAYEKWRGALQLPTVQGLVVGRSLLYPADGDVAAAVDTAVGLL

SEQ ID NO: 12874 - protein, 273 aa, Streptomyces avermitilis
MTTNLYVPQGATSGPQYVLDIDPERAGWTYSSLRIVELAPGGTHTFTTGDSEWIVLPLGGACTVEIEGKEFQLLGRESVFAGVTDFAYVPRDARAQIASGAGGRFALAGAKCERRLPARYGPAPEVPVEDRGSGNCARQVRNFASADAFDCDKLIAVEVITPGGNWSSYPPHKHDENRPGAETELEEIYYFEIDGPNGFGYQRVFPSRVGGSDVLAEVRTGDAVLVPDGWHGPSVAQPGHAMYYLNVMAGPGQERQWRICFHPDHVESTGGYR

SEQ ID NO: 12875 - protein, 627 aa, Streptomyces avermitilis
MTSTTRLTVAQALVRFLAAQYTERDGIRQRLIGATWGIFGHGNVAGIGQALVEYADDMPYHQGRNEQAMVHAAVGYARQSNRLSTHAVTTSIGPGATNLVTGAALATVNHLPVLLLPGDTFATRPADPVLQQLEVPYAGDVSVNDCLRPVSRYFDRVTRPEALIPAALQAMRVLTDPVETGAVTLALPQDVQAEAYDWPEEFFAERTWTVRRPGADPTELAEAVRAIRVARRPLLVAGGGVHHSRAEEALAEFAEATRIPVASTQAGKGSLRWDHPQDVGGVGHTGTATADELARTADLVIGVGTRYTDFTTASHTLFTGDGVRFLNLNIAPFDGHKLSGLPLIADARSGLQELTEALLMHEHRVPPAYVSEYTEDKERWEYRVDAAFEAEDPDIRPTQPQVLGALDELVDESDIVLNAAGSLPGDLHKLWRTRSRDQYHLEYGYSCMGYEIPAAIGVRLAAPDRPVWALVGDGTYLMMPTEIVTAVQEGIAIKVLLIQNHGYASIGGLSESVGGERFGTAYRYRSEDGQYTGAPLPVDLAANAASLGMRVLRAKTVRDLRAALAEARAADTPTCVYVETKTADTVSGAPPAQAWWDVPVAETATRSSAVKARELYERHVSTRRRHL

SEQ ID NO: 12876 - protein, 500 aa, Streptomyces avermitilis
MTKIVNHWIGGKTVEGASGTYGPVTDPATGAVTTKVAFATVDEVDAAVAAAKDAYATWGQSSLAKRSTILFKFRALLDANRDAIAELITAEHGKVHSDALGEVARGLEIVDLACGITVQLKGELSTEVASRVDVSSIRQPLGVVAGITPFNFPAMVPMWMFPLAIACGNTFVLKPSEKDPSAALKLAELLAEAGLPDGVFNVVHGDKVAVDRLLEHPDVKAVSFVGSTPIARYIHTTASAKGKRVQALGGAKNHMLVLPDADLDAAADAAVSAAYGSAGERCMAISAVVAVGAIGDELVEKIRERAEKIKIGPGNDPASEMGPLITKAHRDKVASYVAGAAAQGSEVVLDGTGHTVDGFEDGHWIGLSLLDKVPTSADAYRDEIFGPVLCVLRVDSYEEGLALINDSPFGNGTAIFTRDGGAARRFQLEVEAGMVGVNVPIPVPVGYHSFGGWKDSLFGDHHIYGNDGTHFYTRGKVVTTRWPDPSEAPAGVDLGFPRNH

SEQ ID NO: 12877 - protein, 469 aa, Streptomyces avermitilis
MTDTLRPAETPVLDAGPLTSDGPQKLKRSIGIVGGTLLTLSCVTPASTLFVVVPDLFGSLGTATALTIAIGSLLCIAVAFCYSELGTLIPSAGGEYAMVSTMAGRLAGWLVFVLSLLVVMIVPPVIAMGTADYLAPIVHLDPAVAGAGVMLLATLAGLLDLRANAWITGVFLVLEVIAAAVVAVLGFAHSERGAGSLVSMQVAGSGGHTDTVTGMLVVSGLAIALFVTQGFSTAVYLSEELENPRRNVARTVLATLAISTVIILVPVVAITMGASDLSTLTGGDISSMVTAWSNSAVGTFVSLCVALAIINAGIVMVIQNSRVLFASARDKAWPEPVNHGLAKLGRFGSPWVATLAVGVPGALLCFVNLDTLYGVTGVSVTGMYLLVAVAALLARRGSHAHTPAWRMPLWPAMPVLLIVVLAYILSQQETGYLLWTGGITAVATLYWAFYLRPRRDTRWLVSIPEDTQE

SEQ ID NO: 12878 - protein, 864 aa, Streptomyces avermitilis
VAAVAAVVVLAGAGTWTAVASDEAPPVHRTDRAMAMGDGVKINTSYFTAGSGRRPAVLLAHGFGGSKADVRDQAQKLARDGYAVLTWSARGFGGSTGKIGLNDPKAEVADVSKLIDWLARRPEVQLDKSGDPRVGAAGDSYGGAVSLLAAGYDDRVDAIAPAITYWNMADALFPNGVFKKLWAGLFINSGGGCDKFEAQLCAMYNRVAESGKPDAQARALLDVRSPSAVGKRIKVPTLLVQGQSDSLFSLGQADAAARAIRANGAPVDVDWIAGGHDGGNMETNRVQARVGAWFDRYLKDEKGVDTGPAFRVTRTGGVNSTDGTAQLRGASGETYPGLRSGRRTIALSGREQNFANPAGANPPALSALPGLGGSGGLSQLSSLGIGASLDFPGQFARFDSAPVTRDLRISGSPTATVHVKSTSEDTVLFGKVYDVGPGGTQKVLPSQLVTPIRVEGAKEGKDVTLSLPAIDHEVRSGHRLRLVLASTDLGYASPTAPATYTVSLKGDLLVPTAPGVTTAAAPLPAWVWWLPLAGVVVALALLLSGRRRTATPAPDPALAEVPLEITDLSKRYAKSADRYAVRDLSFRVEKGQVLGLLGPNGAGKTTTLRMLMGLIKPDAGEIHVFGHAIRPGAPVLSRVGSFVEGAGFLPHLSGRENLELYWQATGRPSEDAHLDEALQIAGLGDALARAVRTYSQGMRQRLAIAQAMLGLPDLLILDEPTNGLDPPQIREMREVMIRYAAAGRTVIVSSHLLAEVEQSCTHLVVMDRGRLVQAGPVHEIVGSGDTLLVGTGTPVDEPVVEKVGALPGVASAVRTDEGLLVRLDTDGSAGRLVVELVRLEVPVESVGPHRRLEDAFLTLIGGAA

SEQ ID NO: 12879 - protein, 287 aa, Streptomyces avermitilis
MSTLVERTETADGYRARRTLPLRVEFVRQLKRRRTLVMGAILAVLPFVLVAAFAIGGEPGARNGRVTLMDTATASGGNFAAVNLFVSAGFLLVIPVALFCGDTIASEASWSSLRYLLAAPVPRARLLWSKLVVALGMSLAAMVLLPVVALAVGTAAYGWGPLEIPTGGTLPAGTAAQRLLVVVAYIFASQLVTAGLAFWLSTKTDAPLGAVGGAVGLTIVGNVLDAVTALGDWRDFLPAHWQFAWADAVQPQLEWSGMIQGTAISLTYALVLFALAFRGFARKDVVS

SEQ ID NO: 12880 - protein, 86 aa, Streptomyces avermitilis
VMSKLKKVAAVAVMVGGMALGGGVANAAGGHGYDDPADVIIGNLQPVNCHQDFEGGLAFAPVQLASTEGNSQNIGNFCTVVGPVED

SEQ ID NO: 12881 - protein, 86 aa, Streptomyces avermitilis
MSKFKKVAAVAVMVGGMALGGGVANAAGGHGYDDPADIIIPNLQTVNCNQEFEGGLAFAPIQGAALAGSNSQNIGNFCTVIGPRND

SEQ ID NO: 12882 - protein, 112 aa, Streptomyces avermitilis
VLHVIVCNCPSTVRKGSGRAKENGEVMSKLKKVAAVAVMVGGMALGGGVAHAGDGPLYDDPSGVIIGNLQPVNCDQEFAGGALFAPVQGAAALGDNHQNIGNFCTVVGPVED

SEQ ID NO: 12883 - protein, 93 aa, Streptomyces avermitilis
VREEIGEVMSKFKKVAAVAVMVGGMALGGGVAHACDGPLYDDPAGVSIDNLQTVNCHQEFEGGLAFAPVQLASTDGNSQNIGNFCTVVGPVED

SEQ ID NO: 12884 - protein, 573 aa, Streptomyces avermitilis
VRPVEPRCGVQLASRTRAVAAPIRSRCATACSFGPGPAFPTYSSRKTTRLRKNLSKGMVVAAAATSILSLYAIPAFADPHSEGTTGGSHGALSGDAVQAPDVPGASHGSDRSDDDREHGGYGHDSDYGDDADYGDAASSVPTAEASSTASHDTYGSGHSEHGDYSHDSGYSDDADYGDAASSVPTAEASSTASHDTYGSGHSEHGDYSHDSGYSDDADYGDAASSVPTAEASSTASHDTYGSGHSEHGDHSHDSGYSDDADYGDDAVRSDASSTGGAPKAKAPSTAAHVSGRGDDVRDHGVARQDSGYGDDAVRSDASGTGGVAKSGGSSAPKSGGASAAPRDSGRKHGGVGAVHGDASSTGGAPKVKTPSAAAHVSGRSDDDRDHGVARQDSGYGDDAVHGHDAVHGHDNGNGGVPKTQAPSASSHESGRKDDDREQGDAGHDSGYGDDGVHGDDSGNGGGDVGYGDDSGNGGDAGYGDDGGYGDDAGYGDDDDSDKPPTKPTKPAKPTTPPTTPPTKPHTWTPPATTPVAERPSLPDTGSGEQMLAASGVAALLLTGGAILYRRGRAASRR

SEQ ID NO: 12885 - protein, 406 aa, Streptomyces avermitilis
VGAREEAAAKSPVPVPVPTTAATAAATAVPTASASASLPAPALATAPATAPATAEPPAPPPAFGAYLDYGPRGVTRMAKLSRWLDGAELRVGHTYLPGDRWSNIEGAPRFLDTWANWRRERDDRILVLNVPMLERNEESHSYTEVRTLLRQGAAGEFDEHYRQLAQRLVDLKVPDTVLVLGWEMNGTTYTHRCGPDPEAWKTYWNRIVTTMRAVPGQKFRFDFAPSRGHDAVPWTDCYPGDDTVDIIGMDTYDQPQGMSFDEQVSEPYGLQKHVDFAKEHGKPISYPEWGLFRNGDNAAYMRRMLTWMDEHKPLYNTLTDYCPHGVWRCRQNPKAAEEYRSALSGRTEPEPTSPVPTPAPTPGSTSQPTPLPLPLQACSPLDLGTWAEYLLGGKLCVRFDWWSRIR

SEQ ID NO: 12886 - protein, 374 aa, Streptomyces avermitilis
VSGAPRAEGGTLRAELCTDEREFAALGPAWGRLYRRCGAATPFQSHAWLHSWWTSYGRPGRLRLVLVRDGGELRAVAPLMRVGRPLPRLVPLGGTISDYGDVLLDDEHADQAAAALAEALSRAARTTLIDFREVRPGGAVERVYECWRGPRRRAGDSLCLELPALPMAELAARLPAAKAQRARAKLRKLTALGVERRTTDPDRVDAALRLLLALHRLQWQGRRVTPEHLHERFAAHLVRAVGPMVRSGDAVVTEFLLEGEVMAVDLTLLSPRLAGGYLYGAHPRLRERKADVAAMLLDACARHTATGGHDTLSLLRGDEPYKYNWRPEPVVNQRLLLARRRTAPLLSAIVCGVAARSRGKELVRGWWERGGGGT

SEQ ID NO: 12887 - protein, 224 aa, Streptomyces avermitilis
MNLMTSMADSATPPARRHPAHRRLRALPPWSLLAAGTLAGALAGGAYGVLTPPAYSATAYVIAVPTATSDPQAALGLAQAYGRVATQLAVLGDAQVWAGVPVKTLRENVQSATSPDAPMVAVTATSARADLATDMANAVSRSLIRHANDTKNATHVELLQFSRAVKPAKPSSASPALTGLVGASAGGLLGGLALLVRPRRAADDDARPAAVPGPATAADAHGQL

SEQ ID NO: 12888 - protein, 391 aa, Streptomyces avermitilis
MPEFKALHIITGLGVGGAEQQLRLLLRHLPVDCDVVTLTNPGTVADGLTADGVRVVHLGMTGNRDLSALPRLVRLIRSGGYDLVHTHLYRACVYGRTAARLAGVRAVVATEHSLGETQLEGRALSAGVRALYLASERLGRTTVAVSGPVADRLRRWGVPEPRIEVVPNGIDVARFRFDPVTRERTRRRLGLPEGAYVVGGIGRLTAGKRFDVLIGALAHLPGDCWLLLVGGGPEENVLRRAAQRAGVTDRVLFTGERPYEPDGTPVSDLPALTSAMDVLASPSPEEAFGLALVEGLAAGLPVLYASCPAIEDLPPRSAEARRVRGGADAFAHALAQTRALAEARSSCPPSRTVSVAARHYCITRSAAQLMDVYAAAVSCSSPSPSPLGVTV

SEQ ID NO: 12889 - protein, 232 aa, Streptomyces avermitilis
MYHSVGDCSYDPYRVTVSPRRLDRQLGWLRRRGLRGVGVRELLAARARGAGQDLVGLTFDDGYADFVAHALPLLRRHGCGATLFVLPGRLDGDNAWDPLGPRKPLLSAAGIRQAAAEGVEIGSHGLTHVDLIRADDALLRAEVSDSRALLSEMTGALVDGFCYPYGRVDRRAVDAVREAGYTYACATGPGDLTGPLALPRVHVGEHDTAWRLHLKHRLHQLRRLHHRPAERV

SEQ ID NO: 12890 - protein, 586 aa, Streptomyces avermitilis
MTVTPPQAGDATIPPARLGADRPDPGSARAVSQGFLARAALVTVGLSLAGALLGLGRDQVLARLFGAGSETDAFLVAWTVPEFAATLLIEDGLAFALVPAFSAAVARRRTHGDTGDPVRALVRSTLPRLSLAFAVASALFVFGAPYLVEALAPGLHNPGFAVDCTRLTGTCVLTFGLAGYCSAALRGHRRFVAPAAIYVAYNTAIITAMFALGARWGVRAAAVGVAVGGALMVVTQLPSLLRQLHRRQTAPATDRADPTDKTDAADTAVTADPADPADTTVTADPADTADAAAPAKDRRTMNLTLIVTVLLFALCRQSQVLVERFLASTLPAGAISHLNYAQKVAQMPMVLSLMLCTVTFPVVAQALAEGDTERARDRVECDLRVVSCVVLLGTAAIVACAPQLVHLLFQRGAFTARDTAATAAVMRVYALGLLGQALVGALVRSYFSAGRPTWYPMAAMTAGIVATSWLGAWAVGSFGVLGIAAANAAGITLTALILLYGMGARSVPIRTRRVLAEMSKPLRAAVVACVVGGFCASRIDSPALGLAAGGTAVTVVFLLLARVLGVQDLAPALRTVTRRLPYARIR

SEQ ID NO: 12891 - protein, 451 aa, Streptomyces avermitilis
VSHACAPPAARGLTPVLPVVAVVALLALPVAPGGEGGATLADAASGVVVLCCAVRLLRHRRRPLSRTAAVVLGLPVVGFAVAATGAATPGAAVAGFGRYLQIFVLVPAAVLLLVRDRRDLRLLVWSMVGLAVWQGALGVHQYATGTGASYTGRDIRAVGTFGPGDIMGMATVVSFGLVCAVGLALGPASARQRVWAGVCALLLVMPLAVSFSRGAWIATALACGAQLVLAGLRRAVRAGAVVAAVAVILVGGFGVGSTLLEQRLSSIGQVADAPDQSVTDRYTMWAAATDMWRERPLTGIGLKGFPDHRDGHASLALSSGSDTEGANAAYRRQPLLSPHNMYLLVLSEQGLIGLLTLAGSWLALLVLGLRRLVRARGANDPGLDCALIACGLLVWQLIDFVYADIGGPSTVLSAVCFGLTAWWALASPGPAVAEAAPAYPGTAVAEEAAAR

SEQ ID NO: 12892 - protein, 491 aa, Streptomyces avermitilis
VTAERTLPPPGGQPPVHGFPPVSVIPPRDATAGFRFPAGQRTAARRPHGLPLLAADAAAALTAALALPHPLLTVPPLLLAVLCLNARAALYRPTAVPAVLDELPAVCARIAVGWCALAALVAALSPAHILSAGTLLTGCVLQAAASCAGRGTLHWRRRRTLVRHPAAALVVGPAATARRVAAAFLRRPGCGLRPVGILADDAAGGEGLPELSTGEEAQRAVIQNGVRAVLIVGPVGEHGPLLRALAESGCALWEVDADVPAYDRAGRAAYEGAGRTTRDRAPGERIAGFRCRRLDVRRHLGSPAKRAFDVLVSGVLLLLVGPALLACAVVLRVSDGPKVVFRQERVGKDGRPFTLLKFRTHRPADAHEAATRWSVADERNMSRFCRFLRRTSLDELLQLWNVLRGDMSLVGPRPERPYFVAKFSQLHPGYAARHRMRTGVTGLAQIHGLRGDTSIEDRARFDNAYIDDWSLWQDICVLLRTAAALVRATGS

SEQ ID NO: 12893 - protein, 413 aa, Streptomyces avermitilis
MYQPATAPSPRVLHVTQPVDGGVARVVTELVRAQRAAGFDVTVACPGHGLAQAVRELGAGVRHWSATRAPGPSLPGEVRRLARLVEEVRPDVLHAHSAKAGLAARLAVRGRIPTVFQPHAWSFEAVGGVTAAVATAWERWGARWAARVVCVSEAERARGVRAGVRAHWRVIPNGIDPGRFHPAAVTTVRAALAPLAGLDPAAPLVVCVGRLCRQKGQDVLLEAWSSVRRRVPGARLALVGDGPQERPLRHLAPEGVLFAGAVADAVPWYQAADLVVLPSRWEGMALAPLEAMACRRPVVVTDVAGARESLPPGHREHCLVPAGRPGPLADALTRALLDPLLRESLGHQGRRHVLTAHDVRHSAEAVAALYRELLGTGRTSADPAEHAECADPAEHTQCADLAEHTECRESIRS

SEQ ID NO: 12894 - protein, 87 aa, Streptomyces avermitilis
MKSLKAAAVVAGSMVLAGAVAPAAAHAATEVPPASLTGAVNQLTKGPVNLSPLHADNKGSALGTVKGAADSLTQQGNARLIGGLPLG

SEQ ID NO: 12895 - protein, 128 aa, Streptomyces avermitilis
VTLAPVLAASGSAGPEEARFDETYRGRRIVGDRYDAQRSGDAYSGAWHVTVDGRPLHLMRRADGSWMTMVDHYRSYPTVLAAARAAVDELGPTARLGVPHGGGGHMDDSGTPGGRKGAERDHGSGVHA

SEQ ID NO: 12896 - protein, 287 aa, Streptomyces avermitilis
VYTRKDVSTLTRSERRRLVAALLEVKRRGEYDEFVRMHIKYYVADGETGLRAAHMAPSFLPWHRMFLLDLERVLRRVDESVTMPYWDWTRSRSRTAAPWTEDLLGGTGRQSDRQVTTGPFAYRHGGWPIKEGITDAEYLMRDLGRSRDPIALPTARDLQGALDDPVYDTAPWNSTSAKGFRNRLEGWGPGRGAASWRNHNRVHRWVGGHMVSGASVNDPVFWMHHAFVDLLWSRWQQRHQGARYLPEQQPARGDAQRGRIVARHERMPPWDVTPDQLEDHSGIYRYA

SEQ ID NO: 12897 - protein, 548 aa, Streptomyces avermitilis
MLQKASKIGHSSHVVTLDVRPQLLDALSALRDRVAAASFPLPLAGAPRARANRDELLAQLDDYLVPRLRDPEAPLLAVIGGSTGAGKSTLVNSLVGRRVSEAGVLRPTTRTPVLVCHPEDHHWFSGMRVLPDLTRVWVPHQEPGDDLHALVERGERTLRIETAETLPPGLALLDAPDVDSLVADNRVLAAELICAADIWIMVTTAARYADAVPWYLLRTAKENKATLVTVLDRVPHQVVSEVSRQYGALLAKAGLGDVPRFTVPELPESAWGGGLLPATAVATLRTWLIQQVQDPAARQQAMARTAYGVLDSLKSRMPELAGAAAAQYAAALRLTAAVDGAYDSEYARVKGRLQAGAVLAGDALKRWRAYPLDCTAGELLDALVESLGSLLLCAVTAADERVDEAWRREPASGAPELTDRDPTLESAEHRIGMAARRWRRVLEEYAEEEVRNLDKSLAPDAEVVAALVATALLGGRRARAAGEGLAERIGAHGALRLRDRGGRLLSEYVDTTLHIERERRLAPLDALDVHAEPQAELIAALSVLQKER

SEQ ID NO: 12898 - protein, 622 aa, Streptomyces avermitilis
VKRGFPPPSAADADASGRTESTEPADSTESGEPWGDGLIARRVSETADGQQEVAALLETRSKAVQPPEPLAYDGSLRSRLDALRELVGLSRTRLDSRTLAEAGRVLDEAVARRRLSGEHTVVAIAGATGSGKSQLFNVLAGVTISETGVRRPTTAAPIACSWSDGAAPLIDRLGIPGRLRRRPLQSPEGEAQLRGLVLVDLPDHDSAAVQHREQVDRILALVDAVIWVVDPEKYADAVLHERYLRPMAGHAEVTFVVLNQVDRLPGEAAHQVLDDLRRLLDEDGIALGEYGEPGATVLALSALTGDGVGELRESLGQFLAERGAAARRISADVEAAGARLRPVYATGRRTGLSEEARDDFAGRLADAVGATAAGEAAERAWLRNANRACGTPWLRLWRWYQDRSEPTTGRLRVGAPADEEATARQRVEQAVRTVADRAAVGLPAPWAQAVREAAVRGSQGLPEALDELVVRTGSPAGRPPRPGWWPVAVLAQASMTLLQVFGGLWLLGQVIGFMSPNLGVPVLLMVAGIVGGPVVEWSCRLAARGPARRYGLEAERRLREAAGGCGRARVLDPVAAELLRYREVREQYAKVMGAGAGAGAGAAGVGAGAGAGTGAGVQARVG

SEQ ID NO: 12899 - protein, 158 aa, Streptomyces avermitilis
MNETIVCVVGNVATRPVYRELASGASARFRLAVTSRYWDREKSEWKDGHTNFFTVWANRALATNVGASLSVGDPVVVQGRLKVRTEAREGQNWTSADIDALAVGHDLSRGTSAFRRPSAKDGEAGVSPAARPEPNWETEPGSQPSVEHQPQPEPAGVT

SEQ ID NO: 12900 - protein, 471 aa, Streptomyces avermitilis
VSFAFSAFSALSVRGRGAARLAAATLVSGLVAAGALVTAGPAVADSTPQSGGGATATMGGLKTYGDAVIHDNGGDEQVSAGLFEMAVDGGGMLQTYCIDIHNPTQKDARYQETPWSGTSLSGNENAGRIRWILQNSYPQVNNLTALARQAGASGLTEQDAAAGTQVAIWRYSDGADVDAVDPQAEKLADYLEKAARNLAEPAASLTLDPPAVSGHAGERLGPVTVHTNADSVTVTPPVDATANGVKIVGKDGKAITSAADGRPIYFDVPKDAADGSVALTVQASTTVPVGRAFASESRSQTQILAGSSESTVSATATANWAVKGAIPALSAVRNCAKGGVDITAADEGDEAFTFELMGSEYTIEAGKSQTVTIPLQEDQAYDFTIKGPGGFEERFKGILDCKTESGAGGDATQTLSEPSPATVGGTSTDTNLAETGSSSATPFIAGTAIALVVIGGAALVLVRNKKTSTQD

SEQ ID NO: 12901 - protein, 547 aa, Streptomyces avermitilis
MRKTRKAHGDKVILDDVTLNFLPGAKIGVVGPNGAGKSTVLKIMAGLEQPSNGDAFLSPGYTVGMLLQEPPLDESKTVLENVQDGAAEIMGKLKRFNEVAELMATDYSDALLEEMGKLQEDLDHANAWDLDAQLEQAMDALGCPPGDWPVTNLSGGERRRVALCKLLIEAPDLLLLDEPTNHLDAESVQWLEQHLAKYDGTVVAVTHDRYFLDNVAGWILELDRGRAIGYEGNYSVYLEKKQSRLKVEGQKDAKRAKRLKEELEWVRSNAKGRQAKSKARLTRYEEMAAEADKMRKLDFEEIQIPPGPRLGSIVVEVNNLSKAFGEKVLIDDLSFTLPRNGIVGVIGPNGAGKTTLFKMIQGLETPDTGTIKVGETVKISYVDQSRENIDPKKSLWAVVSDELDYINVGQVEMPSRAYVSAFGFKGPDQQKPAGVLSGGERNRLNLALTLKQGGNLLLLDEPTNDLDVETLSSLENALLEFPGAAVVVSHDRWFLDRVATHILAYEGDSKWFWFEGNFESYEKNKVERLGPDAARPHRATYKKLTRG

SEQ ID NO: 12902 - protein, 136 aa, Streptomyces avermitilis
LRHIYRCPLRWADMDAYGHVNNAVFLRYLEEARIDFLSPPGKQFKQGSVVARHEIDYKRQLVHRREPVDIELWITEIRAASFTITYEVKDADQLYVRAATVVVPFDFEAQRPRRITAEEREFLEEYRDDVTETVAA

SEQ ID NO: 12903 - protein, 231 aa, Streptomyces avermitilis
MTVLYLADEGEAADLAAFLARLIHYDRGAAVRLQASGTALAVFGRPPSFDVLAIRTARLGKPYEDGLDVSLDVTVSAGELLESIDESAATAVVPAAVTGPPWAGLLPPRGGWQPEPGLPAPDALRATVAAAVSEFRSRTQQLPPEGRTRAELDRIGREIWSRTLGDTRLPVRAAHAAQSLGFLRPAPGGTSTPDEAPLGLFSSGAWLRLRTPYGSIAVRRAGLGALDVSVR

SEQ ID NO: 12904 - protein, 134 aa, Streptomyces avermitilis
VNEIRRGTLQEQTFYEQVGGEETFRRLVHRFYEGVAGDPLLKPMYPEEDLGPAEERFTLFLIQYWGGPTTYSEQRGHPRLRMRHAPFAVDRAAHDAWLKHMRVAVDELGLSEEHEHTLWNYLTYAAASMVNTES

SEQ ID NO: 12905 - protein, 326 aa, Streptomyces avermitilis
MSAHALDHDLEALAASARAVLLREIDASGAWDADPRWREAFETVPRHLFVPYYYAGAVGGYERLWRDSPDPRARERWVRGAYADAPLATRVRDGELVSSSSQPSLMAKMLVELDVRDGDAVLEIGAGTGYNAALLAHRLGDEQVTTVDLDAEITESARQHLAAAGHHPAVVTGDGARGVPARAPFDRIIATCTLTSIPRPWLAQCVPGARILAPFATGLIALRVRDAGYATGHFLHTPAYFVPLRGVVRPEQEPPNLGGLPRRARGHELFRFLLTLTAGRLDPQEAYTLWEREGQPGRERYGVTVGDGRSWAWLDDPEGPYTWPLP

SEQ ID NO: 12906 - protein, 481 aa, Streptomyces avermitilis
MPTCPNGHQSGSDDWCEICGHRMAGAVPPPPPPPPPASGYGYPPPGSPPPPPGAGGQPGGQPGGRPHLSSGPEPELCPQCRTPREGGAPFCEECRWNFLTNTATSYTPAAPRPSTPNPAPRFQQGGPGQPTGPGGDPYEYQSSRPSQMNRPAEPIPPGPPYGGDPSGPSGRPGFGGDPSRQPGFGGDPSRPPGYGGDSSRPSAFGGDSSRPSAFGGDPSRPVPPPPGPGGPGAPGGPGAPGGPGAPGGPESTGGPGAPPSFQQAGPPPVFQRPGPPAPPAFPQETGQPPVPRQPGGPSFGGGDDDWVISPPSSSSPGGPGGAQGGGYGYPQPGSTQAPPGPGYQQQPLTWSATIGPDRDYFMAMMQRSGPEAAGLNLPAYSPEQQRTLTGNQISIGRRRHSTGDTPDIDLSVPPEDPGVSHQHAVLVQQPDGSWAVVDQNSTNGTTVNGAEEPIQPFVPIPLQDGDRVHVGAWTTITIRRG

SEQ ID NO: 12907 - protein, 458 aa, Streptomyces avermitilis
MGFLRGIREGMANFSKSNAPQFSVDVYQNEYLPEGGREVNAIVTVTATGGGTTKSAVAAPRPYASGAAPDAAVAVMVDCSGSMDYPPTKMRNARDATAAAIDTLRDGVHFAVIGGTHVAKEVYPGGGRLAVADARTRDQAKQALRKLSAGGGTAIGTWLRLADRLLSSADVSIRHGILLTDGRNEHESPQDLRAALDACAGRFTCDARGVGTDWEVKEVTGIASALLGTADIVADPAALSEDFTRMMETAMGKEVADVALRLWTPVGTAIKFVKQVAPTVEELTDRRTEAGPRAGDYPTGSWGDESRDYHVCVEVPAAGLGQEMLAGRISLVVPQSDGSTQNLGAQGLVRAVWTDDMEASTSINPQVAHYTGQAELAQVIQQGLDARKSGDVDGATAKLGRAVQLASASGNTDTAKLLAKVVDVVDAAAGTVRLKAKVEEADEMTLETRSTKTVRVKK

SEQ ID NO: 12908 - protein, 447 aa, Streptomyces avermitilis
LMSQMPQPTALSRCPSCAEPLESGDRFCGACGYDLSAVPVPPQDTPTLTMNGATPRPPSQVASVDWPIAPEVDGSHAPAAVHLPTDLPGTDSGGSELPAGKPAMSGSTGVRFDRPAEPDDYPLAAPRPAADPRTADLPTPPAGTKLCVACRAGHVDSDGYCENCGHAQPRERDHMEQELDAVAAVSDRGLRHHRNEDAFAVSSTALPDGSPAVVAVVCDGVSSATRPDEASLAASRAAGESLLAALPRGTHPQQAMHEAIIAASHAVNSLATEPETAQEHSPHQNAPACTLVGAVVTTSLLVVGWVGDSRVYWIPVDRALPPVRLTEDDSWAAQMVAAGLMSEAEAYADERAHAITGWLGADAYELEPHTASFKPDRPGVVVVCTDGLWNYAEAAEEMAEIVPLDAALRPLHSAQVLVGHALDGGGHDNVTVAVLPFPAPPQGAGSA

SEQ ID NO: 12909 - protein, 834 aa, Streptomyces avermitilis
VSEAQQKCQRPGCTGSYEDVGGGELYCDMCGLAPVVAAGGMVGSPATGITGGGRGSRGSGSSSRASSRASSRSSQSRRSVSGRLSRALSGKTSGRSVSVRSSGSTAGTSGRSRLGMGLVQVPDVPRPDPRAMVLENPEVPERKRFCSRSDCGAPVGRARGEHPGRTEGFCTKCGHPYSFVPKLHTGDVVHGQYEVVGCLAHGGLGWVYLAVDRAVSDRWVVLKGLLDTGDQDAMAAAISERRFLAEIEHANIVRIYNFVEHLDQRTGSLDGYIVMEYVGGKSLKEIANDRRTPTGKRDPLPVEQACAYGIEALEALGHLHSRNLLYCDFKVDNAIQTENQLKLIDMGAVRRMDDEESAIYGTVGYQAPEVADVGPSVASDLYTVARTLAVLTFDFQGYTNVFVDSLPDPDHIEVFRQYESFYRLLVRATDPDPVRRFASAQEMTEQLTGVLREVVSLQTGRARPALSTLFGPETKVTDTVLFAELEGDVSRLGARVVPVGKRGRAASTASGVVPGRGTRTLVKPLDTAAAALALPVPRVDPGDPNAGFLAGLMTSGPLELVAALGNAPSPSVETRLRQIRARLENGDSHTALEVLAKLEDERPDDWRVVWYRGVAALVTGDHEVGALSFDAIYDAFPGEPAPKLALGLCAEVLGQLDNAAEYYRLVWTTDPSYVGSAFGLARVQLAAGDRRGAVRTLESVPESSIHYTAARVAAVRARLRHRTNEAPEASFLDDLGAAAGQVEALNGYGLDAVRREQLSTEVLGCALDWVLSGSQGSAPPPDGGRALLGNELDERGLRFGLERSYRTLARLAQGGEERIDLVERANRYRPRTWV

SEQ ID NO: 12910 - protein, 441 aa, Streptomyces avermitilis
MGVTGPPEPVLDRDEVDRALARLGAEHEAIETSLLALQDHAGRRLLEGAELTGTTKERWTAAEASITLLWAYFDAYSDALRSARDIRSRRRWSSREDLVELTGILRGATVTVAGSTTATANAPTLAGTGKLSEQFTLAALVDRMNELYASSLDMVVAADAVWSALPARIDLLAAELQRTRRLAHSVGVRPGEHPAGDDLERITRTLTRLREEVISDPLTYWVPAPGSSAPGGGRPDTTTYDREARALEDVRREIDAVLTVRQDAEARLVRLRDVLSRADRTLAEARSARGEVLAKIAASEVPAVSGPPTALQEQLQTAAEYRRHAQWHRLSPLLESLEQRAEDELLRARESLTAVTAPLAVRAELRGRLDAYKAKVARLGFAEDPLLIERYDAARRMLWSAPCDLRVAEEAVLRYQRAAADLLSPRVPDQGGPTDRRGPVA

SEQ ID NO: 12911 - protein, 335 aa, Streptomyces avermitilis
MTARRLRASLKGWGGVGAMAVACLLTAVFVLLPLTRASGEGGAGVGGQGVAEGTQVRDETCDHPERKSPPASNDESGAAIKAIKKRGYLSVGVDQNSYRWGYRDPNSTKKGSDLEGFDIDLAHRIADEILGKPNADVRFHAIPTNQRIEAIRSGQVDMVVRTMTITCKRLADVAFSDPYFRTGQQVLAPKKSGITGYDKSLAHKRICTAASSTAFDTLTADRKAGRLVVSARMSEPVPNQLDCLVRLQLGQVDAVVTDGALAASQAAQDPTVELKGAAFTDEYYGVAMKLDAKDLVRRVNQVLVDYRRSGWQASYDTWLSPTLGKNSGPSKPPAS

SEQ ID NO: 12912 - protein, 487 aa, Streptomyces avermitilis
VTHPQKGSAPPAQAAPTTPALPRSGVPGAREAPGARASQGRPDPAPPRRTAWAEGVDQLRAAATTEPGRLRLIGAVLALLVVAFGAVTAWQMTDRSAAADDVLHSSQPLSAGAADIYRSLADANTTASSGFLAGGEEPAGSRTRFEDDIRTAADKLVVAAANSEPGSPSADTIAKLNKLLPEYKGLIERARANNRQGFPLGGAYLRYANDTMQQKMLPAAQDLYTKENQRLRSDYDSATPYPWAAMGLGVLALAALGWAQRRNYRRTNRVLNQGLVAATAASAVVLLWLVVGHTVARAGLDSSYDHGVRSLNVLHDARIASLNARGNENLTLVSRGAETKTLPDESVEDVFDYNFKQDMKKLSAGLAEAKSLADDQAGGQPVTAATGNMEEWQSRHREARAADDSGNYQAALDKVIGSKADKPTGECFDGVDHNLELALAHEETEFKQAAGDGRDAMTGLSVGAAVLAVLGAAGAVLGIGRRLSEYR

SEQ ID NO: 12913 - protein, 318 aa, Streptomyces avermitilis
VLAIDAGNSKTDVAVVAADGTVVGAARGGGFRPPAVGVETAVDVVADAVGRAFAAAGVTSVTHVSACLANADLPVEEKQLAAALHARAWGTSVEVRNDTFAILRAGVAEPHGVAVVCGAGINCVGMRPDGRTARFPAIGRISGDWGGGWALAEEALWHAARAEDGRGGPTALARTLPAHFGLESMYALIEALHLEHIEHSRRHELTPVLFATARDGDPVARAVVDRLADEVVAMAVVALTRLDLLAEETPVLLGGSVLAARHPQLDDRIRDLLAARAPKAVPRVVTAGPVLGAALLGLDHVHAPEEVHARVRAHYEGA

SEQ ID NO: 12914 - protein, 421 aa, Streptomyces avermitilis
MKLAVVGGGSTYTPELIDGFARLRDTLPVEELVLVDPAADRLELVGGLARRIFARQGHDGRIVTTSDLDAGVEGADAVLLQLRVGGQAAREQDETWPLECGCVGQETTGAGGLAKALRTVPVVLDIAERVRRANPDAWIIDFTNPVGIVTRALLQAGHKAVGLCNVAIGFQRKFAGLLGVAPADVHLDHVGLNHLTWETGVRLGGPEGENVLPKLLAEHGDAVAGDLRLPRSIVDRLGVVPSYYLRYFYAHDEVVRELGTKPSRAAEVARMERRLLEMYGDPALDEKPALLAERGGAYYSEAAVDLAASLLGGGGSPYQVVNAYNKGTLPFLPDDAVIEVQAAVGPHGPTPLPVPPVDPLYAGLMANVTAYEDLALEAALRGGRDRVFRALLAHPLIGQYGYADALTDRLIAHNREHLAWA

SEQ ID NO: 12915 - protein, 297 aa, Streptomyces avermitilis
MTQVLDKPVELTTTVSPAERTARRRALLEWVAVHSLGVAAALFFVLPFVFVFLTSLMSDTQALSRDLIPHTWQWGNYRKVFDTPGFLTWWKNTLLYAGAGTVITVVSSIPVAYALAKFRFRGRNLSLMLVISMMMLPPQVIIIPMYLFWAKQLDLSGTLWPLIIPMAFGDAFSIFLLRQFLMTIPNEYLDAAKVDGCGDLRTLLKVVLPMARPGIAAVALFQFFYAWNDYFGPQIYASENPGAWTLSYGLESFKGAHHTDWNLTMAATVLVMAPVILVFFFAQKAFVEGVTLTGVKG

SEQ ID NO: 12916 - protein, 313 aa, Streptomyces avermitilis
MTTYTLRAKRRRAAFRTAAFMSPWLIGFTVFFAYPLISTVYFSFMHYDGFKPPTWSGTKNWTYVFEHYPLFWPALRNTLWLVLVMVSLRVVFGLGVGLLITKIKTGTGVFRTLFYLPYLAPPVAATMAFAFLLNPGTGPVDSILEKAGIPAPGWFNDPTWSKPALTLLALWGIGDLMVIFMAALLDVPQEQYEAAELDGASALQRFRYVTLPNISPIMMFAVVTGVIQTMQYYTQPLIAGKVASGVIQGAGTQFEPGYPDKSTLTLPQLVYNLGFQRFDYGSACVVALVLFALSMVFTAFLMRRRGGLIQAGD

SEQ ID NO: 12917 - protein, 445 aa, Streptomyces avermitilis
MPAMSRKVAVALAASASIALLATACTGQSDAGANDDASKDTTINFWHAWSAPGEVKAVRSLVAGFEKAHPNIHVDIVANMTDDKINQALRAGGDKAPDVISSFTTNNVGKFCSSGALVDLNPFFKKAGVDPATTFPKAMNEYTQFDGNRCAAPLLGDAYGLYYNKTAFKKAGITSPPKTWSEFEKDAKKLTLTKGDSYKQLGFMPNYHGWESTTEHYFAQFSPTYFDRSGKSNVAEDPAFEAGFTLQKKLVDELGGYKKLETYRATLGDEWGPKHPFHTGQVAMQLDGEWRLGMAEEAKPDFEIGVAPLPVPDDRADQYGKGYITGTITGIAATSKKQNAAWELVKYMTTDTDAVVGFANDIHNVPSTLAALKSPKLTYDPRFKTFLDIAADPNSTTTPASVNGGVYLVTIQEFGYAYESGRAKDLKAGLAGTAKQIDTDIAQAK

SEQ ID NO: 12918 - protein, 403 aa, Streptomyces avermitilis
MAGSAGTPGTPRVLRAMNDRAALDLLLEHGPLSRTRIGKLTGLSKPTASQLLARLEAAGLVLMTGTSEGRPGPNAQLYVVNPGAAHAAGLDVTPERILAAVADVTGRTVGAYELPTPGRRPAQPVVRQVTDALDGAVKAAGLARDDIHRLVIGTPGAFDPNTGRLRYASHLPGWHSPTLLDELAAALPMPVEYENDVNLVAIAEQRLGAARGHADFVLLWNEGGLGAALVLGGRLHRGWTGGAGEVGFLPVPGAPLVRQVTRANSGGYQELAGSQAIPELARELGIEDIPPGPYAEVAATLVERAAGHDDGPYRQLLRTYATGLATGLASLVSVLDPELVVLSGTSLSRGGEPLRALVQAELEDLAASRPRLVVGDVHEHPVLRGALESALAATRDEVFDTSR

SEQ ID NO: 12919 - protein, 366 aa, Streptomyces avermitilis
VSLPAVLLAAGVTPSPSPSQTTDPATATLQDAQHSATNAASWVSQNWSTWLAIGLRVLLILVIAGVLRVVVRRAITKLIDRMSRTAEGVDGTALGGLLVNVERRRQRSQAIGSVLRSVASFLILGTAALMILGTFEINLAPLLASAGVAGVAIGFGARNLVTDFLSGVFMILEDQYGVGDTVDAGVASGEVIEVGLRVTKLRGDNGEIWYVRNGEVKRIGNLSQGWATAGVDVTVRASEDLDRVKATLDDVAERMSKEEPWNELLWGPIEVLGLDSVLLDSMVVHVSAKTMPGKAAAVARELRWRIKRAFDAADIRIVGGLPSQPDGDPVPDPTATVAAPSVYSNTASPQAEAASPLTPPVRPAPK

SEQ ID NO: 12920 - protein, 178 aa, Streptomyces avermitilis
VPHVLVLNASYEPLGVVPLRRALVLVLENKAVCLEESGAFMHSATVTVPAPSVVRLKRFVRVPYRGPVPLTRRALFARDGGRCMYCGGVATSVDHVIPRSRGGQHAWDNVVASCRRCNHVKADRHLFEIGWRLRHKPAPPTGLAWRIIGTGHRDPRWLPYLQPYGADDAMARIDGISA

SEQ ID NO: 12921 - protein, 447 aa, Streptomyces avermitilis
MRTDLRLALLLIRGSDRREWWRVALTAVGAMGATGLALGATAIVSLRGQYNVPLANGLLNQPGERSGVILTLLLLLVPVLGFLGQCARIGALHRDRRLAGLRLAGATPGQVRRIAALEAGLTCLLGSVVATVFAALLLLSQWQHPPATVWAGFALVMVAVPLLGVLVSTLALRRVIASPLGWVRRVRPQPGKGRGPGLAFIAAALVLLTVGLVITPGTFGGFGTAPLLIFTVVVVTGMGAVWLTGATARLTGRLLAARTGNPATLIAAERLRDDPWAAARTHAAVLLVTVVGTAFVGIRQTLLAGLTGRDRRMFADNMSFYTTGINLTGAAILVALGITLAGLAVGTAESLAARRRGLSAQAAAGVPRPVLAKALLLETALPLAPAVALAGLGGIGIGVLYAAAFGEGIPVLPLLVPPAVYAACLLAAAASLPRLRRSVHPAELRYA

SEQ ID NO: 12922 - protein, 237 aa, Streptomyces avermitilis
MSNPLLAARGLVKAHGSTPALRGASVELRAGEILAVTGASGSGKSTLLHCLAGIVRPDEGAVVYGGERLDQLPENRLSELRRTEFGVVFQFGQLIPELTALDNVALPLLLAGTSRKAAQERAGEWLERFGVRGQEESRPGELSGGQAQRVSLARALVTGPKAVFADEPTGALDSLAGEQVMTALTHTARESGTAVLLITHDAQVAAYADREVSLRDGVVIAAGHLPSGADTSAEVTR

SEQ ID NO: 12923 - protein, 177 aa, Streptomyces avermitilis
MSTRHILLGLLAAGPSHGYDLKRRHDERFPQARPLAYGQVYTTLQRLVRDGLAEVDGTDSDGGPERTLYRSTDDGSLELTRWAGEITPPAPFVTNEIFAKVVVAILASGDPAAYLSAQRAAHMARMRELTAVKTASGADLATVLSADYALNHLDADLRWMTTTGARLTTLTAEVDAA

SEQ ID NO: 12924 - protein, 83 aa, Streptomyces avermitilis
VAASAHLLLSALSKPEAEPSAGPEHLLYAFSAEGAGAEAPLTSEPPLPDAEPLTSEPPLADATPLTSEPTATGTAAGPDPAGF

SEQ ID NO: 12925 - protein, 740 aa, Streptomyces avermitilis
MPPAETGESETDEPGEADRAHAADGIHGADETDGAHEAHGVGEAPLARLAALHGVATSYSPSPGRTVAASDAAVTTALAALGVDAGTPDAVHRALAARETELRRRLLPPTVVCWGEQPPAALTDLPDGTRLRIETEQGETRASAEQLPPGVHALHITAPDGRSADAHLVVAPARLSAPPGRAYGLLVQLYSLLSQRSWGMGDLGDLAELAAWAGRALGAGFVQLNPLHVAVPGDPTDPSPYRPSSRRYPDPVHLRVEDVPEFAYVDDPGPVRTLLDRAARLRESVLRKGALIDRDAVWELKREALERVHAVPLGPGRRAAYVDFLAEEGEALEDHATWCALAEVYGADGHGWPAGLRDPRSAETARARGELMDRVDFHAWLAWLTDEQLAAAQRAARDAGMAVGLVHDLAVGVHPVGADAWAQQEYFAAGMSVGAPPDAFNALGQDWGLPPWRPDRLAESGYAPYRRLLRALFRYAGALRIDHVMGLFRLWWVPQGRPPTEGTYVRYDAEAMLAILVLEASRTGALVIGEDLGTVEPGVRETLHARGVLGTSVLWFERDWEGDGLPLPPERWRADCLATATTHDLPPTAARLTGAHVELRDRLGLLARPLEEERAAAAADTAEWLALLARLGLLKGASGGICSVSEEAEIQAVHAFLLRTPARLVGLWLPDAVGDRRPQNLPGTWDQYPNWRLPIADARGRPVTLEELAAAPRLHALVDVLRGLPAGGGAPGGARCGERG

SEQ ID NO: 12926 - protein, 79 aa, Streptomyces avermitilis
VDKKNALRAGALAAGTTLMMLLMSSPALAVVRDDGDDPGPGLSVIDTLGLFVAAPIVLFVVIAGLVIVGEKSHKQPKQG

SEQ ID NO: 12927 - protein, 176 aa, Streptomyces avermitilis
MNASRPITPPKDPVDAIIEQWAAARPDLDTAAMEVFGRVFRLSRTMGDRMEKAYERFGISRGEFDVLATLRRSGEPYTLSPRQLSATLMLTTGGMTGRLDKLERAGLLRRSPDPHDRRGLQVTLTDEGFRLIDEAVEAGLAVQTEALDALDAQQAGQLADLLRQLLAGTVSPAPGN

SEQ ID NO: 12928 - protein, 369 aa, Streptomyces avermitilis
MTKNGSTRAPLIALTALAPVSWGSTYAVTTEFLPADRPLFTGLMRALPAGLLLLALARVLPRGAWWWKSAVLGALNIGAFFPLLFLSAYRLPGGMAAVVGSVGPLFVAGLAAALLSERPTVRTLLTGIAAALGVSLVVLKAAGALDPLGVLAALAATASMSTGTVLTKRWGRPAGVGPLALTAWQLTAGGLLIAPIALLVEGTPPALDGRAIGGYLYLALANTAVAYWLWFRGIGRLTATQVTFLGPLSPLTAAVIGWAALGQALTPVQLAGMAVAFGATVFGQLRPRAQDRRRHRETTAVPLDAGPNSNAATTAPGAAAVPGAPTATAAPSVPTATAAPTVPGATAAPSAPTAPTATTATTATTPNGS

SEQ ID NO: 12929 - protein, 857 aa, Streptomyces avermitilis
VPGTNLTREEAQQRAQLLTVDSYEIDLDLSGAQEGGTYRSVTTVRFDSAETGAESFIDLVAPTVHEVTLNGDTLDPAEVFKDSRIALAGLLAGRNVLRVVADCAYTNTGEGLHRFVDPVDQQAYLYTQFEVPDARRVFASFEQPDLKATFQFTVKAPSGWTVVSNSPTPEPTDDTWVFEPTPRISTYITALIVGPYHSVHSVYEKDGQSVPLGIYCRPSLAEFLDSDAIFEVTRQGFDWFQEKFDYAYPFGKYDQLFVPEFNAGAMENAGAVTIRDQYVFRSKVTDAAYEVRAETILHELAHMWFGDLVTMEWWNDLWLNESFATYTSIACQAYAPGSRWPHSWTTFANSMKTWAYRQDQLPSTHPIMAEINDLDDVLVNFDGITYAKGASVLKQLVAYVGMDEFFAGVQAYFKRHAFGNTRLSDLLGALEETSGRDLKNWSEKWLQTAGINILRPEIATDADGVITSFAIRQEAPALPAGAKGEPTLRPHRIAVGLYDLDEASGKVVRGERVELDVDGELTAVPQLVGKRRPSVVLLNDDDLSYAKVRLDEESLAFVTEHLGDFEASLPRALCWASAWDMTRDAELATRDYLSLVLSGIGKESDIGVVQSLHRQVKLAIELYADPAARENLVNRWTDATLAHLRAAEAGSDHQLAWARAFAATARTPEQLDLLEGLLEGTQTIEGLAVDTELRWAFVERLAAVGRYDETEIAGEYERDRTAAGERHAATARAARPTEEAKAEAWASVVESDKLPNAVQEAVISGFVQTDQRELLAPYTDKYFAAAKDVWDSRSHEMAQQIVVGLYPAVQVSEETLRKTDEWLASADPSPALRRLVSESRSGVERALKAQAADAAAA

SEQ ID NO: 12930 - protein, 173 aa, Streptomyces avermitilis
MTTYPTHTARTTYTARPIGPSALKELRDTDDAGRPRVPFTDDEGGAPLRCCLRRSEPGEHIVLVSYAPLRRWAAETGAEPGAYDERGPVFIHAAECEGPAGDGHPFTGAHRTVRRYSADGRILGGRLVEVPDAAAADQAFDEAFAEAFGDPETRLVHVRAVEYGCFLYEVRRP

SEQ ID NO: 12931 - protein, 338 aa, Streptomyces avermitilis
VRVGIVGATGQVGTVMRRILVERDFPVTELRLFASARSAGSVVDGVTVEDASTADYTGLDIVLFSAGGATSRALCEKVAAQGAVVIDNSSAWRKDPAVPLVVAEVNPHAIADRPKGIIANPNCTTMAAMPVLKPLHEEAGLEALIVATYQAVSGSGVAGVAELHGQAQKVIADADKLTHDGEAVDYPEPQVYQRPIAFNVVPLAGSLVDDGLHETDEEQKLRNESRKILEIPALKVSGTCVRVPVFSGHSLQVNARFARPLSVERATELLGGAPGVALSEIPTPLEAAGKDPSFVGRIRADETVDNGLALFISNDNLRKGAALNAVQIAELVAAELKG

SEQ ID NO: 12932 - protein, 179 aa, Streptomyces avermitilis
VAVLRRMARRAQGAYAGADDPLDAAQERRVRAVLALGGVPQADLPDGVQQVRLRLLERVARGDEAPRDVSAWAAVVASNLAMDWHRAKRRQERLGERLASLRQLEHPSGEDSSVLSLAVAQGLDELPDAQRQVLVLRFYADLPVRGIAEELGIPEGTVKSRLHTAVRALRDRLHEDEVV

SEQ ID NO: 12933 - protein, 250 aa, Streptomyces avermitilis
VAENESDAGERAVDALMAAITDEPLPAGAETDGALMAEHRAALADVAVLREQLGIIGAALAEPEGAAERPAPVPAPREHAGRPPGRPGRRSRRPAARAVAFGTLVAAAVAGAVVGMGWLAASGGDGVSADSKASGGKADASSRTAPGYVACARLIVEGTVADVEPVPGADQDRIALAVDRYYKPAAGKDQVTFVMDHDVDPRLHQGDHVLIGIPRDSAVPDIWTTGEKDIAHERAWIRKALPESRNLICE

SEQ ID NO: 12934 - protein, 1101 aa, Streptomyces avermitilis
MTPDPQPAPTSGARRVARIAVAAGLVAALSAAGPIPMALAADHAPATPDPGTKSATAKLGSNDADLLAEAKADGAKNVTMMIATAAGQTEQVADQLDAVKGGSVGRAYDKLGYVRATVPTAKADAAIAAAAKLSSVHGIDLRQEIALDDPAPSADTAKGASSKATGTYSGPSKSTPAENPYNPSFETGAVDFVKDHPKADGRGITIGVLDSGVDLGHPALQKTTTGERKIVDWVTATDPLLDSDATWRPMVTSVAGPTFTYSGKTWTAPAGSYQISTFKESATTGGDAKGDANRDGDTTDSWGVLYDAATGKVTVDLNNNADFSDDQPMKPYKDGHQIGYFGTDDPTTDVVERQPFVVEIRKDVPMDPLGGTWVGKKADFVNIGVIESEHGTHVAGITAANGLFGGKMNGAAPGAKIVSSRACTWTGGCTNVALTEGMIDLVANRGVDIVNMSIGGLPALNDGNNARAELYTRLIDTYGVQLVISAGNSGPGANTIGDPGLADKVISVGAAISKQTWAANYGSQVEKPYAMMPFSSRGPREDGGFTPTLTAPGASINSTQTWLPGSPVAEAGYSLPAGYSMLQGTSMASPQAAGASALLLSAAKHKGIELTPATLRTALASTADHIKGVQAYEEGAGLINIVDAWESIKDDATAHDYTVKAPVDTAIDDALKTPGFGTGLYDREGGLKAGDKKTYDVTITRTSGADRAIRHELYFENNAAGTFRIVGSDEVKLPLNQPVTVKVQAAPKSAGLKSAILEVDDPRTEGVDKQILSTVVVSAPVKYTYSASGSVQRNSTTSYFVTVPEGAKSLEVAIGGLKDKSQTRFIAIHPYGTPVDNTGTPYCYPNYLDGNGCKPDVRAYADPQAGVWEIEVESRRTSPLLDNPYKLDVAVLGAAFDPAVVTVPEAKVGTPAAAAWKVTNNFAALDGKLKGGPLGSSKNARPTIAEGATQVTTVEVPTGAKSLDVAIGKVSDAAADLDLTVKNAAGTVVGSSADGDSEEAVSVASPAAGTYTIEVAGYSVPSGSTAYDYQDVFFSSSLGQVTVDESAPVKLGTGDSATVSGSVTAAAAAPEGREFFGQVQLVNARGTVAGLGSVKIEKVTP

SEQ ID NO: 12935 - protein, 178 aa, Streptomyces avermitilis
MSVTRDPRPLTGEPVSLDLLNTRWNREGATQDLLTDTDGLAVWLAANALDFPADDTVLRHVLQARDALAAVVDGSLDEGAGRVDAVLGHGRIRATLTAEGPGESVEFEDASWGPAWLAVRDYLKLLNTAPDRIRHCAHDSCILHFFDTSRNGTRRWCSMAACGNRAKASRHYARTREA

SEQ ID NO: 12936 - protein, 150 aa, Streptomyces avermitilis
MALRTGHVGLNVTDLDRSLAFYQVALGFRLLGESKEEDRRYAFLGAEGEDDRPVLTLWQQAQGSYDTTRAGLHHLALEVDSVEQVRAYESSLRAYGVEFAYEGVVAHREGSASGGIFFHDPDGTRLEIYAPSGTDGAPAPSATAPTCGFF

SEQ ID NO: 12937 - protein, 293 aa, Streptomyces avermitilis
MTYHSGSRAVQDRLGVREFADHVGRGIGQGIRPVAAAFLGLQPLLVLGAADPASGAVWASPVTGEPGFVRATGPRQISVAGGVRPDDPLAPALAAEGTPVGTIALDPRTRRRMRLDGHARPTPRGFAITADQVFSNCPKYLQRRESYERLDRAPKPARRSTELTASQSEFVAKADTFFLATVHEHGADASHRGGNPGFVRVDSPGELSWRDYPGNSMFLTLGNLSLDPRAGLLFLDWESGTTLQLTGTASTEFAADGERTVRFRVKEAVETPSALPLRWSAPAYSPANPEPAR

SEQ ID NO: 12938 - protein, 152 aa, Streptomyces avermitilis
VRKNLRVAAYAICVRDGKLLLARAQDPDGKPEWTLPGGGMEHGEDPYDTVLREVEEETGYHIEVTGLLGVDSVRRTFPRRLRTPTDHHGVRLVYEGRVVGGELRPEVGGTTDLAAWQDLDAVPGLPRVGVVDIGLALWRRRPVTGRVARPAK

SEQ ID NO: 12939 - protein, 596 aa, Streptomyces avermitilis
MSRIRSVAAATATAAHAAAGALDRRSLLAATGAVSLSAGLGFALRPGSEVPAPAHAATGEALAVSRQAPAAPLAPYTRGTTLSSVAAARSGSSGYRRLGDGAAWKRVVRGDLATPKAGRAGRRTALASFVQFTDLHLVDVQHPLRYEYLRSQTASAWRPQESLSVAGAVSLVERVNALRGAPVTGTPLHFVMTTGDNTDNNSKTELDWFLKVMSGGRVTPNSGDPRHYEGVQSSGLKLYWQPDAALRDADKQLGFPRIQGFLAAAIRELRSPGLNLPWYSTVGNHDALPGGCYAPGDSYFAEVAVGGKKLMTLDQAAGKAIWDNVKKGGDPKGVDFKAMLKSQARHMRSVTPDEARAPFTPAEYLKAHLDPAHTGPGPIGHGYSEANLSAGTQYYVFRIADDVLGISLDTTDPGGHYEGSIGTAQLKWLEKTLRDNKDSYVIVFSHHTSKTMRNLNTDPAHPGEKRHGGAELVSVLGNHPNVAAWVNGHSHKNDITAHAAPNKGSKGAFWEISTASHVDFPQLARIIELVDNKDGTISLFTTLIESAAPHRTDFADLTQTGLAALYRELGFNAPGARSTLSGTAEDRNTELVLTKG

SEQ ID NO: 12940 - protein, 407 aa, Streptomyces avermitilis
MTTISLVQPSTAPAGTQVTIVGSGFTGATAVKFGATNATSFSVLSDNVITAVVPPGSGSVLVTVVAPSGTSNGVSFAYTVPVITVINPTSGPATGGTSVTIIGTGFTGATAVKFGATNATSFTVLSDNVITAVSPPGTGTVQVTVVTPSGTSNGATYNYVPTLTSLSPASGPAAGGTVVTLTGTGFTGATAVTFGGTPATSFTVNSDTQITATAPAHAAGTAAVTVTGPGGTSNSLPFTYIPVPVVIALAPASGPAAGGTSVTIIGTGFTGATAVKFGATNATSFTVLSDNVITAVSPPGAGTVLVTVVTPGGTSNGAAYSYTGTPVPTLTSLTPTSGPAAGGTVVTLTGTGFTGATAVTFGGTPATSFTVDSATQITATAPAGTGTVQVQVTTPGGTSNTLAYTYV

SEQ ID NO: 12941 - protein, 69 aa, Streptomyces avermitilis
MHPRPTAPEIVPEQAWFRSSYSDAGQNCVEIAAPTPGTDIAIRDSKNPTGPSLLVPAAAWSAFVTGIRT

SEQ ID NO: 12942 - protein, 295 aa, Streptomyces avermitilis
VHMAAKRGRTAQRLELGLQLRQLRENCDGGDRGVGLTRKQAVQGLRISEASLQRIETGSLNFRFVGDLRKLLTKYGVTDEDVVDSLISLNRESNQQDWLTQYRGLMPSGMPGFVGLEPEAHAMKAYHPTLVYGLLQTERYARAVHEVQKPIEEYTTEFIRSSVELRMKRQEVLTRESPVKLHVILGEAALRYPIGGAEVMREQCARIEELSGWDHITVQVLPFRPSYRSINDFAILDFGNNLPPRVQADSAWGSVSTSDKPREVDRFSRRFDTMTASALPPEDTPEFLHRLEREL

SEQ ID NO: 12943 - protein, 175 aa, Streptomyces avermitilis
LDTLRMKGPHMPTPEPPTLLAHDWSMGYPMTLRSVRLARLHVRRRLTMWQWGGDIDDAVLVASELVANAVRHARVVGRELWVRIAELEGDGLLVEVADPVRAFPEVAAEPDGEGGRGLLVVRHLTAELDWFLRADVGKTVRARFAPHPHQNSDPHPHPHARGGAAGGPVTPPLPS

SEQ ID NO: 12944 - protein, 249 aa, Streptomyces avermitilis
MITGLAALALHGFASAPPFPSLDKIDVLVPKPRRLRSTGYARIVRASALPDASVVAGVPVAPVPRALADAVAELSDAGVVRRLLTEAVRAGHCEPASVVRELTQARLLGRPHVVDAVDSLLAEGRAIAEGRLYRMVREHGLPDPVWNVDLRLPGGPPLGGLDAYWPEQAVAVELDTRAPRQGHRQDAEDASWSEYARKRELLERLGITVVHITPKKLRDAMEQQAAVIRTAMMASEDRDPAAHVVVLPR

SEQ ID NO: 12945 - protein, 835 aa, Streptomyces avermitilis
VSLDLRSAVGDRDDERAPRTFRSVTTIRFRCAEPGATSFADLIAPSVTAVSLNGRDLDPGEVFDGARILLEDLAAENELVVDAQCAYSRTGEGMHRFVDPEDGEVYLYTQYEPADSRRVFANFEQPDLKAPFRFEVRAPEGWVVWSNGVGELTDGVWRFAETKPISTYITAVVAGPYHYVTDSYSRTFDDGTTLEIPLGAMCRKGLAPHFDSDDVFLVTKQGLDFFHDHFDYPYPFGKYDQAFVPEYNLGAMENPGLVTFREEFIFRGKVTQASYEGRANVILHEMAHMWFGDLVTMEWWDDLWLKESFADFMGAFSLVGATRFKDGWITFANRRKAWAYRADQLPSTHPITADIRDLQDAKLNFDGITYAKGASVLKQLVAYVGRDAFLEGARRYFKRNAYGNTRLGDLLSVLEETSGRDLATWSRAWLETAGVNSLTPQVILSADGRITELSVLQEAAESHPELRPHRVAVGLYRSEAGALTRYARAEVDVFGPRTVVGELAGSAAPDLVLVNDDDLTYCKIRFDETSLATLRSHLGDITDPLARALCWSALWNLTRDALMPGRDFIDLVLRFAGRESDIGVLQMLHAWANSALTFYAAPEWRETGARLLADGALKELRLAEPGSQHQLTWARFFAAVASSEADLQLLQGLLEGTAKIDGLDVDQELRWTLLEPLAAHGTADESVLAAELARDDTASGKRHQVRCLAARPSAAVKAQAWASVVESDALSNALVEATIAGFTQPSQRELLAPYAAKYFAAIERVWTERSIQIGMDVVKGLFPALQDSQETLDATDAWLAAHEGAAPALRRLVLEARDDLARTLRGQACDRAAAV

SEQ ID NO: 12946 - protein, 212 aa, Streptomyces avermitilis
MSEKTPVDFWFDPLCPWAWMTSRWVLEVEKVRDIEVRWHLMSLAVLNEPKLDELPEEYRELLETKAWGPVRVVIAAQQEHGAKVLGDLYTALGTRFHNQGEGPTKEAVAAALDEVGLPASLLDHWDSTPYEAELRASHKEGIEKVGQDVGTPVIAVPGADGEQIAFFGPVVTPAPKGEEAAKLWDGTLLVASVPGFYEIKRSRSQGPDFSNL

SEQ ID NO: 12947 - protein, 213 aa, Streptomyces avermitilis
MPVYTLPELPYDYSALAPVISPEIIELHHDKHHAAYVKGANDTLEQLAEARDKESWGSVNGLEKNLAFHLSGHILHSIYWHNMTGTGGGEPLAADGVGDLADAITESFGSFGAFRTQLSKASATTQGSGWGVLAYEPLSGRLIVEQVYDHQGNVGQAATPILVFDAWEHAFYLQYRNQKVDFIEAMWQVVNWQDVARRYEAAKSRTDVLLLAP

SEQ ID NO: 12948 - protein, 462 aa, Streptomyces avermitilis
MSSRTTLDTAPETSAADAPLSHGLKQRHLSMIALGGVIGAGLFVGSGAGIAAAGPSIVIAYSVSGLLVMLVMRMLGEMSAAYPSSGSFSAHAERAIGPWAGFTAGWSFWVLLCTAVGLEGIGAAKIVTGWLPGTPEWGWVALFMVVFCVANLAAVKNFGEFEFWFAALKVGAISLFLVLGVLAMTGVLPGTDSPGASNLHDFLPNGSEGLVIGLLASVFAYGGLETVTIAAAESENPVQGVARAVRTAMWRIALFYIGSMAVIVTLVPWDSKEVVEKGPYVAALDHLGIPGAGQLMNVVVLVALLSAMNANIYGSSRIAYSLVERGQGPKALGRVSGGVPRIAVLVSCVFGFVCVVLSYWRPNDVFPWLLNMIGAVILVVWIFIAVSQLLLRRKVEREAPEKLVVRMWAYPVLTWVALAGMAAIFILMARQPDTRVQLYSTGAMTLVLAAVGYAWQRARARA

SEQ ID NO: 12949 - protein, 299 aa, Streptomyces avermitilis
MTAIEIRKVTAHIGAQVSGVDIGKPLDEETVTALRDALNAHKALVFDDVDLDDAGQQAFARHFGALTTAHPTVPAVEGAPNVLPVDSERGRANHWHTDVTFVLNPPQASTLRSITIPPYGGETLIANAAAAYRDLPEPLRALADTLWAEHTNDYDYAVPDEAVDEEQARQRAQFTSITYRTAHPVVRVHPLTGERGLFIGGFAQRIVGLSTGESRKLLDLFQSYVTRPENILRWRWSPNQLVLFDNRITQHYAIDNYDGRPRRLNRVTVAGDVPVGIEGKESYSIAGDASHYTPVAVAA

SEQ ID NO: 12950 - protein, 453 aa, Streptomyces avermitilis
VTAPRQLHLNAFLMNTGHHEASWRLPESDPYASVDLAHYVELARIAERGTFDSLFLADGPVLFNRVGQRPSGALEPITLLTALATATEHIGLIATASTSYNSPYNLARRLASLDHLSGGRAGWNIVTTAGAEAARNFGLDEEPAHAARYERAAEFLDVALKLWDSWEDDLIVADKAAGVWGDDRKIHPPRHQGPYFRVEGALNVPRTPQGYPLLVQAGSSDDGKRFAARYAEAVFTAQQTLKDAQDFYADLKSRTREAGRDPDHVKILPGIVPVIGSTEAEARRNEQVLEDHIVHEHGVERLEHLLHLEPGTLRLDAPLPADLPPESAIEGAKSRYTLVVELARRERLTVRELIGRLGGGRGHLTFAGTPEQVADAIEEWFRHGAADGFNIMPAVLPSGLGLFVDHVVPILRARGLLRTEYGPRRTLRERYGLPRPANQYATALSALSALATR

SEQ ID NO: 12951 - protein, 250 aa, Streptomyces avermitilis
MATHTEQLTRPAVRLQGLTRSFADRTVLDGIDLDLPAGQFTALLGHSGSGKSTLLRAVAGLDHEVTGSGQLTAPERVSVVFQDSRLLPWRRVLDNVLLGTDGKEAAERGRAALAEVGLAGRERAWPGELSGGEAQRAALARSLVREPELLLADEPFGALDALTRIRMHTLLRELWERHRPSVLLVTHDVDEAIVLADRVLVLERGRIGLDLTIDRPHPRSYRDPLLGEYRERLLTALGVTEHQGAQEDHQ

SEQ ID NO: 12952 - protein, 290 aa, Streptomyces avermitilis
MTTTDVPTATAPTTTEPRPAPAEKSRRDQRIRRRTLAPGKRLPASRLIGPALFLALWAAASAAGQLDPGAIPAPWTVLRTTGQLWSAGTLPTDVLTSLERAAYGFALGLSAGVLLALTAGLSRVGEALIDGTVQLNRAIPTLGLIPLFILWLGIGETFKIAIIAIVVYIPIYLNLHAALSGIDHRFVELAEVQGLSRLRFIREIVVPGALPGFFVGLRLGVTGSWLSLVVLEQINATSGLGYMMFQAQNYGRTDIILVGLLIYGVFGLASDSAVRLFERRVLSWRRTLSN

SEQ ID NO: 12953 - protein, 357 aa, Streptomyces avermitilis
MPPLSPSTPGVDRRLFLTSLLGATAAAAGLSGCADSSAAAAKGSSPSAPLATKIPSGTSLKIASYQNVQQTQFRLAGLSKLPFTVSSWANIGAGPDVINAFRAKSLDVANNAGIPPIQAHFQGFDAKIVAINITRKPNYVFATKPGSDIRTVEEFKGKRLAFSQGQAQGVVLLRALKKAGLKYDEVDLVPLTSNQFLTALQAGQVDIAPLANQQSPAYLKQYGSKGAHTIPTDVVDLLNLLWAPTSVLADSAKAAAVAAYIPRWAKGQVWAYEHPDQWNKEFYVKTQNLTLAQAESITKLANKPLFPPSWDEAVTWEQETADLLAEGGFVKAFKVGSLFDRRFEGIAAKAVPAEYRR

SEQ ID NO: 12954 - protein, 410 aa, Streptomyces avermitilis
MPRTAAPTLLPPQPPQPPQPPTTVLRAADSARRRTSASAVLRSVLEHGPVARSTVARLTGLSPASVTDYCARFAELGLLHEASVPRRSGGVGRPHVPVDLDDSRFVVGGVHVAVPYTTVALLDLRGRVVAERRLKHDRTEPSLVLARAADGLAALLSAAADRTPLGVGVAAGGWVDRDSGTIVEHPLLGWRDIPVRDVLGAHTGLPVQVDGHARALVGAERLFGRARGSRSLLHLFVGNVVDAAFATNDEVHHGPRSQAGAIAHLPLRGGAETCDCGRVGCLQVELSERALCRRARAAGLAVGVNPVRVVEAAAGGDPVAVRLLVERARMIGRAAGLLLDILNPDTVVVTEIGIIHREDCLAALREAVGPQRAAAVVPTSFPDSVLAVAGGSVALDVLYRDPLGVSPGAT

SEQ ID NO: 12955 - protein, 193 aa, Streptomyces avermitilis
MSTAVASAPRSGQVLADLLPASRVRDAALVLGGAALTGLAAQISLPVPGSPVPVTGQTFAALLVGTALGAGRGFLSLAVYALVGMAGVPWFAGGGSGAAAPSFGYILGMLLAATVVGALARRGADRSVLRTAGAMLLGEAIIYAIGVPYLAFATGMSLTAAIAAGLTPFLIGDALKAALAMGVLPTAWKFLNR

SEQ ID NO: 12956 - protein, 453 aa, Streptomyces avermitilis
VSVRLCGHDALMDSNTADTTEPLALRPADPGFEEELAGFQTGFTQRPTVVFAAASAADVAAAVAYAAAEDLPVGVQATGHGLPGGAEGGVLITTKRMDRVSVDPVSRTARVQAGVRWGQVVAAAQPYGLAPLNGSAPGVGAVSYTLGGGLGILAREFGYAADHVRALDVVTADGQLRQVTRESDPGLYWALLGGGHNFGVVTELEIGLVPVARLYGGSLAFDGREVDPAAVLRAYERWTRTVPDGLTSSFAAVPYPDLPGLPPHLRGRHVLSVRVAYTGSDGERLVAPLRETGPVLADSLRVMPYAESHTIHSDPDFPHTYYGDSAVLSELDVEAAASVPALAAADAPVMSVVQINHLGGALARRAPNSVPHRDGRFLVRLLAMADRDTARELLDPALARLAPWTIGRALNFAFGAGDRTEGLYDPETRKRLAGLKSEHDPANLFRRNYNLTG

SEQ ID NO: 12957 - protein, 256 aa, Streptomyces avermitilis
VVPLQVLRIQAQPRGTNMGSRHMTAITGSLLTASFSAVMIFACTATADDQGPASGKGGKPVDEAPAGVKLTTLLPSKISVDNSSHKTAITATVKNGGTKDSGKIRLLVAGFDGLVVKNVKGCTAIAKADLPPGSNSAFSCAIDNLAAGKSTSYAVDATFDTGKTGKICLPVQTSDGKKTYWQQGPVPFGTTNPSPNAPATPLLLGTDNKPVAPGGDRLADTGVTEDVLPLAAAGVTLVAAGAAGLWWTRRRPEPQP

SEQ ID NO: 12958 - protein, 803 aa, Streptomyces avermitilis
LPGNSGGGVPGLLVTGRYRLVESIGQGGMGRVWRATDEMLDRQVAVKEMRIDGLDAEDTRTRRERTLREARATARISHPNVVRVYDVVDESDRLWIVMELVDGRSLERIVVEDGPLGPGETARIGRELVAALRQVHAGGVLHRDIKPGNVLVENLGHRVVLTDFGIAAIQDAKALTMVGMLVGSPDYMAPERVSGRPQGPPSDVWSLGATLCAALGGHSPFSRSTTLATLHAVLYEEPELPTEAGGLRQILAALLEKEPSVRPGLEEVAAALEALVATGTSVAGAGDAGAGAAGAGVEAAGVEVAGSGSGDGGNGGDRGEGAVGERGAGLGAGSGGEPGAGSGPELRVGPGAESGAGAGAESEVGAVPRGVRQPGEEGEPEQGGPDAGSGGRRLESPTRALLDTALIRAARTAPEETRPDADPRWSEPVQDAIPGRPTRAVPPEAPPTRETPAVGPGHTAVTQPSHSPAPAPALPTPLPFPAQPHHPEAPLVPPTASPTASPTASPTASPAVGNASTEAPSAGRAEPLASGVPERAGAGERPSRGGAAPGTGSHAALANAVTASRLPGWPGAAPTSSPMSPGELPGPALPSAPRPPRHRRRMGLAAAGGVVAAGAVAVVVIAATGGSPGHDRDASSATSSAPSASSGGPSRSPTVDGTSRPPSLPPGSRTEAGMYAWVPPKGWKRVVQSGTEVHYTSPDAQQEILANATPARGDLLKQWQVAEEDREKGLNYRRIRLERTTFRGAPAVVWEYNVTAKGQYWHVRLLGFRSRGTSYELSTWYHPDIEGSAVPAYERVKKSFTPL

SEQ ID NO: 12959 - protein, 494 aa, Streptomyces avermitilis
MTSQPTLSKAENGPDRPGEPGGGLQAGLKNRHLSMIAIGGVIGAGLFVGSSTGIATAGPGILLSYALVGTLVVLVMRMLGEMSAANPTSGSFSAHADRALGRWAGFSIGWLYWFFWVVVLAVEATAGAKILEGWMPGVPQWGWALIVMVVLTATNLVSVGSYGEFEFWFAGIKVVAIGAFIVVGGLAIFGVLPGVDAPKAGLGNLTDSGGFLPHGPGAILTGVLLVVFSFMGSEIATLAAGESEDPQRAVTKSTNSIIWRIGVFYLGSILVVVSLLPWNDPSIKDKGSYVAALDSLGIAHAGQIMNFIVLTSVLSCLNSGLYTASRMAFSLGQRGDAPKAFARTTSRGVPLAAIVVSVVFGFVAVFFNYKFPDSVFLFLVNSSGAVALFVWLVICFSQLRMRKIIQRESPEKLVVKMWLYPYLTWATAALIVFVLGYMLTDTEHDGRETVLLSLLVAAVVLVIAVVKQKLDGSRAVAAAGADEPAVAEAVADAH

SEQ ID NO: 12960 - protein, 159 aa, Streptomyces avermitilis
VYLGSDHAGFELKNHLVEWLKAAGHEPVDCGPHIYDAQDDYPPFCLRAAEGAAADPDALGIVIGGSGNGEQIAANKVKGVRAALAWSEETASLGRQHNDANVVAVGARMHTQEEATKFVETFLNTPFSGDARHIRRIDMLSAYETTGDLPAIPAHHPQQ

SEQ ID NO: 12961 - protein, 269 aa, Streptomyces avermitilis
VPEGHTIHRLADDYEARFGGAAARVTSPQGKFADAAALLDGTVLETADAHGKHLFLGFRRADWIHIHLGLFGKVGFGDAPAPPPTDTVRLRLANDTSYVDLRGPTTCALITDGEKRAIHDRLGPDPLRPDADPARAYDRVSRSRTSVAALLMDQKVIAGVGNVYRAEVLFRHGIDPYRTGRELTRREWDAIWADLVALMREGVRNNRIDTVRPEHTPEAMGRPPRVDDHGGEVYVYRRANLPCHICGGEIRTAGLAARNLFWCPTCQQA

SEQ ID NO: 12962 - protein, 409 aa, Streptomyces avermitilis
MTTDVRVLRQDDWNLWYDTLIRAFGGVAEASEERELWQTLTECDRSIGVWDGDACVGTAGAFSFRVTVPGGASVPAAGITMVSVAATHRRRGVLTAMMRRQLDDIRSWGEPLAVLTASEPAIYGRFGYGIGTHQLTADVDTSRVRLSVPPGTDDVRLRYAVPADVLDVCEAVYARLVPGRPGMPARRPGWDRLMVLDPESRRDGASPLQCVVAERDGETVGYTRFRVKPDWEPSGPKGTVVLQDLEALDPAAHAALWRFLFDIDLTSHLNARNRPLDEAWLHLVSDIRRCNLRKRDSLHVRLVDVGAALEARTYQAPVDVVFEVEDAFCPWNEGRWRLTGDGKGATCVRTRDSVDLALSVRDLGAAYLGGVSLVSLGAAGRVRELRPGALTEATSAFSSAIAPWLPHGF

SEQ ID NO: 12963 - protein, 391 aa, Streptomyces avermitilis
MAAGRERRAAAETFTARLKKQWHRARTGVRRSAVDYFRGDGSDWIALAGLLLTIPLIAATTLMNSVWCSPAALVLPIVAGGLLLRPSSLLGLYAAAASALIVESVKLGPYTEGPSRVTPGVVLVVAACGFFGLLIAQFRSRVGVPWRRGGTMLFDLRERIRVQSKLPKLPLGWHREMALRPAGGQSFSGDFVVAARTNGGRTLEVVLTDVSGKGMDAGSRALLLSGAFGGLLGSLPPHAFLPAANGYLLRQDWDEGFATSIHLVLELDSGDYELFSAGHPPGLQLSAGSGRWEEKAAEGPLLGVYDGAQFDPVKGSLRPGDVLMLFTDGLVETAERDIVEGIDRLTGEADRYVAGGFHGAAWHLIEAVAKDVNDDRALLLVCRDGPTAAAR

SEQ ID NO: 12964 - protein, 315 aa, Streptomyces avermitilis
MGLRKRRREIDERASGRIPGPIPGRTPLASGADGADPGAYGAVPGVDRTAPGVDRTAPSVGRAVSGADWAVELRGVRRRYGRGGSAVHALRGVDLALARGSFTAVMGPSGSGKSTFLQCAAGLDRPSGGTVHLGGTDITGLSENKLTALRRSRLGFVFQAFNLLPSLTVEQNVVLPLRLAGHRPDRRRAAEVLAQVGLQDKGRRRPGQLSGGQQQRVAIARALVTRPDVVFADEPTGALDTTTAAEILGLLRQAVDVHGATVVMVTHDPTAAAWADRVLFLADGSIVDHLERATAPRIAARVAALTTPSFEGAAA

SEQ ID NO: 12965 - protein, 814 aa, Streptomyces avermitilis
VPNGLARAAVRFKPAAFAGTFVALAMAALIVSACGILLETGLRASVPPQRYSGAPVVAAADQRAHLVTGHGDDRDDEAQPLPDTARIDNSLVARAGSVPGARTAIADVTFPVLDEKGAARTAHGWGSTAFTGERPMSGRAPGPGEVVLSGAGRAAVGGRVTLTTADGPRTFRVSGTTAEQATPTVWFADTDAVRVSGHPGRVDAIAVLPKEGVTAAALEAQVAKALGDRAQVHTGDDRGAVEDASLAQAKELLVGLGGSFGGVATLVAVFTAAGTVALSVGQRAREYALLRAIGTTPRQVRRSIATETLLVAPLAGAVGCLPGIALARWWFGQLQDKGAVPHAVRLSVSYIPLLSAIGAVLLTALLAGYLAAHRTSRIKPGRALSEASVERLRPGWIRTPLGIAAAVGGFVCAGLADSLDGEDAANASLGIVMLFMLAVALLGPLVARVCAALFGLPLRGAGAPAVLAAANSRTNARRLASALTPIVLAMAFSSVLVFLHTSEERATRDQQRAGITADHIVTSDAGLAPAAVHEAAASPGVTTAVGVLRTAVLIPAAGSLESATTQGVTGSAADLARVQDLDVEHGALSLKPGRVALDASLADSAHVRVGDRVHLRLPDGTKASPILAATYGRGLGLSQVTLPRADLATHVTSALDTEIWTKGGRAGALAPLGRVLDRADYTTAESLDRALNAWANTVMAAVLGGFAAVAAVNTLVMTVLGRRSKLGTLRLIGTTRRQVLRMVRWEALLVALSGIVLGTAIALATLVPMVRGLTGRSPYIPPLVYGSFAGAVLLLGLTAVTLPARAALRPARER

SEQ ID NO: 12966 - protein, 110 aa, Streptomyces avermitilis; identical to SEQ ID NO: 11631

SEQ ID NO: 12967 - protein, 105 aa, Streptomyces avermitilis; identical to SEQ ID NO: 11630

SEQ ID NO: 12968 - protein, 100 aa, Streptomyces avermitilis
WLVRVRIVGRTTRVRRRMRRAISRRSAGWRRSSRRGTGRRRRCRISRLMVWRMSTTARNCGGIARRPRRALSSCRRRWRRTTGRRSRRSRRRRRRSTTSA

SEQ ID NO: 12969 - protein, 131 aa, Streptomyces avermitilis
MTGWDLKPQGIQGVLKTTGETASHIETHAKSYGKHLTSAATNAGTISAEGGGEQGGEKPSGGLVALALSQYAEHAATDLKFIAARAGKSLQGAVDATTAYLNGDQEMAAEAQRKALSAPDLDPMKPGVQTS

SEQ ID NO: 12970 - protein, 824 aa, Streptomyces avermitilis
VIKPEAIPQYTGNLEQLEKDYGSLKTVAGSIRTTGKDVHSQFQGLSAYYTAPEAEQLFASTKPVADRADGFADDLEKVSGALSSYSTEVRPLVQKLEQLKLDATKFVSSVKGDDDWEYDEDKIDEHNKIRDDVTATVAAFWAAERTCHNAITKLFGGTQMVAGDGSDRKDQYGFNADDLKNAKLPWGDPMEEKHHVWEVGHWVKSFVWDGLIVDGVWGTIKGLGTLVGFGGWDAMGQAWKGLAQLATGLAISSIPGASALFWTLPDDKLPSWLRDSRTAMKETGKALVAWDEWGKNPGRAAGAVTFNVLTTVFTGGAGGAAAGAGKAGAVAKVLSVAGKAGKFIDPMTYVAKGAGAGLSKIGDIAKGLKGIGNIEIPKLPDGSVQLPDGRLLEPNGDLVGPGGVVDTTPVPHEPVLPAHWTIQEPALSGVRAGDGLPGGVAHAGDSLPTGGHYDTSLPSGAADHVPGGTAGHTPSGTAAHTPSGTFDGTPTSYDHTPTATPHDVPTGTPHTGHDLPSGGGHPPEPHGTGHDTPGGHTDDASHGSGHDGPGHGHDGTGHTDDAAHVGDHAGVDHAAVDAAAHHGTDTPVAPGHSGADAAGHGGAGEPFEYEPHMSGDDFEELATDAEKHAVATAELERGTNPAASLSDDAGQAYGDAYWNDYVDNLDPSGREALRTYTGHDYTEINSHLRGENPDVYPETLHTIDEMDRVMGTRPVPEDIMIVRGTGIEHLKLRSPLDMLGNTYGDGAYTSSALGRTVPPAFAWKPVVMHWRVPKGTPALWLDKISKHPGERELLLARGTQYKVTRVFMDEAGKWHVYGEVLPRP

SEQ ID NO: 12971 - protein, 137 aa, Streptomyces avermitilis
VDFMSSEQPINPRFDDDLRFVESPGGPPRYRDWTEKPVQYFTVVDKQGGGVLGYVWAGDEDDAAAYEPRQAAGPRGVNAGISWGSRLRKAKERGIRPSEALAELVADPEPGGTGRPLPGSLTDAPNAAAVDALAKSD

SEQ ID NO: 12972 - protein, 202 aa, Streptomyces avermitilis
LQTPRGTSTMTTPPAPNPHQQPHPQANPYAQPQANPYALQGGHPQAPGYGAPGYGAVPPQAGPQWGAPYGPGAYLSCKFCGGAPAVDVTFRAHRGLLILMSFQKLSGPMCATCGLGVQRAMTTQTLWQGWWSPFSLFLFTPFTLVWNLIARGKVTKLQPPQPGQHGPQVDPGEPVHRRGLAYVALVPVLWICFMIAQGLTQS

SEQ ID NO: 12973 - protein, 174 aa, Streptomyces avermitilis
MPYVAEAKLGGACFMPQEGRAQAQPRLMALAEVEAVARTAHAAQKDKAGRPYAEHLQAVAEGVRARGGADELVAAAWLHDSVEDGVLSERWLADAALSQRTKDVVRAVTKRAGEDPEAYARRILATPGARLVKAADLAHNADPRRLAVLDGPTAERLTLKYAAMRAYLGLGAED

SEQ ID NO: 12974 - protein, 87 aa, Streptomyces avermitilis
VALCPDGLYSCSCCCCCFFCSAFCFARVAWRKDQPMHPAHRTAAIAIPANTLPNRSSTVRRPRCAPNSSASRIRRRRTATDSSSWLS

SEQ ID NO: 12975 - protein, 451 aa, Streptomyces avermitilis
VVSTATTSRAQLSRVTLVGERRRADIVLPSDTPIGQLLPDILQLLDDRAAARPMTRQLITSDGSVLPHDATLSSAEVADGAVLQLVRAHSAPPAPVVHDVTDQVADDLDLRAWRWRPSARRASAGVATVAFAVLAAVLARREFALESLTGGLVAATLLFLVTGALVARIGDGNRGLATALLLACGGLGLLTAWTAADAYHWPGTARLAAVVAALVLTLVLLAFFSPLGRGGLIGAGGTAVIAIVWEAVAAVQDQPARLGAVMAVFSVVLLGLLPRFALMASGLTGLDDRRSGGVSVSRHQVGNALAATHRGLALATIATAASAAAGGWLVTTAGTPTVWTVTLASLTAVVLLSRARAFPLVAEVVALFAAAALLGVRLVMVWLDHDGGAAPLIVLCAASVLPLLVLAVQPPEHVQVRLRRSADLIESIGVIGLFPLAVGVFGIYGQLLNKF

SEQ ID NO: 12976 - protein, 366 aa, Streptomyces avermitilis
VPAPGSGRPRSSPRTRRTHQPSAPAEAQAQAQQAYTAQQPHAPQPQARSAAHLPGARPARTPDSRPVVDKTLAGAGLKPRHGEPFATRAVRAVRRTVSSSAAREVAETTATAEVLQQAVTTGRQIAVTSIRGGAGKSTIAALLGTTYAHYRHDPVLLVEADPALGTLPLRLGAETLRWTTGDVAGIVEPQMSLLDVTGYLVQLPDNAWLLPGSQGQIGAMLDLRSYEKVMVSLRRYFGVTVVDCETLPAEVARVALSASQARVLAVPATLEGVSSTYAVLEWMRGLPRHVIAGTVVVLTETVPHSGLDLDKAAEKLRATGASVQLLPYDRHLAAGGVIRTELLAQPTRLAATRLAAQVFELSQQRR

SEQ ID NO: 12977 - protein, 1324 aa, Streptomyces avermitilis
MSTRLIHRPARTTRPAAASEPRTIEAPPNLPEGKSGSIATSLLPVAGVMSSVVMMTVVRNSQFAGLGAIILVVTIVGSMALVFSQRGKAQRTRRTQREAYLAYLEDLREELSKEERERRERAGVLNPPPDALYDIVRDPARLWERRRVDGDFLRVRVGTGEMPVRDLKVAQQGSSVLTPPDQFMLNEASALMSRFSTGTELPLTVPLDRVGNISVIGPREDTLRVARALLVQAAATHAPDDVAMALAVPGDRLADWEWAKWLPHLLDTEQFDGPVAARRIAPSTPQLARQIGPELRRRASFAAEVRRGLSGKDALSMSSRLLVVTDGHGEDAVDLPRPDDAVGLRDMGVTVLHLLDQRVQEPGSVGVRITVDGDRIVIEDLREAEPIGAHGTVDEVSVPFAEGLARMLAPMRLSAESMVDAPLTGPVDFAELLGIDDVAHLELDQLWAPRGERAFLRVPIGISDSREPVLLDLKESSELGMGPHGLCVGATGSGKSELLRTLVLALVATHPPEDLALVLVDYKGGATFAPFADLPHVAGVITNLENQAGLVERVHASLAGEVKRRQQVLKDAGNVADIGHYAALRAEKRPDLDPLPHLFVVIDEFGELLTAKPDFIDLFLSIGRIGRSIGVHLLLSSQRIEGGKLKGLDTYLSYRLGLRTFSADESRTVLDTTDAFHLPPLPGFGYLKVDTSHYERFKASYVSGGYRGPVQRETEDTGPLALEYQAFNTLGESQSSGPDEPKMRRRETGPTEMGVLVEQIENADTAPVRQIWLPPLPDAIALDKVAGPLDVGARGMQLAKRRGPLQVPLGVLDDPTKQWQGQWYLDLTVAGGHAAVIGGPQSGKTTLLRTLALSLSLTHTPQEVGIYGLDLVGGGLQALSGLPHVGGVAGRADRERAGRTIDSVRGMLNQREELFRVHNIDSLEQLRDLRAAGRLPELASTEIVLLIDGFGALRDDFEELDDAVVDILKRGGGYGIHVVAGMLRWNDVRIATQSQFGTRVELRLNDPSESSIDRKLAETLAPEEKGRILTDGKLFAQVALPRTDGLPDKADLGAVLERTARTVRATWTGEVAQPVRVLPHILEPQLLPGPAAEPRRVPIGLDQTQLAPVLLDLFAHDQHLVIMGDSECGKTNLLKVIADGLIERYSEDELVFAVMDPRRGLRGAIPEEYRGGYAYNSKLCAGLSAGIATELEKRLPDESADSEDLEPGSWGSGPRIVILVDDYDVLTTAGQQPLAPFIPYIPSAVDIGLHFVLTRRVAGAARGLYEPLLQGLRESGASALVMAGDRSEGQLFPGVYATQQPSGRGVLVRRGEPNRLIQTVYAAG

SEQ ID NO: 12978 - protein, 476 aa, Streptomyces avermitilis
MTKDVIALTKKMPDPLSVLAGLLSGGPDKLVGAEGEGAVVQLCDEEGRPLVSVEAPLLVQVRGEAQRLLGATEPEVPYWWTEARATTGVKEAEQLAGTFAARLASLVGGTAWPPQAAGSLAVVKADGVRAAPTPAAAQPAVDVLTDKVAVVIQDRPVVAMTAWLSDALRAAANAELGLQIVTPAGTRLSPAVRNSLPGWPSRWVVQDEKDGYYDGLSGAVLQWTNGLFATVESPDATPQDPHTPVADAFKKGLAEEGDTGERQLAISFRTIHPADDRLVLGGALESVWRGITGEPPAGWGTEEPANLPWSLRQLTDVAFERSPAPTWLVVVGSPERPGLATVRVSRTTGGVEEDVTLAFGYGPGEEPPVDALPKVAETLATRHDLQSMLVQIRKARRDLSVPPRFEGPGVPLAFALGAEEVRAMPGDRARRTPLAQPPVQLGPKTRPALYYPLPGDPSDLSGWQDFERLMRHLKGA

SEQ ID NO: 12979 - protein, 375 aa, Streptomyces avermitilis
VPSPRAPQNSSSSQISQTSRGASQAASPESKPVKQRDAFFDNAKYLAIVFVAMGHAWEPLTDHSRAAEALYMVVYTFHMPAFILISGYFSRSFDMRPDRLKRLVTGVAVPYVLFEVAYSLFKRWADNDPGHPISLLDPWYLTWFLVALFVWRLTTPLWKVVRWPVPLALAIAVLASVSPDIGDDLDLQRVLQFLPFFVVGLFMKPEHFQLLRRREVRVLSVPVFAIALAVAYWAGPRMNSAWFYHRDSAQELGAPWWAGVVMTLALFGCSLVVTSCFFAWVPRRKMWFTALGAGTLYGYLLHGFIAKGSRFWDWYDAAWLQTPYGEVIATVFAATLITVLCTPPVQRIFRFAMEPKMEWAFKRDATEIARERAKA

SEQ ID NO: 12980 - protein, 64 aa, Streptomyces avermitilis
VAISLSVVLLLAIILVVLIRGGSIKAGPAIVAVLFGFFLASTGMAPSINRFLDSIAETINSISF

SEQ ID NO: 12981 - protein, 463 aa, Streptomyces avermitilis
VKSAVETLNPTRVRLTVEVPFEELKDSLDAAYKKINQQVTVKGFRKGKIPARVIDQRFGRGAVLEEAVNDALPKFYTEAVNEAELNPLGQPEVDITELKDGETLNFTAEVDVRPTIEIPDYSGIEVEVDAVEVSDEDVEKAVTELRERFASTSPVERAAEDGDVVTLDLEAKVDGEVLEDGVAEGVSYTIGSGELLDGIDDAVKGLEAGGETTFTSELKGGSAAGKEAEVTVKVSQVAARELPELDDDFAQLASEFDTLEELKADSRKRLENMKQYDQATQAQERVLEKLLELAEVPVPEKLLEDEINTRKHNLEHHQLGQMGLDLEKYLEIQGKTVEEFDAETKEAAVKGIKTQFVLDELVNKEKLNVNQEELTEHLMRRAASSGMSPDQFAQAVVEGGQVPMLVGEVARGKALAVVVEAATVKDTNGEIVDLDDEDETESTPETTEAAEAAEESTEDKPEA

SEQ ID NO: 12982 - protein, 219 aa, Streptomyces avermitilis
VRRPGAVVRRAGGYVTNLMPTAAGDPIGGGLGDQVYNRLLGERIIFLGQAVDDDIANKITAQLLLLASDPDKDIYLYINSPGGSITAGMAIYDTMQYIKNDVVTIAMGMAASMGQFLLSAGTPGKRFALPNAEILIHQPSAGLAGSASDIKIHAERLLHTKKRMAELTAFHTGQTVEQVTRDSDRDRWFDPVEAKEYGLIDDIMPTAAGMPGGGGTGAA

SEQ ID NO: 12983 - protein, 226 aa, Streptomyces avermitilis
VNDYPGSGLHARTQAEYTGARAESRYVIPRFVERTSQGVREYDPYAKLFEERVIFLGVQIDDASANDVMAQLLCLESMDPDRDISVYINSPGGSFTALTAIYDTMQFVKPDIQTVCMGQAASAAAILLAAGTPGKRMALPNARVLIHQPYSETGRGQVSDLEIAANEILRMRSQLEDMLAKHSTTPIEKIREDIERDKILTAEDALAYGLIDQIISTRKMNNSAVA

SEQ ID NO: 12984 - protein, 428 aa, Streptomyces avermitilis
VARIGDGGDLLKCSFCGKSQKQVKKLIAGPGVYICDECIDLCNEIIEEELAETSEVRWEELPKPREIYEFLEGYVVGQEAAKKALSVAVYNHYKRVQAGENGGGQSREDAIELAKSNILLLGPTGSGKTLLAQTLARMLNVPFAIADATALTEAGYVGEDVENILLKLIQAADYDVKKAETGIIYIDEIDKVARKSENPSITRDVSGEGVQQALLKILEGTTASVPPQGGRKHPHQEFIQIDTTNVLFIVGGAFAGLEKLIESRAGAKGIGFGATIRSKRELESKDQFEDVMPEDLVKFGMIPEFIGRLPVITSVHNLDREALLQILVEPRNALVKQYQRLFELDGVELDFEREALEAIADQAILRQTGARGLRAIMEEVLMSVMYEVPSRKDVARVVITADVVHSNVNPTLIPRDARGRGPGEQKTA

SEQ ID NO: 12985 - protein, 322 aa, Streptomyces avermitilis
MSFNQPGPYGGQPQQPGPYGQPGPYGQPPQAPQPGYGYPQQAPQQPGYGYPQQAPQGAPPQQPPYGQQPGYGQQPPYGQQPPYGVPQPPAPGGGKKKTGLIIGAVAVVAAVAVGAYFVIGSGGGSGLADDGAHKLTTPQTVLSEYKRVGKGGESSSNSTVKDLAESGVKNGKSVVGFYSTADFGNYDPENPSDTSDLPSQSELLTAKGVTMAGGYGTIADPKAALDKFFAALKKNAEESSSGSKSELIGSPESVDLDGAVMKCQSAKSTNSLTKKVSTDWFCAWADYSTIAMVSPGDNTGSVSKDVAADITTKLRDQVRVKA

SEQ ID NO: 12986 - protein, 874 aa, Streptomyces avermitilis
VTENSQQQPPASEPELPTQYAPADVEGTLYERWVERGYFEADAKSDKPPFTVVIPPPNVTGSLHLGHAFEHTLIDALTRRKRMQGYETLWQPGMDHAGIATQNVVERELGKEGKSRHDLGRAAFVERVWQWKAESGGQISGQMRRLGDGVAWSRERFTMDEGLSQAVQTIFKKLYDDELIYRAERIINWCPRCLTAISDIEVEYQDDDGELVSMKYGEGDDTIVVATTRAETMLGDTAVAVHPDDERYKHLVGKTIRLPLTERFIPVVADTHVDPEFGTGAVKVTPAHDPNDFEIGQRHNLPNIAVMDEHAVITVSGPFQGLDRLEARSAIVAALRAEGRIVAEKRPYVHSVGHCSRCKTTIEPRLSMQWWVKVGPLAKAAGDAVREGKVKIHPQEMEKRYFDWVDNLHDWCISRQLWWGHRIPVWYGPNGEVVCVGPDDEVPTGEGWSQDTDVLDTWFSSGLWPFSTLGWPEQTESLAKFYPNSVLVTGYDILFFWVARMMMFGLYAMDGTPPFHTIALHGMVRDQFGKKMSKSFGNAVNPLDWMDKYGSDALRFTLARGANPGVDVPIGEDWVQGSRNFANKIWNATRFALMNGATVEGELPPVEQQSATDRWILSRLNATVAEVDALYDDYQFAKLSDALFHFAWDEVFDWYVELSKTTFMGGGEAAKVSGRVLGEVLDVTLRLLHPIVPFVTETLWTTLTGGESVVIADWPVDSGFRDQAAEKEIETLQSVITEVRRFRADQGLQPGQRVPARLTLDDTALAPHEAAIRQLLRLQPEGEDFAATATLPVAGATVALDLSGTIDIVAERKRLAKDLAAAEKEKAQAGAKLGNEAFLAKAPDHVVDKIRGRLAKADEDIARIQAQLDRMPEA

SEQ ID NO: 12987 - protein, 453 aa, Streptomyces avermitilis
VPARPADPETDKALREVEAELATRWGETKLEPSVSRITALMDVLGDPQRAYPSIHITGTNGKTSTARMIEALLGAFDLRTGRYTSPHVQSVTERISLDGAPISAERFIETYDDIKPYIEMVDGQQEFRLSFFEVLTGMAYAAFADAPVDVAVVEVGMGGSWDATNVIDGDVAVVTPIDLDHTDRLGETPGEIASEKAGIVKQDATVILAQQPVDAAQVLLKKAVEVDATVAREGLEFGVVSRQVAVGGQLLTLRGLGGEYEEVYLPLHGPYQAHNAAVALAAVEAFFGVGSQRPEPLDLDTVRKAFAAVTAPGRLEVVRRSPTVVLDAAHNPAGARATAEAVGEAFDFSRLIGVVGASGDKNVRGLLEAFEPIFAEVVITQNSSHRAMDADELAAIAVEVFGEDRVQVEPRLDDALEAAITLAEEEGEFAGGGVLVTGSVITVGEARLLLGRG

SEQ ID NO: 12988 - protein, 122 aa, Streptomyces avermitilis
VRTLCASTLIGEVFVIGFAGLVAMKDPDLSTGTVWTVSGIAMAVCVLLCGMITRPGGVQLGWALQIALIASGFIVPSMFFLGAIFAALWWASVHYGRKIDEAKARFAAQAADHPAPVPPDAA

SEQ ID NO: 12989 - protein, 137 aa, Streptomyces avermitilis
VSQRTLVLLKPDAVRRGLTGEIISRIERKAGWAITALELRTLDQDTLEQHYGEHKGKPFYEPLVEFMASGPVVALVVEGERVIEGVRALAGPTDPIAAAPGSIRGDYGVIVRENLIHASDSEESAERELKIFFPGRV

SEQ ID NO: 12990 - protein, 343 aa, Streptomyces avermitilis
MGNSMSFIGRDMAVDLGTANTLVYVRGRGIVLNEPSVVAINTNTGGILAVGSEAKKMIGRTPGNIVAVRPLKDGVIADFEITERMLRYFILKIHKRRYLARPRVVVCVPSGITGVERRAVIEASSQAGARQVHIIEEPMAAAIGSGLPVHEATGNMVVDIGGGTTEVAVISLGGIVTAQSIRVAGDELDNAIIQHIKKEYSLLLGERTAEQIKITIGSAYDLDTDEHTEIRGRDLVSGLPKTVVISAAEVRKAIEEPVNAIVDAVKTTLDKCPPELSGDVMDRGIVLTGGGALLRGLDERLRRETGMPIHIAEDPLDSVALGSGKCVEEFEALQQVLDAQPRR

SEQ ID NO: 12991 - protein, 314 aa, Streptomyces avermitilis
VRDTRESRLLLVLLVAIAFALITVDIRGGQDSPVDGARQAAATVFGPIENGVSSAVDPVGNAVAAVRDSGSRHDRIAQLEHDNAALKAKLGSDDRNRSRLKQLNKMIRVAGEGQYGIKGAEVIGIGAAQGFSWTVTIDVGANDGIKRDMTVLNGDGLVGRVTTVGPNAATVLLANDPDFTVGTRMESSDELGFASGQGDRPLRVQLLNGKAKVVKGDRLVTFGSQADRPFVPGVPVGVVSRVDPSGGDLTRTVYVTPYVSFTKLDIVGVVVAAPKKDPRDEVLPPKPRPTPTPTVTVTVTPSANASADGQQQQQ

SEQ ID NO: 12992 - protein, 223 aa, Streptomyces avermitilis
MRFNRMLLSTALVVVALVIQVSVLARLHLPGAVPDLVLLTVLGLAMVYGHVGGALIGFGAGLLADLVPPADHAAGRYALVLCVIGYLAGLAKPENGRLKSASGPMAVVVAAAIGTTLLYAGVGALVGDTAARHVGLVSLLVTAAVYDLLLAPFVVPGIMALARRAENDPLAEGGSGAKAADVSSGWLSSGTGLRIGGQRGGLRAKAVKARVARAGRIKGVKRL

SEQ ID NO: 12993 - protein, 749 aa, Streptomyces avermitilis
VTNIPETGRTPRVQIRLVVIQILVFSLLGTLGGRLWYLQIRNGDEYAKEASGNHVQQVVQPAVRGSILDARGVPIADNETRLVVSASRTDLLKMKDDGKAVLTKLAGVLDLKPEDVIEKVRLCDAKTPQPCWNGSPYQPIPITDEATAKQALQIRERSEDFPGITAEPEAVRRYAAPGEANTAQVLGYLSPVTDNELQQAKDSDSPYLRSDQVGRSGLERQYDKELRGKAGVTRYEVDNLGRVIGKAKSDAAEPGSNLVTSIDARVQRVAEYELNDAMKVARTQFDKNTNENYKADSGAVVVMEAKTGRVVAMASNPTYDPNAWVGGISAKDYARLTGKKSNYPLLNRAIQGQSAPGSTFKVISTAAAVEAGYDFNGHYPCTSSYSIGSQVFKNFESENFGPISLGRALEVSCDTVFYGLAHNEWKRDGGINPKKKTNDWFFKAAHQFGLGKETGIDLPNEVTGRIPDRQWKQSYWKANKDAWCKSGKKDGDYVEKIAYENCLEGNKMRAGDAVNYSIGQGDTLVTPIQMATIYGAISNGGTLYDPTVGKAVVSADGKNVREIKPKSHGKLPISKSTRDQMDEALAGVATRGTAAWRFGGWPQDKIPMHAKTGTAEVYGKQTTSWFATYTKDYTVVMTISQAGTGSGASGPAVRKIYDALYGVSQDGTIDRKKALLPTPEKSLPKIQNDGSIDAPKVEKYDPKADQTSEEGGQPAATDSPAATTPSPTTGNRDTRRRTARPRKRRRMLT

SEQ ID NO: 12994 - protein, 398 aa, Streptomyces avermitilis
MTGNSFSVSGYGPDRAGWTRIFARDSLARRLDWPILLSAVALSLIGAALVYSATRNRTEINQGDPYYFLIRHLMNTGIGFGLMVGTVWLGHRTLRTAVPILYGLSVFMILLVLTPLGATVNGAHAWIVFGGGFSLQPSEFVKITIILGMAMLLAARVDAGDKPYPDHRTVVQALGLAAVPILVVLLMPDLGSVMVMVIIILGVLLASGASNRWVFGLLGTGALGAIAVWQLHILDEYQINRFAAFANPELDPAGVGYNTNQARIAIGSGGLFGTGLGQGSQTTGQFVPEQQTDFVFTVAGEELGFVGAGLILLLLGVVLWRACRIARETTELYGTIVAAGIIAWFAFQSFENIGMTLGIMPVAGLPLPFVSYGGSSMFAVWVAVGLLQSIRVQRPMSA

SEQ ID NO: 12995 - protein, 507 aa, Streptomyces avermitilis
MADTKREIERKYEGPATGSGAGLPGLTAVPGVASVVGKGVTELDATYFDTADQRLAAHSITLRRRIGGEDEGWHLKLPVADDVRDEIHAPLADTVPHHLSSLVRSRIRDAELVPVVRLRSSRDVHHLLDASGALLAEVSVDRVRAERLDGGEGATQWTEIEAELADGGDPAFLDRVEKKLLKAGLHRSTSTSKLARALEETGAAAKRLTGAPAAPEPPTTAGDHVLAYLRAQRDALVELDPAVRRDLPDAVHQMRVATRRIRNTLRSYTAVLDRTVTDPVRVELKWLAGELGVDRDQEVITERLSAELDELPRALLSGPVHNRVRSWSQRRHAGSRKALIAVLDGRRYLYLLAALDALVSDPPLRKAAGRKPRKVLGKAVRKDFEKLSRLVTKALELPPGKERDLAMHEARKKAKRTRYAAEVAAPALGRAAKSQAKSMKDVQKLLGDHQDSVMSRDALRDLAEKAQEAGESSFTYGVLYGREEQRAAADESALPKAWKKARRKARV

SEQ ID NO: 12996 - protein, 652 aa, Streptomyces avermitilis
MPAETAVSVFPQLEALLPHVQKPIQYVGGELNSTVKPWDACDVRWALMYPDAYEVGLPNQGVMILYEVLNEREGVLAERTYSVWPDLEELMREHQLPQFTVDSHRPVKAFDVFGLSFSTELGYTNMLTALDLAGIPLESKDRTLDDPIVLAGGHAAFNPEPIADFIDAAIIGDGEQAVLDMTDIIRAWKAEGRPGGRQEVLFRLARTGSVYVPAFYDVEYLPDGRIGRVVPNKSGVPWRVSKHTVMDLDEWPYPKQPLVPLAETVHERMSVEIFRGCTRGCRFCQAGMITRPVRERSITGIGDMVEKGLKATGFEEVGLLSLSSADHSEIGDLAKGLADRYEEDKIGLSLPSTRVDAFNVDLANELTRNGRRSGLTFAPEGGSERMRKVINKMVSEEDLIRTVSTAYGNGWRQVKLYFMCGLPTETDEDVLQIADMAMNVIAEGRKVSGQNDIRCTVSIGGFVPKPHTPFQWAPQLSAEETDARLGKLRDKIRGDKKYGRSIGFRYHDGKPGIVEGLLSRGDRRIGSVIRAVYEDGGRFDGWREHFSYDRWMACAEKTLPAFGVDVDWYTTRERTYEEVLPWDHLDSGLDKEWLWEDWQDSLDETEVEDCRWTPCFDCGVCPAMQTEIQIGPTGKKLLPLTVNKPAVSGHSH

SEQ ID NO: 12997 - protein, 443 aa, Streptomyces avermitilis
MHHPRSPERTAPAAFPLTGRSGAMHSLRRRLGVCSLAVGFIAVLAVPSADAAVPAGAGQADFPKVSCGWPAVVSPSRLNFAFPETNATYWVMPYQLAKGDRLVVDGTYPSARFTSLTTYDVKGSTVDSLADKAITPNSGSKNPFAQANAGTNPAEHRYRVTVQSGVAATPGHNTLAATADSAASGAGFLALRIYVPDEESDPTGGVPLPALSLQHQGGSTSTFDTCANAGSAHGDAGPLAGFLRQLVKKYAPPGGFEGCGKSTPSAPDFAVPNKAEGLFPNPYNKYLCTPVSHESGRIAVIRGKAPTFPDTIQGQSVLTKTQLRYWSLCQNQWQLPYPSSSCAADYQTALKDGQYTFVVSTPQDRPTNATTTDKVTWISWGPTDVNGILLFRNMLPAGDFHNAVQNIQKGQDPATVMGPYYPTITYCAKATFEKGGPDACPAR

SEQ ID NO: 12998 - protein, 415 aa, Streptomyces avermitilis
MDLEKPSTQQPPPDGCLVVAIRLPVRIVVLVLVVPVRMVWDALVVGGRFLRDTVLRPVGRALQWVARAVFVWPWVTLWRYVVVPVGKGFARLGYVLFVVPAGWLYRNVLTPLGHGITWVLRGLGAGLGWVLVRIGAGTAWVLRGIGAGLGRVLAGIGAGLAWVYRTLLTPVGHGIAWLLRGLGLVLATVGLGAYAAVAWLVRHLLVIPALWSYRHVLTPLGHGIAWVARGVAWLGGMAVTGIGAVLHWTLRILFVLPALAVRRWILTPVGRVLAVVAREIGDALGHAWRVAGRLSLVVGRFLGTLFRWIFVEPVRWVYRWVFVEPVRWVYRTVLTPVGHVVRDMVLRPAAEAARGVGRVTRQALATARESARQARADFRRMLFGGPREPQPVARREPGAAEARTLGSSTTVLTKD

SEQ ID NO: 12999 - protein, 264 aa, Streptomyces avermitilis
VQRIRLRYTKRGRLRFTSHRDFQRAFERALRRAEVPMAYSAGFTPHPKVSYANAAPTGTGSEAEYLEIALTEARDPDKLRELLDESLPTGLDIVDAVEARTSGLADRLTASVWELRLDGVDPADAERAVEAFKTAETVEVQRKTKNGMRTFDARGAVAGLDARVETHSPQADRPTDQPCAILRLVVRHVTPAVRPDDVLSGLRAVADLAPPVPAAVTRLAQGLFDEETGTVTDPLAPDREAAATAPSMAAATAAAKAPVPEGSA

SEQ ID NO: 13000 - protein, 1387 aa, Streptomyces avermitilis
MLEPIEPTEGSDNNTPSDTLPPRRRRRAASRPAGPPAAVAETATGATAPAEAAAETTAPITRPADIAETAEDAEAAEAAGTEETEEAAVAEPAEVAAATEDAAPRRTRRRATRRVSAPAGAPEAAESATAAETDSAAESVTAATGSAEVSAPETGEAAAEEEAAPKGRTRRRATRRASAPAGAPKAAEATEATEAAEAPVTTEAEVTAVAPEVAQEETPEAEDAAPRRARRRATRRVTAPAAAPTGDAAEERVEAPVTASDKTEAQAATKAEAKAEAKATSETRAAAQAEEAPAAEAAAETAEDAGPRRSRRRATRKAAVGFSAPAPKVTGDDSGRRPARPAVAVFQAPVFTEPMFQTPERAAAAAAAEAAVERPAEPVEEETAEAAAESGAGAAAGSGAGSTARSGAGSTAGSRRRRRRGGAEDEPAAVTATEDVVEETEEAEEAEDSVDGDEAEETGSRRRRRRGGRRRRRGESADADDESGESDDLAAEQAEQDVEDTAEQVEEDDEEADEREESGGAGSSSSRRRRRRRRRAGDSGTDAEPGESDPERTVVKVREPRSSKKDEHPSDEVQSIKGSTRLEAKKQRRREGREQGRRRVPIITEAEFLARREAVERVMVVRQSGERTQIGVLEDNVLVEHYVNKEQSTSYVGNVYLGKVQNVLPSMEAAFIDIGKGRNAVLYAGEVNFEALGMANGPRRIESALKSGQSVLVQVTKDPIGHKGARLTSQVSLPGRYLVYVPEGSMTGISRKLPDTERARLKTILKKIVPEDAGVIVRTAAEGASEDELRRDVERLQAQWEDIQKKAKSGNAPTLLYGEPDMTVRVVRDIFNEDFTKVIVSGDEAWETIHGYVAHVAPDLSDRLSKWTSEVDVFATYRIDEQLMKALDRKVWLPSGGSLVIDKTEAMVVVDVNTGKFTGQGGNLEETVTRNNLEAAEEIVRQLRLRDLGGIVVIDFIDMVLESNRDLVLRRLLECLGRDRTKHQVAEVTSLGLVQMTRKRVGQGLLESFSETCVHCNGRGVIVHMEQPTSVGGGGKRKKRGRGGAEQELPHEHEHELAQEPEPDEAVAETEAEVAAEVAAPVALPAPGYEPDEELYSSAAEAEAAASRGRSRRRATRRASAPAGAPRAEERAPRSRAEERAPKSRAAAEAEPMAVEDPVVEPPVAAEPVVAEPVVAEPVAVAEEEAAPKGRTRRRATRKVSAPAGSPKAAGEAETVTVVASAPEAEEPKAEQPAEPVAEPAAGPEAPVESAAPARPRRRAVRKATAPTSSEETAVVVVPSSETASADTAAGAAPSGEAPSAEAPSAEAASSEAEEAPAKKTAARKTAKKATAKKAATKKTAATKTAAKKTTAKKTTAKKTAAKSTSKKTAAASQPAPSTVTASTDEA

SEQ ID NO: 13001 - protein, 449 aa, Streptomyces avermitilis
MARVRLKGTGRHRAVKPVKGGRQAVALATVLSAAGVQAVASAGTAEADNPTWTEGPIFNDPLGTTDQQYAIRTRLIELTGAALPGSTIKVAVYHVWEASVVNALVDAKNRGVNVQILLDESSVSDRPTNTSYSTLAAALGTDRAQGSYVTTCPANKSCLGDPKFGQSIMHNKFWLFSAVQGATNVVVETTSNSTPSAHTRFFNDALLLPNNPTMYDAYSDYFNTMVTKDWASWNYRTVSNGLYKAYFFPRAGNTRDTDTVYSVLNNVQCTYKDSAGVKQQTKVRVAIFKLTRMAIAEKLLALKKAGCSVSIVYAETDSAKSSGGTKGTWEKLHTSGGPTVRCYNDDRDPLNPGQKLATPFIIHSKYILIDGMYDGVKNKVSFTGSGNYTGPALRENDESIVKVDDDTVHDMYKTHFDRVTKVAYPGTADTTDLCKGVKPLPDDGEKTLT

SEQ ID NO: 13002 - protein, 106 aa, Streptomyces avermitilis
LYAIVRSGGRQHKVAVGDIVEVDKISTAQVGDTVELSTLLVVDGDAVTSDPWVLAGIKVQAEVVDHHKGAKIDILRYKNKTGYRRRQGHRQQYTAIKVTEIPTAAK

SEQ ID NO: 13003 - protein, 84 aa, Streptomyces avermitilis
MAHKKGASSTRNGRDSNAQRLGVKRFGGQVVNAGEILVRQRGTHFHPGSGVGRGKDDTLFALDAGAVEFGTHRGRKVVNIVPVA

SEQ ID NO: 13004 - protein, 479 aa, Streptomyces avermitilis
MTTFVDRVELHVAAGSGGHGCASVHREKFKPLGGPDGGNGGRGGDVILVVDQSVTTLLDYHHKPHRSATNGKPGEGGNRSGKDGQDLILPVPDGTVIQDKAGNVLADLVGHGTSYVAAQGGRGGLGNAALASARRKAPGFALLGEPGDFQDIVLELKTVADVALVGYPSAGKSSLISVLSAAKPKIADYPFTTLVPNLGVVTAGSTVYTIADVPGLIPGASQGKGLGLEFLRHVERCSVLVHVLDTATLESDRDPVSDLDIIEEELTQYGGGLNNRPRMVVLNKIDVPDGKDLAEMVRPELEARGYRVFEVSAVAHMGLKELSFALAELVGAARAAKPKEEATRIVIRPKAVDDAGFTVVLEEDGLYRVRGEKPERWVRQTDFNNDEAVGYLADRLNRLGVETELMKAGARAGDGVAIGPEDNAVVFDWEPTVMAGAEMLGRRGEDHRLDEPRPAAQRRRDKQAERDDAEKEYDDFEPF

SEQ ID NO: 13005 - protein, 724 aa, Streptomyces avermitilis
VVDLGYAGRHHPRFPPSAAPFAGAQPVPSAGLAPRRIAQLSTLLAMFALFTAQIVSALLPNVPVFIAASAAGLALDVYLQYRDPGLLALLGKVRFDVTVRQLLRDMLILVGLQRIDDIEPLNEQAPLVIALCGFYALHFTCQAVAVLVRRSRTLPVVTRNIDASALRLSAAPPRILARRQGHRLLTFSIPTTIGLLITAATTDALWGGIGVGIAIALLLGGIAYLGTWLTKKKRAKSEQQVMEWLDKWLAKYKPTVAMYFSGGTSSAYQANMWLSTLSAVEGKPLIVLRERFMVQKIEATDVPVICFPKVSTMFSLENSTLKMMLHPANAAKTSQVLRIPTIKHAFINHGESDKLSSCNPYAKAYDEVWVAGPAARERYALAEVGVEDKDIVEVGRPQLAPIRPYSGAPTGTYTTVLYAPTWEGWDGNPGNTSVVLAGENIVKQLLADDGVRLLYKPHPMTGSVDPRAGAANERMKAMIREANTRRSGARPGSEAAAELARRTAELDKLTSTAFRVSADELERMMLQGTPSGDREAAIAEATLAWEKAYWASFPEWEHQIITDARPAIFACFNQADLLISDVSSVVSDWLSSEKPYAVANTSGMSETAFRVGFPTVSAGVILTPAADGVPALLESVRHPEKDLFTAARAELKEHLLGPSDPPSLARFNAAIADLCTKADERRVRMESRLAVEIPSPRGAAEETAHESTQGLQAEDDGAEDSVNA

SEQ ID NO: 13006 - protein, 375 aa, Streptomyces avermitilis
VSAARQGVAQARRIVVKVGSSSLTTAAGGLDADRVDALVDVLAKSRSGGEKEIVLVSSGAIAAGLAPLGLRRRPKDLARQQAAASVGQGLLVARYTASCARHGIRVGQVLLTSDDTSRRAHHRNASRTLDKLLAMGALPVVNENDTVATDEIRFGDNDRLAALVAHLVRADLLVLLSDVDGVYDGDPSKPGTSRVAQVHGPQDLAHVEIGSAGRAGVGTGGMVTKIEAARIAAAAGIPVVLTSAVHAADALAGRDTGTYFHPTGKRSADRLLWLQHASTPQGALTLDDGAVRAVVERRKSLLPAGIAAVEGEFTAGDPVELRDSEGRAVARGLVSFDAKEIPQLLGRSTRELARELGPAYEREVVHRDDLVLLQP

SEQ ID NO: 13007 - protein, 181 aa, Streptomyces avermitilis
VRRVRPGAAASRDGGTSRSVGATRAVGEERALTSVAAGDTYDGDTYDGDTYDGDVYEGDSYEREEPVEVPRLWHVTLSVSGGEAPLKEVRRGLEQLAHDHPFLLTSRYANDHAEIRYWEEARDLHDAAAVALRLWGEHRQTAKLPPWEIVGLEVIDRETYHHRVAEGYGPLPATPVGVHPF

SEQ ID NO: 13008 - protein, 428 aa, Streptomyces avermitilis [sequence omitted]

SEQ ID NO: 13009 - protein, 250 aa, Streptomyces avermitilis
VLMTTGAYRCGCFLTLTCESSRQVDEFPYRLPKLTPQVYSGSVPEDVGGTPSFPDGGEPDDDRDRGGMDEEFASVVFDEAFVRAAVVHEPTAVERLLAAAQARAEAQEAEARRAHTRGVRGDDERYEDGFGPDGGDFGHHRDLDDLDDTEVLEGRYGAPGTYGRPYGRQVRWHRPVAWILALVMGVGMVALAFAAVYRGASSGRQEQVPPPASTGLEQGQEAGTGTGTGTGPSASAEYSPPAVSAEPRTP

SEQ ID NO: 13010 - protein, 355 aa, Streptomyces avermitilis
MGGPGNPPEGTPEGAPGGGEDEYRSVVFDESFVRAARLQEFSAQERMGDHAPAVRRRPPLHRGLSRQALILVLLIAVAFGTAIYMGVRHPYQTPKAQPVEPLRMTVIPLAPQSAVPGATDAEALYAHSPAAQFRIGAEGITLPASRRTAHFSDGQVVTALTTVKDYLVESSLDPAVLTGGATRPVRILLDPQQLDQFDQSFDHPAADGRHAPTGWLVRFDPSRAELADRKIRVQGTLQAAETSSDTLEVTADHTLVYALRPTGSDTKAQTSLFTVRRELTFRFDRDDLRMHQAELLVSYVQAGPLACAEDAADHLHPLLAGQTAKAGGPAGTDPYATGSATALCGSLAASAQPKV

SEQ ID NO: 13011 - protein, 376 aa, Streptomyces avermitilis
MSDDSHEHNGHENVPSRQRRRFAGISSRAYEHPADRSALVALRKLSGFDTVFKALSGLLPERSLRLLFLSDSVRVSDAQFAHLNDMLRDACYILDLEKVPPMYVNQDPQPNAMCIGLDEPIIVVTTGLVELLDEEEMRAVIGHEVGHALSGHSVYRTILLFLTSLALRVAWIPLGSLAIMAIVTALREWFRKSELSADRAGLLVGQDLRASMRGLMKIAGGNHLHEMNVDAFLAQAEEYEAGGDLRDSVLKILNVLPRSHPFTTVRAAELKKWGESRDYQRIMDGHYPRRTEDKDASVSDSFRQSAASYASDVKNSKDPLMKLVSDIAGGAGDLGGRVRRGFGGFAGSSPGDAGGSAQDAPPHDAHPDDESPNGNG

SEQ ID NO: 13012 - protein, 54 aa, Streptomyces avermitilis
MSFHSTAAQLVTLAAEGEEHGGNHESLSPYMTGGGALVILLLLLWITTRFNRDR

SEQ ID NO: 13013 - protein, 224 aa, Streptomyces avermitilis
MGEQDMPTGPASGTVHGARRGPGNGPSNPGKRRLGVMGGTFDPIHHGHLVAASEVAAQFHLDEVVFVPTGQPWQKTDRKVTPAEDRYLMTVIATAENPQFSVSRIDIDRGGPTYTTDTLRDLSALNPDTDIFFITGADALGQILTWRYTEELFSLAHFIGVTRPGHTLADPGLPEGGVSLVEVPALAISSTDCRARVANGAPVWYLVPDGVVRYIDKRELYRGE

SEQ ID NO: 13014 - protein, 600 aa, Streptomyces avermitilis
VNDRYDGYAGGDQYELVGYDEFGQPVYRQVPSQPHQGYEPYAGQQQQQQQQQQQQGYGYDPYANGGQQPSPSYDTGQQQPVSSYDTGQQQPVSPYDTGQQQAVPPYDSYDPYGTASTGTAYDPYGRTATGGQQPRVAEQTAYIPQQAGPAESGTGGGTRSAQAAPDGGPESDGRADRDDGTEQFAFVEEPDGDSEDVIDWLKFTENRTERREEAKRRARSRVVALVVVLALVAVGGVGYLWYAGKLPGTSSDAKTGTATATGAQKRDVVVVHLHNTKGGGTSTALLVNNTTTKQGATVLLPNSLALTGEDGTATTLAKSVDDDGSSDTRDEIDTVLGTDIEGTWRLDTPYLNNLVELVGNIDIDTDTDVPDPDSKKKGTAPLVQKGDDQTLSGKMAVAYATYRASGESQNAQVERFGQVMQAVLRKLSSDAQAATTTVQTLAQILDPSLSDKDLGTFLAKLADHAKGGDYKTALLPVQADGTLSTTDSVVKDLLGGTVKSPQAGDAVRVGIKNATGNKDATEKARVVLVNGGYTFVEAGTGTAQTLSRITYADAADKANAIEVAKTLGLPTSSVKKGSVTSNANVSVILGQDYQVSGSTG

SEQ ID NO: 13015 - protein, 148 aa, Streptomyces avermitilis
VTATDRSLELINTAAQAAADKLAHDIIAYDVSDVLSITDAFLLASAPNDRQVKSIVDEIEERLNKELGVKPVRREGDREARWVLLDYVDIVVHVQHSEERVFYALERLWKDCPELALPADAQATRGKAAEHAKLQDAEEAAELDGELR

SEQ ID NO: 13016 - protein, 224 aa, Streptomyces avermitilis
VSSGVGPDAGKKPGRGRRVILWRHGQTSWNVERRFQGTTDVELTETGVGQARRAARLLASLKPDAIVASDLRRAAATATELAALTGLDVTHDEGLRETYAGVWQGLTHEEIIAQFGDQYAAWKRGEPVRRGGGELETEVADRAAPVVLRHAEKLPEDGTLVVVSHGGTIRTTIGRLLGLESHHWEGLGGLSNCCWSVLGEGARGWRLLEHNAGTLPEPVLGDDD

SEQ ID NO: 13017 - protein, 297 aa, Streptomyces avermitilis
MTTTQRRRPELAAFLRSRRARVTPADVGMPPGFRRRTPGLRREEVAQLSGVGVTWYTWLEQGRPINASPQVLDAVARTLRLDHPEREHLYHLAEVPYEPGPAGLAQQIEPEIQDIIDALDPHPAVVYNSRYDVLATNPAYRDLFVVPATIEVAAPNVLWTLFSVPEKDCPVVYRDKELPVMVATLRSSYGRHVGEPAWEDFIRGLSAVSPYFAELWASGEVIPPGPRVKTFRHAAVGELRMTSVSLSINGLPECRIVAYTPEDADARRKVAVLRERREKLWPPSDGHRTETAIADAG

SEQ ID NO: 13018 - protein, 478 aa, Streptomyces avermitilis
VPGPTPATSKDPGTDNRPGRLLAVVLAAQFMAMLDVFIVNVAVPTIGSELHASGAGLQLVIAGYSITYAVLLITGARLGDLLGHRRVHLAGLALFTAASLACGLAQGTGELIAFRLVQGAGSAAMIPQVLSLIQRNFTGEARARALGAYSAVLATGAAAGQVLGGLLVSADLFGTGWRPVFLVNVPVGIVLLAAGSRVLPRGDARALERSRGLDLPGLVLLAAAVSLFTVPLVLGQEEDWPLWSWLSLAAAAVFFVLFCGYESRLARRGGAPLIAPRVLRHPGIGLAVLRLIAVMAVNAGFLFALTLHVQGGLGYSALHAGLTFAPTAVVFGLVGLTWRSWPASWQGALIPTGFAVAALSMAGVGWSLHGGGDGGMRLYAAFAGVGVGLALGFSPTLTTALATVRPEDAADASGLLATVTQLGQLIGIAAFGTLFLNRLESLGAPGAYTSADALLVCMYALAGTAATGAVSGLVRRRR

SEQ ID NO: 13019 - protein, 77 aa, Streptomyces avermitilis
MGAHRRKCDWCGSGTPIVRDMEPVNHDYQYWCEECARALIIKGDPIETYRELEGEPIYGRLLDEHCTLKRFYSFATA

SEQ ID NO: 13020 - protein, 404 aa, Streptomyces avermitilis
VSAVMTLIDLPRVCRRTPVALGACLLSFTAFWIAQRAAHVSMIDLMVYRAEGATVRAGGDLYTLRTTSARLPATYPPFAALLFTPLTVLDPADLRTLATAGNLALLVLFVWLTLRIVGHARVETLWWVSAAAVWCEPVWTTLRYGQINLLLAVLVLWDLARGPGQRWAGAGIGIAAAVKLTPALFAVFLLATGVMAHTRQRSGGPWLRHARAAAATFAGATLLGAAVLPYDSWRFWTRVVFQTGRAGLAEDTANQSLRGVLARLLHTPEPGLWWAAVAAVAGAAGLAVAVAAELRGQRAWAVTACGMTALLVSPVSWSHHWVWCVPMAVVLATLNGAFVLGAALVFCSYALWWVPHGAGRLELHQSGAELTLSALYGGTAFVFLSLVGGALGRTPRSDQAVAKE

SEQ ID NO: 13021 - protein, 524 aa, Streptomyces avermitilis
VVGLPQLTSGFDLVERLDLPMHLKVHGPLEPMGGEQLAQLSERISLKGRGGAGFPFHKKLRSVAEAAIKRGVRPVVVVNGSEDEPACRKDTVLINRAPHLILDGALLVAEALGARTLVIGVTRESTQRSMEAALSERGLSNRRGAAIRARVQRNPIRMVTGAAASLIRSIDGGPAIPPGRKVSASQNGVGGAPTLLSNAETFAQLAIAARIGAERYCNTGLYDEPGTVMLTVSGAVARPMVLEVPTGVPLRYVLQLAGAPPVPQGVLTGGYHGKWIDAATVNEAIVSRNSLDAVGGALGAGAILPISQETCPLGESLRVAQWLADESAGQCGPCYLGLPAAARGMADILNGGGPAALEALKQVAKAVKRRGACSHPDGSAMFLESTVKAFTDDLAAHVLGNGCGRPVEGVLPLFEDGQLPAGISSGQQQEESGPSRQKIYVDWTLCRGHGLCADILPEVFELGADGFPTVAQAQVPRYAETKALRAVRRCPALALRLEEDTRSAPARNNLPVLSQGRGRRALGR

SEQ ID NO: 13022 - protein, 436 aa, Streptomyces avermitilis
MNPRRSNSSLPTPGRSAYGAATAATLLLIPVIVLVGGDGLRDFLNFGAGVLSLVALSCSVIWGLVATDRLFLNTRQRIVAQAVHRTTAISSVAFLLLHVTVKLALDHTQLIAALIPFSLGVTGSAGLIGFGSVAGLLMIFTAITGALRNAFATSYPVAARWRAMHMLAYPAWCCALVHGLYAGREAKPIFVILYSLCLIGVMGALALRAAPRPFKRKVADRIVAIIGNGAPLGREDLEASRARNAESMAGSGGRSGGRSGGSGSRDAEESILAASQRMAASSASPYDAPPASRSMTPEPGNGFAAAYRATSATPRAQDPFGADGTQRMDLPMDMQATEAMPRVDDGASNAPRWPAPSPPPVGEAPRSSFDPMNDTYAGGISYQGYDNSYAQGESNVPYGTYNTNDTYNSGPATETLPGAYDAPGSGEPWNAPSGGF

SEQ ID NO: 13023 - protein, 962 aa, Streptomyces avermitilis
MSETNPAAASEVAAPHRYTAAVAAEIEARWQDFWDAEGTYEAPNPTGDLAGGPALVAKPKKFVMDMFPYPSGAGLHVGHPLGYIATDVFARFQRMTGHNVLHTLGFDAFGLPAEQYAVQTGTHPRVSTEANIENMKVQLRRLGLGHDKRRSFATIDPDYYKWTQWIFLQIFNSWYDEEANKARPIAELVAQFESGERAVPRADGATRAWRELTAAERADVLGEYRLAYASEAPVNWSPGLGTVLANEEVTADGRSERGNFPVFKAKLRQWNMRITAYADRLLDDLDALDWPEAIKLQQRNWIGRSEGARVDFPIDGEAVTVFTTRPDTLFGATYMVLAPEHPLVEKFTPAAWPEGTHDVWTGGHATPAEAVAAYRAQAASKSDVERQAEAKDKTGVFTGAYATNPVSGEQVPVFIADYVLMGYGTGAIMAVPAHDTRDFAFARAFELSMRCVVEPSDDRGTDPSTWDDAFASYDAKIVNSSSGEISLDGLGVVEAKARITEWLERKGLGEGTVNFRLRDWLFSRQRYWGEPFPIVYDEDGIAHALPESMLPLELPEVEDYSPRTFDPDDANTSPETPLSRNEDWVNVTLDLGDGRGPQKYRRETNTMPNWAGSCWYELRYLDPHNDQKLVDPAIEQYWMGPREGQPTGGVDLYVGGAEHAVLHLLYARFWSKVLFDLGHISSAEPFHKLFNQGMIQAYVYRDSRGIAVPAAEVEERDGAYYYQGEKVSRLLGKMGKSLKNAVTPDEICAEYGADTLRLYEMAMGPLDVSRPWDTRAVVGQFRLLQRLWRNVVDEATGEVTVVDAEPDEETLRALHKAIDGVRQDLEGMRFNTAIAKVTELNNQLTKAGGPVPRTVAESLVLLVAPLAPHIAEELWRKLGHNDSVVHQDFPVADPAYVVDEAVTCVVQIKGKVKARLEVSPAISEEELEKVALADEKVVAALGGAGIRKVIVRAPKLVNIVTA

SEQ ID NO: 13024 - protein, 245 aa, Streptomyces avermitilis
VVEAVIAVVALLFLLFVALGAYVTVKAVGAAKRGVDRTLSQARRTVEDTTLRARTFAQPGPVGELAQLRLKLRTSMRATQDALHAGVAEDESLKESLALFDRLSAHGHELDGELRRLETEPDRTKLAQRLPGLRERTEQIIHSADSLRWAARDRARRFADDDLASLSAQIDMEAGALRHWTTERTTPASTWPEAPAPEDATSGGQAWPETPESGTAEEQTRSAITPPGRRPTYPWQKKPRPESTT

SEQ ID NO: 13025 - protein, 281 aa, Streptomyces avermitilis
MSRHVAIVTDSTAYLLPRTMERHGITAVPLTVVLGDQALEEGTEISARSLAQALQKRRPVTTSRPSPQLFAETYRKAAEAGATEIVSLHLSSEISGTYDAAVQAAREAPVPVRVVDTGMVAMALGFCALAAAETVGAGGTVDEAVTAAEKRAAGTSTYFYVDNLDYLRRGGRIGAAQALLGSALAVKPLLQLDDGRIELLEKVRTASKAIARLEEIIAERAGSAQVDIAVHHLAAPERASALADRLRARVPGVADLHVSEVGAVIGAHTGPGLLGAVVSPR

SEQ ID NO: 13026 - protein, 387 aa, Streptomyces avermitilis
MALRSRSRTASPTSGPGRGPVSDGRTRHRHHPRNRAGRRHASAEVLRLRAEALFAEEGGPRPEWGNGPPEADRDVGGPSAGTALGFGVARVREGRGPDAGGVAEDEAACSGVTVGEAGGSGVDAGGVVGAAWRERVGLAVRERMPLWLQSRCGLERRSVAALTVLLVVAAVFAAQHFWSGRTQEVRAPEVVRAAAPFGGEGEGGGREAKPGDPAGARATGDGTSSGTASGTGNGTAAGAGAVIVVDVSGKVRNPGIQRLPAGSRVADALRAAGGVRPGTNMQGLNRARLLADGEQVVVGGPAPAPDPGTAATATGGSGAGTTPSTPVSLNTATADQLDTLPGVGPVLAQHIIDYRTQHGGFRSVDELREVNGIGDRRFADLQNLVRP

SEQ ID NO: 13027 - protein, 840 aa, Streptomyces avermitilis
MRTTQERGPAEPGASQAPAPGASRPAGPLATILGSRPVHVASGSRAGNSHPKQDGPTDLRLVPPALAAWATAALALDASAGWVTGVVLLCVAVAGGLLAARRTGAQGAPAGGLRRPSGERDRWGSWPKASVAAVLLCVAAAAASAGLHGADLRRGPVPALARQYAEVTAEVEVTSDPRLTRPRIKGDHTAPTAVLLDAEVRRLTKADGTVVATRTPVLVIVDAHSRTLAGPRGAPAFSGGGARTAVESRRSPWLSLLPSTRLRVFARLAPPLAAGDRVAAVLRVRGGAPPEVTGEPSGAQRLAGRLRAGLREATDGLDPDPRALLPGLVVGDTSRVTSELDEAFKETDLAHLLAVSGGNFTILLALFIGPAGLAQRVERRGLAPWLGIPLRGTALFGGVLTLGFVVVCRPDPSVLRAAACGTIALLAIATGRRRSLIPALSTAVLLLVLYDPWLARSYGFLLSVLATGALLTVAPRWSAALQRRRVPPRLAEALAAAGAAQALCAPVVAVLSARVSLVAVPCNLLAEFAVAPATVLGFAALAVAPVAMPVAKGLVWCASWPVGWIADIARTGAALPGGGVDWPGSWTGALLLTLVTAAVVLVGRRLVRHPWPAGLCVGLFLLVVVQPPPLTRVITGWPPPGWRFAMCDVGQGDATVLAAGDGTGVVVDAGPDPALVDRCLSALGVDRIPLVVLTHFHADHVAGLPGVLRGRSVGAIETTGFEEPPDQVEFVRAHAAARHIPLTRAAAGERRRAGALDWQVLWPPSDRAPAPDGPNDASVTLLVRSAGLSLLLLGDLEPPAQQALLRSPAAAGLGSVDVLKVAHHTFLVGHLLESFRRQLR

SEQ ID NO: 13028 - protein, 92 aa, Streptomyces avermitilis
VGVRKILTIKLEIEVNEKVTRYSRLENTYGEVVIAAMEAARAHMPTDSIEQITSHARWEYRHWDPKSITYAKGEIPEIEDLTDDEIEWLAED

SEQ ID NO: 13029 - protein, 109 aa, Streptomyces avermitilis
VDSPDESLQACADSWNDGNANKESVASISTAAQAENPTAYVHVGFSSVFPDKCMITVANPSTMYAQQYLQGGGGEWSLAPAWTGSVNDLDGSTLPWNARMAQDGTIIVL

SEQ ID NO: 13030 - protein, 106 aa, Streptomyces avermitilis
MTKCIHGDHEFPFEDETGAYCEEHGVTLLWNPPHFAWDDLLAEPRRLHSSAFPWLSDLTDEQAYEFLGEVIEAAQAAGTHTAFLHALDVLVGQHAPTPTLPHGVMP

SEQ ID NO: 13031 - protein, 117 aa, Streptomyces avermitilis
MPESGHTWRREFKAHPVEADSVRRWVACRLEHPDAPQVANELFVSVLSTGSPVVEMTLSTAGSRARMTAAGSVEMSALQSYGPGFRIISGLSALSGVNTDGQGLWAQLTSKTQGTEQ

SEQ ID NO: 13032 - protein, 252 aa, Streptomyces avermitilis
VAVERPGYLRIAAELRKRISSGEFGIGDQIPTLPALAEEYGVLETTVRNALALLRNEGLIETRARAGTRVRERPPIHRLTADRYRNKAGVPSTPFTRDQGIGWSEYRLDKKYEQVEATMELAALFECEVGEPLLARHFVFHDNDQPTQMSVSYLRWSDVEGSPVADPIHEPWPGGTQAQLASIGIRVTEITESFTCGMPTDHESKTLKIGSGVPVLRYTRRHIAEDGRIVEVAHPIVRRGDTTVVDFVIKLD

SEQ ID NO: 13033 - protein, 257 aa, Streptomyces avermitilis
MKLVTRRQLGWPASAAPTQTSTKGVKVHYEGTAVSVDLLKDHARCLAEWQAIRKSHLANVRENYSDVAYNYAACPHGFLLEGRGIGKRTGANGNQPLNVAHYAIVGLVGSEGLTEPTDEMLSAIRDGIELLRQHGAGDEILGHRDGYATSCPGGPLYAWVKKGAPRPTGTEPAQQYEPFPGAAWFSKGLKSPVVARMHDRLVAVGCNRYKSSANKDTIGSGDVASYEAWQRLQGFTGSAAKWPPGKTTWEALHVPKG

SEQ ID NO: 13034 - protein, 103 aa, Streptomyces avermitilis
VLYTLTLYVLLGIGLAASVGFLVLHRPRRFFRVTEINASWWVIIVGLLYARSLMLLGIRGARPGETWWDSAISIGFLTAIDVLLLVRFFSYLWYLREHPEKRS

SEQ ID NO: 13035 - protein, 74 aa, Streptomyces avermitilis
MWPFARRNQVSPESETAKRAAEKSLKDAQAGMPEAQARLNESRRVTEQLKAHNRANAYSDFIEGIVLGRLHRDA

SEQ ID NO: 13036 - protein, 115 aa, Streptomyces avermitilis
VVPELIRALAVAQEAGGGPDIGKLLGQFAQYGVVGLIVVLLIIGVIVPKYVMSNLLTDKDAWRDAFEKEREAHQLTRQQLAAAQASADVANEQGQAMVRLLEEFGHRPQTAPGSA

SEQ ID NO: 13037 - protein, 315 aa, Streptomyces avermitilis
VDVNRIFGELFPGARQFAQSALDALSKDDEQVFLLHAGVSIERLAKAVLAQKSPFLLLETKGNGNEDALFQIAGLEQGKKIRTIGAATAIARLKRLGVLPQTKDTELDELIELRNGVAHLTAAHDGSFDALAKFVGTSTTLLTAWGRSGPEHYWGPHYGLVELTLSEAGEKAARHFSRLVEQARYRVAQRAQALPQTAMEALLKERSINVAMTWPNSRTVLLPHKCPACGNLGALLTGPPVLITSGKPGEAFPRRFFCPICELDLRTPEELTSAGMDSRVPLVEANGERVLTEAEEALWHQFPDGGGDENVSAAR

SEQ ID NO: 13038 - protein, 66 aa, Streptomyces avermitilis
LENTMQMTPEQLVEEYRDTVLELHLTRRHVSALETENASLRAQLAPAEEQGHSHSHGEDGGHSHND

SEQ ID NO: 13039 - protein, 562 aa, Streptomyces avermitilis
MARHLFGLSPADVTVSQSGTSLVLQPGSVGTAWDARSGGTQITDLTDLSGTPITTVTSDSYSVIGFYGPDGVTTIYLDFGFSGGRALMQATDLGNAIDDLQTNKANLAGDTFTGPVVLSGTGSDLTVGGVVNTTGPATVNLGSGSPSYASLPKGIAGRSENAGLIIGSSYIGGDDDGTGTDSTGRLNLYSYQRANVGSFGENIRHFMMRSDAKTMQAFYIPVQTSNKKGGYDATTRDPLSTGVSWKPVVWQGAHYEANDHGSVHGHWELEVADATGALQGRLEIPFIDQSKLSNAVDTTTIGIAWTNIRTNLADFSIRAQNITSGDYAGQNTALRIGGNNTVNKDVLLSISSDMQNSGRRWGFRANTDTESTGNAGTNFQLLRYADDGSQLGTALFVQRADGQITTGSPAAKGARLALVWGTNAVQGFSAQPSSSPGAAAGFDAVMTATTDRAYQANVIGDANRRLVVFADGKTEWGDGTATRDANLYRSAAGRLKTDTAFSVGTNLLINTTSVGAGVGVLGIANATTVPTANPTSGGVLYVEAGALKYRGSSGTVTTIAPA

SEQ ID NO: 13040 - protein, 342 aa, Streptomyces avermitilis
VTQSSFPFGSSQITTEDQWSSYFRMFQVDGVFATSENGTDLKVTASNASTVSLGAGEAVVQGTYYANTAALNVSVPTNSGGGSARNDLIVLRRDPSADATTVQYKTGGTSFPSLTQTLNGTWEIPLARVTVAAGASVVPPAGVTDVRWFVGRPPVVGSAAYRRPPVRGQLHVDNGSDVYLGDGTSWKYLGTAEDPAASTYTPVWDAGGTAISWGSGSTNIGRYKRISGNLYWVKIQLQPTGNPPAYDDPIRVTLPFTLQGSTRDLFNVAFSQATANGGLSFVGTGMTFPTEANNKIARIRVPLSEGISGTSGGINSRNILTNSPFNIQNGDILTITGTFEAA

SEQ ID NO: 13041 - protein, 396 aa, Streptomyces avermitilis
VEMAFDQPRVTVQVRDDSLDIVGVVDDFTALTITPRFNAVGAYVLNIAADSPKAHLLVPGNGLVIRRGADVLMSGPIREPNWTRSDNDGGSGTLTVNGVDDMTLLAGATCWPNPTAAPGSQTDSVYKISGVVAETAMRALVNLNIGPGAQAARKISNLTLAADGAHGASITKQVNQFDNLLTALQDIAKTAGLGFRIVQVGSNLQFQVYEPADLSASAKFSFGLGNLTDASYSVTAPTCTKAVVVAGGGSSPRVVSVTTRADAAFPGPWIEQFVDLTSVDTASVDLTAQMNQAANEALTSGAAQGNLTMTPIDTPRLQFGRDYTVGDQVSCQVKGDFFADVVREVSISFDAQGGYLAKAVIGSSDSTNNQDVLARQFQYIARIFNKLRRLETRKPS

SEQ ID NO: 13042 - protein, 311 aa, Streptomyces avermitilis
MPIFVRPSGIVLPGGINPPPVQPLEVPSLSWTDARGRTTLLSDWESGWVLQPGIRGLDLPGYDFYTDASPGIDGNALRGLRAQAREVFLPLAFFDVDRSGFMARKRSFFRTLNPSLGLGTLTLTESDGSFRSIEAYYVSGAEGDFGQDTSGLHWQTVGLTFSCPSPYWLGAAVHQEYAAGATGSFFPVLPVKVRDSQVLGNTTIDNPGDATSFPVWTIHGPATSAVITNNTTGLNFSVTASLGSSDVLVVDTRERVQTAVLNSSQNWWPNLATDSDLWGLEPGENDVSLTLVGTDSNTTVQLDYQPRFLTA

SEQ ID NO: 13043 - protein, 1142 aa, Streptomyces avermitilis
MTTTVGRVEVSIVPETSGFAAQADAALTPAMERLGQKLGRTLSRSMTQALDFSGIDNALRRSLDTAEASAASKGHQIGKRYGQAMKAGLSTELRGLQGTLDVTIRPVIDRGAYRAVQADLNYLTRPRTVSINADADTRVAADDLALLTRARTQTVTVNLRTDEARSNLLDFRRAADDASGAASRATESLSSASGAGGLMGALKGVGVAAALSALPALGALVPMMAGAGLAAGTLKLGFAGVGDALEQAGKDQKKYEEALKKLSPAQRAFTKAVVGLKKEFAPIGREVQKAMLPGFTRAVKDAGPVVKILGKHMTEMGEAFGDAAEGVGRMLKDSGFQDDLQANLKLGSQFVREMTSSLGPFTRSLLDFGAASGPTLRAFSDGIGGLLSKGLPSMFSGLRAGIPGAAKMLDGLFSAIDDVLGGLGRLSGEVARDLGPVFGEQFALSGSIVTGAMDAIRGAMVLLRPVFKDITFGLKSVRDIAAIIGPTLRDTGLAIFSAFAPVGDSVNGAVGPLQRLNQAIAANKIGILEGARQFGNAVIDMTSAAITAAPTIIHAFTLVSGGILSALSGVAHGAALAFGWVPGIGGKLKAADKAFGDFKDSYIEGLTTAESKASHFAASTAPKLAAGKLKLNINNWSDQLAEAKRKLATVPPSKQSALKATIKDLEAKIRSARGQLDSLDGKTATTYVKTVYEKVEAQNAPKFRARGGPIKLAAGGNPSGLVRGPGTGTSDSIPAMLSNGEYVIRAKSVAKYGMAFLNAVNQGSLGISRLASGGLAGSEVANGLASGMTNGMSKVNDAARVMAAAVEAGVRTELQIASPSKKMQALAKEIGAGLIKGLTGSRDQIKSTSASLAKSIWATFSGSTDNRLVATLNQQTKKLLDLAAKRDKVASSLAAGQQMAKDQKAAGLSFASMTSLPNGGNTFDAGGILSGLKVRLGQLKTFSGNVAKLAKMGLSKDLIGQIIAAGPDGGAAYAAALVKATPDQLKALNSAQSQIAKVSSSYGNSAADIMYDAGSQAGKGFLTGLKAQQKAIENSMSDLAKKIQAAIKKALKIKSPSRVMAEIGEHVGQGLVMGMDATHAAIVSSSNRMATAVQRGVATEPAQRAEQGRTVIFNAHTTDKPTRQTVMDALRDSHALYSPLVA

SEQ ID NO: 13044 - protein, 132 aa, Streptomyces avermitilis
MSWLELWEFVLALPYDSMTKSAMAGDHGRRRWTESDYMLRELLAVAQFQARIAWAGHHIEGKVPDLPLWEEPDRRSPEQIEADRELAVARAERARKYHEATKPGSQDTEYAKKLAAALAEHQRVAAEETAAS

SEQ ID NO: 13045 - protein, 110 aa, Streptomyces avermitilis
MTQPNRKRIKLETLRAQRLEATGTKELEVIVEDEKFVFPLFNWLPIATYKKIQSLPDKNDLIAQTEILLGKEKTERLFELGLTTGDLLDIFDALQADAGVSTGESTSSSD

SEQ ID NO: 13046 - protein, 205 aa, Streptomyces avermitilis
MPVFVMATTTGEESMSADNTQVRVGVTGAVYVAPVGTTAPTEPYTPWGANWIDLGYCTEDGLTESLNEDRQEFKGWGRKRPLRTQITNRTNTFKIVTQETKAHTVSLFYGVDIADMTSSGTGDTQFISWNEPENPEPLYYALGMDVIDGDYPKRITVARAEVTAKGDIVYKADQTVSYDLTFTALEAASGVSAINYMLGKVPLPA

SEQ ID NO: 13047 - protein, 147 aa, Streptomyces avermitilis
VTVPLTSLVFPDTEQMVVNHLLEVLGYEASTVRPDGGAFTEALPFIWVNRIGGVRVTRTSQGRSLHDEARISLDVYATEGANTSSRVAATDAVAQVRAAFEQMHGTSRDGGFVLRTWEETGPAVRPEEPNTNVTRIGLIVGLRVRPV

SEQ ID NO: 13048 - protein, 79 aa, Streptomyces avermitilis
MATFKLTFPYKGRWPGDVVEVRDDEVRDLVQSGIGHLEGAEPVLRLGRLPEVVQPPEAPHEATEAPPEPVKRRGKTSAD

SEQ ID NO: 13049 - protein, 94 aa, Streptomyces avermitilis
MGAFQPNKVAIEALGFEDFVQQDLHERAGRVVDVAQATAPVDSGRFRDSIHAEDGSDGEILVVSDLEYSVYVELGTREQAPHNTIATALDAARD

SEQ ID NO: 13050 - protein, 113 aa, Streptomyces avermitilis
MLLLPTDDVTILTRPEATRDRQNNRVVDWSDAERTTYRARVQFLSSTETEQQGDQVITDLEVFLPPEAVVTAVDQAEVDGVTYRVHGKPQVQRGAGPIAQLDHMRIVLREVTG

SEQ ID NO: 13051 - protein, 131 aa, Streptomyces avermitilis
MAYATVEEFTDYLDPDPVPANASRLLDRASTKLDRLLTGAVYETNADGLPTDPALAAVFREAVCIQAQYIGALGDETGANANVASMTLGNQSIVRALGGRDGKGTTPRVSQDLLDLLQVKGLLPVFPRVWG

SEQ ID NO: 13052 - protein, 111 aa, Streptomyces avermitilis
MARTALTPQRFATTGLTATYVTPDVAGVSLRSSGKQVLHVKNASGASITVTLKIGRTVQGQAVTAPTATVAASAERFFGPFPDDYEQPDGTDTVFVDFSAVASVTVACLSL

SEQ ID NO: 13053 - protein, 440 aa, Streptomyces avermitilis
MPVTLSEAKNNATDAVDVQVIDEFRKESAVLDALTFDDVVNPAGGGATLTYGYRRLVTQPTAAFRALNTEYAPSNVQTQRYSVDLAVLGGSFEVDRVIAKVGPAASGAVALNMAQKIKATKTRFQDAVINGDVDGGEDADAENGFDGLDKALRGSDTEFRATQTTNWSDFDTNPASAQVALDTLDEWLSLLDGAPTMVLGNKTALARVRALARRAGQYVQSPVDGLLGPGGRPIVREQYGNIVFVDPGEKPGTSAPIIPIETRDPDSSTWTLEVTGSPTGGTYTVSVTVGGSTQTTSGIAYNANASTVQSAITGLSNVGTGNATVSGTTVKTLTFTGDLADLSVGVTASGASLTGGTSPAVAVAQTGNSAVSGLTDLYAVRMGLDGFHGVTTVGGQIVSTYLPDFTTAGAVKKGEVEMGPIAVVLKATKAAAVFRNIKVQ

SEQ ID NO: 13054 - protein, 209 aa, Streptomyces avermitilis
MATPAEPGTGAENPGIPPEGTTPPEGTAQPESVKDDKGSKSGETNWQAEAEKWKAQARKHEDRSKSTTTELQRQSALLAQLAEKAGIKLDDGKPDAEKLTQQLTATQGKARQSAVELAVYRAATKHSADADALLDSRGFLKQVDDLDPDADDFATKVGDAIKAAVESNPKLKTAPAPPARSGTEMSGRGEGARKPTNLADAVAARMRGN

SEQ ID NO: 13055 - protein, 525 aa, Streptomyces avermitilis
VMGTAWPPPELADVFAQQDIWSAWYAGTPEGLTDAYLNAPNDRPAARRKGLLARLGRWFWGQPTPMGERPSKLHVPLAGAIAAVSANLLFGAPLNLTVDDAATQERLDQLADDTTYAVLREAAEMSAALGGVYLRVVWDQSIQDKPWLVAASPDIAVPEWKWGRLSAVTFWNVIREDANTVVRQLERHEPGWIRHSVWIGSANELGVQMALTDFPETAGLADLVIDGDGIPTGTPKLTAQYIPNLKPNKLWRHLPAAANLGRSDFSGVEALMDALDEAYSDWMRDLRTGKARLLVGTEVLENLGKGQGAHFDIDRELFAPLNLEPGEDKGSVIEQVQFNIRTEEHRALCADLAERIILGAGYSLQTFGVTSEGSGNPTATEIAARERQSLTTRANKTSYWRPALAHLFGVLLEIDRTVFRSQVVPQIPDVEFPDVVTPDPGETARQLNDLNTAGAISTYEKVRRLNPDWRDEQVLEEVARIKADQAEAKPQPTHPARAQEPAGQPEKSPEGSQVNEDVSEPLVAR

SEQ ID NO: 13056 - protein, 432 aa, Streptomyces avermitilis
VDLQPLTAKQRLGVQISRQHQITIYEGSVRSAKTITSLIDWLDFVRNGPPGNLLMAGKTTRTLRQNCIDELVSILGTQLCSYNEGKGVLTLLGRRIIIASGNDESSKDKIRGLSLVGAYVDELSTMPESFFSMLTSRMSDANPRLIGTSNPDSANHWLKKKYLDKARVHLTRTGEVRTPGNDLDLARLTFVIDDNPTLTPTYVQQRKAEYAATPLLYKRLILGEWCIAEGAVYEVFDDQRHVVDIVPEIVQWLGVGLDYGTSNATAALLVGIGSDGCVYVTNEWRHDGHTEEQLSDGQISQRLRTWMRTLTVPGSRDKGIEPPRLIVDPSAASLRKQLQLDGLGSMRAHNKVLSGIRIVANLLAADKLRIHRGCTHLLDEMASYVWDPKASLLGEDKPLKQDDHSVDALRYAIKTTQHIWRPHVELNFEEVA

SEQ ID NO: 13057 - protein, 162 aa, Streptomyces avermitilis
MARTFSEADEATLRQLHADGVSRNAIARQMGFAVGTITNHARRLGLSFDREAVRAATDARQVDLKDQRQQAQQRLMDFFNHQLDRAESRYLVTGWTHTGAPVAEWLQEPPARETKDLTSAATQALDRALKLAQFDAEHDDKNLSAMDRFLGAMLSERPEQDE

SEQ ID NO: 13058 - protein, 81 aa, Streptomyces avermitilis
MATVENQNLYEFLQSARVSEIELKYPDEVKRISRTPLDSKVTCTLLELARFAKRVRDEAKAESLDEFKAWGHDRPVKTTLI

SEQ ID NO: 13059 - protein, 158 aa, Streptomyces avermitilis
VENPSPLPPNVPPRPSGAPTAHTTANSTDSPDGWRDEYENDPEYQRILAGVERPWWKRPVALWGGVVAVAVGSFFLGGAVLGSGDNSGSPSQDSWVQDQVDDQPQGNQPAGISLAQKSQILSKYCNRQAGGPYNVSEAALLECLQSYEVTDQGMVMPK

SEQ ID NO: 13060 - protein, 69 aa, Streptomyces avermitilis
VEDEIWLTIREASDLTGVSPQTVYSWIRRGHLKVEGLDHRGQKLFRHLDVARAEMATRAKAGRVLVRAA

SEQ ID NO: 13061 - protein, 207 aa, Streptomyces avermitilis
MMIVMQPEVLSGLIGFGGALVGGAASFGGVWLTLSHQRKLAREARLAEIGQEAADKALNELITLGEFLGSVRSDVATMPTDERASYLDTVFGHMENVERAVARIPNRELRNRVKSLLIVMRRFRAAGVRHFFAVSWLAELTDELTDLLSAYIRSDPLPSLSERTEEKQRRAAQHELAERRRFELMQDPDPANVDPREEDADDDGPAS

SEQ ID NO: 13062 - protein, 186 aa, Streptomyces avermitilis
VNHMTIALFGLNKDYTVALVGLTGTLLGAVVAFLGIRWQVNRQEREKQLDHATKECGRALLTLLRLFRKEPEYVSGDAPESWKSDMTDQVDVLKLTIPLFHHKDLRKRLNSTVDILADWHYVVFDGPGGHEYPESAPVIREVLQHAVDCIGAVRRGARRLPEETEAFRTAIGNISEFWAYDADSRL

SEQ ID NO: 13063 - protein, 171 aa, Streptomyces avermitilis
VGIRLPAPELTAPGTGERPADARASGIASTTRQAKRHTVPMAYDLSKGAPAPKPEAQIFKGYVATVTLYADRAQIKRKLMGKVTGAKDAVIPLGDVIKVQSKEPTRLVNGYVQLATEEDRGQLRIATAEAQKAIANNSRTVLFTWNQRETFAAYLAAATAGVQAQGGNPFG

SEQ ID NO: 13064 - protein, 53 aa, Streptomyces avermitilis
MDYAAMYRQAMADGSTDYAHTIVVSATQAAEAGGVSPEELRDLVNEIKAHEEG

SEQ ID NO: 13065 - protein, 222 aa, Streptomyces avermitilis
MERLAKGSSALTVGTARGITAWLKAGEKVSDYVVRVIFLTIPGGVLWGLLSASRAFMWLLVVIWCIAAWRAAQPAQEKSEAKEPDLHPDDLADLLWELAGDRKGVHLSQVAQQLTKETPGRTWSVKDVRRLMEAAGIPTRHSVRVQGIGVAVGVHRQDIPGSPSPAPVSPSPQGVEPQVNPATATATTPYVRDLGGGATATFTPDPQQPNRTHVTVVRPTED

SEQ ID NO: 13066 - protein, 178 aa, Streptomyces avermitilis
MNSVTTATVSLGAVTIGLGILAWHLTKWWRGGGKGPGPGGGGGRDPKALIPLLSSMSLGMIAITAAGGLIGTAAGFLLNTGSLIGNWSLTAATGTVTPEVTRSGLKALSPGGCALLCIYFVVCVALWKSGAKLLKGKIAAGVTAGVMLGLSAGFSGMASVALVTITNTVGDKITGVVL

SEQ ID NO: 13067 - protein, 130 aa, Streptomyces avermitilis
MTDKIPDPPNYPPYSAGCAPTEVHVHLTTEQPEESRWDFRWLQLGRNTKCLLVSVITAPWWAGALRDVRTEQGQPGAWFMAGAALCAALWFDHIRQRFVTRVFVWTAALGAVGALPLLSAFVRMMTGSPA

SEQ ID NO: 13068 - protein, 314 aa, Streptomyces avermitilis
MSPPVPKLEPTLAPLTPSGSTAVPTTPLPLLVRAAITGGRPAVLAAALALSAPGEYRLAVLAGWDWRFALIMPGVLSLYASVAAAIAGSLPKGSTERKQANAGALIALALAMTAQVASHLIEAGYLDKSPAVVVAVSAVPPLVAAHTLHLTAAATRLTPKAVRVEEPVSVPAPAVQESLETVAPEPSRQNALTAPPVPSVPLVTPVMEADEHEASEEPQEADEAPEDEPEVTEEPEPVTEPEKPRQELTQRDRIDQVIRALYDELGNRRPATRHMVAALTDAGLPNSEGTARESRKRVELAEPHLKDLPDAIAA

SEQ ID NO: 13069 - protein, 215 aa, Streptomyces avermitilis
MNLYECFVCGTPQEAKTCDRCRSRIRGDLSALPELYRGLEGCRQRGQNGGGDGRSSKRLHAPVPGDERVLNLLGPASRQPVTDARDQTGETPFLALLESWCQAVSEERALDHVKTNVTAMTAMLTAHLPWICDQPWVVEFAEEIRALVHTVQRITMTQPRKELLRGVTCPSCEGLTLVRHFPGDWSAECALCPSVRLDERDYRLLVQSQAQGLTA

SEQ ID NO: 13070 - protein, 74 aa, Streptomyces avermitilis
MNLTAVADALALEDSETAMHLGVLLALAHQVAQGQPARIHEVLSQTPEIPEGATRGEYAALLRLTVLEVHPLRI

SEQ ID NO: 13071 - protein, 515 aa, Streptomyces avermitilis
MRGRRADVQREPHPGDPVRQLRPPSPRPRHRHRPDRRGRPPDAEGPVTLSLTDLFCGAGGSSTGAAMVPGVQVAFAANHARDAIDSHQANHPDADHDLADISEVEPTRYPRTDLLWASPACTAHSLASGKKQGHGEYVDGVKATSGIDEAAIKSRATMWDVVRFAESHQYRAMIVENVVEVMQWGPPGKPGAVFKAWLDSIRAWGYEHRLIFLNSMFAQALGPGAPQSRDRFYAIFWRSGERAPDFDKWLRPQAECPTHGPVRVVQRFKRPDRLYGKFRSQYTFRCPYTSCADQALEPKARAAAAAIDFSLPAKTLGERKRPLAESTLRRIRAGYQAFASDHLLVPVEGRQGKVARPAHLPLRTCTTRNETGLALRYMVELRGGASSHRAITEPLAAVCAGGTHHGLVQAPAMTLPYYSTSKARPAAEPLGTVTTLDRHAVLPGGEIEHFEDLRFRMLEPSEYARAMALPDGYILTPTSKRNKVKLIGNGVTPPAARDLVAMVVEAVTGEALEPA

SEQ ID NO: 13072 - protein, 145 aa, Streptomyces avermitilis
MNQPTVSLNDLIRTRIEEIAEDLWANHRVMQVPSGEARWLEVGHAVVAEQWSCHQNHGDGVCGEPLVPYQVAKELLGCPEDPTFPEDEFKRELIPFDHLDPIWGFNASELIHFSDVRAMHGVYGEPFNTPDGIIEWRYPDEGAQG

SEQ ID NO: 13073 - protein, 80 aa, Streptomyces avermitilis
VSALDQYLVCSGPEMVQDLVVLEDGCIEAVTTREIRVFEYQADRSLKELFGPDKDRALTAFWQDVERFNELNDISGGNDR

SEQ ID NO: 13074 - protein, 75 aa, Streptomyces avermitilis
VNAQAIREVLTDTELAPSTRLVWAYLNVAAEPQNSSSIGHDLGFCHSTVSHHIGALKDRGLVRRRNGVWLPEVPQ

SEQ ID NO: 13075 - protein, 286 aa, Streptomyces avermitilis
MSVSHLPSIFRAVQEIFPDTALRMGFSTEHKAAFVVAADLGKAIDYKADAESFIRSLVKGPGDSRTLYVGNELIPTAGGLQTMKVIYKRGAFHLMMRSNLPKAAEYRDQVFDLLEQIEREGFVVNASAPVEQLKTMKPLVEQTIDELLEARLQERKDYRSIIRAVRDAGGQDRDFADVQNMIYLGLFGMTAQTVRERQPQVSGERYKREYRSAKAGDLRPSKVAKDFLTKEQLKALDDGVNYITSVLNLQCPDGVMTLDDIKGAALDFGAHMRSLRARRAGSGVAA

SEQ ID NO: 13076 - protein, 485 aa, Streptomyces avermitilis
VVSGCLCWGPDATKPPGLVTPGAASEEFKFLGSRRLLHLSGPAVPAHLHETGTTLKNVANSSGSSPSGHVDLDAVNSLHLVEMAARSVGRSETLIEHLLSWQIETRPFLSGTRGLARWTNLSDKTVRATVGPEGGLSEFKFLWTRTRGSSSALAEERDSMEVRFRSNSGGDYRSTSPKDLQAPGGPLAGGLGDLDKKQGKEGAWWGNAVVTAAISERAQEVLANGLKTLSELDTMKGMEQKARTLRALDASLDVWSEVQGPDAPEFALGRQAWKLAVLCGLRDVTLSTDDIAGLLGLAPKSVRDLLARMTKAIPGLVRKVRQGRSFVYEIAWAQVFDEAMGDMYDERVSRHDIRNRRAAQDKALQATAARRGTGAGYLAYRLSMANPKRAEYLERNPLPEGADGAWRALVEAGDELALYEHLRAQEAEAGPVPSTPAVLVEEAKEVTSLNPLLGQPAQESLEAPQRIDPEVLAAMRARICASTYA

SEQ ID NO: 13077 - protein, 113 aa, Streptomyces avermitilis
VVIPEAVKAPEPEKPGEPSQDELRAAYDYLGLRETSEGLEVTQRGVQSALGTVKKIAREDPSSAEARVMAMGAADDDRIEFLRCVQLDKLSKVMAKRAAGDPRWLGVATPPRI

SEQ ID NO: 13078 - protein, 81 aa, Streptomyces avermitilis
VQHVAPSNSPYITCIQCESTWLTETYEAANGIGGSYSDEFTYECPTDGYHVPECTCACCVYSDCGHDNDKTCFDPNRELKH

SEQ ID NO: 13079 - protein, 82 aa, Streptomyces avermitilis
MSLEWTQKAYYEASGGDRVGLLSLDDGHSAVVWAYADPHCSMQVISFDPDKALEVFEISRNGAENREGLRYDSRQAWDGGSL

SEQ ID NO: 13080 - protein, 63 aa, Streptomyces avermitilis
VGRGFPVSEQLYTVTAFSNDYEHKPSRGVVYQVVDATEEYVEKLKAREAEEHPDRWLKVEAQG

SEQ ID NO: 13081 - protein, 124 aa, Streptomyces avermitilis
VLGCPARLESRGRERLVPDRRSERIRARSAGVPDVKGLVVIDPEAPGGCRKVSYGPVVNGRPLRSPAMRKLIGNLVKDQVRWAEREAKEAAWVERQMATAPPLTMVQTQMLRRVKTDLTRAAQL

SEQ ID NO: 13082 - protein, 279 aa, Streptomyces avermitilis
VSAATRNAFRSLATDLTIRIVAELWEDHGFAPIPPEELKYDDPGQRRTTFMLYAEGVDWGDPEHVRRALLVFEDFIRAYRDPDQQGTPKWLEDIGVRLERDGFLLDKSGRISWERAPVRLLDRDLSTLSDGSGIAVELERIRRDLTTDPHGAIGAAKQLIEATAKTALRELSIEIDKNAALPTLVSTVQKALKLDAGSAPDGPDGSKAVKKILSGSVNIAVGVAELRNQGFGSGHGQASAPSGLGVRHARLTVNAAVTWCELILDTLADPAAPWRKGQV

SEQ ID NO: 13083 - protein, 500 aa, Streptomyces avermitilis
MKTSARDRVRRVGIYVRISDDREGGGLGVKRQEDDCRLLAASLGWRVIEVYIDNDVTAADRRKKRKDYLRMLADIEMGCIDAIVSWHPDRVYRQPVELEHLINIVEDHKTEIATVKAGDLDLSTPTGRLVARMLGAIAKYEVEHKQERILRKIQELVEAGKIHNSGHRPFGYTRLFDGEGSRRKILGEILNEEEAAHIKKWARRVLEGEKLGTLVAEANEAGIKTSTGGAWSYQAMRFLLMSGRISGRKEHRGEIYGQAVWPKIIEPEDSDMIRALLAERSEEFKAEYGERDTPALKYPLSGLVKCTCKVSHVAGEPCSCKEEGKKHHRMSTGQRGDKDMPIYTCKKDGGGCGGRTIQIPDLEPLLEKLLFKRLEEVEAAAEADDNDPRPALEAKLARWERRKKELGDELLDGDRPAREIRDAIDTLNGRMAGARKEIAQYGVKANLSEVSAAELRKAWKDYSVARKQSTYRGLIREILIHPATRPFNVWNPDRVEVFWK

SEQ ID NO: 13084 - protein, 118 aa, Streptomyces avermitilis
MTEPIAAGKPESLRRLPWTGPEGSAEYAAPEDGVEQIADRTEAHLIRMARNDAAYALTMAERPEVSRTDLCLLVRKLAGAVGDVASVAELRGERLNEPIYAPAVRALEEALRAALSQR

SEQ ID NO: 13085 - protein, 88 aa, Streptomyces avermitilis
LQDGTGTVSPQQFSEGIGTMNAIPEYEFVSAAACRDKKVGNCPQVAVNLPGVVALRDSERPETIVTMTPDQWVTLTDAVKAGEFDLSA

SEQ ID NO: 13086 - protein, 84 aa, Streptomyces avermitilis
LASRRTGVPEWEGTSMTREQWETTQEAAEAAWFRKAEWQRITRQLEALYGAMRAGDTSVYTRQRIGRLEALQQALCGFPEQLAA

SEQ ID NO: 13087 - protein, 538 aa, Streptomyces avermitilis
VSVLRLSVLTDETTSPERQRAANAAAAAGLGIDLGDREAVDLGVSASKTTPFERPELGKWLRRPDDFDALCFWRFDRAVRSMADMDDLVKWARENKKVIVFAEGPGGRLTLDFRNGVDLITELILKIFAFAAQFEAQSIRERVISAQDAMRVMPLRWRGSRPPYGYMPAPLDGGGWTLAQDPEAVAVIERIILELMGDPSKSVLGKSAADVARGLNADGIPSPRDHWSLKKGRDTGGKTGGRAGETVTRGRFTWRHGSIKELLTSERMLGWKTQDNKPVRDSEGKPVMATAEPILTREEFDAIGAVLSERSVDNKKVDRVDTMALLLRIIHCEGCGQRMYLHRPSANSKSTSKTETYKCGALTRGQKCDAPSIIKREWAEEYVERQFLWMLGALEVTHTRTIPGYDPQPEIDATLAEFEEHQAQRGRQKSNAGKAAWQRHADSLDARLADLESREKTPPRVEEIRSGKTYSRIWASADTAGKRKMLQDAGAHLNVKRSSRGGWRKLDERRVDFTVRDPFFAEAASELTSMGDELAANG

SEQ ID NO: 13088 - protein, 279 aa, Streptomyces avermitilis
MNSAQADAYLRRIGVTHPAWPTVDVLRELQLHHLRTVPFENLSIHLGEEIVLDEKRLLDKVVGARRGGFCYELNGAFGALLESLGFDVTLLAARVYGEEGRLGVPYDHLALRVRTVDGGDWLADVGFGAHSHYPLAFGERGEQVDPGGTFRVIEAGVDAAGARSSGGSAASGDLDVLRDGKPQYRLETRPRVLGDFVAGLWWHSTSPKSHFTQSLVCSRVTEDGGRITLSGRRFTVTAADGRKEVSDLGTDEEVLGVYRERFGIELDQVPTVQKRGEIG

SEQ ID NO: 13089 - protein, 81 aa, Streptomyces avermitilis
VSDVRHVLVLPDRDAAQEAAEALGERFALDEEPQLVRDALAGEDDAEDAQWLLVLRDERGRLDPKELDEFAGEWDGWREEP

SEQ ID NO: 13090 - protein, 336 aa, Streptomyces avermitilis
VARGMLGAMAKKTAHDDPLAPVTLAVGQEDLLLDRAVQEVVAAARAADADTDVRDLTSDQLQPGTLAELTSPSLFAERKVVVVRNAQDLSADTIKDVKSYLGAPAEEITLVLLHAGGAKGKGLLDAARKAGAREVACPKMTKPADRLAFVRGEFRALGRSATSEAGQALVDSIGSDLRELASAVSQLTADVEGTIDEAVVGRYYTGRAEASSFTVADRAVEGRAAEALEALRWSLSTGVAPVMITSALAQGVRAIGKLSSARGGRPADLARELGMSPWKIDRVRQQMRGWTPDGVAVALRAVAEADAGVKGGGDDPEYALEKAVVAIAGAARSRRG

SEQ ID NO: 13091 - protein, 56 aa, Streptomyces avermitilis
VRERAGRMCVSEPAAVVTAARDSPPPPLPVPSRPWELPPPDPRFGLHGLVLKRRTG

SEQ ID NO: 13092 - protein, 88 aa, Streptomyces avermitilis
VANIKSQIKRNKTNEKARLRNKAVKSSLKTAIRKAREAAAAGDVEKATEYQRAAARQLDKAVSKGVIHKNQAANKKSALASKVAPLKG

SEQ ID NO: 13093 - protein, 622 aa, Streptomyces avermitilis
VPATPNNVPEPSRTDPALIRNFCIIAHIDHGKSTLADRMLQLTGVVDQRQMRAQYLDRMDIERERGITIKSQAVRLPWAPTQEPGNTHILNMIDTPGHVDFTYEVSRSLAACEGTVLLVDAAQGIEAQTLANLYLAMENDLKIIPVLNKIDLPAAQPEKFSEELANLIGCDPEDVLKVSAKTGLGVEALLDKVVAEVPAPVGVADAPARAMIFDSVYDSYRGVVTYVRVIDGQLNKRERIRMMSTGATHELLEIGVSSPEMKPADGLGVGEVGYLITGVKDVRQSKVGDTITTLNKGATEALGGYKDPKPMVFSGLYPLDGSDYPELRDALDKLQLNDAALVYEPETSAALGFGFRVGFLGLLHLDVIRERLEREFGLDLIATAPNVVYRVLMEDGSEHTVTNPSEFPEGKISEVYEPVVRATILAPSEFIGSIMELCQTRRGTLLGMDYLSEDRVEIRYTLPLAEIVFDFFDQLKSKTRGYASLDYEPTGEQASSLVKVDILLHGDKVDAFSAITHKDAAYAYGVRLVAKLRELIPRQAFEVPIQAAIGSRVIARETIRAIRKDVLAKCYGGDISRKRKLLEKQKEGKKRMKMVGSVEVPQEAFIAVLSSDDSGGSAKGKK

SEQ ID NO: 13094 - protein, 636 aa, Streptomyces avermitilis
VSDTQTLIENRPPSVAALFLERVAATPDAEAYRYPVPSPKLSASPEQGGAPAGQGPDDWKSLSWAQAAERVFAVAAGLIELGVQPEQRVALASSTRVEWILADLGIMCAGAATTTIYPQTNADESAFILADSESKVLIAEDAAQLAKAVEKRAELPALTHVVVIDPTGVESSDWVLTLAELEARGAAHLEKNPDLIKEKVGAITSDQLATLIYTSGTTGRPKGVRLPHDNWSYMAKATAGTGLISADDVQYLWLPLAHVFGKVLTSGQIEVGHVTAVDGRVDKIIENLPVVQPTYMAAVPRIFEKVYNGVAAKARAGGGAKYKIFQWAAEVAREYAKVSQDNFRRTGAASVPFGLGAKYKVADALVFAKIREAFGGNLRACVSGSAALAPEIGYFFAGAGIHILEGYGLTESSAASFVNPGEAYRTGTVGKPLPGTEVRIADDGEILLRGPGIMEGYHGLPEKTAEVLEPDGWFHTGDIGELSPDGYLRITDRKKDLIKTSGGKYIAPAEVEGQFKGVCPYVSNILVHGADRNFCTALIALDEPSILEWAKENGLAGKSYADVVAAPATVALVEGYVTELNGGLQRWQTIKKFRLLPRDLDIEHGEITPSLKLKRPVVEREYKHLIDEMYAGSREA

SEQ ID NO: 13095 - protein, 194 aa, Streptomyces avermitilis
MSAEETTDERASILLVDDMEDNLMALEAVLGSLNEPLIRARSGEEAMKALLRRRFAVVLLDIRMPGMDGFETAANIKRLDQTKDVPIIFLTGTDADAGYAFRGYATGAADYLTKPFDPWVLRAKVSVFLDLHRKNRQLERMLAREQERFDELAARLREIGTRVASSDHQEVLELRHHVQQMEELLRGMRQGRGV

SEQ ID NO: 13096 - protein, 1383 aa, Streptomyces avermitilis
MSENSATRVLEDGQIRASDLRPLLAAMTAARDGIFTRVPETGHGLVAELSTAFNQIMDRNAHFNSEVQRVRRELVRHGRLDERLSASPGQGYWAARVSDVNQLLDALVAPAANATRVLDAVAGGDLTQRVDLHDGNRQLRGDLRRLGRAVNKMVDQLSLFTGEVTRVAREVGTEGRLGGRAKVQGLSGSWRDVTEAVNTMASRLTAQVRDIALVTTAVARGDLTRTVTVEATGELLELKLTVNTMVDQLSAFADEVTRVAREVGTEGQLGGRAQVRGVSGVWKDLTDNVNFMASNLTSQVRNIAQVTTAVANGDLSQKITVDAQGEILELKSTINTMVDQLSAFADEVTRVAREVGTEGNLGGRAQVRGVSGVWKDLTDNVNFMADNLTSQVRNIALVSTAVAQGDLGKKITVEAKGEILELKSTINTMVDQLSAFADEVTRVAREVGTEGNLGGQAQVRGVSGVWKDLTDNVNFMALNLTSQVRNIAQVTTAVANGDLSKKITVDARGEILELKDTVNTMVEQLRAFADEVTRVAREVGTDGRLGGRAQVLGVSGVWRDLTDNVNYMADNLTSQVRNIAQVATAVAQGDLSKKIDVDARGEILELKTTINTMVDTLSSFSSEVTRVAREVGSEGQLGGQARVEGVYGTWKRLTTNVNELALNLTTQVRAIAEVASAVAQGDMSRSISVETRGEVAELKDNINLMVANLRETTRAKDWLESNLARLAALMQGHRDLMEVADLILRELTPLVNAQYGAFFLADPDEDGASLRTTVPAKGLAFIAGYGSAHSVTVDTGGMPVHGLVRQAAREKKRILVEEAPPDYIKINSGLGEAAPASVVIIPILFEDKLLGVIELASFSRFSDVHLAFFDQFVNTIGVAINTIIANSRTESLLGESQRLAIQLQDRSDELQSQQAELQRSNAELEEKAALLATSSQYKSEFLANMSHELRTPLNSLLILARLLSDNPDGHLSDQEVQFATTIHRSGSDLLQLINDILDLSKIEAGRMDVRPKKLPLIKLLDYVHATFRPLTIDRGLAFDVAVGEDVPREMYSDEQRLQQILRNLLSNAIKFTASGRVELRVGRVKDPEHRYTREDSEEVIAFAVSDTGIGIAPEKLPVIFEAFQQADGTTNRKYGGTGLGLSISREIAGLLGGRIIAESVPGKGSTFTLYVPVVSPGHAATGPAPEERPLPTPEQLSTESYITHDPEDSWPAPTKLEEWQVGRAGQVLPGRRVLIVDDDIRNVFALTHVLGRVGMPVLYAENGREGIETLERNPDVELVLMDIMMPEMDGYETISVIRRTPRWAGLPIVALTAKAMPGDREKSIARGANDYVPKPVDVDQLLTVVCALLDPEGADAEERDDFAEPTDPGPVTSGEPAVPPLTE

SEQ ID NO: 13097 - protein, 739 aa, Streptomyces avermitilis
MGAFPTQRETQRDAVSRAPGAPAHQGAGRRTTVRTTLPGGSLAPGAARRFVREALADWAELGLSGAASLPGRLSDDAVVVVSELVTNAVVHAGTDVDLVCRIDESEEEPAGLVVEVSDRHPSRAVRDEAAGHPYGTAAAERPYGTPEYGRGLRLVSALSEAWGITYRTGAKTVWARLPVDGALPVDGAPAGDGVLPVEGTPVVEDGIGAYAGERSLGRGLRADEIFGPEHPGYPGHFGHVGGSEHFEPFEGPEHPDRSGLDSGLDSGLGIGLGIGFAENSGHPEASGPRGTQDHDWLNRGALSFLAEASDLLAGQLDEDLVAALAGQLLVPRLADWCAVWLEDEATGWRGPETGMAPGPRLARVWHGSENRIEDLRRALERHPPRLPESVRTRPVPAPWPAEALGPHGASGSALAYRLIAGGRPLGTLVIGRAGLLRYPDEITGLVEDLSRRVALAIGAARQYARQATISRVLQRGLLPGAVAEIPGVRSALVYEPLDKGGPSGDFYDLFPAGDGRWCFAVGDVQGKGPEAAVVIGLARPWLRLLAREGYQVADVLDRLNQLLLDDATEAADAAARALVAAGGPGLGADEGPQNRFLSLLYGELVPFEGGVRCTLASAGHPLPLLLTPDGDVRPVAQPQTLLGVVEDATYTCETFELHPADTLLCVTDGVTERRSGSHQFDDGDGLAAALAGCAGLSAELIAERIRRLVHEFGARPPEDDLALLVLQAERGAPSRGEGT

SEQ ID NO: 13098 - protein, 410 aa, Streptomyces avermitilis
MPSALPDGEPVPDDGSLPAHALAGAAERPLGFYLHVPYCATRCGYCDFNTYTATELRGTGGVLASRDNYAETLIDEVRLARKVLGDDPRPVRTVFVGGGTPTLLAADDLVRMLGAVRDEFGLADDAEVTTEANPESVDPAYLATLRAGGFNRVSFGMQSARQHVLKVLDRTHTPGRPERCVAEARAAGFDHVNLDLIYGTPGETDDDWRASLDAALGAGPDHISAYALIVEEGTQLARRIRRGEVPMTDDDVHADRYLIADEILSSAGFDWYEVSNWATSEAGRCLHNELYWRGADWWGAGPGAHSHVGGVRWWNVKHPGAYAGALAAGKSPGAGRELLSEEDRRVERVLLELRLREGCPLSLLRPDGLAASRRALSDGLLEPGPYDAGHAVLTLRGRLLADAVVRDLVD

SEQ ID NO: 13099 - protein, 270 aa, Streptomyces avermitilis
MRQYSPDLTPPWKKPKPVPEVPADPGLVVEEPGTGFCGAVIRCEAGTVTLEDRFGKHRVFPLEPRGFLLEGRVVTLVRPSGNAPVRPTRTASGSVAVPGARARVARAGRIYVEGRHDAELVEKVWGDDLRVEGVVVEYLEGVDDLPRIVTDFAPGPDARLGILVDHLVPGTKESRIAESVTSEYALVVGHPYIDVWEAVKPASVGIQSWPRVPHGQDWKKGVCRALGWPENTGAAWQHILSRVRSYKDLEPELLGRVEELIDFVTAGGPA

SEQ ID NO: 13100 - protein, 242 aa, Streptomyces avermitilis
MRVTWEEAGWESVAPFVGRRRLPGWDCTVGLVIGDSAALMIDAGSSLREGALLRAEAQRLLGPGRRVTHLALTHPHFDHVFGAAAFSGVEVFGAVGLDTALAHGREELRADAVRNGLDPRAAEGAADLLVRPRHHVFGEWTLDLGGEVQVLLANVGPGHTAYDLAVLVSSSPEVVFCGDLVEESGEPQAGPDAIPSHWPAALDRLLDLGGQDAVYVPGHGATVDAAFVRTQRDELAARFGIA

SEQ ID NO: 13101 - protein, 338 aa, Streptomyces avermitilis
MLSERRLEVLRAIVQDYVGTEEPVGSKALTERHNLGVSPATVRNDMAALEDEGYIAQPHTSAGRIPTDRGYRLFVDKLAGVKPMTGPERRAIQNFLDGAVDLDDVVGRTVRLLAQLTRQVAVVQYPSLTRSTVRHVELLSLAPARVMLVLITDTGRVEQRMIDCPAPFGETSLADLRARLNSRVAGRRFADVPQLVQDLSEAFDPEDRGTVTTVLSTLLETLVEETEERLMIGGTANLTRFGHDFPLTIRPVLEALEEQVVLLKLLGSAGDSGMTVRIGHENAYEGLNSTSVVSVGYGSGDEAVAKLGVVGPTRMDYPGTMGAVRAVARYVGQILAES

SEQ ID NO: 13102 - protein, 378 aa, Streptomyces avermitilis
VATDYYAVLGVRRDASQDEIKKAFRRLARELHPDVNPDPKTQERFKEINAAYEVLSDPQKKQVYDLGGDPLSQSGGGGAGGFGAGGFGNFSDIMDAFFGTASQRGPRSRTRRGQDAMIRVEIELDEAAFGTTKDIQVETAVVCTTCSGEGAAPGTSAQTCDMCRGRGEVSQVTRSFLGQVMTSRPCPQCQGFGTVVPTPCPECAGDGRVRSRRTLTVKIPAGVDNGTRIQLAGEGEVGPGGGPAGDLYVEIHELPHQTFQRRGDDLHCTVTIPMTAAALGTKVPLETLDGMEEVDIRPGTQSGQSIPLHGRGITHLRGGGRGDLIVHVEVTTPTKMDPEQERLLRELAKLRGEERPTGQFQPGQQGLFSRLKDAFNGR

SEQ ID NO: 13103 - protein, 357 aa, Streptomyces avermitilis
MSSALTDLFPHPIVQAPMAGGVSVPQLAAAVSEAGGLGFLAAGYKTADGMYQEIKQLRGLTGRPFGVNLFMPQPEQADPAAVEVYANQLAGEASWYETELGDPDSGRDDGYDAKLAVLLDNPVPVASFHFGCPARDVLEALARAGTFTLVTATTVDEALAVQRAGAGAVIVQGVEAGGHQGTHRDNPEADGAGIGLLSLLAQVREAVTLPIVAAGGIMRGSQIAAVLAAGASAAQLGTAFVATPESGANALHKQALTNPLFVRTELTRAFSGRPARGLVNRFMREHGPYAPAAYPEVHHLTSPLRKAAAKAGDAQGMALWAGQGHRMARELPAGQLVRTLADEVEAAKTALSGGGAR

SEQ ID NO: 13104 - protein, 249 aa, Streptomyces avermitilis
MTAPVFVVEHFNAGGGGHYVLDGAEGRHAVSVKRLRPGEDVVLTDGAGRWADCVVLGTEGKDRLIVQMDSVTEEPPEEPRITVVQALPKGDRGELAVETMTETGVDAIVPWAAARCITQWKGDRGQKALAKWRSTAREAGKQSRRVRFPEVAGAMTSKQVAALLATADLAAVLHEDTEHGTEPFATAQLPTSGSIVLVVGPEGGISPEEIELFTGVGAKTFHLGRTVLRTSTAGTVATALLLARTGRWS

SEQ ID NO: 13105 - protein, 210 aa, Streptomyces avermitilis
MGALRLIWRRPLRQRPLTQRPGGRRSRGQRPPGRRLAAAAGLAVVAMGGAVACQPGDLSTAAVAYTTDRTATTELERQHVNVRWLSCTATYGNGNKAYTPGKSSSPTASTNTVATVDCRGQTSDGKKITVKGKVTRAVDGKCVRGNLTATVGGKEWFHVNGLGNCDAASTPTYTPPVTYRPSPGQPGPTVTVTRTIWCQGDPTCWPVQGK

SEQ ID NO: 13106 - protein, 1073 aa, Streptomyces avermitilis
VTQPASPAYLRFPHLHGELVAFTAEDDVWVAPLDGGRAWRVSADNVPVTHPRISPDGTTVAWTSTRDGAPEVHIAPVDGGPARRLTHWGSSRTQVRGWTPAGQVLAISTVGQASLRRSWARAVPLDGGPATTLPYGPVGDVSYGGPGVLLLSAPMGREAAWWKRYRGGTAGKLWIDRDAEGEEAGEFVRLHADLDGNIEYPSWVGERVAFLSDHEGVGALYSSLADGSDLRRHTPIDGFYARHAATDGTRVVYSSAGELWLLDDLDGAEPRRLDIRLGGQRADLQPHPVSAARWFGAAAPDHTGRGSAISVRGAVHWVTHRSGPARALAAEHGVRARLPRTFRVDGEEHVVWVTDAEGEDALEFAPATGAAPGAIPRRLAAGQLGRVVGLAMAPDGSRAAVASHDGRVLLVEQETGEVREVDRSEDGDVTGLVFSPDSAWLAWSHPGPRPLRQLKLANTADLSVTEATPLRFRDYAPAFTLDGKHLAFLSARSFDPVYDEHVFDLAFVGGSRPHLITLAATTPSPFGPQRHGRPFDAPDKDETPDSEGAPSTRIDLDGLGDRIVPFPVEAARYSGLRAAKDGVLWLRHPVRGVLGASRATPDDPDPKTELERYDLAQQRIEHLAADADHLAVSGDGKRVLLWTDGKLKVVPSDRRASNDDESDTNITVDLSRVRQTVDPAAEWRQMYDEAGRLMRDNFWRPDLAGVDWEGVLARYRPVLERVATHDDLVDLLWEVQGELGTSHAYVSPAGGGWAGDRQQGLLGADISRHEDGSWRVDRVLPSETSDPDARAPLAAPGVAVRAGDAVIAVGGRPVDPVTGPGPLLVGTAGKPVELTISPSGGGDPRHAVVVPIADEEPLRYHAWVADRRAYVHEKSGGRLGYLHVPDMVGSGWAQLHRDLRIEVARQGLVVDVRENRGGHTSQLVVEKLARRIVGWDLPRGMRPYSYPEDAPRGPVVAVANEFSGSDGDIVNAAIKALGIGPVVGTRTWGGVVGIDSRYRLVDGTLVTQPKYAFWLEGYGWGVENHGVDPDVEVVQTPQDHAAGRDVQLDEAIRIALAALEENPAKTAPSLPES

SEQ ID NO: 13107 - protein, 117 aa, Streptomyces avermitilis
MAGEPQDDCLFCKIVAGHIPATLVRETETTVAFRDINPQAPTHVLVIPKVHHPDAAALAAAEPAIAADVLREAGEVARDEKLESYRVVFNTGSGAGQTVFHAHAHVIGGRGMQWPPG

SEQ ID NO: 13108 - protein, 301 aa, Streptomyces avermitilis
MSVRELVVLGTASQVPTRHRNHNGYLLRWDGEGILFDPGEGTQRQMLRAGVAAHDLHRICVTHFHGDHSLGLAGVIQRINLDRVPHEITAHYPGSGQRFFERLRYATAYRETVALTEAPVAADGVIADTPAYVLETRRLSHPVESFGYRLVEPDGRRMLPERLAAHGIKGPDVGRIQREGAIGGVSLEDVSEVRHGQRFAFVMDTRLCEGVHALAEGCDMLVIESTFLDGDHQLAEDHGHLTAGQAGRVAKDAGVRHLVLTHFSQRYSDPDAFEREARAGGFEGELTVAHDLLRVPVPKRH

SEQ ID NO: 13109 - protein, 333 aa, Streptomyces avermitilis
MPLPKAELHLHIEGTLEPELAFALAARNGVPLPYAHTDELRKAYQFDDLQSFLNLYYELMAVLRTEQDFEDLANAYLPRAAAQGVRHAEIFFDPQAHIARGVAMGTVVEGLWRALGRSTENHGVSTQLIMCFLRDESAESALETLEAAKPYLDRIIGIGLDSAEVGHPPAKFREVYEAAAALGLRRVAHAGEEGPPEYITEALDVLGVERIDHGLRCMEDDALVERLVRERVPLTLCPLSNVRLRAVDVLAEHPLPAMLDAGLLCTVNSDDPAYFGGYVADNFHAVRDALGLDQERMRELARNSFVASFLEHDEERRARYLAEVEAYDFPGRP

SEQ ID NO: 13110 - protein, 429 aa, Streptomyces avermitilis
VSARTTTPWPLVALFTAGYLAAYLLPTTVGRLDAGLPLSATQAGSIGSALLLSSATAGFVLAAKVDRFPGGPRRLARAGLLLAAAGYGTAALTHTVPAVIAGAVLGGLGSGTATTVAATGIAARHDPHRASTLGLLSVSALAGALYLTIPHLGPGHGLPLAALALTALLTWPATHRLPATAPTPHTAPRGTGRLPHPRSGLLLATGILFWSLSQNSLWGVSGRIGLTQAGLTEVTVGAVFAAALGAGLLGVSAAGALGPRLGRALPIGAGTALIAVCIAVSASATDLRTFATGEIAWNALYPVVLSYLIGLAASLDPRGRWAVLVGSASSLGTAAGPLAGSLLSARAGYPAMGAILAVGLLVVALPLTAVALHTGGRPLLPSTIRRRGGAPAQPAVLEIPLDTPAVPNRGAYDTAGPRQAAAAPGPGAS

SEQ ID NO: 13111 - protein, 263 aa, Streptomyces avermitilis
MPEPTDERGVREVKSAARTVDLLELLAARGDRPARLTELADELDVPRSSMYALLQTLVTRGWVRTDVTGSLYGIGIHALLTGTSYLDSDPRVRVVRPYLDEASEALGETIHLGRLDGTDVAYLATRESHEYLRTISRVGRRLPAHVGALGKALLAERPDEALPEGPYEQATPHTLTTREALAADLARTRARGYSVDREEGVLGIVGFGFALRYDTPAQDAISCSVPVARLTPAHEEQIVTVMRDIRAKAEAAAPGPAGAPRWR

SEQ ID NO: 13112 - protein, 331 aa, Streptomyces avermitilis
VSADTDTDTDTGTGTGPDTDTGTAAVVERLRGGMARGVLSFPLTSFHDDGSLDLDGFRAHLETQLAAGPGAVFPACGTGEFFSLDEDEYRQVVTAAVELTAGRVPVVAGTGYGWAQAARFARIAEDAGADALLVLPHYLVAAPQDGLVGQLERLAERTRLPLIAYQRGQVTYSVESLRRIARIPGVVGLKDGHSDLDRLQRLTLAAPEGFLFFNGAATAEIQARAYAAVGVPAYSSAVHAFAPEIAGAFHAALRDGHGKAVEKLLREFYVPFVELRDRVPGYGVSLVKAAARLRGRPVGPVRAPLTDPSAADLADLTSLLSTGLDLVGAAL

SEQ ID NO: 13113 - protein, 528 aa, Streptomyces avermitilis
VTRDLTITEVRLTPILVADPPLLNTQGVHQPYTPRLIVEVVTADGLTGVGETYGDGKYLELARPFADKVIGRQVSDLNGLFTVADEVAVDQARVDHQVDVGGLRGVQTADKLRLSVVSGFEVACLDALGKSLGLPVHALLGGRVRDAVEYSAYLFYKWAGHPEGVACEKDDWGAAVDPAGVVEQARKFTERYGFTSFKLKGGVFPPEEEIAAVRALAEAFPGQPLRLDPNGAWSVRTSLKVAEELGDVLEYLEDPALGTPAMAEVAAGTSVPLATNMCVTTFAEIKEAFTRDAVQVVLSDHHYWGGLRNTRELAAVCRTFGVGVSMHSNTHLGISLAAMTHVASTVPNLHHACDSHYPWQSEDVLTERLTFEGGKLAVSDAPGLGVELDRDRLEFLHRRWLDDDGSLRDRDDAAAMRVADPGWVTPAVPRWYGAAGCGLRAEGLPVARGRWFLGAVDPGAGGPVPGGQRTPCPGARGPTEPAARPRPPGPAGASAPSAPRDGTGVTGAAPRGVWCTLAWIRTTPGSAP

SEQ ID NO: 13114 - protein, 369 aa, Streptomyces avermitilis
VIASNGEGPHRQTHVDPLAAVRAPGDPPWDVYLTGPVFLDIIFTGLDSAPVRGTESWARGMGSSPGGVANMATALARLGLKTSLAAAFGDDHYGEYCWDALAQGEGIDLSPSRTVPGWHSPVTVSMAYEGERTMVSHGHEPPPEETAPDCPPRARAAVASLAPGSRAPWIAQAASEGTRIFADVGWDDTGRWDLAGLADLGHCEAFLPNADEAMRYTGADCPRAAAHALTEHVPLAVVTLGADGAYAVDRRTGEAAEVPAIAVEAMDPTGAGDVFVAGFVTGTLAGWPLADRLAFAGLIAALSVQEFGGSLSAPGWSEIAAWWRRVQSYDDQDPTALRRYAFLEGLIPEVTRPWPLRRAVPTIGFGRSA

SEQ ID NO: 13115 - protein, 355 aa, Streptomyces avermitilis
MTQTPTAQTPAQGQARAHFTVPAKHPMVTVLGSGDALLRVIEKAFPAADIHVRGNEISAVGDAGEVALVQRLFDEMMLVLRTGQPMTEDAVERSIAMLRASENGEGDGQETPAEVLTQNILSSRGRTIRPKTLNQKRYVDAIDKHTIVFGIGPAGTGKTYLAMAKAVQALQSKQVNRIILTRPAVEAGERLGFLPGTLYEKIDPYLRPLYDALHDMLDPDSIPRLMAAGTIEVAPLAYMRGRTLNDAFIILDEAQNTSAEQMKMFLTRLGFDSKIVITGDVTQVDLPSGTKSGLRQVQEILEGVDDVHFSRLTSHDVVRHKLVGRIVDAYEKYDSENGSENGSHKPRGKAGHKGL

SEQ ID NO: 13116 - protein, 165 aa, Streptomyces avermitilis
MSIDVNNESGTEVDEQAILDIARYALARMRIHPLSELSVIVVDADAMEQLHIQWMDLPGPTDVMSFPMDELRPPMKDDDEPPQGLLGDIVLCPEVAERQGKEAPTQHSMDEELQLLAVHGVLHLLGYDHEEPDEKAEMFGLQAAIVDGWRAEKGLTGPSPAPTVS

SEQ ID NO: 13117 - protein, 435 aa, Streptomyces avermitilis
MSPQLVIGAIALVVVAWLAACAEAGLARVSSFRAEEAVRSGRRGSAKLAQIAADPTRYLNVALLVRVACEMAAAALVTYACLKEFDRTWQALAVAIGVMVLVSYVAVGVSPRTIGRQHPLNTATAAAYVLLPLARIMGPIPPLLILIGNALTPGKGFRRGPFASEAELRAMVDLAEKESLIEDEERRMVHSVFELGDTLVREVMVPRTDLVVIERYKTIRQALTLALRSGFSRIPVTGESEDDIVGMVYLKDLVRKTHISRDAESELVSTAMRPATFVPDTKNAGDLLREMQQERNHVAVVIDEYGGTAGIVTIEDILEEIVGEITDEYDRELPPVEDLGDDRHRVTARLDIGDLGELYGIEAYDDEDVETVGGLLAKALGRVPIAGASSVVELPDGRELRLTAETSAGRRNKIVTVLVEPIDPAGPSAEGAKEE

SEQ ID NO: 13118 - protein, 119 aa, Streptomyces avermitilis
MTPQELRAFCLSFNATVEDFPFTPETSVFKVQGKLFALTRLDARPLTVNLKCDPDDAVRLRSEYEGLIIPGYHMNKRHWNTVTVDGELPDRLVRELVEDSYDLVVAGLPRADRLRLDRP

SEQ ID NO: 13119 - protein, 489 aa, Streptomyces avermitilis
MAIDTTSSAPVHEPQPPLDTRLSTRDKLVLFVLCAAQFMVALDFSVLNVALPVLGRDLGMSQSALQWAVTAFALPSGGFLLLFGRIGDLYGRRRLFLTGLALFGTASLLATFAWDPASFLAGRALQGLGAAAIVPTGMSLLTTTFPEGPARDRALGISGTLLSLGFTVGMVAGGVLTDAFGWRSTMGLLTLFALIVLPLAPGLLPESRTPDRPRLDIPGAVTVTGGLLSLIYALSTAAERGFGGTDVIATLVAGVLLLAAFVTVESHAEAPLVSLPMLRRRTVAWGNLGGLITFSMMSTVVFVLTLYLQETLGLSAFETGLVFGVQGVLSAVAGANASKVIGRLGARRTLVVSLAGQGAFVATLVALGDGGWSVWLATAAVSLASMCHLGAIISYGLTVTSGVPDDEQGLATGLVTSTQQVGITIGIPLLGVLATTSSDLLAGVHTVLALDAVIVLAAAVLIAVGLGRRPATAPGAASGAVEAEAVGSR

SEQ ID NO: 13120 - protein, 289 aa, Streptomyces avermitilis
VAEDALKTHRLRELREFLMSRRARVTPVEAGLPDGGARRRTPGLRREEVAVLAGVGASWYQWLEQGRDISVSPQVLDAVARVLRLSNAERRHLYVLAGLNPPAPEPASRDDCEGLRRLIDTWMPYPAHIMDIYYNCVMYNDAAGVVLGMRPENTQNCLIDFFTDQLYRGRSHSWERNARTVVAQFRATCSACPDDEGFQQVLAQAKAASEEFAALWDERDIQDAGLIRKELEHPVVGLLCVESTAMKVPARPDLTVVLHTPLPEANTAAKLEWLASPEGRRGTMYPVAG

SEQ ID NO: 13121 - protein, 117 aa, Streptomyces avermitilis
MTESSALDPEDRKIVTLARSARARNGVPEGAAVRDETGRTYVAGTVALDSLKLSALQTAVAMAVASGAKSLEAAAVVTESAEASAEDRAAVRDLGGPGTPVLVAGPDGAVRVTVTAG

SEQ ID NO: 13122 - protein, 159 aa, Streptomyces avermitilis
MRSKRLGTGVALAAGTLAVAGLAFAPTAQAVTPQTATIVADCGTYGGGEATLTATQSGTAATITLSSSEITSPLALSQDSITSTLTLVKASGGTTAFTGTKNPAVAAGAGVTVGPLSGTVAAGDSLQAYGGSLKMVIFGFVTITCTAQGLQSPGPFVYE

SEQ ID NO: 13123 - protein, 440 aa, Streptomyces avermitilis
MAARTRRHRWAAVLGATALALAGGGALACPAGAVSQQVDFATHCIPPAIAGIPPIDGTTAAKIDVDNTAPKVGDTVTVTYTVVTPAASNPTDLALPADIMTPTGKVTLGGAQTGAVTVTGPKKNDPVPGKGAFPSFSMTGTFTVTSPGAITLAPGDYNIHTSYILELDTPCTVISPPAPVSQTITAADTTPVNNRAITLGSASGKPGDGVTVTGSNFTAGATVTLAGRAGTAQTADTATVTANAQGAVSGSLVVNDKATTGVVAYEGSAWSDTKGAGPAAYVVIDDTPVPAGSQKINTKVTAGTLSMSQAGDTVDLAAVDFGKGGFSRGSLQTVTVKDFRGGAAGWSLTGKVTDFTGPGGAKIDAAKLGWTPVCLTKAGSPSTCAAGSPGSVGSAGATLASAPNGTVTGGEFTVDARLSLNVPAFTPAGSYSGVLTLTLT

SEQ ID NO: 13124 - protein, 343 aa, Streptomyces avermitilis
MLRKPYVLLLTALLAAGLATPSYAADNGSWSVFPVATQLASRPYFYLSADPGTTIKDKVEVANKTGKPLTFRLYAADAYNTARDGGFAVRTRSERQRGVGAWAKPARSRVTVPPHDTVTVPFTLRVPERAEPGDHPGALVALDERVDRGDGSVAVGVRRAVGARVYLRVNGPTVPAVAVENVRFSHHQPLIPGTGAGTATISYTLRNTGNVTLGPKVRLTAKGLFGRTLLSRGLTRIPAELLPGQRVRLTEPWRGSPQLDWGDVTLTASAPHTRESASVSFFALPWPAAVVLLLTAAVGAALVIRARRGRARPSGPVPPSPPEPTTPSRPRSSPSARPSRSRR

SEQ ID NO: 13125 - protein, 112 aa, Streptomyces avermitilis
MKLITAIVKPYRLDEVKTALQELGVHGLTVTEASGYGRQRGHTEVYRGAEYRVDLVPKVRIEVVVEDADSDAVIDAIVKAAQTGKIGDGKVWSVPVETVVRVRTGERGPDAL

SEQ ID NO: 13126 - protein, 436 aa, Streptomyces avermitilis
VTLAAARIDTGDTAWLLAATALVLLMTPGLALFYGGMVRTKSVLNMLMMSFVSIALVTVVWLAAGYSLAFGDDLAGGLIGGLDHAGLADLGPADVHGTVPTLLFATFQLTFAIITAALISGAIADRAKFAAWLVFVPLWALLVYVPVAHWVWGPGGWILDRLGALDFAGGLPVEITSGASGLALCLVLGPRLGFKKDAMRPHNLPMVMLGAGLLWFGWFGFNAGSALGANGLAAAAFLNTLAAGCTGLLGWLFVEQKRDGHPTTLGAASGAVAGLVAITPSCGAVSLLGALVVGLAAGVVCSYAVGWKFKLNYDDSLDVVGVHLVGGIIGTLLIGVFAAKEMTGGTEGLLYGGGLGQLGKQLVAVVAVGAYAFAVTYGLGKLIDKVMGLRAAEDDEHQGLDLTVHAETAYDHGILGHGAPSSASVVPTAQKVKSQA

SEQ ID NO: 13127 - protein, 330 aa, Streptomyces avermitilis
MGAMSVRTQSSEPSEGGGTSHATKAVGDHRAGFACFVGRPNAGKSTLTNALVGQKVAITANQPQTTRHTVRGIVHRPDAQLILVDTPGLHKPRTLLGERLNDIVRTTWAEVDVIGFCLPANEKLGPGDRFIAKELASIKKTPKIAIVTKTDLVDGKTLAEQLIAIDQLGQELGFEWAEIIPVSAVGDKQVDLLADLIVPLLPEGPALYPEGDLTDEPEQVMVAELIREAALEGVRDELPHSIAVVVEEMIPREDRPADKPLLDIHAFVYIERPSQKGIIIGPKGKRLKEVGIKSRKQIEALLGTPVFLDLHVKVAKDWQRDPRQLRKLGF

SEQ ID NO: 13128 - protein, 281 aa, Streptomyces avermitilis
MTTQNQPLDLLEGYYDSVPRAAGRAEDFGPLTLFVRETAGWPYYARPTLDWTGPAATAKDVERVRERQRELGVPEAFEWVAEVSPGLREAVAATGLRVHAHPLMVLTEDLPLPEPHPLVRVLGPEDPFLASALAVPHVAFAAPGTAVGEAGLAELAAAITDRAGEVPGAADRIRAGRTVLAAAVEDGVALCSGMHLPVGRVSEIAGVGTLPSARRRGLGLAVTAALVADARAAGVDTLFLSAGDEDVARMYGRLGFTRVATALIAEPEEPAEPEEPAGPAE

SEQ ID NO: 13129 - protein, 421 aa, Streptomyces avermitilis
MTAAEPVTSSVEALAEPVERVGRGWAFALSLANGAIWVGWYGPLQILLASQAEDFAPGTGMSKETMLAWVTGAGAVVSLVANPLFGALSDRTTARRGRRTPWIVAGAAGGALSLLLLAGAGGVWTMAAGWCLVQLTLNAAFAAVTAAVPDRVPRRQRGAVGGWLGAAQILGVVGGTGLATVAGGVGAGYAACALFTAAGVLPYVLRYRDLRLPRAARPPWSWRAFVTSFWLSPRRHPDLGWAWLTRFLINLSNALVLLYLLYYLRDRLRYDDPGQGVLILTAVNGVTLLATVVVGGVWSDRVGRRKPFVIWSGVLMAVATAALAAWQTWPGAVVAAAVLGVGFGVFASVDFALMTDVLPKALDRGKDLGVINVANALPQVAAPALAAPIVTYLGGYRVLYLVAAVIGLAGAVLVGRIRGVD

SEQ ID NO: 13130 - protein, 441 aa, Streptomyces avermitilis
MIRRMATNPISQFPAGFLWGVSTSAHQIEGAADEREPSVWDAFTAEPGRVKDGSTAAVACDHYHRYAEDVALLADLGVDAYRFSVSWPRVNSPGGLDFYDRLVDELCAAGVRPVPTLFHWDLPLALDWLDRDTAARFAEYAARVAERLGDRVTKWITLNEPAEHTLLGHALGAHAPGRQLLFDALPAAHHQLLAHGLAVRALRAAGVTDIGIANSHGPTWPASQEPADLEAAAFYDLLLNRLFSDPLLLGRYPEGIGELMPKGSAGIESDLKVIAEPIDWYGINYYAPTKVGAPQGAEIEFGGLTLPAELPFSVREIEGHPVTDFGWPVVPQALTELLTGFRERFGDRLPPIVITENGCSYEGIDDQERIAYLDGHVRALHRAVEAGVDVRGYFVWSLLDNFEWAEGYERRFGLVHVDYDTLERTPKASYGWLRDALRARR

SEQ ID NO: 13131 - protein, 88 aa, Streptomyces avermitilis
MRIQVKRTGGFAGIERHAEVDTSGRADAPEWHALAERAVAAGRGTPPIGVPDGFGYEITVDGTTVYAADPRLTEEQRKLVSRVLKEGA

SEQ ID NO: 13132 - protein, 356 aa, Streptomyces avermitilis
MTTNGGFEPVFCTIVPPHVLDTLAQHEDPAVAEPARRTLERDALERTHRRLTTVLGAPTVAPPRDAAADKPQRTIYDARHHQDLPGKKVRGENDKPGKDATVNRAFAGLGATFELYLSAYTRNSINGEGLPLTATVHFDENYNNAFWNGEQMVFGDGDGEIFLDFTIPVDVIGHELTHGVTQYTANLTYFGQPGALNESMSDVFGSLIKQYTLGQTATEADWLIGAGLLAPRVTGTALRSMKEPGSAYDDDLLGKDPQPGTMDGYVRTGRDNGGVHINSGIPNHAFYLVANTLGGHAWERAGQIWYDVLTGGELQSQASFADFAKLTVAAAKARYGDGEEQQGVLKAWEQVGVPTS

SEQ ID NO: 13133 - protein, 573 aa, Streptomyces avermitilis
MANRQQPTSMPIHKYRPYEQVDIADRTWPDNRVTVAPRWLSTDLRDGNQALIDPMSPARKREMFDLLVKMGYKEIEVGFPASGQTDFDFVRSIIEDETAIPDDVTISVLTQAREDLIERTVESLVGAKRATVHLYNATAPVFRRVVFRGSKDQIKQIAVDGTRLVVEYAEKLLDERTTFGYQYSPEIFTDTELDFALEVCEAVMDVWQPGPDREIILNLPATVERSTPSTHADRFEWMSRNLSRREYVCLSVHPHNDRGTAVAAAELALMAGADRIEGCLFGQGERTGNVDLVTLGMNLFSQGVDPQIDFSNIDEVRRTAEYCNQMEVHARHPYVGDLVYTSFSGSHQDAIKKGFDAMEADAAAKGVTVDDIEWAVPYLPIDPKDVGRSYEAVIRVNSQSGKGGIAYVLKNDHKLDLPRRMQIEFSKIIQTKTDAEGGEVTPKDIWAVFQDEYLPNPRNPWGRIQVKTGQTTTDKDGVDTLTVEASVDGVDTVLTGSGNGPISAFFDALQSVGIDVRLLDYTEHTMSEGASAQAASYIECAIDGQVLWGIGIDANTTRASLKAVVSAVNRAAR

SEQ ID NO: 13134 - protein, 241 aa, Streptomyces avermitilis
VLPGRGRNGRVVLRGRVPQILGIRTSILGTRTSWTPVGDGEFFCPGCGGDRNYQRLTGRRRFTLVGVPVLPRGETGPVVECAACRHHYGNDVLDHPTTVRFSAMLREAVHTVALAVLAAGGTCARASLETAASAVRSAGFEDCTEDQLSALVEALAADTGRVFGGPCDPGLAIELHEALDPLAPHLAATGREAILLQGARIALADGPYTPAERDALATVGAALTICSDDVTRLLAAARTPS

SEQ ID NO: 13135 - protein, 692 aa, Streptomyces avermitilis
MGARNTSVTRSRRRAVPWLVLGLWVAALAAVGPFAAKLAEVQHDRVVDYLPASADSTQVARIQDQLPGGETTELVLVYHREGGLTAADRTVAGEQVTEIAGRHRLTGTPRGVPSTDGTTLMYPVASNEPGADEDERDALVDDIRHIAHGEGGLSVEVGGTAALATDAAGVYASLGGPLLYTTVAVVAVLLVLIYRSPVLWLVPLAVAGVGDYLAMGVAYGLHQAFGTTISGQSQGIMTILVFGAGTDYALLLVSRYREELRRFERPYEAMRAALRGCGPAVLASSGTVAAGLLCLLAADLNSNRDMGPLGTVGVLCALVAMLTLLPAVLVLLGRRVFWPLVPAYGSEPKARRSLFAAMGSSAGRRPLAVLAGGAVLLGALALGALNLPGPIKQQDTFVDKPESIAAMETLAEAYPERSTQPIAVITPAGRADGTLARIRTVRGVDSVREGRTGDGWTEISVIAKDVPQSAGETATIERLRHALTGSYVGGPSAQRIDLLDTNARDRGVVVPIVLASVLLILVALLRGLVAPLLLVGAVVAVWGAALGIGGLVFGPLFGFEGTDPGLGLLSFVFLVALGVDYGIFLMHRMREESTAGAEPAAAALTALRTTGGVIASAGLVLAATFAVLTNMGLVQLVELGFVIAVGVLLDTFLVRTYLVTSASVALGRKVWWPGGLSKEPDPPRPERQPEPV

SEQ ID NO: 13136 - protein, 450 aa, Streptomyces avermitilis
MDFYEPPGAPPCRRGAPLAEDGPVQATTTAARPRRGERIMAAVNRDPRTAPHALRNDALLAVAVAVLGTALALFTDEGRRPDTLGWVLLLAAQVPLVWRRRHPMLVLAVVVALVVPYHALDNNHAAPTPASYVALYTVAVTGRPLRTLLTGMTVLAISVSVMLTVNTHQAVELLRISGWIVAMLFFGVDVRFYRQYVASIVERAERAERTREEEARRRVAEERLRIARDLHDLLAHSITLIGVQTSVAAHVLAADPERLDRAAVAKALDDIAETCRSARGELRTTLEVLREHTADDSWQAPYGAHGPLPGLDGLPDLAGAARAAGAEVELSVRADGVPPAVGAAAYRIVQEALTNAVRHGGRADLTVRVGVADRDGALRVSVTDDGAGTGGGTPGFGLVGMRERARSVGGTLDAGPGPEEGFEVLAVLPLTRGDVPSARTAGPLRPEGVR

SEQ ID NO: 13137 - protein, 227 aa, Streptomyces avermitilis
VPPTPVRVLLADDQTLVRAAFAMLVESATDMEVVGQAGTGREAVRLARSERADVVVMDLRMPDLDGIDATRLIAADDDLAGVRVLVLTTYDTDEYIVEALRAGASGFLVKDTKPAELLDAIRTVAAGEALLSPGPTARLIARLLRTPVPPPAAAVGPECLSGREREVLTLVARGLNNTEIAESLGLSPLTAKTHVSRIMGKLGARDRAQLVIVAYESGLVTPGTAQG

SEQ ID NO: 13138 - protein, 403 aa, Streptomyces avermitilis
MSVRSRTTLLAAAVGLVTALAVTGTAGPAAAAPPPSRGCTSSVPYTAGQYGYDTYRIPATLRTRAGTLLAFAEGRRGGAGDTGNIDVVLRRSFDGGCAWGPLTVVAAGRGDTRGNPAPVVDSRTGRIVLVTSYNGGAVTEAQIMRGEVTPEQSRRVFVQTSRDDGRHFSAPRDITAQVKPANWRWYATGPGHAVALTRGPHAGRLVVPANHSAAPPEGSADTGREARYYGAHAIYSDDGGLTWRLGFVDDSYDGVDNANENAAAELPDGRLYFSARDQNGTSAGNRLDTYSGDGAQTLDRPYAVQPTLNDVPVVQGSVLQLTGNGAPLLFSGPSVPTARRSMAIRRSEDGGGTFVTVKTLSALPAAYSDLVQVSATKVGILYETGVAGPYDSIEFRRVPVGEL

SEQ ID NO: 13139 - protein, 311 aa, Streptomyces avermitilis
MTLPTPLTGVVPPVCTPLTPDREVDVPSLIRLVDHLVNGGVDGLFVLGSSSEAAYLTDRHRRLVVETVTAHVGGSVPVLAGAIDMTTPRVLDHVEYVTAAGADAIVVTAPFYTRTHPAEIARHYRLIAARSSVPVFAYDLPVAVHTKLDPELVLELAAEGVLAGLKDSSGDLGGFRAVVTGARARPDITGFSVLTGSELFVDSALALGAAGAVPGLANVDPEGYVRLDRLCRAGDGERARAEQERLCALYGMVGAGDPARMGGSSSALGAFKAALFLRGVIACAATAEPQVPLSEEEVERVGKHLAAAGLL

SEQ ID NO: 13140 - protein, 355 aa, Streptomyces avermitilis
VTGLVSLSGVHVVHKARSGGLFTRDRVHALTGADLAVARGETVGVVGESGCGKSTLAKVLVGVQRPTSGTVSFGGRDLWSMKPAERRTVVGGGTGMIFQDPSTALNRRLTVRRILRDPLDVHRRGTPAEREDRVRELMALVGLPRALADGLPGQLSGGQRQRVAIARALALDPDLVVADEPTSALDVSVRAQILNLLLDLKERLGLALVFVSHDIQTVRRMSDRVITMYLGRIVEEAPADEVTDGSRHPYTRALFSATPGLLDPIDPIPLVGPVPSATRPPSGCPFRTRCWKADARCAGEMPDFTAVSGPEHRFRCHHPVQEGESTHDLVGQAASASPATAMADVPVQHVPREPS

SEQ ID NO: 13141 - protein, 652 aa, Streptomyces avermitilis
MITRTRLAHALSRPGVRLRRLPPLSRIALGLLTVVVLAALFAPLLAPHDPLDQQPPADGSGHPSAGHWMGQDSLGRDILSRLMYGARWSLAIGLGATALALLVGALLGAVAATSRKAVDETLMRCLDVVMAFPGIALAAVLVAVFGGGVTVLICAIAFLFTPPVARVVRANVLDQYGEDYVTAEQVIGARTPHIVLRHVAVNCAAPVLVFCTVQVAEAIVFEASLSFIGAGVRPPDPSWGSVIADGKNMVLTGGWWATVFPGLLMLVTVLSLNILSEGVSDAWAAPAARDVQGRDDRLETPRPGSGEVLRLPGLTEAALRLRSRARPLPEGRPVLAVENLAIGFDARHGGVDIVDGISFEVRPGEVLGLVGESGCGKSLTALTVMGLEPKGARVRGQVRFRQRQLVGEPMRVRRRLLGHEMAMIYQDALSSLNPAMTVRAQLKQVVRRGGKRSPAALLELVGLDPERTLRSYPHELSGGQRQRVLIAMALSRSPRLIVADEPTTALDVTVQAQVMELLLRLRAELGFALILVSHDLALVADVTDRVVVMYGGQIVETGVTADLVEAPAHHYTRGLLGSVLSLESAARRMTQIEGVVPAPADFPAGCRFADRCPLASEVCRTTAPGLAGTRTHTAACHHPAVDLVTTESEAVT

SEQ ID NO: 13142 - protein, 320 aa, Streptomyces avermitilis
VIAIARILARRVVLLVPLMLGIVLFVFLVMRFSDVDPASAFFQGANPTPRQLHDFRQQNGLLDPLPVRYVHFVGDLLHGDLGISALTRAPVVEQVTTALPLTLQLTFLGLGIAVVLALTGGVTAAIYRDRLPDQLVRVVSLTGVAAPGFWLALLMIQYLAVDRGWFPTGGYINPADSPSGWLRTMTLPAFALSLPVAAQLTRIVRTAVVEELDKDYVRTAIGSGLPPRVVVGRNVLRNALINPLTVLGLRVGYLLGGAVVIETIFSLPGMGKLMIDAVQNGDPAVVQGVVLTTATGFVVVNLVIDILYLLVNPRLRDAAR

SEQ ID NO: 13143 - protein, 543 aa, Streptomyces avermitilis
VRDATHDVPALHRRSFLKYSGALGAAAALSSSLAACSSGPESTNDTGGGGSGGNRTLTAVIGYGNDGSWDPTQTASAFSMAANNHIYEGLLDTDPISREPYAALATQVPKDLGGTSWKFTLRSGATFHDGKPVTADDVVFVFGRILDPKTQTLVKGFFASWLKDVRKIDAQNVELVLKFPFPEGVSRLTLAKIMPRHVFSRPGAWEDAIKGKAVGSGPYRQTAHHPKSNTTFEAFAGYNGPRKPAFKKMNWLTIVDAAPRVAKVSGASAGAQLADNIPYANIQQLKKDGMTVEGGAGMNNLFLMFNTKHKPFDDVRVRQALHYAIDTGKMVEVALKGHGKPSSSFLNEGNPAYRKAKTVYDYDPEKAKELLKAAGVKGLEIEILSVNVSWIVDCLPTIKASWDAIGVRTTLSPQETTAVFTKMDQKQDYQVVAAASNPNQFGLDADLIMHYNYGPQNLWMQYARWAGDSVAKQLFRDMDLATRQPDAEKKKLMIQDYIDVVAEQAVLYPVVHNELMTAWDPEKLSGIRAQPYPGVNLLQAKWA

SEQ ID NO: 13144 - protein, 237 aa, Streptomyces avermitilis
MRRMSEETGNSRIRREVVQLILDRRLRAGAPLPTETELMEDLGVSRNSVREALKALQALDIVEIRHGYGTYVGRASLTPLVDGLTFRTLSRPDDDTDALAEILQVREVLEEGLIRRVTATLSEAELDRLESVVARMETAGRAGRSFAELDREFHELLYASLGNAFVPQLLGAFWTVFRRVAGARDWTDDPAPAVTARRHRDILTALRARDVEGAQRAMADHFRGIEARAAEESRGVG

SEQ ID NO: 13145 - protein, 144 aa, Streptomyces avermitilis
MTDTWSPTDVGVLRLPSGRLVRGRGLRRPLPEGQEPTYAVYLLGKRPPEVPWEAHWLRWPDFRLPSSRTQAREVLTDAWRRAAAERVEIACGGGRGRTGTALACLAVLDGVPPQEAVAYVRAHYDRHAVETPWQRRYVRQAGCW

SEQ ID NO: 13146 - protein, 479 aa, Streptomyces avermitilis
MLTTLLRDSRALAALAVPLILTQLAQVALTTTDTVMMGLLGTRELAAGGLALVIFNQLRTMGVGLVTSVGNQIAAAGARAEQAEQAEAERTAGRDDDGRGHAQEEAHEEMRGIVRASLALATLAGLAGAVLMILIGQALPWLGQDAAVADRAQTMLFALAPGLLPCLWFQAIRQFTVGMRRPQALLRITVASVAVNAGLNWVLIHGTWGLPRMGLTGVGVATSSVYVLTCIALYVSARKDGALAPLLALDVMKADPAVLRRLLRLGLPIAATYGSEAGFFSLTALMAGSFGPAALAAHTAVNQLVYIVFQVAVGLSHAASINVSRELAVGRYEDAGRIKNTALACAAAVMTVVGVVYLTLPELVLAPFLESGSGQALTIATHLLVVTAFLQFFDCAQNIGVGLLRGLDDTRSGFRITLIGYWAVGLPAAWLLAYALELDTLGIWLGLLTGLATTAVLLLRRYAQSLTTRSARHTPLTAT

SEQ ID NO: 13147 - protein, 342 aa, Streptomyces avermitilis
MPGSLRRPSVVSRVSDLIGYTPLLELAATETGSRLLLKLEMFNPTGTAKIRMARQMITDAEERGELRAGGRIIESTSGNTGLGLAVIAAERGYTFTAVVDNHAAVDKLRAMKALGAELVHVVDDGTDELATAAREELAEEMARGQDNTIFTEQHNNPSNGVGYFPVAHELHEALDGRLDVLVGAVGTGGGLCGTARELRTLIPGFTTIGVEPKGSIAFGGPAHDYYQSGTGTPEGAPIGALVDFGLIDEGAKVGDVEAFATCRAVARTGLLIGGSAGGVVHEALTRLPGLPPGTTMVALINDGGEKYMDTVFNDDWMRARDLLDPAAEREVDELLTKLRGNR

SEQ ID NO: 13148 - protein, 457 aa, Streptomyces avermitilis
VAVTGPPALPTLPALPDPAADAVLGSGLLEELAYALGGPFHFLLPDAFDANLRALHSVLDETGVDGFVYFAKKANKAAVWAERSAAGGAGVDVASAAELRQALGHGVRGEHLVVTGPAKDLALLGLAVRHGALIAVDALDELDTLITTVSGDRTRPARLLLRCLPPAQPHSRFGLGEAEVALALERCVTAGEAVRMEGFSFHLSGYDVKLRADLAGHLVELCLKARVLGLEADRISIGGGLPVSYSSAADWNTFLTRQNGGHYHADRTFDPDGFYPYHSPVAGADALRRILATRPEGHRPSLAALLNDAGITLLLEPGRALLDRAGGTVFRVQGVKDRDGYQLLTVNGTSLSLSEQWFNSEYLPDPHLLSAHPDTPDAVWPAAVGAATCLESDMLTWRKVPFPRRPRTGDLLVYPNTAGYQMDSNESPFHDLALPPKVVIDHTDRARPRWRLDRHAP

SEQ ID NO: 13149 - protein, 343 aa, Streptomyces avermitilis
MTMPDASTTAAAEPIPRADRHLRILSTGDLAGIDISLADVVSTVEDAYRTLHAGESDNPRKLTVKPRDGHSVAYAMLGRDGSRDVVAVKTSYKHGLDKGREEQHYYTTLTLYDDVTGLPVAMMDCSRIGSLRTPAVSALLARECAAPGARSALVIGTGTQGRLALPFLLTTLPGLDRLMLFGTHPEGVTAVRERLRAHFPDRDVEIVTDAGAAASEADIIVATAGGHTPAAVGADRLKPGSLSILVGHGLAPSALHRADRVIATSEAQMKVTGIDMADADGELRAVDAEFPPVITGDTAGRRTATERIFAYNSGLVVTDIALGHRFAQLALEQGLGTEVALWR

SEQ ID NO: 13150 - protein, 330 aa, Streptomyces avermitilis
MSTAAAPARQLDPDSVSELRQATEHIHAEFGTSATTPALLKRIATTANAFGDGLRHHCRPVDTDDGLFVLRGLDIDDAAAGPTPDSWATAGDSGAAHDITLLLLATVMGNPIAWEGQQDGRFVHNIVPSPGHETEQTGASSTVLLSPHTEDAFHPGRAHLLMLGCMRNHDDIATTAASVRKTRLSERDVRTLTRPVLPILPDDAYAEAQGYAEEPPPVPALFASEDGITLRFDPAYTPLDQADDAYRSAYGRLGEELARVSVAVSLAPGEVLVVDNDLVVHGRVPFQARYDGTDRWLKRASVRVPGRRTRPLTEAHEHGYGQSAIEAHAR

SEQ ID NO: 13151 - protein, 516 aa, Streptomyces avermitilis
VNINRRQVLLAGGAMGASALLAACSGGGDDTSAASSDKGGKPRKGGTLRIGALGRAGAITRDPHGTQGNESDYLILALVYDTLTVPGADPNTKPRLAASWEPSKDLKTWRFKLAEDAAFHDGSPVTADDVVWSLRRLRNTPSGAARLPGIKAENITADGKDTVVLVSDYANAELPPLTRLTTFVLKKGTSDKELAKAPGTGPFKLDRYRAGNARLVRNDQWYGGTVYLDAIEVTMFETPQAMANALLAGQIDVASNAGAVAARTAKSRKDVQVVRRPDDMSMPLVMRTADGPFADARVREAMRLVVDREAMVKQVLSGYGTVANDIMGTGDPGYAKDVPQRERDLAEAERLLSEAKFDLSKTYELVTTEDISGLAESATLFASQAREAGIKIKVVKQESGAFYEKTWLKGDLYTTYWGTNDSVVFFASKTLVSEAGQNEAGFADKKFDATYRKVIATADPKARAEVLKELQRIEYDRSGYLLWGMADGIDLAASKVRGLPELAGYGRVQLENVWLG

SEQ ID NO: 13152 - protein, 296 aa, Streptomyces avermitilis
MLAILIAAVFAAVELLPGDAANATSERGDSAADVAARRHLLGLDRPLWERFADWMTGLPTGDLGTSARGQKVTDLLADPFPNTLLLATVAFVLTAALSLALGCWTAARPGSMTDRIVGHAATSAFAIPEFVVSVGLLIVLSLWTGWLPAVTLTGADGAPATWTMLIMPALALVIPQTGWNTTIVRGALADQAATPHVEAAQLDGLSPHRVIWRHALPGAVPAVATGLATSTGMLLGGAVVVETLFNYPGIGSVLAGAVANRDTPLIAGVVVCAGAAISLVLLAADVIRARVLGASS

SEQ ID NO: 13153 - protein, 282 aa, Streptomyces avermitilis
MSVATTGRRPATADGRGRVLPRVTPAILLVLLALTGPYLAAHPLDKPVTAPFAPPGDGAPLGGDQLGRDVLSRLLHGGTALIGSALLVAFVVTLLAALIGCFAVLHPVVGRAVERTADVFILLPPVLGIMLIALAWPGGGRWAVISAATVLGIPYAVRVVAGAAAPLATAGYVEAALARGESVTYTATRELLPNLRGTVLALFGLRFVEAVYVISMAGFLQIGPQPPAADWALMIRENAPGILLNPWAVVAPSLTIALLAISVNLAATSLAPRSARKAVTTP

SEQ ID NO: 13154 - protein, 528 aa, Streptomyces avermitilis
VTTPTPAPATGHTPDTPASGAAGTPATLVTATDVGIRIPDGPVLLPPTSLTVRAGEITALTGASGSGKTTLLRALIGHLPARAALACTALDVLGHHVPGLSPAALRALRRSRIAYVGQDPGSALNPRMTIRRLIAETATDAGDHVVPDLLRECRLPTVDGFPDRRPTALSGGQQRRVALARALARTPDILLLDEPTAGLDAALRDDIADLLRHLATARGLAIVMACHDPKLVDTCADHVVRLTAPARPASVAPVSVAPVSAAPAPAPPRVPGRRRPAPAPVVAAGPASAADEGIAARSVSVVFRGRYGVQQALDSVDFTAPPGSATGIVGPSGSGKTTLLRVLAGLHRPDSGTLTLEGQPLAHTARGRRPEHHRRIQFVPQNPLAALNPSRTVGAALTRPLRRHTRLARAEIPGRITALLEQVELPADFARRYPAELSGGQRQRVSIARALAAEPDVLLCDEITSALDPDTAVAVMEVLRRLRTERDMTVALVSHEIHLVAAYTDTVHLLDAGRVTAYGPTAALLPTA

SEQ ID NO: 13155 - protein, 398 aa, Streptomyces avermitilis
MSATPPLPLLKRLPPAVWVAVTWCASTLFTLLTTVRFPGETEPGKWPAAQLYRWDGLTFLVLAAALVLTGSRRLPGRPLTALALLLTAAGLVTTTLGVGEVPLAQFLVVDVALYFIAAGHRRRTGVIALSMALAMLVTWMAVRLLSSWDVGMSAELAVALVTVIAWLLGNATHRTREYADKLSARAAEQAVTAERLRIAREMHDMVAHSIGIIALQAGAAARVVTTQPEAAREAMTAVENTGREALSGLRRMLGALRQADHGEAPEAAGLADVDGLAAATTAAGVRVDVRRLGERRQLPPDIDLSAFRIIQESVTNVVRHAATDSCEVSIDYGDDDRLSIEVADRGRGSGTRTDTGFGLSGMRERVALLHGEFTAGPRPEGGFRVTVRLPVPAPAAAR

SEQ ID NO: 13156 - protein, 239 aa, Streptomyces avermitilis
MSAVRVVLADDQQLIRTALRMVIADLADMDVVGEAANGEEAVRLADELRPDVVVMDIRMPGTDGIEATRRITEAPGDVRILMLTTFDDDDYVYGALRAGASGFLVKDMGLDDILAAVRVVAAGDALIAPGVTRRLIQDFVASPEQPRARRELTEITEREREVLTLVGTGLTNTEIAERLFISVATAKTYLTRLLAKLDARDRVQLVIIAYEAGLVAPARGGRSDDHRGAGGAVTPLRRR

SEQ ID NO: 13157 - protein, 90 aa, Streptomyces avermitilis
MREYDLSNARWRKSTYSNGEGGECVEVAYDFIGAARWRKSTYSDDNGGECVEVADGVPGVVPVRDSKVPDGPVLLIGSASWTDFIGAVTA

SEQ ID NO: 13158 - protein, 277 aa, Streptomyces avermitilis
MANGSRQAAWEFFGAELKRRREDAGFTQVELGSRVFVSGGYIGQFEQAIRKPQLDVAQRIDEILQTDGFFERTWRKLIDDKRYADYFAEVVELERAATKICQFAPSVIPGLLQTAAYARAVTIAANPFVTDEYVEEKVSARLERARILKDATRPEYWAILHENVLRVPVGGPAAMVMQLEHIAALADGRRVLVTVVPREEGACASMAAMMQLMEFDDAPPTLYTETSFSGELLDDPAVVKRAQRAYDLLRGAALSPKTSLALIESAAEDYRRCASTT

SEQ ID NO: 13159 - protein, 75 aa, Streptomyces avermitilis
LQNPQNPPIGSYAVDTRNGRVGIVMGYEGPYVQLRPYGGGREWDVEPEAVRGATQAERLSAATAYANARSRGELP

SEQ ID NO: 13160 - protein, 251 aa, Streptomyces avermitilis
MGLMSLFRDDGIVLRTQKLGEADRIITLLTRGHGRVRAVARGVRRTKSKFGARLEPFSHVDVQFFSRGSELIGRGLPLCTQSETIAPYGGAIVTDYARYTAGTAMLETAERFTDHEGEPAVQQYLLLVGGLRTLARGEHEPHLVLDAFLLRSLAVNGYAPSFSNCAKCGMPGPNRFFSVAAGGSVCVDCRVPGSVVPSAQALVLLGALLTGDWETADACEPRYVREGSGLVSAYLHWHLERGLRSLRYVEK

SEQ ID NO: 13161 - protein, 285 aa, Streptomyces avermitilis
MVVRGILGRQRREYRAPEPHPSGARAPKLPGELIPNHVACVMDGNGRWAKERGLPRTEGHKVGEGVVMDVLKGCIELGVKNLSLYAFSTENWKRSPEEVRFLMNFNRDVIRRRRDEMDALGIRIRWVGRMPKLWKSVVQELQIAQEQTKDNDAMTLYFCVNYGGRAELADAAKAMAEDVAAGRLDPAKVSEKTIQKYLYYPDMPDVDLFLRPSGEQRTSNYLLWQSSYAEMVFQDVLWPDFDRRDLWRACVEYASRDRRFGGAVPNEQLLEMERDMKGSEGVQDA

SEQ ID NO: 13162 - protein, 798 aa, Streptomyces avermitilis
VRRTPRKATAAGALMAATAFLTVGIQAVPATAKPAAPHPSPLRTGGQEAKLTPAQHSALLKSAAKKTTTTAATLGLGAKEKLVVRDVVKDNDGTLHTRYERTWAGLPVLGGDVVVHTPPASLAAGTVSSTFNNKRTIKVASTTASFTRSAAVTKALKAAKDLAAEKATTDSARKVIWAGSGAPKLAWETVIGGLQDDGTPSQLHVITDATTGKELYRYQGVKTGTGNTQYSGTVSLSTTLSGSTYQLYDTTRGGHKTYSLNNGTSGTGTLMTDADDTWGTGSGSNTQTAGADAAYGAQTTWDFYKNTFGRSGIKNDGVAAYSRVHYSTAYVNAFWDDDCFCMTYGDGTSSTHALTSLDVAGHEMSHGVTSNTAGLNYTGESGGLNEATSDIFGTGVEFYAANSSDVGDYLIGEKIDINGDGTPLRYMDEPDKDGGSADSWYSGVGNLDVHYSSGPANHMFYLLSEGSGSKTINGVTYNSPTSDGVAVAGIGRAAALQIWYKALTTYMTSSTNYAGARTAALNAATALYGASSTQYAGVANAFAGINVGSHVTPPTSGVTVTNPGSQSSTVGTAVSLQVSASSTNSGSLTYAATGLPTGLSVNSSTGVISGTPTTAGTYSTTVTVTDSTGATGTASFTWTVSSSGGGGTCASTQLLGNPGFESGNTTWTASSGVITNSSSEAAHAGSYKAWLDGYGSTHTDTLSQSVTIPSGCKASLTFYLHIDTAETTTSTQYDKLTVTAGSTTLATYSNLNAASGYTQKTFDLSSLAGTTVALKFSGVEDSSLQTSFVIDDTALTTS

SEQ ID NO: 13163 - protein, 138 aa, Streptomyces avermitilis
VTTAGSPVRGRSTRQRAAVAAALDEVDEFRSAQELHDMLKHKGDSVGLTTVYRTLQNLADAGEVDVLRTSDGESVYRRCSSGEHHHHLVCRVCGKAVEVEGPAVEKWAEAIAAEHGYVNVAHTVEIFGTCAECAAAKS

SEQ ID NO: 13164 - protein, 298 aa, Streptomyces avermitilis
MTFLDYAFMQRALLAAVLVGITAPAVGIYLVQRRQALMGDGIGHVAMTGVGLGFLLSWSPVWMATAVSVLGAVLMELIRWYGKTRGDIALAMLFYGGMAGGVMLINLAPGGSNTNLMSYLFGSLTTVSQEDVTAICLLAAFVLLVTLGLRRQLFAVSQDEEFARVTGLPVRALNLLTAVTAAVTVTVAMRIVGLLLVSALMVVPVAAAQQLSRSFAATFAIAVAIGVSVTIGGTVTTYYRNVPPGATIVLLAIGAFILLTALATPLARRRARAAAQETGDPAECTIPATRSPERKVGV

SEQ ID NO: 13165 - protein, 270 aa, Streptomyces avermitilis
MDGVGGMDGVDGIGGANDPVISLRGVRAELGSRPVLRGIDLAVHRGEVVALLGANGSGKSTAVRSIIGQVPVSGGEIELFGTPRRGFRDWKRVGYVPQRTTAAGGVPATVTEIVASGRLSRARFGMLRKADHQAVRRALELVGMADRAKDSVDALSGGQHQRVLIARALASEPELLIMDEPMAGVDLASQEILAATLREQVSRGTSVLLVLHELGPLEPLIDRAVVLRDGCVLHDGPPPQAVGQHALPGHDHVHPHAAHDAEPIRTGLLS

SEQ ID NO: 13166 - protein, 320 aa, Streptomyces avermitilis
MNVRRRLIPGTAVAATTLLGLGTLSACSDSTAADGGNGGKLDVVASFYPMQYLAEQIGGKHVRVTSLTQPGQEPHDLEISAQQTVQLEKSDAVLYLKNLQPAVDDAVAQSGVRTKIDAASLTTLEKHGNEVGGHAAAHDDTKGEESGGTDPHIWLDPVKYSEVAQGVGKALAKADPEHAADYRKNTAALVEKLDGLDTRYADGLKNTGTKVFITTHAAFGYLAERYGLTEEAISGLDPESEPSGNRVKELEKMAQADGVSTVFYETLVSDKTAKTVAKDARLRTDVLDPIEGITEKSRGTDYFQVMESNLKALRTALGAK

SEQ ID NO: 13167 - protein, 460 aa, Streptomyces avermitilis
VAADKIDTIVSLSKRRGFVFPCSEIYGGQKAAWDYGPLGVELKENIKRQWWRYMVTSREDVVGIDSSVILATEVWVASGHVATFSDPLTECTSCHKRYRADHLEEAYEAKHNRSPENGLADINCPNCGNKGQFTEPKQFSGLLSTHLGPTQDSGSVAYLRPETAQGIFTNFAQVQQTSRRKPPFGIAQMGKSFRNEITPGNFIFRTREFEQMEMEFFVKPGEDEKWQEFWMQERWNWYTGLGLREENMRWYDHPAEKLSHYSKRTADIEYRFQFGGNEWGELEGVANRTDYDLSAHAKASGQDLSYFDQEAGERWTPYVIEPAAGVGRAMLAFLLDAYVEDEAPNAKGKMEKRTVLRLDPRLSPVKVAVLPLSRNPELSPKAKGLATALRQHWNIEFDDAGAIGRRYRRQDEIGTPFCVTVDFDTLDDNAVTVRERDSMKQERVSLDQIEGYLAARLIGC

SEQ ID NO: 13168 - protein, 350 aa, Streptomyces avermitilis
MIRRKLRLLAVALTAAVLTPLSIATAPTASAADTCAVKSRPSGKVLQGYWENWDGSSNGVHPPFGWTPITDSRIAAHGYNVINAAFPVIRSDGTALWEDGMDTGVKVATPAEMCQAKASGQTILLSIGGAAAGIDLSSSAVADRFVATIVPLLKKYNFDGIDIDIETGLVGSGNIGQLSASQANLIRIIDGVLGQMPSNFGLTMAPETAYVTGGSVAYGSIWGAYLPIVKKYADNGRLWWLNMQYYNGSMYGCSGDSYSAGTVQGFTAQTDCLNKGLVVQGTTVRVPYDKQVPGLPAQSGAGGGYMSPSLVSQAWRHYGSGLKGLMTWSINWDGSKNWTFGDNVKALQGR

SEQ ID NO: 13169 - protein, 338 aa, Streptomyces avermitilis
MRTRPLGSTGPQVSALGLGCMGMSSLYGEADRAESVATIHAALEAGVTLLDTGDFYAMGHNEMLIGEALRTAPAGLREQALTSVKFGALRGPDGNWIGYDGRPAAVQNFAAYSLQRLGVDHIDVYRIARVDPDVPIEETVGAIAELVEKGYVKHIGLSEVGAETIRRAAATAPISDVQIEYSLISRGIEDRILPTTRELGIAITAYGVLSRGLISGHFTRDRQLAATDFRAFSPRFQGENLDHNLTLVEALRKIAEQKGVSVAQLAIAWVLSRGQRHNTDIVPLIGARTRERLSEALGALEVTLDDADLNAIEAAVPADSAAGERYPQAQMAHLDSER

SEQ ID NO: 13170 - protein, 195 aa, Streptomyces avermitilis
MAPSTETLTAERILEATEEVLRRHGPAKATVVDVARALGVSHGSVYRHFRTKAALREAVTQRWLDRTAKALSGIVAEDRDPQERLLDWFSALFAAKRHKAGDDPELFATFMVLTGESSGVVDDHIADLTGQIAAIVRDGVARGTFAASDPVVAARALFQATGRFHDPCYAREWEQPGIEAEFDALLELVLRGLRA

SEQ ID NO: 13171 - protein, 274 aa, Streptomyces avermitilis
MTDHTTAPGAQARPEFDTSVPHSARIWNYWLGGKDNYAVDEAAGDAYSAVYPGIVTIARSSRAFLRRSIRHLVAEAGIRQFLDVGTGLPTVDNTHEVAQGIAPESRIVYVDNDPMILAHARALLRSTPQGATSYVDVSLYEPDRILAAAAETLDLTRPTALILSGILGHVPDYDEARSIVRRLLDGLPSGSYLSVNDGSRGTDPDYERAQDGYNETGAVPYFLRPVARIEAFFDGLELVEPGVVSVPLWRPEESGADAPAPAPIGQHGGLARKP

SEQ ID NO: 13172 - protein, 282 aa, Streptomyces avermitilis
MGQRGRHAAPRAGMQRVRRVAAVVLAAGALASAGTSAAFADMLEDIPLSGEQNIDQVGAQNLACGNSARLVRLNVAQIEHRDRVCTDDDGHTGHNSAHAGGARAEGGTTLGPQGNTAQTGKQNLACGNSADLVTVNVTGDMYWDTTCVVTDDGHHHHGGHQQGAHAEGARAVGGTSVGPQANTAQTGRQNLYCGNSADALTVNVMGTISKHTTCAAADRSSHGSGDTDHGRASVLPGQAVGPEANAAQNGNQNQTCGNPGTGVDVPLGRTTRQTSCTVHAGA

SEQ ID NO: 13173 - protein, 594 aa, Streptomyces avermitilis
VRAGKARCVAVAVAVVGGVMSVACGPAGADTPGARAEGGSGTGDVFQTNVAQEGRQNNHCSNVTGDETVDLTGGRLQGRCVTEDGSFNGFSKVHTGPADAKGGGGTTRLAQQNVAQRGRQNNDCASRNTFSLTASGDKIQSNCADEDTSVSDHTYSQGRGASAEGRSGGNFDQQNVAQAGRQNNICDSPDYVFPDLTGSRFDTDCTNKDASVSRHTSDKSGGAQARGAQAGSSEVQDIAQEGRQNNFCANPNSTDADPVSDSRVDADCANKDASLSEKTRHKGGGAQAKGGALAQEQQNIAQEGRQNNSCANPNVSTLDLSGARTDTDCVNKDVSRTKHSLVKGGPARAEGGSGEDVFQQNIAQEGRQNNACDNANDSDITATGGRSKNRCATVDGSKNRHTVETSRGAAAVGGSGVADLSQQNIAQSGRQNNACANANDSDITATGGRSKNRCATVDGSKNRHTVETSRGAEAVGGPSAADLSQQNIAQEGRQNNACANHNGLNADVTGARQDTACVTVDRSVNAGTKKSSGGASVEGGSSVADLFQQNIAQEGRQNNACGNTNNLTLTANGGSTQNQCVAVDRSVNIGTQED

SEQ ID NO: 13174 - protein, 151 aa, Streptomyces avermitilis
MTALHWKLVIDTQDALSLADFWAAALEYEVEDNSDLIAGLLATGRLPEAAVTEHDGRRVFRGFAAIRHPQDPHEKATGIGQGRRILFQDVPEAKTVKNRLHLDVHAEPGGRDALVARLESLGADRLREVDQGPAGHWWIMRDPEGNEFCVA

SEQ ID NO: 13175 - protein, 107 aa, Streptomyces avermitilis
LLRERTGSARGQYGRTVRTDVRAGIGPDRRQVFLDAGGVMPQINTSKVSRWDQHGRVHIVHVQRAGVQRVIRCGTCGWRQGAQFLPWLKAEEHLAEAHQATVDPTGA

SEQ ID NO: 13176 - protein, 169 aa, Streptomyces avermitilis
MAVKPEESEKSEEADFTPLRPPTLLALPSYLAGHVARIGHRALVEALKEYDLRLPHFAVLVGLGDFGPLPQHELADRLGLNRSHLVGYLDQVETQRLVRRERDPRDRRRQRVALTSEGTERLGELKALAGRSQTEFLDALTETERDTLIGLMRRIVTRDDAAQQAMSTP

SEQ ID NO: 13177 - protein, 263 aa, Streptomyces avermitilis
MPDYGHDLLFGAVLTPDAQNPRAVLESARLADRSGLDLVSVPDHPYRPDFLDAWTLLSVIAAHTERVRVFPNVANLPLRPPAGLARAAAALDVLSGGRVELGLGAGGYWDAIAGEGQPRRTPGEAVEALAEAIDVIRALWASGGAGATVDGTHYRLDGARPGPPAAHPLGIWVGALGPRMLRLIGRTADGWLPSATRVPPAELAVGQRIVDEAAIAAGRDPRAVRRLYNLPGPVPAEPLAELTPAVRAGSRPGGEGVGGPRPR

SEQ ID NO: 13178 - protein, 475 aa, Streptomyces avermitilis
VTETLTSPTTRSPVAPPVLGGLGLFTVLLGAALPLIDFFIVNVALPTIGRDLHASETVLELVVAGYGVSYAVLLVLGGRLGDLFGRREFFLGGMAAFGLTSLACGLAPSAWTLVAARVAQGAAAAAMLPQVLATIQSATEGPRRAKAMGLYGATAGLSMVAGQILGGVLVAADIAGTGWRSVFLVNVPVVVVGLFLAARAVPETRSQRPEPVDGPGTVLLAVSLLTLLVPLTEGRAAGWPLWTWPALAAFPFAAWAFYAVERRADRQGRTPLVPPSLFALTSLRRGLVMIVPFSIGFSGFMFVIAVALQRGAGLGPVPAGLALAPMAVVFFAVSLCGPRLVARYGTRVVTAGGLIQAVGVTLIVLAALRSWPDLGVLELLPGAAVAGAGQALQLPVLFRIILSEVPPTRAGVGGGVMITTQQSGLALGVATLGSLFLALVPGWGMRDALVTTLLVQLAGVALTTALSLRLPRSIS

SEQ ID NO: 13179 - protein, 300 aa, Streptomyces avermitilis
VRAAEERARATQDTPRAQHTREAAIRRHELAAFLRHRREHITPEQVGLPRGRRRRTPGLRREEVAQLSAVGVTWYTWLEQARDIQVSVQVLDALARTLLLDSSERAHLFNLAGTADPEPGANCPSVTDAQRALLEQLEPIPACIQNSRYDILAYNRTYGLLLCDLDAIAPVDRNCMLLCYTNADWQASIVRLDDTMRLMAAKFRASMADHLAEPAWKMLLKRLSGESPEFREAWERHEVVSARSKLKQFRNAHVGLLSLNHTDLWLGPHNGPRMVTYAPADEESRRGLEKLQEIAVAREG

SEQ ID NO: 13180 - protein, 481 aa, Streptomyces avermitilis
MPELSPRRRLLVLAICCLSLLIVSLDNTVLNVALPSMQKELHASVAGLQWTIDAYTLVLASLLMLAGSTADRIGRRRVFRTGLVLFTIGSVLCSLAPNLESLVAFRMVQAVGGSMLNPVAMSIITNTFTEPRERARAIGVWGGVVGISMAAGPIVGGLLVDSVGWRSIFWINLPVGLVALLLTWRYVPESRAPKARRPDPVGQLLVIALLGSLTYAIIEAPSSGAAEILAFGGTALAALIALLWYEPRRAEPLIDLRFFRSVPFSGATVVAISAFAALSGFLFLSTLYLQNVRGLSALHAGLWMLPMAVMCFVCAPLSGRLVGSRGPRFSLLTAGIAMTASGVLFAAFEAETSDVTLVIGYVLFGVGFGFVNAPITNTAVSGMPRAQAGVAAAIASTSRQIGGTLGVAVVGAVLASGVRTGPYRQVFESAARPGWWIIAGCGLSVLVLGALSSGAWARATARRTAQRLESTEVRDEAGVNA

SEQ ID NO: 13181 - protein, 401 aa, Streptomyces avermitilis
MSTPAATMVSPLQIGPHTVQPPVVLAPMAGITNAPFRTLCRGFAEGHGWESGGRPPKGAADGGKGLFVSEMITTRALVERNEKTMQLIHFDATEKPRSIQLYGVDPATVGKAVRMIAEEGLADHIDLNFGCPVPKVTRKGGGSALPYKRNLLRAILREAVSGAGNLPVTMKMRKGIDDDHITYLDAGRIAVEEGVTAIALHGRTAAQHYGGTADWDAIARLKEHVPEIPVLGNGDIWSAEDAVRMVRETGCDGVVVGRGCLGRPWLFSDLVAAFEGRTDDSARPTLRAVADVMVRHATLLGEWIGDEARGVIDFRKHVAWYLKGFAVGSEMRKRLAITSSLVELSDGLAELDLDQAWPLGADGPRGRTSGNNRVVLPDGWLKDPYDCAGISEDAELDTSGG

SEQ ID NO: 13182 - protein, 617 aa, Streptomyces avermitilis
LPLFTRSNQTPDRAGAATDEGLPSADAEDATPEEPAAPPSDATAGKPEPEPEGAGAVAQAAPRTRRARLRARHPVAARVLSWAVTLLAGALVVVALLLPNKPADFRPSEFARIPVEALLGAAVLIALPRRPRLFAAVLGGLSLGVLTLLNLLDIGFNEFLGRGFNVVLDWSLLGDAQSYLKDSAGEAGALGATVAVVVLVLAVPAVMAWAVVRLGNLMARHTAITTRATLVLSTVWMTCASLSLQVGGVPIASEHTAAVVRDRAARVKATIRDERGFAREAKADTFGNTPGSELVPDLRGKDIMFTFIESYGRSAVEDPIMSPGVDATLDAKTKELAKAGFHAKSGWLTSATYGGSSWLGHSTFLSGLWIDNQNRYRTVTAGDHLTLTSAFKKTGDWRTVGIMPGVQKGWPEAKFYGLDHLYDAHHLGYQGPKFSWSTMPDQYTLAAFQRLEHGRKHDKPLMSEIILTSSHQPWAPIPKTIPEDQVGDGSVYDAVEKAGKKPADVFYNSTKVKQEYGKSIQYSVTSLIDYVVKYGNKNTVLVFLGDHQPMARVSGDKASRDVPVAIVAHDPKVLDKITDWGYSDGLRPAHDAPVWKMSSFRDRFLTAYGSTPRPSKG

SEQ ID NO: 13183 - protein, 647 aa, Streptomyces avermitilis
MTDRHHLLVHGGTFAAVGDGGDISGVRGGGSGSPDGLFVRDARHLSRWQLTVDGAVPEALSPVRAGDTARCVLVPRGGRQEPPAYTFFREQAVTEGAFVESLRVTSNRPAPTTVRIAVTADADFTDQFELRSDHRTYSKAGAVRSRQVLDDGVEFSYQRGEWRSGTRVTSEPAPDGVEETGTGARRLVWTLDLEPHGSAELSLRVAARPHGAAHPAEVPASPADASARLLALEGEFLGGVPFPTGWPELAAACARGLSDLAALQVPATGPDGEELRVPAAGAPWFLTLLGRDALLTSLFALPYRPQLAAATLPALAATQATEVGVGSVAQPGKIVHEVRHGELAHFGQVPFGRYYGSVDATPLFLVLLGAYVEQTGDVALARRLEPNARAAVGWMLDHGGLTSRGYLVYRADGGGLANQNWKDSPGAICSADGSRATGAVTAAGAQGYAYDALRRTAQLARTVWGDEVYAALLEQAAGDLRDRFQRDFWMPEQGFPALALDGEGRQVDALASDAGHLLWSGLLDKEYGEMVGRRLLEPDFFSGWGVRTLAADQAAYHPLSYHRGSVWPHDNALITLGLARYGLHDEARTVAHALVDAATAAGHRLPEVLAGYGRDTHAEPVPYPHACVRESRSAAAPLALLTAVGGA

SEQ ID NO: 13184 - protein, 431 aa, Streptomyces avermitilis
VPSRGLYPHQWSWDSAFISIGLRHLSPLRAQTELDTLLGAQWGDGRIPHIVFNPSVPLDAYFPSPDFWRSSTAGRAAGAPRTVQTSGIVQPPVHALAAWLVHLSDPGLSRSRGFLSRVYPHLAAWHRYLLHRRDLGGGGLVSVVHPWEQGMDNSPTWDEPLSRVTPAPARSFRRADLDHGAAEDRPTDLDYGRYVRLATDYRDGEYADGRGEFAVEDPAFNALLIASEHALARIACELGAAGTARHTRAERLTAALVDRLWDPAEGMFFCRDVRTGDLVPERSVAGLIPLLLPALPRDIAAALVGTACGPHFGLGDTTRLVPSYDLTGEAFDPHRYWRGPAWFNTNWLLERGLRLHGERGRADALRDAALRTADASGFAEYVDPYTGEACGALGFSWTAALALDLLHEPHEPDEPLGHDVSPMGIGTFRHE

SEQ ID NO: 13185 - protein, 408 aa, Streptomyces avermitilis
VCMNGRAGRVGNQASAGDLLELVRSGRATTRGALQQATGLSRATVGQRLDRLFRAGWLREGAGGPVDSPLGGRPSITLEFDDAHAVVLTADLDTRHARAAVLSLTGEILAEQAGLLVLGDGPDAVLGELGHWFAELLRKAGRPADEVCGIGLAVPGPVDRDTGRVVQPPIMPGWDGYDIRGRLGRAFAEHAHGRADVPVLVDNDANLMAYGEQRTAYPDCSAFALVKVSTGIGAGVVVGGTIYRGIDGGAGDIGHIRVPEGTDALCRCGSYGCLAAVASGGAVAARLAEAGVPAASGSDVRELLTAGHPEAVALAREAGRRVGDVLATVVTLLNPGVLMIAGDLAGTPFLTGVRELLYQRALPRSTAHLDVVTSRLGDRAGLIGAGALVVEHLYAPERVEERLLALGV

SEQ ID NO: 13186 - protein, 916 aa, Streptomyces avermitilis
VSENKDPQVADVAESGVAGVKFVYDFTEGNKDLKDLLGGKGANLAEMTNLGLPVPPGFTITTEACKTYLDSGEEPAALRDEVSAHLDALEAKMGKKLGQADDPLLVSVRSGAKFSMPGMMDTVLNIGLSDKSVQGLAKQAGDDRFAWDSYRRLIQMFGKTVLGVDGELFEDALEAAKAAKKVTIDTDLEAADLKRLVTKFKKIVKTEAGRDFPQDAREQMDLAIHAVFDSWNTDRAKLYRRQERIPHDLGTAVNVCSMVFGNLGPDSGTGVAFTRDPASGHQGVYGDYLQNAQGEDVVAGIRNTVPLAELEQIDKKSYDQLMQIMATLENHYKDLCDIEFTIERGQLWMLQTRVGKRTAGAAFRIATQLVDQGLIDEAEALQRVNGAQLAQLMFPRFDDQAKVEQIGRGIAASPGAAVGKAVFDSYTAIKWSRSGEKVILIRRETNPDDLDGMIAAEGILTSRGGKTSHAAVVARGMGKTCVCGAEELEVDTKRRRMTAPGGVVVEEGDVVSIDGSSGKVYLGEVPVVPSPVVEYFEGRMHAGADDADELVAAVHRIMAFADRKRRLRVRANADNAEDALRARRFGAQGIGLCRTEHMFLGDRRELVERLILADTDAEREESLKELLPLQKKDFIELFEAMDGLPVTVRLLDPPLHEFLPDITELSVRVALAESRKDSNENDLRLLQAVHRLHEQNPMLGLRGVRLGLVIPGLFTMQVRAIAEAAAERKAAKGDPRAEIMIPLVGTVQELEIVRDEADQVIAEVQAATGTELKLAIGTMIELPRAALTAGQIAEAAEFFSFGTNDLTQTVWGFSRDDVEASFFTAYLEKGIFGVSPFETIDKDGVGKLVRDAAVAGRATRPDLKLGVCGEHGGDPESVHFFHEVGLDYVSCSPFRIPVARLEAGRAASQSAGSDHR

SEQ ID NO: 13187 - protein, 497 aa, Streptomyces avermitilis
VTRRLLLSYLSLAALVLLCLEIPLGFVYSRGERERVVGKARDESESVSMYASLSITAGRAERDLPDRAAHCAERIGGKVVIVDESGGLLATSHPLSTAEVRGLAARPGIAAALRGTSTVDVRTSTIGGVQYLSVAAPVRHGAYRQGAVWITLPTRTVHSRVHHVWLLLALGGLAVLTAVAVVGFAIARWTGHPIRELERATHQLADGGTATPVAVTTGPPEVRSLAATFNRTAARLEHLLASQRAFAGEASHQLKTPLAALRLRLENLESGMAPHARPGLTAAMTETDRLARMVEGLLAMARLDESAATREPVDLDRVCAERHRTWTPLFEQHGVRLVLLGDPAGQVLAVPGAIEQILDNLLSNALRVAPSGSAVTLDVRRPPAPERRFHHRPPDPSRPSRVALHVMDEGPGMTEEQRRRAFDRFWRAPDAPKGGTGLGLALVQRLTHASGGEVELRPARRGGLDAVVRLPSARPPAHSHPSGREGRRRRGAPAVPA

SEQ ID NO: 13188 - protein, 282 aa, Streptomyces avermitilis
MGLRVLLIEDDETIAEPLAEGLGHFGLTVDHVATGTEGLRGPYGDVVLLDLGLPDMDGIDVCRGIRQVSGVPIVILSARGEEADRVLGLELGADDYLAKPFSMRELVARVRAVTRRTQRARPAHEPTPPTPTSTPSPPPAPSYEPTSAPAYQTAPPPSHEPAPRPSYEPPPHPAPGPGPLVVDRRTRQVWVGEQPVVLTPKEFELLALLTEDPGAVYSRQQILDRVWDPHYQGPTKTLDVHVATLRRKLGHPAWIQTLRGVGFRLAVHTEPSRRRHQQVAYP

SEQ ID NO: 13189 - protein, 201 aa, Streptomyces avermitilis
VKELLDHARSFKRQVDFESGEYRKLAEGQYPEALFITCSDSRVIPALITGARPGEIFELRNAGNIVPPHGQHGASGEAATIEYALEVLGVQNVVVCGHSHCGAMGALKSGDDLSMLPGVDAWLELARPDLAPMLGTACDDPSLPDVAQCNIVNQLSTLRSYPVVRQRLETGLLRLHGWYYEVDTGQVYELDDDGRFRVHAG

SEQ ID NO: 13190 - protein, 705 aa, Streptomyces avermitilis
MSGSHARGRVPAHTRTAAKTVTKTATKTATKTATDAATETVPETATRTAPKAGAKADLGTEITASLVVFLVALPLCIGVAVASGVPAELGIISGVIGGLVVGAARGSTLQVSGPAAGLAALVSETVLEHGVAMLGVIVLGSGILQIVLGLVRLGRLFQAISLAVVQGMLAGIGLPLMFSQAYPMADTKAPGTPIENMAGIPGLLGETVTHPQAAIAALLGIVTIVLSFLWKKMPGPVKKIPAALVAVGIGIAVAALPGVNVKTLQVGNLPAAVRMPGPEQFAGLADAAIISSVLTFTVIASAESLFTAAAVDRMHSGPRTRYNAELIAQGAGNTVAGILGALPITAVVARSSANVQAGATTRLSRVLHGLWLLAFALLLPQVLALIPISVLAGVLVHSGWKLFAPEEFPKMWRQDRGEFAVMTLTTLVIVATALLEGVLIGLAAGIVLAALRMSQTVIRQHLDEDTAKVVMAGNATFLRLPQVIEALEAAAASGRPRIRLDLTGVTHLDHACRNQVEDFTAQQRGLGLRVELLMPGPAKAGPAETGPVGRAGAMASAPGSGGADTPSARDSGAGAMTSASGAWAQAAAPGSWTEASAPGSWEEARTSGSWEEARPPASPPAGAAGAAESFRQGYRHGSRGYRTAPLPRRRRAAAPVEESAPVEAPAMAEAPATAEAPAPAPSPTAEWFYLDTSLSDPDDCAGRLG

SEQ ID NO: 13191 - protein, 308 aa, Streptomyces avermitilis
MADWNTSDIPDQRGRVVVVTGANSGLGYVTARELARKGARVVLACRSEARGAEAGDRLAAELPGAEVELGRLDLGDLGSVRDFAAWFPYERLDLLVNNAGVMALPYGTTADGFETQFGVNHLGHFALTGLLLPTLLGTPGARVVTVSSGMHALANIDIHDLNGERRYRRWIAYARSKTANLLFTHELTRRLAAHGSEVLAAAAHPGYAATNLQTAGVRMEGRRAAERIVELGNRVLAQPAEAGALPVLYAATAPEVRPDSFTGPSFAGWRGAPAPSWRAPWTLNDAMGERLWSASEQLTGVTYEALKV

SEQ ID NO: 13192 - protein, 116 aa, Streptomyces avermitilis
MTLAPETTALKVHLSLGGDWLSICDLSLLTPGRGVAALLPDGCQVALFLDRAGRVYGIDNRDPFSGAAVLSRGLTGTHQGRPFVASPLLKQRFDLESGQCLDDESVRIATYEVRTS

SEQ ID NO: 13193 - protein, 868 aa, Streptomyces avermitilis
MSTTALVGTGHRPTIVLVGHGMVGQRFLEALAERGLTATHRVVVLCEEPRPAYDRVQLTSYFSGTTPDELSMTDAEFITEHGIDLRLGDPAETVDREARTVTARSGLVIAYDTLVLATGSYPFVPPVPGKDAEGCFVYRTIEDLLAIEAYAKSRATTGAVVGGGLLGLEAAGALKGLGLTSHIVEFAPRLMPVQVDAGGGAALLRTIEDMGLTVHTGTGTQEIVTGDDGAVTGMKLSDGSELATDLVVFSAGVRPRDQLARDCGLPVGERGGIAVDAQCRTEDPHVFAIGECALAADGRVYGLVAPGYEMAETAAATIASADSSFTGADLSTKLKLLGVDVASFGDAHGATAGCLDVVYADSRSGTYKKLVIGRDGELLGGILVGDADAYGTLRALTGSVPPVSPEQLVLPAGGGGGVALGPSALPDSAVICSCHNVTKGAIRGAVTEHSCTTLPEVKKCTKAGTGCGSCVKVLGQLVNDELTASGVEVDHGLCGCFTQTREELYEIVLALRITSYRSLLDRYGREGARGGDGCEVCKPTVGSIIASLAPTIGANGYVLDGEQSALQDTNDHFLANLQKNGSYSIVPRIPGGEITPEKLIVIGEVARDFGLYTKITGGQRIDLFGARVEQLPLIWTRLVDAGFESGHAYGKSLRTVKSCVGQSWCRYGVQDSVRMAIDLELRYRGLRSPHKLKSAVSGCARECAEAQSKDFGIIATANGWNLYVGGNGGATPRHADLLAQDLSDAELVRLIDRFLMFYIRTADRLERTSVWLERIPGGLDHIRDVVVHDSLGICEELESLMTAHVANYRDEWTETINDPEKLARFVSFVNAPDTPDPVVGFVPERDQIKPDLPLLTIGHRPLEGSAQR

SEQ ID NO: 13194 - protein, 260 aa, Streptomyces avermitilis
MPDISLTMVVVLCFAALAAGWIDAVVGGGGLLLLPAMLLGLPGGTPAAYALGTNKAVAIVGTAGAAVTYARKTRVDVGTAVRIGLAALAGSTAGAFVAAGLSTAVLKPVVMVVLLGVGTFVILRPAFGMAPSTEPVSVRRMLAAIGLAGLGIGFYDGLIGPGTGTFLVLALTALLHLDLVTASATAKIVNCCTNAGALATFAWKGTVFWQLAALMAVFNLVGGMVGAHTALKKGSGFVRVVLLTVVFALVANLAYNQWIA

SEQ ID NO: 13195 - protein, 206 aa, Streptomyces avermitilis
VPRFGNIAIASVTVAALCSGAWLLGSGAESHAPPQPSAAQASARADREQSAAPALPPSPPDRIRIPSIRVDAPLMGLLLTPQGSLDVPPAEKKNLAGWYEAGTTPGETGTAIVAGHVDNAEGPAVFYDLGALKKGSSIEVQRRDGATAVFSVDAVEVYEARNFPDEKVYGAARRPELRVITCGGGYSKTTGYQGNVVVFAHLTGSH

SEQ ID NO: 13196 - protein, 169 aa, Streptomyces avermitilis
MRRTARLLTGTALAVGAAGLAASPAYGGDSGILEVYPSTVVPGGTITANTAACGAATGDASAVGAGTFPLAPSAHEHDLIGQFRVPPSAQPGTYEIVVKCSGGRQVTGDLMVTLTSTKQQVQPKGSVKTGVGGALGTDPVQTAAGVAALAVAAAGGTWLLHRRARGDGI

SEQ ID NO: 13197 - protein, 220 aa, Streptomyces avermitilis
MKTTTTVELSSAPVSAPVPVPVPAPAAAAADGPVRVAVLVGSNRQGRFGPVVAEWLLGQVRERDDLVPDVVDVAEIPLPTTMSPSPAATAALAEVTPKLAAADAFVVLTPEYNHSFPAGLKNLIDWHYAEWRAKPVALVSYGGVSGGLRAVEHLRQVFAELHAVTVRDTVSFHGASAAFDERGRPHDPAGPSAAAKVMLDQLVWWAQALREAKRTRPYGG

SEQ ID NO: 13198 - protein, 225 aa, Streptomyces avermitilis
MNLFSRNSSPRRATTPAAPTVPAGSTAPAGYSAPITTVTPDPALAALSGEWVIDPAHSRIGFSVRHAMVTTVRGAFAEYESRLYFDGRNPARSRAEIVLSTASVQTGVEQRDAHLIGRDFLDAARYPHLRFASTAVQLASPDVYRMAGDLTIRNATCPVVLELTYIGHVMDPFGYERVGFDGTTTINRSDWGLTYNARLAEGGAMVSEKVRLQFDIAAIRSTPAG

SEQ ID NO: 13199 - protein, 140 aa, Streptomyces avermitilis
MAAELHLLGRAVKQTQYRQHRALDSRLAGVGTTLAQWDALRAISRSPGASARALAAATFQSEQAFGTLAGRLVTQGMVERRPGHGRRIEHHLTPLGEKTLKAGHQVAEEVLAECFAPLSEAERTTLLNLLRRLGDEAPDE

SEQ ID NO: 13200 - protein, 249 aa, Streptomyces avermitilis
MTSELPFTLSEAGTGRPVLILHGGGGPATVAPLAGHLARTAHTLVPTHPGWNGTPRPDRFAGVDDIALAYLRHLQDRGLRDVLVVGSSLGGWIGAELAARDDLGIITGLVLIDAVGIQVDGEPVRDFFALDARGVAEYSYHDPDRFYVDPADIPAGQLAARQANMATMRALAGDPYMHDPTLRGRLARVPVPTLVLWGESDRIVTPAYGRAYTDAFPDARFEVIPKAGHLPQLEQPEATFAAIDAYLAR

SEQ ID NO: 13201 - protein, 504 aa, Streptomyces avermitilis
VIDNAAAVLTHQAARLGLTAAQGTSVRDVVVDADGGQHVRYDRTYRHLPVLGGDFVVHLAPNGSYRGADRSTRRAISLADITPALSAPKAADLATAALRAANTGELLKKVTAKPQLVVDALHGAPKLAWRTNVVGQDSLGNPVARTVLTDARSGKQIDAWDSIETATGDGKSLYSGTVALESTLSGSTYQLKDATRGNTYTGDAANKTDLCILGICFSRAPATLFTDADNHWGTGAASDRSSAAVDAQYGTNETWDYYKNVHGRNGIAGDGKGSYNRVHYGSNYNNAFWDDSCFCMTYGDGDGTTFGPLVALDVAGHEMSHGVTSKTAALTYSGESGGLNEATSDVFGTLVEFHANNSSDAGDYLIGEKIVRSGFGKAALRFMDKPSKDGNSADCWSSSVGNLDVHYSSGVANHFAYLLAEGSGAKTVNGVSYNSPTCNGSTVTGIGRDKLGAIWYRALTVYMTSSTNYAGARTATLSAAKDLYGAGSTEYNAVAAAWSAVSVG

SEQ ID NO: 13202 - protein, 147 aa, Streptomyces avermitilis
MVTAHGDDDPVTLPFFVYGTLRPGEHNHDLFLRGRTESEEPARLRDAVLYEGPGYPYAVEEPGAGPVCGELVTALPEAYGELLGALDRLEEYVPGDPGNLYERVALHVTRGDGAAVRAWVYVAAPAVAARLRARGTLIGGGDWHARR

SEQ ID NO: 13203 - protein, 363 aa, Streptomyces avermitilis
VRVLRCRSPRAGDRGGGGPCGVTGRRGGAPNLAAMTDSDKSDITRRRVLALGGAAAGAAMGLGISSCSSDSGARTSGSPAHGASGTDVCVLNSSATEGSYYLDGALFRQDITDGKKGVPLTVRLTVRDRTGSCAPLGDAAVEIWHCDAAGHYSGYPTAGPAGTAPGPAGGSTDTSGADERTYLRGYRTTGDDGTVEFTTIFPGWYPPRAPHIHVKVHTGGTSTDRTYQGGKVNWTGQLFFDDRYGDEVYGTSPYTEHTGTRTRLTEDTVYAGGGARDGLMAVTGDVVKGFTGTLTVAVDPEEEGRGADTVGAGSPPPGGAPSGSPSTGTPSGPSPTATPTVTPGGTPTPPPDSAASASATATP

SEQ ID NO: 13204 - protein, 230 aa, Streptomyces avermitilis
MGLPRLGIRRPRLPRTRAGRRRAVQVVMLGCVLALLPATWMFAVAGDRLRTTEDAPRTEVAVVFGAGLWAGEPSPYLAHRLDAAAKLYRAGRIEVVLVTGDNSREDYDEPDAMRTYLTRHGVPDGRIVSDYAGFDTWDSCVRAKKIFGVNHAVLISQGFHIRRAVALCQAAGVDSYGIGVDAKHDATWYYGGTREIFAAGKAALDAVFKPDPRFLGPKEPGVGEALAADR

SEQ ID NO: 13205 - protein, 306 aa, Streptomyces avermitilis
MTASNPSRDESSFRPGGRPPRAVPLDSTAQLMNAISSQLGSQLSLVSLNGARRPAPPALVLVGHGSRDPRALSTVRTLIDRVRELRPHLPVHLGHIELNEPLLPDTLAALQDDSRAVLVPLLLSRGYHVKQDIPDAAAAATRVRTHVAAPLGPHPLLVETLHARLTEAGWRTRMSDSARRASAVVLAAAGSRDPESAVDTRRIAQLLAERLGVPVVPAYASAAAPTVPAALRALAARGRHRVAVASYFTAPGRFATACAEAAPWIAAAPLGAHPAMARLVLHRYDQTLAATGSATGPASVPALATA

SEQ ID NO: 13206 - protein, 450 aa, Streptomyces avermitilis
MEGTTPGTPQAYEDYEETVSYEDAVTRVGYDESAVERWAVEPDKRPGRTAFQRDRARVLHSSALRRLAGKTQVVTPGTRSRAWDASPRTRLTHSLECAQVGRELGAALGCDPDLVEAACLSHDLGHPPFGHNGEQALNEFAEDCGGFEGNAQSLRLLARIEPKRFVRSEGSGELVSVGLNLTRAALDAATKYPWPRRAHPTDPTSPKFGVYEDDRPVFDWIRKGAPGHRTCFEAQVMDWADDVAYSVHDVEDGLHAGHIDPNCLHAEPERQAVFAVAIGRYVPADTDPAELAEALDRLLDQEWWPHGYDGSAVAQARLKDATSQLIGRFCLAAEGATRAAYGSGRLTRYAAELVVPRAARLECAVLKAVADWYVMQRAEQERLRADQRVVVAELAEALTARAPEGLDPQFWALFDEAADDRARKRVIVDQIASLTDVAARSLHARLTGHL

SEQ ID NO: 13207 - protein, 421 aa, Streptomyces avermitilis
VVDADQTFVIVGGGLAGAKAAETLRAEGFTGRVILICDERDHPYERPPLSKGYLLGKEERDSVFVHEPAWYARNDIELHLGQTVDAVDRAAKTVRFGDDGTLVHYDKLLLATGAEPRRLDIPGTDLAGVHHLRRLAHAERLKGVLAALGRDNGHLVIAGAGWIGLEVAAAAREYGAEVTVVEHGPTPLHGVLGPELGQVFAELHREHGVRFHFGVRLTEIVGQDGMVLAARTDDGEEHPAHDVLAAIGAAPRTGLAEAAGLTLADRAHGGGIAVDGRLRTSDPDIYAAGDVAAFHHPLFDTRLRVEHWANALNGGPAAARAMLGRDLTYDRMPYFFSDQYDLGMEYSGWAPPGTYDQVVIRGDAGKRQFIAFWVKEGRVLAGMNVNVWDVTEPIQALIRSGTPVDTEALANPHVPLETLTP

SEQ ID NO: 13208 - protein, 632 aa, Streptomyces avermitilis
VAGRINDEDVKAVRDAVPIDAVVSEYLQLRNAGGGNLKGLCPFHDEKSPSFQVSPSKGLFHCFGCQEGGDTITFVMKVDHLTFSEVVERLAAQAGITLRYEEGGYNPSHQRGERIRLVEAHKIAAQFYIEQLDTGSEADTGRKFLAERGFDQAAAAHFGVGYSPQGWDHLTRYLRGKGFTDKELLLSGLSQEGRRGPIDRFRGRLMWPIRDIGGDVVGFGARKLYESDNGPKYLNTPDTAIYRKSQVLYGIDLAKKDIAKVSRAVVVEGYTDVMACHLAGVTTAIATCGTAFGTDHIKILRRLLMDNGSARVIFTFDGDAAGQKAALRAFEDDQKFAAETYIAIAPDGMDPCELRLAKGDEAVADLVEPRTPLFEFALRQIVARYDLETPAGRAAALDESAPIVARIKNSGAQHEVAVQLAGMLGILDTQFVVKRVSQLARWARDRGGKGPAPAQQRPQQSYAAVQVPSGPALHLRNPVYATERELLKLALQRPELVSPAFDAYGIDEFTAPQYAAVREAIIEAGGAEYGVQDPQEYLVRVREVAPDDTVRAMVTELAVEAIMRRTVDEAYAGDQLVTVRRRAVERRVREVQGSLARLSAGGDPAQLAAVQNELWVLQQYDQALRERGAQAL

SEQ ID NO: 13209 - protein, 332 aa, Streptomyces avermitilis
MSGTWRGFGWASGELPRVPLDDATREAAKLPRTLRPVVADEVTQRPVFDPALKQYENAYRATDPGFTDPTRGDAWRAARRRALELVLAAIADSAWVDALVLRGSVLMSAWFGDAAREPGDLDFVVVPHTWKIGDGRTDRMLEGIAAAAEELAAERGPRLGISARGAVVEDIWTYERVPGRRMVLPWSTPGLPGGHVQLDFVFNERLPEPAEPVELPGGAIVQAATPALSLAWKLMWVINDMYAQGKDLYDAVLLAERHPLPYELLHEVFRLSGEWPYPFREKILLEDVVEAVGYVEWNHFVKEYPQFTDDEQLFADRLVRAVAPTFDGRPEV

SEQ ID NO: 13210 - protein, 217 aa, Streptomyces avermitilis
VTVRCDGAAESGRLSRWAAAAGLKLTHIVLARGRMPSQPMLTLTGSPSYADESARADEVTARLRADGFEPVRVKIESTPWAPEVPREPCGGERYFEHHVKLLLAAGSDLGALAARVVPHGAHLSWNARRAHGGGWHERFVTQRCRGVDAEGAGRALERLLRELDGLEVVDVEREFVLFDSDVSVDDGWIEEVGGRWTAAAAAAATGAATAVPQEVRG

SEQ ID NO: 13211 - protein, 443 aa, Streptomyces avermitilis
VPESSERGRPAHSGSHTPAVPLNDYGMVGGEAVDPIPDVPLPHLPAATFLEVAPVQTQTLAQTDISAENAEPDAETDVIAAVPAQSRAAHHPETETEPTAPPEPDEPPAGAVESVDVVETVELVEAPEPPAPRARSNDTGGPSSDLFRQYLREIGRIPLLTAAEEVELARRVEAGLFAEEKLSSTPDLDSQLGLDLDKLVVMGRMAKRRLIEANLRLVVSVAKRYVGRGLTMLDLVQEGNLGLIRAVEKFDYARGYKFSTYATWWIRQAMSRALADQARTIRVPVHVVELINRVVRVQRRMLQERGYEPTPEEVAAHLDLPGERVSEVLRLAQEPVSLHAPVGEEDDVALGDLIEDGDATSPVESAAFLLLREHLDAVLSTLGERERKVVQLRYGLADGRPRTLEEIGRIFGVTRERIRQIESKTLNKLRDHAFADQLRGYLD

SEQ ID NO: 13212 - protein, 642 aa, Streptomyces avermitilis
MAGPMGRMMAGGGPDQHSMDFKGSGKRLLSQFKPERATMAGMLVAVVVSVGLSVVGPKILGRATDLVFAGIIGRQMPAGATKEQVLQSMRERGEGGVADMLSGTDFTPGKGIDFTAVGNVLLLALCTFLVAGLLMAVATRLVNRAVNKTVYRMREDLQSKLSRLPLSYFDKRQRGEVLSRATNDIDNIGQTLQQSMGQLINSLLTIVGVLAMMFWVSWLLALVALVTVPLSFFVATRVGKRSQPHFVQQWRTTGKLNAHIEEMYTGHTLVKVFGRQEESAAQFAEENEKLYEAGFKAQFNSGVMQPLMMFVSNLNYVLVAVVGGLRVASGSLSIGDVQAFVQYSRQFSMPLTQVASMANLVQSGVASAERIFELLDADEQQADPVPGVRPKELRGRVALENVSFRYDPEKPLIEDLSLKVEPGHTVAIVGPTGAGKTTLVNLLMRFYEVSGGRITLDGVDVAKMSRDELRAGIGMVLQDTWLFGGTIADNIAYGAARDVTRGEIEEAARAAHADRFIRTLPDGYDTVIDDEGSGVSAGEKQLITIARAFLSDPVILVLDEATSSVDTRTEVLIQKAMAKLAHGRTSFVIAHRLSTIRDADTILVMENGSIVEQGAHAELLAADGAYARLYQAQFAQAVAEVD

SEQ ID NO: 13213 - protein, 577 aa, Streptomyces avermitilis
VLIRLLRTYLSPYQKPIAVLVLLQFLQTCATLYLPTLNADIIDNGVVEGDTGYILAFGGLMIGVSLVQVICNIGAVYYGARTASAVGRDIRGSVFDRVQSFSAREVGHFGAPSLITRTTNDVQQVQMLALMTFTLMVSAPIMCVGGIVMALGLDVPLSGVLVAVVPVLGISVTLIVRRLRPLFRTMQERLDTVNRVLREQITGNRVIRAFVRDDYEKDRFRGANTDLTEVSLGTGRMLALMFPIVMTVVNVSSIAVVWFGAHRIDSGGMQIGDLTAFLAYLMQIVMSVMMATFMFMMVPRAEVCAERIQEVLDTSSSVVPPTAPVVELRRHGYLEIRGAGFRYPGAEEPVLKAIELTARPGEVTAVIGSTGSGKSTLLGLVPRLFDATDGAVLVDGVDVTTLEPKLLARTVGLVPQKPYLFAGTVATNLRYGNPDATDEELWHALEVAQAKDFVERLDNGLDSPVAQGGTNVSGGQRQRLAIARTLVQRPEIYLFDDSFSALDYATDAALRAALARETAEATVVIVAQRVSTIRDADRIVVLDEGRVVGTGRHHELMAGNETYREIVLSQLTEAEAA

SEQ ID NO: 13214 - protein, 110 aa, Streptomyces avermitilis
VLRGRGVDVRRIFLLGAAAELAAVQAAAPALFGVQVVVPQPADYAAIGAARQAAWALGVSQGTLSPGAPPVWQGAAAQVLEPGEELAVGQAVRQQYVSVREQTHPGAFRA

SEQ ID NO: 13215 - protein, 365 aa, Streptomyces avermitilis
MGIVAGLDSSPDFTRIVVCDTDTGAVLRQGYAPHPVETEGGGRPSDVDPQAWLLSLGEAASGGLLEGVQAIGVSAQQNALIPLDTQGNTVRPAIVGGDRRAQVAAADLIDTLGGRQAWAEAVGCVPQAAQPVTKLRWLAKSEPDAALRTAGLLQAHDWLVWQLLGRPARRTTDRGGASGTGYWSAATGAYRPDLVELALGHQALLPDVLGPSEAAGTTPEGLLISAGTGETMAAAFGLGIGLGDAVVSLGASGSVMAVHPEALVDSSGMITSLADATGMHLPVVTTMNAVRTLRGAAELLGVSDLEGLSDLAMKSTPGSHGLVMLPYLEGERTPNLPHTAGTLAGLRRESMRPEHLARAAFEGML

SEQ ID NO: 13216 - protein, 104 aa, Streptomyces avermitilis
MRYRLTFVAGLALGYVLGTRAGRERYEQLKKAAHQVAQNPAVRNTAETAALQGRQFAGKAYHTVSEKVGDHVPDSVAGRVRSLRERNANGSVRSREDDWGTSNT

SEQ ID NO: 13217 - protein, 138 aa, Streptomyces avermitilis
VMRQKVPARKRGLAVDVLGLVIAVVVVAASAHENAVGITRLDRGAADTDVLRRSLAVDDGGNGEERRLVLVVDQLEELFTLCPGGRERREFLAAVLGVAAQVQTAKLPSAWSSSACAPTSTPSAPPIPGSSKRWKVIR

SEQ ID NO: 13218 - protein, 613 aa, Streptomyces avermitilis
VDQTQSAAEGDRSTRAAIATMYRLTTGHRASLTLATVLTLVGSALGLAQPLAAKQVVDASGRGQVLWPLLLLLAGLFVTEAATGAVGRFVLERMGEGIVRGLRHSLVGRLLRLEMREYDRLRSGDLISRVTTDTTLLREVVSQALVDLLTGALVAAGAIVLMAWIDPLLLLLIAATVATAAAIVASLLKGIRAASERMQTSVGAIAADLERALGALPMVRVHRTEDREAGRIGECVESAYSAGVRTAKLASVMSPAVELAVQGSFLIVLVIGGLRVNGHANSLGDLVAFLLYASYLVLPLSSVFRAVGLIQRGMGAYQRIEQALSLPAEPSQETPTVRARTREPARQTVSYEKPALALRDIGFGYDPSRPVLRGLSFTAPHRCQTALVGLSGAGKSTIFALISRFYEPDSGTLLFDGLPATELSRAACRGRIAVVDQNTHVVHGTLWDNITYAAPDATEAEVRRAVELAQLEGVVRRLPGGLSGMLGERGSRLSAGERQRVALARALLARPSILLLDEPTSHLDTLNETALTTVMKDVARECALLVIAHRLSTVQHADRIIVLDEGRAVACGRHEELLTSSPTYRELAAGQMLRPAATPPSPVTTARHPHSPL

SEQ ID NO: 13219 - protein, 144 aa, Streptomyces avermitilis
MTTPSALERPTGVPFARRMAARLVLSPALALSLLPPRRLRAVLHFACRGAMPATAAQAKNARDAMCAVSLRCAGPKGCLPRSLGAALLCRLGGSWPTWCTGVRVVPPFTAHAWIEADGRPVDEGVPDDYFTRLITVAVASRSGR

SEQ ID NO: 13220 - protein, 95 aa, Streptomyces avermitilis
MTTVPQQKDTRMALKFGANVSTAETDYGTVLLDERAGEYWELNPTGTLVVNTLMAGGDEAAAVVALADEFDIDLVQAKQDVDALVQQLRTSGLAE

SEQ ID NO: 13221 - protein, 590 aa, Streptomyces avermitilis
VARSFARPGTRILQHASGRPWLVGQWHDQEIVTARAGHTALAVIGCCPIDAVELERQAGRLRDLAELDALARSLPGSFHLVAALDGRLRVQGTASGLRLVFHAPVDGTQVAATRADVLAAALGTDPDEEQLAIRLLWPVPHTLAEAPMWRGITAVSPQDALIISPDGRTVRRSRWWTPPEPVRTLADGAPLVREALAAAVDARTRQGGVVSCDLSGGLDSTSICFLADRSPARVVASTWPGRDPADTDLYWAEQAARSLPEIDHVVWDADTSPLVYTGLLDIDDLLDEPTIGVMDRSRVLHHLPGLAERGSRLHLTGIGGDHVAWCSEAYYHRLLRTRPLFALRQLRGFRALWQWPLGGTARALADSRPYGKWLADSSGRLRDPLPATVSTSLGWGMPPRLFDWVTADAERMAQRALREAAMTAVPLHPDRGLHTDLEQILSCTRIIRQWDRMAARAGVPMASPFLDDRVIEACLAVRPSERVTPWQYKPLLTAAMSGIVPDACLRRTNKAAASMDASNGLREHRADLLALWEGSRLEQLGLVDGTALRRLAQRPATPELRDAILYSTIAAEVWLRGLHRTSEPKAPASS

SEQ ID NO: 13222 - protein, 200 aa, Streptomyces avermitilis
LCGSVTDTAAQVVAAVFDQAEHRDTGHRRCWDVLVDGARHQIDLLKAEALQRSVDVHIIVDLIHVLEYLWRAAWCLHDSISTAALEKAAHAAGQRGTQRKSIDEAMNYLSGKAEHLRYDTALERGWPISTGIIEGACRHLVKDRLDITGARWGLSGAETVLKLRAVRANGDFVASWAWHQQQESIHNHQTRYRDQAITTA

SEQ ID NO: 13223 - protein, 274 aa, Streptomyces avermitilis
LTVSFFVVTPISRIASASASSSRSICVTDIEHLQHPRCMSSRYIANIEVTTQEQPPEAVHCLSHRGDCAGWGGTRRRTPFPMRWCSTARVDSAGPDRLPRHRRGGPAPGRRGAEPSGRNALARAGQARRDRVRPRKLRRRLRADQRRYRLRQVQELAVSAAADIDAFYDALVPAPCTDTTPLILSVDGKGMMMRPEALREDTARAAAAKGGNAMKTRLASGEKHGRKRMATLGAVYDAEPAPRTVDDGKTTPSAARRPSAARGRRPGRSGCAAR

SEQ ID NO: 13224 - protein, 135 aa, Streptomyces avermitilis
VITYLLDTSALWHLFRTPGALAPWEGHIAAGVFHLCEPTRAEFLYSATSPTHRDELAEELDALCLLSPVPKNAWRWVDTAQYKLTQQGQHRAAGAIDLLVCATAVHHGHTVLHVDNDFATVAGVLKELQQRDVRA

SEQ ID NO: 13225 - protein, 631 aa, Streptomyces avermitilis
VVTGHLRWIEGLLDSLGLPAERSDELRARLLAVQARAADPQLRVAVFGETSSGKSTLLNAFLRRRLLPSSALVTTRTTTVLEYREGAEGLMVSTTDDSVLEWPSAPFAGWAGRGRESGPDTLERALRRVLTTALADEVGSLRVLSPVRLLGPGVTVIDTPGFSVTERGHRELAEAAARQADVALVVVPAVAAMSLTLVDFLTGPLRDHHDRCAFVLTKLDLLDEDERSEAVEVVERRLRDLGCADPLLLPCSPGKALGEVTAVGVREPGGSGHLASFLEVEARIARLAADSRRSAVAATVLGLLSELLSAVEETAEARRAALSRGERELAALTLPDLPAFLDAWAARTRDRARTELNAATLTRTSAQSRTTLEVKVGNTVAGEKINDLAGAAEEVSRLVRRHLRRDAQQAVRTAVKRAGEVLTAAAEELARDFAAQYSVLTDLAGEARTAPPVPQVVWPEPPAPDMSGIDRALTAIGTQLTSSGNWRTGGGAMAGALAGSLVAPGIGTVIGGALGALIGRRGPDATREQFLRQARPVIAAAHDEIGALAAACLPRVAEGLSDSVAALRRQYDEEWRDEIARLTAAHDRRRAELAAGIAHAEKTATDARRRRDAVASLRRETSRTVPDLKES

SEQ ID NO: 13226 - protein, 618 aa, Streptomyces avermitilis
VSSASRSEAGPPPAADPSAHVGDVGATASGSLREARRLAEDYGQDHIREALDLLAAGRGRPAFRIAVVGEFNRGKSTLINRLLGRDLLPTGSLPVTRAPVVIRVSDAEGLTLGRPDGRRELRKLDDDTLWDGLTGPPAEREPGAPAGPPEPTVTLAVADDWLAGLDAEVVDTPGVNSGTEEQFEQVRRTAAGSDAVLFVVSALSPMSITERRLLEEEVLCRHVPFVAVVVTMLDLVDGDDREESVRDLKNRLSGLAGLPVLIAPVPGGGESELAALRVLLEGFARDSERALWRDRGIAAQVADHCEAMARIAAEADAVGRLPEEEVAERARLAQALRESEDRQWEQLRTDMTGRQLHLGARLREHVQKGRDGIIERLRWDLERASEPGTWWERDLPVRLGHELSLLARSSERTVLLPAMAADTDWLDREVARRLPGAARSPLPATLELSTDPDISGEVSSLSRTRLVTRLGAQGGSILGFLIAATRQGPRSDSDRSGPPPMVYSSVLSLVGGLLAEAYVRNATEEQRRQVDAVLVRAVDESAGVFQRRAVDALGDVYADMFARLRESHQAWADARRAAVESTSASGTDWPSLASAAAELAAGIRSALADGVRAEEEQE

SEQ ID NO: 13227 - protein, 659 aa, Streptomyces avermitilis
MNQGEDGLPMTTVEGGYAAAAEQRLRLAEMCRRTEKAAEQIGNNGAVRDVTALLERIENEAFHVMVVGDFNRGKSTFVNALLGDRVLPVKAVPATAVITEVRFGESPAALLWTADAAEPEAVDPDRLIELITVNNASADERSPYVKAEVVWPLELCRHNVVLIDSPGLNAYETHDDITLTHLSKADAVIFLQHAIAPMSISESTFLKKYLSAHDPFFVFTYFDAIDDHERDDVTASARRRVTDLRGEDRDRSRFFFVDGKSALRARMAEDDEAFRRTGVEAVERELERYLVTERHKVKLLAPARSVRGVARELRRNIPSELQMLEAESGDLERNWAAAQQPLRELEAQAQQITLDIRNETRVLQDRVETLLGGFLAAVADEAPLVAQDVEITTKLGLNLLKAKVRAQQVAEEIAGGTAKAMEEKVALWVGESLKPVIEQDLERLAERMNAELTSFEAALEKLRIDLHGASGAADAGEGREDEPLTKFLAGLGGFVLSGPAGALVGARFGAKEALRTFLPAFAIGAAWALTPFGLPVLVAALIGQGLFQGKGAGERVEKKMREEIGRAMATQLRLAAPKEAQKAARAFAADTMEPMQREITQGMSFRIEELTRSVASARQVLDQGEEAVERRRGELNRLDGLLGRADDEIGDLVAELTRM

SEQ ID NO: 13228 - protein, 421 aa, Streptomyces avermitilis
VMARYRRRLCLAVDLRQYSRHGYRAQEDAQYRLRLVVEHALRRARVLRVRAQQQVQGDGQLVVFPAGIDAVRVVPALILGLRDGLYQANRTPGAFGRMRMRAALALGSVSRADRGYLGDSVVLVNRLVDADGLRDALENEDGSDLALAVPDEMYRDVILPDGRGLAAGFHRIDVAVVKKDFGCGAWLHVPPSAPVRDSRPEPVIWGHSPGRTAMREFVVPALGAAHVAAAVVSHGQTLREWALTGPDTGVSYGGGGGDFDGPDEADPRDADRTDGHYPGRQRHQPGDHHGSGHHASGHHASGHHASGPPGAPRLPGPHHAAAHHGDPYHSDPHHTGPHYQDAHHADPHHPDLGHADPHYQDAHHADPYHPDLHHADPYHPDLDHADPYHPDPYHPDPGHHDLHHDDPGHHDPGHHFHHGGH

SEQ ID NO: 13229 - protein, 164 aa, Streptomyces avermitilis
VMAEHDPAARELAAAVAAMASFQQVTQQADAKAGTLVTVHVGLAAVVSAQIGSVGAPAPTDLPAVLFWLASLAYVVTFTVSGYLLVQVIRPRTGRHSEPNRFSLDAADHAGADNGRLAAQAWATAHAIARIAALKNVYTSRALAWVGAMVVAATLWLVLAGTIR

SEQ ID NO: 13230 - protein, 234 aa, Streptomyces avermitilis
MIRLGRRVRFERGERLLREGEYGSYVFLLLSGWYKVLARTPDDREALLAVRAGGDLVGELACFDAQPRVATVVAAGRGSAKLIGRQQFLDFLAAYEESAQAVMCAVAGKLRWATRRRQDFGSCPVGTRVARVLLELARAYGRPCATGVSIGVSLTQPELAELVGASEPSVHRVLRSLRERGVVETGYRRVLVRDLPELTIAADGDAAQRIVPASTSHRVAATTIAPTQARARLV

SEQ ID NO: 13231 - protein, 343 aa, Streptomyces avermitilis
MAANRRPTLADVAREVGVSAKTVSRVLNEDGPASAQTREQVLAAVAKLGFQPNLMARNIRVGGPDTTIGLVIPDLANPFFGAVARAIEDTVRERGLTLLMGSSADDSERERALTDKFLARRVSILIVVPSVGADHSHLKSHRTAGLPVIFLDRPGVGLATDSIVSSNRAGAHDGVTHLIAHGHRRIGFVGDLPPKLYTRRERQAGYRSALQEADIPYDRSLVTNAHDQRGAETATAQLLGLADPPTALFAGNNIMALGIVAELARSKRKDVAVVAFDDVALAEALEPALTVVAQDAEEIGRTAATTALTRLDGDRSRARTITVPTHLIVRGSGELPVPALQEA

SEQ ID NO: 13232 - protein, 278 aa, Streptomyces avermitilis
MTATSSPTPVLQARGLVKRYGQVTAIDGADFDLLPGEVLAVIGDNGAGKTSLIKALTGAVVPDAGEIRLGGEPITFSGPQSARAHGIETVYQDLAVAASMDIASNMFLGRELRRPGVLGSVFRMLDKKRMRQEAAEHMADLKIGLRSLTQSVETLSGGQRQAVAVARSVAWARSVVVMDEPTAALGVKESGQVLDLIRRVRDKGMPVVLISHNMPHVFEIADRIHVHRLGRRAALIKPSDYSMAEVVAIMTGALSIDEAGDTVVADSEAAKAAGVQAT

SEQ ID NO: 13233 - protein, 331 aa, Streptomyces avermitilis
MTATTSPYAELKAPTTARRLLTAPTTGPLAALLLACAFFSLSTDQFLTGGNFSLIVQQVMVVGTLAIGQTLIILTAGIDLSCGAVMAFGSIVIAKMAAEGSVPPLVAIALGLVVCGGFGLLNGLLVQKIPLPPFIVTLGMLNVAFALTHIYSEEQTVTNLPGPLTALGQTFPLGHTDITYGSLVTIALFLLLAYALSSTGWGRHVYALGNSAEAARLNGIRTSRLTIGIYTVAGLLYGIAALLLISRTGVGDPQAGQTDNLDSITAVVLGGTSLFGGRGSVLGTFIGVLIVGVFRNGLQLMGVASIYQTLITGVLVILAVTVDQLSRKKAR

SEQ ID NO: 13234 - protein, 340 aa, Streptomyces avermitilis
MSRTTRLSSSLLRAAAVTGVAALTLTACGSGSGSGSGSKSSGSGSVKVGLITKTDTNPFFVKMKEGAEKAAKENGVQLSTAAGKFDGDNAGQVTAIENMVAAGVKGILITPSDSKAIVPAIQKARAKGVLVIALDTPTEPESAVDALFATDNLKAGQLIGEYAKAVMKGKKAKIAALDLAPGVSVGVQRHNGFLKGFGATDKDVVCAQDTGGDQAKGQTAMENCLQKAPGINVVYTINEPAALGAYTALKAKGREKDVLIVSVDGGCTGTQAVKDGKIAATSQQYPLKMAAEGVKAVVTYAKDGKKASGYTDTGVTLITDKAQDGVTAKDTGYGLENCWG

SEQ ID NO: 13235 - protein, 320 aa, Streptomyces avermitilis
MSPRQITVLGECVADAFTEPANASNELALRVLPGGGPANTAVALARLGTPARFLARLSGDVFGRLFRAHLEESGVDLSYAVAAAEPSTLAVAELDATGQAAFSFHAQNTADWQWTPGELAGVDLSETACVHTGSLALVREPGGAAVEEFLAAAAPRATISIDPNVRPLLVRPEVYRARLAHWCALADILRLSEDDLELLLPGTPPEQACDIWHAAGVRLVVITLGAGGALASLDGERLRVPAVATRVVDTVGAGDSFTAGLLHHLGARGLLGGRLTDLGLDEVAEACRFGARVAALTCSVAGPNPPWRDQLAQLTTAGGA

SEQ ID NO: 13236 - protein, 97 aa, Streptomyces avermitilis
VKKTLLAEFTAREGAQDEVARLIGDYALKVREEEGNITFDVYTKAAAPRAYWIFEVYRDEDAFQAHLNAPYGGPFNAALIPLIEEDASVLTFLDPLA

SEQ ID NO: 13237 - protein, 189 aa, Streptomyces avermitilis
LHARTTICAVVLLLAATACAGPGHTDEPDARPKQATAKPVPAAGALKIGVGHHWSDTDTDGSHISGTTTVMGYTQPAKGATLSDDVTDVPHPVWATLDVRLCADATSTTVMASQTPWSLGFPDGTRGRAPLFSGSGVPKPEYPTGSAAVRPGSCLRGKITFAVERGTRPDQVIYDVESRDPVGWAVPAA

SEQ ID NO: 13238 - protein, 82 aa, Streptomyces avermitilis
VSESPSSGPVGVILSVDPDRFAEVVEAARGAGLTVTGEQAILGTLSGTIAEDRIPALKAVAGIESVDRDRTVHLPPPDAPIQ

SEQ ID NO: 13239 - protein, 444 aa, Streptomyces avermitilis
MANGPMDRRAFGEQPDRPDAPFTGRGAEYTGRYVILLDQSNQESGLEALRASADIAPVERIRGTDAANVAELLERPDVSVLFEELGAAVVEVRPDQRHALVTTAEAEPSIIAAEPERMVYASVITAPQQAPTAFFPAYRSDEGVVERHTKAEIAAAQGPAWDERNWTWGLQAIRANMSSLTGRGVKIAVLDTGVDTDHPDLAGRIDETVSFVPGETVEDGHGHGTHCIGTAAGPASPQQGPRYGVASEARVLAAKVLSNAGSGTDGQILAAMAWAVAHGARVISMSLGAAVQPGELFPQTYEQLAQRALQRGTVIVAAAGNESSRPQAIRPVGRPANCPSILAVASLDRALTVSSFSSAGINGQGGEVNIAAPGRAVHSAAPGGGYQSMSGTSMATPHVAGVLALLAQAAPNASAEDLKASLLSSAFPLTQPVRDVGSGLLQAP

SEQ ID NO: 13240 - protein, 210 aa, Streptomyces avermitilis
MRFRDRRQAGRELAAELLRRAEKGELTDPLVLALPRGGVPVAAEIAHALKAPLDVLVVRKIGAPGRPESGIGAVAGDDPPFFDKSSLAVLGLTEAQLTQAVADQRAEVHRREERYRAGRPAPRIRGRTVILVDDGLATGVTARAALRHLRGQGAAGLILAVPVGSRAVETLHEEADDVICLYEPELFYAVGEWYEDFEQLSDDEVIDTLR

SEQ ID NO: 13241 - protein, 318 aa, Streptomyces avermitilis
LGRHRAACSRPMGRGRGSAVQTQTRMLDQVRTTDGRLLKVEISGDPRGRPVFLLHGMPGSRVGPRPRPMFLYQRGARLISYDRPGYGGSDRKAGRRVADVVQDVAEVADALELDRFAVAGRSGGAPHALACAALLPDRVTRAAALVTLAPRDAKGLDWFAGMAPSNVHEFRTAFNDPERFVARLIPRSAKIRSNPARLLEELRGDLTADDRQIVADGAIRSMLLRNYHEALRSSPYGWVDDALALTGPWGFDPADIRVPVLLWHGAQDVFSPAAHSTWLAGRIPRATAVLEPAAAHFAALRALPAVLTWLLADAARQG

SEQ ID NO: 13242 - protein, 1314 aa, Streptomyces avermitilis
MTAAQDGRIITFYSYKGGTGRTMALANTAWILAANGKRVLAVDWDLEAPGLDRFFRPFLDPHALAATSGIIDIINEYAWAATSGSQRSGAWHQEYAHVEQHAVSLTPERHGLRFAKGGSLDFLSAGRQDRSYSATVSSFEWDNFYERLGGGLFLDALRDDMKASYEYVLIDSRTGLSDNADICTIQMPDMLVDCFTLSDQSLDGAAAVARSVEDGYRKRKIRVLPVPMRIDEGEKEKVDAGRALARLKFDGLPKGLGGEDLSPEELSQYWGAVEIPYRPYYAYEETLATVGDESGIANSLLSAFERLTNVISDGEVASLPPVPEPVRLRCLDAFTRRRPLTTAADVVVAYAAENRMWADWIEAVLKHSGCNVTLYDVSAGPVERPDAATRALVLLSNAFQKSRYGEDVWRAFTGGDPDGAHPALVPLRVDEVRLPDSYLAHEPVDLHRLEEAQCVAGLLSALELPAQPTDGAPAAPRFPGSTPATWNAPQRNQTFTGRNVILTQVREQLRSGMSVVLPQPQALTGLGGVGKTQVALEYVHRFMADYDLVWWTSAESVDNVVASLAELGARIGAPGGEDMALVSRETVQMLARGVPTKRWILIFDNADNPEQLTRYFPAGGGGHILVTSRNQAWATQGQSLPVDVFLRQESIEHLSRRAPGLTAHEADRVATAVGDLPLAVEQAAAWLAETATPIEDYLRQLAEQTTDVLDLNQPADYPETVAATWNISIARLKDRSPASVRLLQLCAFLAPEPISSHLLYSKEMIDELRKVDPTLQESLLLGRVIREIARFALAKVDQVSNSIQVHRLVQAVIRSQLTQEEQRHARHVVHTVLAGARPDGDEPIDDPETWPRFGVIWPHLSASDVRNCTENEPRRLLIDRVRYLWKRGDFPAAQQLAEDLLGHWKPLLGEEDVQYLYLRCQLANVMRSQGRYVESRAINTELLEQQRRVLGAAHPHTYVTMSSLASDLAALGEYTLAVELAREAHDGFSQIFHESHRRTLSAANNLALALRMVGRYGDARSLDQDTYDRRMEVLGPDHPYTLASAGRLGRDLREVGRYEDSVSLLSRAYDAHKRILGKGFPGTLSCAKSLAVSLRRTGRLEDARRLTTATRAQYRTQYDAHTPDSLACDLNMAADLYAADEREAAREVAKEALTEYMKVPGEEHPYTQAALNNLGIFHWGCGDAVEAEAVFRQVLPRMSDVLGDRHPHTLFTEANFANVLADQGRLEEAWALEKRAMDTLRTVLGPQHPETLAVVSNCALTLGALGRTDEARRLREETLAELNRQGRQLGENNGIIQLTGHERRIYRDLEPLAV

SEQ ID NO: 13243 - protein, 444 aa, Streptomyces avermitilis
VDAVERTSDNRPYFFLSYAHTPSWGSGGPNPDHWVHVLFADLCNDIMALTDLPGGAPAGFMDREMRSGDGWPEKLSENLATCRVFVPLFSPRYFTSEMCGREWFAFHERILRARATGSGAVPAIVPALWTHVEYSQLPDSVRHIHVDHAAFGDRYAAQGFYGLIKLNRFHDEYKETVLGLAQRIVQVAHDSPLPSSRPRPYESTPSAFKPRGEGPRRIHLTVAAPTRDTIPEHRDARPYGEDAQDWNPYHSESTRALPSLAEELIRSLDYRTTVSSFDDEDPTGDIPAASVTEDGEDAADKVPPTRPGILLVDRWALLDEERRHRLKEFDAGARPWVSAIVPWNRADLQCHGEEGRQLTEELDRTLPLILERGRRTDCRMAVTGVPTLKTFIDLLPAVVAHTTRQYLKHAEAHPPSGPHLPRPRLMGPIHPQPPDAGPDNGGEA

SEQ ID NO: 13244 - protein, 257 aa, Streptomyces avermitilis
MTDVRQLSSLCDELGVRSGGTLLVHASLGGTGLRDTDVRDALLGALGPHGTLVVPTFTPENSDTSRAYRALTEGMDEREKAAFRAGMPPYEPDVTPCPTMGVLAECVRTTPGAVRSAHPQTSLAGLGPRAAELLSHHDPTCHLGERSPLARLYAAGAQVLLLRVGFEVCSALHLAEYRMTPVPPTRTYRCVVEERGNWTSYEDLALNDGDFASIGALLPRDLLSERAFSGKTAVLFAMRDVVDAATVRMSGYRYEMT

SEQ ID NO: 13245 - protein, 723 aa, Streptomyces avermitilis
VTDTDRDSSIQQLVLKIHSRCNLACDHCYVYEHEDQSWQARPVLIAEETLDKVAHRLAAYTVDRKLESVSVILHGGEPLLVGPTRLRNICAQLRSVLDPLTTLDLRIHTNGVRLNRAHLEILKEFDVKVGISLDGDRAANDRHRLDHRGRSSYDRVVQAVELLRTEEYRHLYLGLLCTVDVANDPVVVHDALSALDPPRIDYLLPHSTWDNPPPSGPSGSPTPYADWLLKIFDRWLEQGRTVPVRTFDSVLSTLRGGPSLTEAMGLAPSDLAVVETDGTFEQADSLKTAYDGAPATGYDVFRHTFEEFARHPGVRARQLGIEGVSETCRGCPVVQSCGGGLYAHRYSTERGFDNPSVFCADLRAFVDGVAERITERELSPAVRGGDELRLAQLRLGREVLARAHDRLAGDPDADEAWRALVRLDTDDATAPHLNSVLAHPYLRPSLHGSWDGRAGLARFMTVAAAAAVHAEAGVTLAWHQPDRELHLPTLGTVRLARPGRVELTVTRDGFRIRGADATPDEPPAEWRPLETLPLTDGTSFLIDDADPHRDCYPVPVAPPLGSSDLRVFRKRLRAAYELLDEREPGRRDRVDALVVTTVTPLMAGTGVRLGDHGIGALGVAVDFEPEEFVRELSRAGRRARLTALRQVADLSVPGNRAGRLLEEASEQLGTASYWRQEPELRAEALAGADRALRTLAALPERDLTESGAVFAAQLRTEWQRLHD

SEQ ID NO: 13246 - protein, 60 aa, Streptomyces avermitilis
MNLTVTKTKRGSAAAQPTHKKLAPLSAINTHEAAALRSTGRVTDIPGRRPTKPITFDSAL

SEQ ID NO: 13247 - protein, 306 aa, Streptomyces avermitilis
VSMRAVTPGPSTTLTEDDLPPLYAVNDRRALSRQSESFRAVRTQLVVLLLATGTAMLAERLNSHIPAACAAVLYALTIAVGLHSSRRRARAHWQAHRAAAETLKSLAWMYMVHGGPFHSGVTHPDALFAERLEERLRELRKVGWEDSRDGPATVGAGQITPVMRAVRAKPFGARRDLYLRERVLEQLTWYGNRASQAHRSSVRWSSVTALLTLLALIAAVLRAAGVIGRWDLTGLLSASAAAGVAWQEVRRHRPLTYAHKLIEQDLDTLRIAMGTTVTEEGWAESVAEAERLVSPQHTDWLVRFGS

SEQ ID NO: 13248 - protein, 158 aa, Streptomyces avermitilis
VTRIGVTGHRRIPAVVLPAVLAGITGELRRHAAVEALSCLAAGADQLFADLALDSGVPLTAVIPGMDYEAHLGGDEVQASYRRLLKSCTARVDLPVEPTHEEAYYAAGRWIVDHADRLVAVWDGQPARGLGGTADVVAYARRTGVPVRVLWSSGVLRS

SEQ ID NO: 13249 - protein, 513 aa, Streptomyces avermitilis
METVPRLPVPLLRAVLGVGTDLELEPTLQHIVDSAAELTGARYAALATADPGHEELARVHRAGPARGGPAPHGPARPGRGDDWLGVPIHVHDQEFGTLYLTGKSGGPFTDKDERMLCVLAAQAGIAIDNVRLYATARQRERWIEGAAAVTTALLTGQNATDALMTVAERARILAGAAAGVILKPTPEGGMEIVTASTPDDPGDIVGTTIEPGSPVLAQLLGGEAVFIDDTATDPRMTTRVRHRFGPSMMLPLEAEGRLIGTLALPRRRGGRPYTPVEQQLAAQFASQAALALVLADMWHSRKRLAVYEDRDRIARDLHDLVVQRLFATGMMLESTQRRAAEEDVHETLGRAVDALRSTVQEVRTAIFALQQPPADAPTTFRGKVLRETAGAAGVPGFRPSTRFIGPVDSLVPEAVAGHLLAALRRALAAASHRPGVARVEVTVDATATLPDGRAGVRLTVHDDGVPDDHEGVPKEREGVPENDGRAAEHGDGASRGTGTGTGTGTTVTWQYPL

SEQ ID NO: 13250 - protein, 345 aa, Streptomyces avermitilis
MTVSLDRLRRCHFAVDLGAARTRVYVKGAGLVVDQPSAAAINTRTGALIAVGEFAEKMTGRTPAYIRVVRPVSGGTVVDIEMAQRMLRHLLGEKLRRALRRKPRLRAAACTPHDADPLAQRATIETLVGLGARRVELVDTLVAAAVGCGLPVERPEASMIMVCGAAATQIAVLSLGSIVTADRIPVGGEAVDHAIVQHLRHQHELMLPSQSVRPLQIALSGNGLTPHGPTSTEIHGRDVATGLARSVLVDTAAVRNAIQTPLTAVLDGIGKVLRDCPPDLVADLADRGIMMVGGSALLPGLDQMLRQATGMPVSIAERPDVCAIQGLGAMLEGRIEPLLLERVAG

SEQ ID NO: 13251 - protein, 1208 aa, Streptomyces avermitilis
MTRGPARRGAALLSAGLVFALLPMGRAAARDAGTPPSPQPASTARTVTLVTGDTVTVTDLPGGKKTVTVERPRGATGAVRTQVVGGAVSVVPDEALPYLRAGTLDRRLFDVSALIRQGLSDRKTGETPLIVGYGKGARAVTPSGATRTRSLTSIGAAAVDADKGRTFWRSWTRQGGIEHVWLDARVEADMAESNAQIGTRAAWDAGLTGDGVTVAVLDTGVDTTHPDLAGRVSRSKSFIDGEEVADRNGHGTHVTSTVGGSGAASDGTERGVAPGATLAVGKVLSDQGAGSESQIIAGMEWAARDVRARIVSMSLGSTEASDGTDPMAEAVDTLSEETGALFVVAAGNTGAPSSIGSPGAADSALTVGAVDSSDRAAYFTSAGPRHGDNALKPDLAAPGVDIRAARSQLAPGTGYYTSMSGTSMATPHVAGVAALLAEQHPDWTGARLKDALMSTSEQLDASVYQLGAGRVSVPDAVGARVTATGSADLGFHRWPHDADRPVTKTVTYSNSSDTTVELSLAVRGAPAGVATLADTALTVPAHGTAATTVTGDGSKAPVGETSGQIVASAGGAPVAHTAFGLVKEAERYSLTVHVKDRAGAATAAGLVVQRLAAGTDPYPASVGDSGTLALRLAPGTYSLTSFLDVRGGHGADSLGLGFLAAPEITLDRDRAITLDGSRLREVEADVDRRTETRQLLMEYDRSGGGSDLFGAVQVPLTYDSVFAAPTPKVTEGSFEYRTVWRLGKPLLEVRGIREAVVQSGGTLTEGRSRPPLVDVGSFTGGVLTGVRGRAVLARLGDGVEPTALAQAAQDAGAKALFVTDDSAGRLTAWWGTDDNADRPLQIATVNAADAARLRAAGGRIDMTGTPNTPYVYDLSEGHRGRIPDRDLTYRPGRRELATVRARFHAVRPVGGGEFRYSLTDAFPVGIGFRERIDYPAERTDHVSTGPGQLWHESVTVGDGTLEERGGLNRYQGGAHTALDWFKPVWHPWLGTGLGWGQERSGAMMRFNTPGWGDSGPDHTGFGDVWSDDSGMTQVTAVHQDGTLVDRRTGSGAYVWDAPADEHTYKVVTDTTLDPDRWKLSTKGHAEWTFRSSATPDDRWTFLPLLNLAFDIGTGLTGDVRGGGRVPVGLFASYVAGAPDTGTIGAGHLEVSYDDGTSWQPVRLSGGTASWHGTLTVPGTAHHISLRASARDDRGGSVEQEIIRAVGVR

SEQ ID NO: 13252 - protein, 465 aa, Streptomyces avermitilis
MADRLSAREAIALLSDDFDRLPVAEGAYAPDGPLSWQGYDASRARATERTGEDESVVCGRARIDGTPAVLIAFEFGFLGGSLGERTGDRLEAAYTYARAHRLPVVSLVATGGSRMQEGMLALTQLQRVARQSALTRAAGLPQLAVLRDPTTGGGWATLGAGADVVLALPGVQVGFAGSRVRPPDADPAAYTAQAQLAAGSIDAVVRPQELRETVGLWLALLTAPSTEPAPPPPALGTSDRLPDTGWSAVQRARSPERPRAQAYLDAYFTRRAAIAGDRCGGTDDGMLCGFGFSSGSGSGSGSGEHGGRVVAYAAQTGTATRPAGYRTATRLIRLADRLGIPVLTLVDTPGAANDAEAERQGVGAAIAELFGAVATARTPLTTLLIGEGGSGGALALAAPGNTWATPDSYFSVIAPELAAAILKRPPEEAPGTADQLRVRPQDLVALGVVRGIVPGGAATSPPPPG

SEQ ID NO: 13253 - protein, 489 aa, Streptomyces avermitilis
VSSLFPALSGGAAERRPALRFGDRALTYAELAAAAGCLAARISGSGRVAVWATPTLETAVGVVAALLAGVPAVPLNPRSGESELGHILADSAPSLILAAAGDELPSAVRGLERVDVEVNAPAAGAPAPATGSVTDDAPALIVYTSGTTGPPKGAVLPRHAIATTLDALADAWQWTADDVLVHALPLFHVHGLILGILGPLRRGGSVRHLGRFGTDGVARELNDGATMVFGVPTMYHRIAEALPDDPGLAKALGRARLLVSGSAALPVHDHERIAAATGRRVIERYGMTETLMNTSVRADGEPRAGTVGVPLPGVQLRLVEEDGSPVPSCDGESVGEIQVRGPNLFTEYLNRPDATAAAFTEDGWFRTGDMAVRDADGYVRIVGRKATDLIKSGGYKIGAGEIENALLEHPGVREVAVTGEPDDDLGERIVAWVVPADPGTPPDADELAGHVARRLAPHKRPRTVRFLDSLPRNDMGKIMKRALPQGSGH

SEQ ID NO: 13254 - protein, 192 aa, Streptomyces avermitilis
MSIQTRRERERAERERLIITAARELAETEGWDAVTTRRLAAEIEYSQPVLYSHFKGKDAIMAAVAVQGFAELAVELSAARAAADGTHGTLAAVATAYAAFAERRPALYDAMFTHAVDLPFATPEAPAALQGAFAGLLHAVEPLAGDDDPGLLTETFWSGLHGLVTLMRSGRLPREAHARRLTLLIDRFTPPR

SEQ ID NO: 13255 - protein, 123 aa, Streptomyces avermitilis
MLTATAYGLAAVLDLFVLFIGARFLLRPRPAAAGYGVPAKPDGDAAYLEIKGLRDATFGILGLVLLVFAGARPEAWFMLVVALAPLGDTLIVLRHGGTRAVAFGIHFATAVVVLASAALLFAV

SEQ ID NO: 13256 - protein, 163 aa, Streptomyces avermitilis
MTLIVPDFDESVIVRSVDAEVVGRAPTTVRLLADSSSTGGALSMQRVTLTNGADGARPHHHAGSAELFYLLDGTAQILSGEQVVTLERGDLAVVPPGLPHAFAAAPGCDADILIVITPGVERFEYFRHLERIAYGKVPPESLLEVQELYDTHFLKSPAWDERR

SEQ ID NO: 13257 - protein, 381 aa, Streptomyces avermitilis
MLTIGAFAKACRLSPKALRLYDELDLLRPARVDPDTGYRYYAPEQLERARLVAWLRRLGMPLARIRQVCALDPGGAAREIRAYWARVEAETTARRDLALFLVDHLTQSSQAPQASQSSASSPSPQSSQSSPSSRKDTIMLELRYSALSDIGLVRDANQDTAYAGARVLAVADGCGAGGASASTAAVEALKFLDEEPLPAGGVLNILEDAVQGAGRAVQDVAAAVGGSARDEIGTTLTAAVWTGSQLALVHIGDSRAYLLRDGELFLITHDHTVVQSLVDEGRLTPEEATVHPQRALLLKALGGGPVPDPDLKLHDARPGDRYLLCSDGLSTVVPTEEIRRLLAAAPVPQAAARALVDAANAAGGPDNVSCVVADVVEAGRQ

SEQ ID NO: 13258 - protein, 290 aa, Streptomyces avermitilis
VARIALVTYRPDEGETSADRDLPVLVEALRAAGADAASRYWDDPDADWGSYDLVVIRSTWDYSWRAAEFVAWAERCGQLTRLANPAAVVRWNTDKRYLGELAGAGVPVVPTRYLAPGDPLGLPDDHEYVVKPTSGAGARLAARYTPGERETAVRQLARMHEQGLTAMVQPYLTHIDTTGERALQFFGGRFLHASRKGAVLAPGTPYDADKIPHPRLRPWQPTPDELAVAESALAAVPDAPELLYARVDLVDDEKGRPVVMELELVEPNLFLWLHPNSLPVVVDAVIAAAR

SEQ ID NO: 13259 - protein, 220 aa, Streptomyces avermitilis
MDRMPSAKRPDRSGPPPRPARSTGAAGSAGPFTSLDFQLVLLRRMADHNPDLVDDARRKLGVSAADMREANRRWQAMLHAPRGRAAASRYRSVLGTPESVTERRIGDLTCEAWQWPLPLWPDLRFEVLVAQKGAVWNEWLVRAPGAPAPELRTSADLRPWCCTVDEVARAFAPARPLEGTAPTRWGLSFTAADAEGVRRECAAEFTWGLLQRVSVTGQPR

SEQ ID NO: 13260 - protein, 279 aa, Streptomyces avermitilis
MTLTLAARLAPFLPTRLVAAAARLLYPRFEPELARLGDLCPPDCRTAVDVGGWYGPWTRLMSRRADRVVTIEPVPHLARLLAAVAPPNVRVVRAAASDRPGTAPLWLPPDDAGDRGVSSLVRRDIHARALEVPCVTLDGLGLRDVGFVKIDVDGNELAVLRGATTLLTRDRPALFIELETRIQPIGPVVDFLAGLGYAGWVLPGRTWLPLDRAILEAHQARTSYVVSHGLLRRALPFRGPRYVNSALFLPDGRRPGARRVRDDGPHALRKATRPIRSSP

SEQ ID NO: 13261 - protein, 73 aa, Streptomyces avermitilis
VNPDDPLLKILACPLDKGPLHLLVPDSEKDGVLYNPRLHRRYPIVDGIPQLLPSSGEQVTEDEHEELLRRMTP

SEQ ID NO: 13262 - protein, 306 aa, Streptomyces avermitilis
VWWGVAAALLANVLYSTGFVLEKRALASLPEVDIRRPARLLRLVLGSPLWIGGSLSLAAGFGAQLAVYRTLPIAAAQGIFVSGLVLLVLLSARLLGEETTGRERYALGAILAALLMVVLSLREGSDKVSRSAPVPLILLVCVPSLAMGVWLYGSAERRARHRHRMPTTGVEYGVAVGLLYGVSSLAIKGVSSYLTPADGLGGAVVGLLRSPYPYLLLFTGVFGLVMSQAALQRCRASLIVPVCTTVTCLFTAVLGTLAFGEALPHEPLRLALRLAGTALAVSVLLAMPKHDTAPQPSAAPKELTPP

SEQ ID NO: 13263 - protein, 244 aa, Streptomyces avermitilis
MTTTTPVRNGLRDFYEDPAVPVASGTPRSLRQARMLAAALGPATAGAKTVLDIGCGDGTAAATAAPFLAGHRLVGVDWSQDALRRAHTRLPYAVRGELTDGGLPFASATADAVLFSEVIEHLVDPDGALDEIRRVLRPGGHLMLSTPNLAAWYNRALLLAGVQPVFSEVSLRAIHGRPGTEVVGHLRLCTARALRELMTASGFEVVRLRGAPFHGVPRPLRPLDRLACAVPSAASLLLLHARRT

SEQ ID NO: 13264 - protein, 441 aa, Streptomyces avermitilis
MTAVEHPARDGTNGPARRPRRIPFPVVDEVARHCLQEEEPETVHIEVHLPGRLDPARLRTAFTRALHRHPRILMREAEGPWYRRRYEWELTPDPDVDVVSFPPPDRDALKHARDRALGAAPPLTASPPIRLEVVDEDDPSHGTVLFLTINHTALDGPACLRVLATAAELYGGRDNSPSAPPVRTPDAPLEQVDTPSTWTPPARVAHGAPEPSPGNGVLVTELSVPHRPKGAPYTVNDQLMVATALMIAHWNREHGARPRPLRITMPVDDRPRGTDMPIGNGTRLVEVPFAPAELTSVDRGSMPDLLRRTADRTRALKSLPRPQLGHGAALLTAPVVPVPWRAALTRGLRRAAAPWTSTTLLSNIGRIPYALDFGDTAGRARAVWFSAPARMPRGLTVTTASTAGRLHLALRWSRTLLSHGDGAHLRDLFEQSLHATQERHP

SEQ ID NO: 13265 - protein, 1517 aa, Streptomyces avermitilis
VSTMTSTVQAPPPAPVRPVGTAEGPPEGPRSRRWLLGFWAVVFVLFLAVHPGRTTFDTKLGVALDPWQFLSDLGQLWHDRGGFGGIQDQYVGYAWPMLPYYGLCKLIHLPVWLAERLWFSLVVSVAFWGALRLAERLRIGTGPARLLAAVAYALWPVFTVVVGSTSAAALPGAFLPWVLLPLTNERHSARVAAFRSALFIPFMGGVNAAATLASLLPVGLYLLSRPRGPRRRKLIGWWVLGVLLATAWWVVPLLMLGIYGENFLPYVETARTTTDTMSAVESLRGAGNWVAYLHFGEAWLPAGWTVASSVLVIVCSALAAGLGLAGLARRDLPERRWLVLTVLAVALITLAGYGGSFGAPFHGVVQDWLNGWLVPFRNIYKFQTGLALALVFGLAHLLGVAAQARGARPVRGRRFAPLIAAVLILPGLAWPYLNGSVLQPGSFQELPRYWHTTADWLKKYSPDSRALVVPATAHGIYTWGSPIDQPLDVLADSRWAQRDYVPFGTPGNRRALDAVEQALMTGGEVPGLADYLSRAGLYYVVVRNDLDPDQIGYVPTTTVKRTLEQSGFQRVTGFGPVMTGGRIADDTPMQVEGLYPRQRAVEIYEPGTDVPRPGQAGLTPVAGTAVVSGGPESLLPLSADPAMRDRAAVLTGDSHPGLGAPEMQVVGDGLRRADTRFGLVNSNTSYTYTRDERNASDSAQDPGRPPHQILPAKGLDRQTVAELRGARSVTASSSGNWLFHLPQYDPVNAFDGNPDTAWAEGAAGSADGQWLRIAFTGSVDLPSSFKVTPLPQGGVRSAATRVRVETEKGSVTSYLQPDGMTQKINVRPGSTSWLKITILDSVERRTGLTGAGFSEIRIPGVQVTRMLRLPTDASGSDAAAEIVSLHRAADPTGLSPTGTEAGLHRRFSTAAAGTYEVKASAVPIAGEGLDRLLYEVAPDQRSRITATAGSTAKLGAGLSARNLTDGDLTTAWIAGDNPTIQLSWPGKQAVGSLVLAPAGGLSSRPTKVSISSPDGAAIAGVDENGWVRFDPITTDRLDITVTETAPVTVHNPVADDDLQLPVGLTEAYIPALDQYRTPQPSSTRTFSLPCGKGPVLAIDGKLYETSARGTVRDLVERRGIELTLCRKGRASAAVDLGSGAHRVEAGDAGPLAVTDVTLTRGTVTEAAAAGRALRIADWLGDRRAVTVEGGAASYLTTYENYNDGWEATLNGRKLTPVRLDGWQQGWRVPAGAGGTVKLSYAPSTTYEAGLIGGGAGVAALVGLALWRRRAPNADEPQPLPPAPGLWLGTVALTLVGVVIAGFFALLVPVLALLAWKRHALLVPIAFLALAGAGIAAATGAGSPVSASEGAFGPVAQLLALIGLFAGLVSIPEPVASGGDGTTHRGAASGGDGTTHRGGVPPGAQAPAEPLRTEPLPRRPRGGSLLGKKPGAKPSEEKPGATGAPGAEAASAPGAGPARTPHAEPAGSPQGEPAAGHTVSARGPGRQEPDPPTARPPLRGPGFRDAAPDDDTGKGDTP

SEQ ID NO: 13266 - protein, 241 aa, Streptomyces avermitilis
MKDPSIRRSLALFRAFRHEQEDPEACYSLLARDAADQVEAYGGPVKARTVVDVGGGGGYFTEEFRRRGAGAYLFEPDVGELGPKPPAGSVVADGYLLPLADAVADVCFSSNVLEHVADPQTFLSEMVRVTRPGGLIYVSFTNWLSPWGGHEWAPWHYLGAERARARYRRRTGRPAKHTLGENLFAVHIGPTLRQVRARDDVTVVSARSRYWPFLAEAVAKAPGLREFATWNLLLILRRCPP

SEQ ID NO: 13267 - protein, 411 aa, Streptomyces avermitilis
MPQHVPSSLRDAFPPAAQYPPDPPALPPQPRRIVFLAHRDLGNPAAGGSELLVDRLADGLTRLGHQVTLLCGGPASPGLPAPPPGSRPRSNGDPHERGGTPRHDYRVVSAGGDLGHYLRARSAFHRRVGACDLLVEVCNGMPYLAPLWHRGPTLCLVNHVHTDLWRMRFGGPLAPAARLGRRLEHWALAGAQRRNLLVAVSPSTAHALRAIGVERERIRVVHNGVEEPGPRAPRSPEPLFVAMGRLVEYKRIDLLLRLWERVRPVTGGRLVIVGDGPERARLEQLAGPGVEFAGHVSEAEKHRLLCAAWLLLHPSAVEGWGLVVTEAAARETPAIAFDVPGLRDSVADGETGVLARGESSFAAAWCALALSSHRRELMGKAARDRAAQYRWKHTVRQFRAVAAEAVRGRTP

SEQ ID NO: 13268 - protein, 350 aa, Streptomyces avermitilis
VDMHIHPYHPPHLVCRAVSRPWSARMRRTASPVSLILLGLGTFLLVLAPLLAWYVKPRAAVNPIDIDTTAVYTGTGSVFDVDKVDTVAGQKITVTQRVRGNVADSERSGKAVWDVTTTVDTDKSLPAADPHDALEFMPGRWVTDRKTNRPAHCCREKPYFEGDAYLKFPFDVRKHAYRWWDNSLGATVTLTYSGVKKIQGYEGYRFTGTVPATRTGTRLVPGALVGRPKSSQVLAEEWYANHGIELVADQRTGRVLYAQVGPRKTLRAPGAKKDAVVLLDSRKIAFTAATQKDQVEQAKKESGQLRMVGRTLPIGAGVAGFVLAVVGAVLVVRGRSHPDTSESSPPPPTI

SEQ ID NO: 13269 - protein, 62 aa, Streptomyces avermitilis
VGTTSDREAHPAMSRLLAAALTVVAATALAVGAALGIVALLDATPDQPNTPLITYEHTGQER

SEQ ID NO: 13270 - protein, 413 aa, Streptomyces avermitilis
VTARPSALPTRSAWRDVPRLQVRQFAALAMAEAPLLAEEILCEIRREYPHLPVVLDDSGEPMALVGIRRAIEVFVQHLETAEGRPRVPPEVFQEFGRGEGLNGRSLDSLQAIYRLGVRLAWRRFAEIGQQVEIPPPAMYELVDAGYEYLDGLVDQSVRGYAEAAARQAGERLRLQRRLMELLLAEHHRGDPADALAERAARVGWPLPDKVAVGVLLRPAREAVAPAVGQGVLLDMEYEQPHMVVPEPDAAGRPELLHRALTGWAGAIGPPVPLAEAAKSLRWAEAAVRLMERGLLPGGEVLHCTQHTEALVLLQPEELIDDLASRCLAPLAHCGPTHQRRLAETLLAWLETRGGAPEVAARLGVHPQTVRYRLRQIRELWGGEIDDPDRRFELELVLRTQRLRGELGGPRARR

SEQ ID NO: 13271 - protein, 257 aa, Streptomyces avermitilis
VGRLVPAVTRALDILELFLDGDGTLSAPDIVRRLQLPRTTVHELVTTLAARSYIVQVPGQPGRYRLGVRPYQLGSRYAEQLDLAAEGQQVARSVAETCDETVHVAILEGTDVIYIAKVDSTHAVRMVSAAGRRLPAHCTSVGKMLLASLSDPELTSRVPDGVELAAMTPNSITDPAVLREALAEIRSRGVAVENRESNPDVSCVAAPVRDRAGQVVAALSISIPMIRWSDERRVELEQLAVKGAAELSERLGHRSVG

SEQ ID NO: 13272 - protein, 286 aa, Streptomyces avermitilis
VTGLDVAVRAHAALGEGPTWDTAAQRLIWVDILGSRVHTYDPASGRRTVLATEQHVGAAKPRAGGGLVVNLRDGVGLYGPEGPGGRDFRWLHREPVPGRRGNDAAVAADGSLWAGTMRYDEAPGGGTLSRLAPDGTARTVLDDVTISNGVGWSPDGRLMYFNDTPTRRIDVFDVDEDGRPVGRRTLATVEEGAGFPDGLTVDADGCVWVALWDGGVVRRYTPSGALDRVLELPVRRPTACAFGGAGLTDLYITTARTGLAAPHPMSGSLLVLPGAGKGLPQPAFAG

SEQ ID NO: 13273 - protein, 503 aa, Streptomyces avermitilis
MRTARFALDPAFTVGEVDPRLFGSFVEHLGRCVYTGVFEPGHPAADEAGLRTDVLDLVRELGVTAIRYPGGNFVSGYKWEDSVGPVDERPRRLDLAWRSTETNRFGLSEYVAFLKKVGPQAEPMVAVNLGTRGVAEALELQEYANHPSGTALSDLRAAHGDKDPFGIRLWCLGNEMDGPWQTGHKTAEEYGRLAAETARAMRQIDPSVELVACGSSGQSMSTFAEWEATVLAETYDLVDHISLHAYYEPLDGDVDSFLASAVDMESFIENVVATCDHVGAKLKSKKRINLSFDEWNVWYLSRHEESALADPLDWPEAPRLLEDNYSVLDAVVFGSLLIALLRHADRVTVACLAQLVNVIAPIMTEPGGASWRQTTFFPFAQAARYGRGQVLDVRVDSPRYETKKYGEADLLHATAVRADDGTVTVFAVNRSRTEPLPLEVALNGLELTSVVEHSVLTDTDPDARNTLDDQERVAPRTVSGTALQDGTLTAALAPLSWNVIRLA

SEQ ID NO: 13274 - protein, 561 aa, Streptomyces avermitilis
MFTLALPTPPPLAQARGSGLSAAFAAGAVIPVGDTPGGIALTPTGTRAYVANHGSNTVSVLDTVTDTVIDTIATGGGPNAVAFSPDGTRAYVTVADDGLVSVIDTATNTIVTDIAVGAGATGVAVTPDGSRVYVTLQSSDTVGVIDTATNTVTASIPAAGTPLGLVITPDGTRAYVACLFANAVRVIDTATNTVIATIPVGPVPILLAVSPGGTHVYVTNVGNSTVSVIDTATSAVIATVGVSAQPRFAAVSPDGFHVYVANSGPDTVSVIDTATQTVVENIGVGDGPTGIALLPDGTRAYVTNAVAGTVGVMATTVIPDQGSTAGGTTVTLTGHHLANATAVHFGTAQAVITANTATSMTVTAPAGSGAVPVTVTTAGGTGTLGHFYYVPVPALSGINPAAGPVAGSDDEIVLTGRHLAGAIDVYFGTTRAVIQTVSDNQVTVRAAGAPAPGGTAVTVITAGGSAGGLSYTYLDPSTVTGVSPDSGPTTGGTEVTITGTGLAGTEQVTFNGIPAAFTVVSDSTLTATTPPSGAAGPVGVTVTGPGGAPAGTFTYVSEPDI

SEQ ID NO: 13275 - protein, 469 aa, Streptomyces avermitilis
MASPASGRVRPQAKPPGPPRVSSARFRPRGGARYTPALNPTAWHRPDLAVYGCLMPTNGPRRRALDWAAAHAPWSAWAWRNTAFVTAGLPLALPAAAALWLALCAPWKTGTALLLMLLASGVLTALQRGRFWSLLELDVPRVPAPAPWYTWRGVTGRLRAESTWRQCAYHLVAAPLAAVGGVVVVAAWGVGLVCTLVLSWLWAVPLRASMPDWSRQYVPLTVLGVLLLLLTPWVAAAVVRLDTGAAAALLGPSRAGELRRRVEDLAVSRAGALDAADAERRRIERDLHDGAQQRLVSLAMNLGLARATLTDLPPEARRVIDEAHREAKEAIEELNNLVRGLHPAVLDDRGLDAALSGIAARAPLPVELTVDMAERPSPTVEAVAYFVVSETLTNVAKHARATRVGVRLRRRADRLRITVHDDGTGGADPAHGTGLAGLVKRVGSVDGTIEIDSPPGGPTLITVELPCVL

SEQ ID NO: 13276 - protein, 156 aa, Streptomyces avermitilis
MSTLVTPPRCATPARSLPAAGGPLSTALVCGGAALLPWMVVLARTLPATAEVRNWSSAWVGLDAALAVGLAGTGLLLRRRDRRHVLAAAATSALLVMDAWFDVLTARAGVELLTAGLLAVCVELPLAGVCARIAVRGLPGRDARSLAGPHRLPVER

SEQ ID NO: 13277 - protein, 215 aa, Streptomyces avermitilis
VRAVIAEDSVLLRIGLVKVLEMAGFEVAAETGDAEGLLTAVEEHRPQLALVDVRMPPGFTDEGVRAALLIRRQWPETAVLLLSQYVEERYAADLLSAQAGGIGYLLKQRVADVEEFIDALRRVAGGGTALDPQVVAQLLLRRGGADPLERLTPREREVLALMAEGRSNAGIAGELVVSESAIAKHINSIFSKLDLPHADGAHRRVLAVLRFLDGV

SEQ ID NO: 13278 - protein, 268 aa, Streptomyces avermitilis
MSLPSRPRHRGLWITVAVISALFVLAPLGSEAYGQFARQTRSTHVTETSERHRIGSVDVEAGSAEVSVGPGRDGGIRIQQRLSWSLSRPPKVERWWVGDRLKIRTACDGTFAMTSMGCRIALDLQVPDGTPVHVVSDSGTVRASGLTGPLDIRTGSGTVKLYAVHGPVTAHAGSGSVTGTVLFSPEMHARADSGTVELDFGAAPRRVTGTVDSGSLTVTVPPGSRYRVRGHAGSGRVHIDDQLQQPASHRSVEVSADSGSVSVGYPGW

SEQ ID NO: 13279 - protein, 155 aa, Streptomyces avermitilis
LGVWVAVGLGARWVGVGSRVELRPRAARMVRMVETGWMSHDPGAVLFIALGLVLVAAGLVWKGRVLRPLSAKRSQAALARDRSRNLLRAADMAIAEARRRAAHDEPVVVTVGDVISVARQHYGHVSVEREQAAAALRRRYEAARCRADCVTDAFN

SEQ ID NO: 13280 - protein, 835 aa, Streptomyces avermitilis
VIKPEAIPQFTGNLEQLEKDYGSLKTVAGSIRTTGKDVHSQFQGLSAYYTAPEAEQLFASTKPVADRADGFADDLEKVSGALSSYATEVRPLVQKLEQLKLDATKFVSSVEGDDDWEYDEDKIDEHNKIRDDVTATVAAFWAAERTCHNAITKLFGGTQMVAGDGSDRKDQYGFNADDLKNAKLPWGDPMEEKHHVWEVGHWVKSFVWDGLIVDGVWGTIKGLGTLVGFGGWDAMGQAWKGLAQLATGLAISSIPGASALFWTLPDDKLPSWLRDSRTAMKETGKALVAWDEWGKNPGRAAGAVTFNVLTTVFTGGAGGAAAGAGKAGAVAKVLSVAGKAGKFIDPMTYITKGAGAGLSKIGDIAKGLKGIGNIEIPKLPDNAITLPEGALKLPDGSVHIPEGAAIPEGAVKLPDGNFKLPDDTPAFPEGTTKLPTEPGAPAQYLDPKGNILDHQGNVVDSVDNAPTDVVDKPSAGGNPADGSDVPHTPSPVREPALVGAGSHTADNAAHVGDNAGQTVRLGDSLGDDLGDVGRTGDNAGTPTVHAGDSLPGQAGHDLSGGRADDVDSTPTAGHDMPGGSTTDTLPGGGHEVPHKGSGLDDAGRIGEDASHTGDHAPGEHGHHGAGAEVAHGGHDPVDHGIPDGNPAHPFDDHAVPHASAPHDGPGLEGRGTPTPTPQTHSLGLKRDGFSMMRPDDAFYREALKSKPLPGHYDVVAHGTPHNTLMDTAGGRELNPRQLADIVRRRADYAPGTPIRLLSCNTGHVDGSFASQLARDLDAPVIAPDGFLYADQWGRFGVHRDLLLFVNSVPALPNTFYRYHPGGYVEEIPRSEWAVD

SEQ ID NO: 13281 - protein, 83 aa, Streptomyces avermitilis
MLMSAGNIIDPLGVEKGPVVPFGFSTDGEWAWPTYWAYFVREYGVSAPDDFMEHVKSRGFVPTDLTDEQAQQAADGIQKALYG

SEQ ID NO: 13282 - protein, 80 aa, Streptomyces avermitilis
MSTDLAWFKSSYSSGSGDDCVEVALSWRKSSYSSSGDGDCVEIATCPSTIHIRDSKNTQGPRLTLSPTAWADFVTHTARP

SEQ ID NO: 13283 - protein, 280 aa, Streptomyces avermitilis
MAVDGAVGTGGGEPDASDSLRTFGAVVQALREHAGLSREEFGERVRFSKHTVASVELGRRMPDPTFVERAEEVLGNTGALRKAVGHLARQPGLAAWFRQWARLEANAITLYTYECRMVPGLLQPEAYARQLFADELPPLDDEQVEAQWAARADRQRLLRDRPNSAFSFILEEHLLLRRTGGVGVTRGLIDHIMEVAQLRNVEIQIMPLVRESHAGLHGPIRLLETPENQWFAYNEGQQSGLLISDSKVVSVLKQRYARMRSQALTLVDSLSLLERMRGEL

SEQ ID NO: 13284 - protein, 152 aa, Streptomyces avermitilis
MTAPSVPQSPVTVRVFTQRLSATPLGARLARHLALNQLHAWGIPHGSRASDTVAVIVAELAANAVTHGRVPGRDFELRLSLVPGSVRIEVTDTRDELRPPGPGDVRSPEPFEESGRGLLLVEALADRWEVLDRDPPGKTVRAEVDVPRGKRA

SEQ ID NO: 13285 - protein, 976 aa, Streptomyces avermitilis
VYAAATAPTGPAPGPPAPDGRPHTVGFDQYSLLIDGKRVVLWSGEVHPFRLPSPSLWRDVLQKMRAHGYNAVSIYVSWNYHSPAPGSYDFTGVRDLDLFLRIAAETGLYVILRPGPYINAEVDAGGFPGWLTATEGTARTSDPTYLSYVDEWLTAVDRIAARHLFTRGDGTIVLYQVENEYADHVTSPLGRDYMAHLYAKVRADGIDVPLFHNDKGRNGHWAPGTFDTGGETGRWLYGFDGYPSPSAPPPDWGYFGVGGVKGGSTASPRTPGFVPEFGGGWFDPWGGAEFDGKGYAESRRTRDAAYERRFYLTNLANGIKLHNVYMTFGGTSWGWLPAPIVYTSYDYGAALDEARQPTAKLVPMHQLGHLLQSVPELAKLDRADDVTIDEAGGEGGADLGIKGIEGIKAYHLVNPDTKAHFHVLRNDTSDDRRVSLHLDSETSVTVPVPGLDARLIATGIALGRRRLRYSSAQPMLWLTAGRQDIAVFTGRPGDPTETLLECASKPKVTVLEGTARYAYTDGALRVDAEPGAAARVLVEGGGATAPLLLLFADDEASARLWRYDTPSGSVLVRGPALLRTATVRGTTVHLAGDTVKDADLEVWAPRGVSDVVWNRRTVRTRATASGSLRAVRRLPGAPKVTLPALTGWRRQAENPESAADFDDSAWRTADRTSSYSTTPVPTGGPVLFSDDYGFHYGDVWYRGRFEGGSVADTVSFSYVTGTQGLLMAWLDGKPLGTHRMPVPDKKTVRKGTWSATATFPVEVRETTDAGPHVLAVLVRRMQHDEDGKANDSHKAGRGLSSVTFNGASPEVSWRIQGEAAPDPVRGPLNNGGLYGERNGWHLPGFADGRWPAADFPRSERRQGVTWYRTGFRLTVDPEVDASIGLTLTDDDPARAYRVQIFLNGWNMGQYINDVGPQHTFVLPNGVLNTRGPNTLALAVLSDGTTSSGPGKVELTLLGRAAGGVPVTLVDSPGRRN

SEQ ID NO: 13286 - protein, 152 aa, Streptomyces avermitilis
MRISARADYAVRAVLELAVREDDGPVKAEAIAAAQDIPHKFLEGILGDLRRGGLVASRRGGNGGYRLARAADTITVADVIRAVDGPIVSVRGERPTGLTYTGSAEPLLPLWVALRANVRKILEGVTLADIAADALPAPVRELAAEPAAWENP

SEQ ID NO: 13287 - protein, 289 aa, Streptomyces avermitilis
MSMTENQAQHEQNDNNVPQPASHRRDKSVQRRRILIGGGTMAVAGGLAIAGMASADPVTDSTTKADTSGSATTSASTSATTSSGVCTLNAEVTEGPYSLDGALVREDIREDKEGVEVQYTLTVVDTANDCAPLADALVEIWHCDALGEYSGFVGRNGHTEEDDGTFLRGGQLTDSDGQVKLISIWPGHYVSRAVHVHMRVHTDVTLTDDSYTGGEVIHTGQLFFDADINTEIQAISPYSDNTTKETQLDDDSIYDDGGASSGLLTLTALGSSVSDGYKATLTVGVDSSS

SEQ ID NO: 13288 - protein, 396 aa, Streptomyces avermitilis
MSTHASAHGSTHTSTHHPIAVIGAGLGGLAAARVLHVHGIEAAVYEADASPTARHQGGMLDIHGESGQAALRAAGLYEEFRAIVHPGGEATRILDKDGTVRHEEGDRPEEGDRPEVDRNDLRRILLDSLPEGTIRWGAKVTGARALGGGRHEVTLADGSVFTTDVLIGADGAWSRIRPLLSPATPAYTGISFVEADLHEAATRHRAAAELVGGGSMFALAEGKGILTHLETDGSVHAYVALKADEDWLSTIDFTGTDTDTAKKTLLTHFEDWDDRLRALITDADGALVPRLIHALPVDHRWERTAGVTLLGDAAHLMSPFAGEGANLALLDGAELATALAAHPADPESALTAYERSLFPRSHRAAGESAANLTFMFGPNALEELVGMMSGHEPSDR

SEQ ID NO: 13289 - protein, 292 aa, Streptomyces avermitilis
VISSLRDIANEHVRYVLVRSEHVRYCLRMTPHSPSPRSRRERPAKPALTRAGIVATAVELMRAEGLERVTMRRLAQELDTGPASLYVYVRNTAELHAAVLDELLGEVDLSPVRSAGDWRDRLARLLTSYVEVLFEHPALARSALVARPSGEHYLDLVEAVLALLAEGGAAPERAAWGLDLLLQYGTATAAEHSTRAESADAQRDREALTAVLDNSSPDRHPQITALGPDLIAGAGEARLAWGFQVLLSGIVTAPDPDTTPAAGTGADAGTGAGAGAGADKNSAPDTATDTTP

SEQ ID NO: 13290 - protein, 271 aa, Streptomyces avermitilis
LPNAQRFNRKCSYGAVFMTDTSEPSIGRRTVLIATGATAVTLAVSAAAATEAPTADAKDAAPAAAAAVCTLTKEMTEGPYYLDGALVRADITEGKAGIPLKLALTVVDDSTCAPISNALVELWHSDALGEYSGFVGNNGHSEPDNGKFLRGGVLTNSSGVANITSIYPGWYRGRCVHIHVKVHTGVTLTSDGSFTGGQELHTGQLFFNETVTTAVAKISPYSTNTVTRTTLAQDSIYDDGGAASGLLTLTALGSSTSSGYAGTLTLGVDQG

SEQ ID NO: 13291 - protein, 62 aa, Streptomyces avermitilis
MQVRVEGYDWSRYNGKQKKSVPLDKLNWDGAALHTDDAYIRVCRDKGSLNPDNCSPTKHYQR

SEQ ID NO: 13292 - protein, 240 aa, Streptomyces avermitilis
LGEANSMSEILTATGVDLSYGNQPAVRDAHLSVSPGEVVAITGQSGSGKSSLLYCLAGVLPATRGQVRFEGRALGDLADEEISVLRRERFGFVFQYGELLPELTVEENTALPLRLAGQRKGPALAAAGEVLERLGLGGLRERRPAQVSGGQSQRVAVARSLVHRQCAQVVLPLGFGLVLALVTGKLAESSYLITGGGTVRWDLPGVPLLALAAAGVVAAAAASSLPLVGRRVDPELIRRD

SEQ ID NO: 13293 - protein, 277 aa, Streptomyces avermitilis
VRRTPTCVLSDAAPPDVGDGHALDRFVEIGSLTKVVTGTALTRMAAAGVLELDDPVERWLPAAPGTGITLRHLAQHTSGLPRLPPRVSRRDPYAEFDRPALHRLLHRLDAIATRPAGRQEEYSNLGYAVLGEALSAAAGTGYEELVTEYVLRPLDLAEVTAHPDPSRRLPAPGLFGWPRRPWTMHGAILPAGGLWATPRAAADLVVRLLVERRLGEPAPTWQTAGPLRWHNGATRDASVFAGALDDGRWVLIHRLNAAPDDTDRAGIEALKRSRAAS

SEQ ID NO: 13294 - protein, 549 aa, Streptomyces avermitilis
MAENVTSLFRSTSAHSPSMAALTRESDGAGPVDFCIPCNPYFPTPAMFDDLAGRLREIITYYPSSADTITAELCNLLQLPPQCVAMGNGSTELITWIDHLLVRESLAIPVPTFGRWTDQPMETGKRVDMFPLQESSGFALDLAQYAEFIRARGTRVAVICNPNNPDGGFIPRQSLIQFMDAMADLDLIVIDESFLEFADAENEPSVVEDAVMRPNVIVLRSLGKNFGLHGIRFGYLVANPALAGKVRSMLPKWNLNSFAETVVFMLKEHGAEYLESLHMVRRDRLDMARQLSALPGLTVYPSQGNFLFVRLPVGAEGTVVRDRLLTEHRILVRECGNKIGSSSRFLRLVVRPQVDVRRLVSGLEQVLYGTRRGAAVPELGTGTSYSSGTAAVDRLVGETNGAGMPGLAAQAAGMQSLAPGAAQAQNPYPPQSPYPTPAPAAMPAPAPMPAPAMPAPAPMPYAAPAAAMPSMAPAPNAPMPGMAPAPAAGLTAVAQTGMPGLASAAQNNRRGMGAAQGLTAAQVRGRTQPEPTPEPTGWPAAGAMYNQVG

SEQ ID NO: 13295 - protein, 383 aa, Streptomyces avermitilis
MELNRRTLIAGTAAAGIAATTLGGTAQAAPGSGRPVKELFGKLADGTKIYRWSLENGGTRLKVLSYGGIVQSLEIPDRHGRYKNVSLGFATIEDYVAKTPYFGALIGRYGNRIAKGRFDLDGKSYQLSVNDGVNSLHGGAKGFDKRPWDIEGFTSGSDVGLHLYYTSVDGEMGYPGTLKAKVTYTLTRHGDWRIDYEATTDKATVVNLTSHVYWNLAGEGSGSIYDHELKIAAARYTPVDSGLIPTGELAKVAGTPFDFRRTKTVGEDIREANQQLLYGKGIDHNWVLDKGITAKPAHVATLRDPSSGRTLRIATTEPGLQFYSGNFLDGTLVGPGGHIYRQGDALCLETQHFPNSPNQPAFPSTVLRPGETYRSSTVHSFDA

SEQ ID NO: 13296 - protein, 414 aa, Streptomyces avermitilis
MSANVTAKTPAEASPGGSPSGSGPGLLRLLVDGMRSNMRQYGMLIALGVIVALFAVWTGGDLLLPRNVSNLVLQNSYILILAIGMMIVIIAGHIDLSVGSITAFVGGVAAVLMVNHDVPWPLAVLLCLAVGAAAGAAQGFMIAYLGMPSFIVTLAGMLIFRGLTEVFLKGQTLGPFPEGLQKVANGFLPEVGPKTNYHNLTLLLGLALVGFVIWREMKDRKRQAEYSLEVLPANLFAVKLALLTAAIIALTMELGSYKGAPVVLLVLAVLLVGFGYVMRNVVVGRHVYAIGGNLPAARLSGVRDKKVTFLVFLNMGMMAALAGLVFAARFNGASPKAGVNFELEAIAASFIGGASMSGGVGTILGAIIGGLVLGVLNNGMNLVGVGTDWQGVIKGLVLLAAVGFDVWNKRKVGS

SEQ ID NO: 13297 - protein, 513 aa, Streptomyces avermitilis
MAGPVLEMRSIVKTFPGVKALSDVTLTVRPGEVHAICGENGAGKSTLMKVLSGVHPHGSYEGEVLFEGETCRFKDIRASEQHGIVIIHQELALVPYLSIAENIFLGNEHAARGVISWNDTLKHASRLMRRVGLDDHPQTRVADIGVGKQQLVEIAKALAKEVKLLILDEPTAALNDEDSGKLIDLILELKNQGITSIIISHKLNEIERVADSVTILRDGRTIETLDVKAPETTEERIINGMVGRDLDHRFPERTPHQPEADAAPALEIRNWTVHHPIDQQRKVVDDVSLSVRRGEIVGIAGLMGAGRTELAMSVFGRTYGRYAQGTVLKDGKEIRTKTVPEAVAHGIAYVTEDRKHYGLNLMDTIGRNISLSALGKVAKRGVVDDHEERKVAEGFRKSMNIKAPTVFEPVGRLSGGNQQKVVLSKWIFAGPDVLILDEPTRGIDVGAKYEIYTVIDQLAAEGKAVVFISSELPELLGMCDRIYTMAAGRLTGEVPRSEATQEVLMRHMTKDKR

SEQ ID NO: 13298 - protein, 370 aa, Streptomyces avermitilis
MRNRRAALAVIASAASLALTLSACGQNSEGGSKDEKKSAKGSTVGIAMPTKSSERWIADGANVEKDLKAAGYKTKLVYGEDDPDTQVSQIENMITQGVSALIIAAIDNKSLDNVLQQAADAKIPVISYDRLILGTKNVDYYASFDNEKVGELQATYIVDKLGLKDGSKKGPFNIELFAGSNDDNNTKYFFNGAMKVFKPYLDDKKLVVKSGQSALNQVTTLRWDGGTAQKRMDDLLTSTYSKARVDAVLSPYDGISIGILSALKSDDYGSKSKPLPVVTGQDAEVASVKSIIAGEQTQTVYKDIRKLAEVATNMVDSALNDKKPEINDTKSYDNGDKVVPAYLLQPVSVDKSNYKQELIDSGYLKASDVQ

SEQ ID NO: 13299 - protein, 322 aa, Streptomyces avermitilis
VTDASPTAPRRPGEQALAALGLGAPALSPADASPHTFPGGGRWRTEVPSVEGPEALAVVLKESSRLDVPIHRISQGSGIWMLTDAEITEMVEATAARDIELCLFTGPRGTWDIGGSTRSDSRGGGLRARGHDAVAGCVEDAVRATELGVKCLLVADEGVLWTLHRARVAGIIPADTTLKVSALIGPVNPAAYAVYENLGADSVNVPSDLTLAHLTEIRRVSAAPMDMYIEAPDDLGGYVRMYEVAELIRRGAPLYLKFGLSKAPGIYPYGHHLRDLTLNTARERVRRGRLALDLLARHGADGDMAPLGSRLPGTLRRFDTSS

SEQ ID NO: 13300 - protein, 334 aa, Streptomyces avermitilis
VSGAVVIEAPGEYRIVAHEPTAPAAGEALVRVHASGICGSDREVYQGNRPEGYVRYPLTPGHEWSGTVEAVGAGVPGTLVGRKVVGEGFRNCQVCDRCHAGETTLCTAGYEETGFTQPGAMAATLTLPARLLHVLPDDADLTAAALLEPAACVAAAALKANARPGERVAVVGTGTLGMFAVQFLRAGSPAELLVVGTRPDREKLSRDFGATGFRTKDQELPADFDVVIETAGSASAARTAASLLRRGGRLVLTGIPAPGAEGLDPTDLVVRQLEVHTVFGAPPDAWAHTVRVFGAGLLDPLPLVTHELPLVEFPRAIELVGSGDPEVGKVLLRP

SEQ ID NO: 13301 - protein, 385 aa, Streptomyces avermitilis
VRITGISTHVVGTPWRNLTYVQVHTDEGITGVGETRMLGHTDALIGYLREAEANHILGSDPFAVEDLVRRMKYGDYGRAGEIVMSGIAVIEMACWDIKGKALGVPVWQLLGGKVTDKVKAYANGWYTTERTPEAYHKAAQEVIARGYKALKIDPFGTGHFELDHDATLYSVSLIEAVRDAIGPDAELMLEMHGRFSPATAVRLARELAPFKPAWLEEPVPPENLKALEKVAAKVDIPVATGERIHDRIEFRELFESQSVDIIQPDVGHIGGIWETRKLAATAEAHYVLVAPHNVGGPVLTAASLQVGFTSPNFKILEHFNDFADAEIKKVVKGAPQVVDGYFHLSDAPGLGVELDTDAAAEFPQQQARFDLWADGWEQRKPKGSK

SEQ ID NO: 13302 - protein, 247 aa, Streptomyces avermitilis
MDYCDPCRRHLNGALACPGCGTPIEELRAYADEAGARPDAEDADASSAEGAAADGARPGRAESRRGTKGRGGRGDRGAPRAGRRDRKAAAHRRRRRTALLVGAGLLLAAGGLSLAELGIEAPGSTPKATAAGGATADGSSSSAATTAEPIGDTAGGDGTSASGSPDASASPSASESGKDKKSGKDKKKDEDEQSVATSAAPGTATSAPAATPPPQTSTAPSANPTPADPTPAPSTSKPCNRFLWWCT

SEQ ID NO: 13303 - protein, 267 aa, Streptomyces avermitilis
VSNSLRLSGAVLAAAFLLGTAACGTSSPSPAASPATGTSAPGEKPSGSGGLVLQVRDGGGLVPVSPAANIPRFSLYEDGTLVTSPATKRSGLPGLRVAHLSAAEVRTVVGAAHDAGLPHSGPLGPAPPADGPVRSYTLDGKLTTTVAPALRDCTRQRELCALDKRLDSLAEPSGTYRYSVMAAVFNESGKGRSPGAATWPLGRLSTAGEPTSAGRCLLLRGTDLKRVREAARTATSSAWTDGTATYRMALRPLLPGEDSCADVVATD

SEQ ID NO: 13304 - protein, 143 aa, Streptomyces avermitilis
MATQKTRPDALTLEVVDLIGTVVARYHEEFEEAAAEHALTGAQARLVSLLSLEPLPMRRLAEKLKCEPSNVTGIVDRLEARGLVERRPDPADRRVKLAACTAEGHRVARGLRDSLDFAREPLAGLSHEERLSLRALLLRMLEA

SEQ ID NO: 13305 - protein, 340 aa, Streptomyces avermitilis
MTVTPQLPAVSREWHLASRPVGWPKPEDFALVEAEVQQPGEGQVLVRNKFVSVDPYMRGRMSAAKSYVAPFELNQPMQGGAVGEVVVSNAEGIEAGDHVLHFLGWREYAVVDAKQAVKVDPEAAPLSAYLGVLGMTGLTAYAGLLRTASFKEGDSVFVSGAAGAVGSQVGQIAKLKGASRVIGSAGSDDKVKLLVEEYGFDAAFNYKSGPVNEQLREAAPDGVDVYFDNVGGDHLEAAIGQLNRDGRIAVCGMISVYNDTEPAPGPKNLARLIQTRGRIQGFLVGDHYDLQSQFVQEVGGWIRSGELKYRETVVEGIENNLEAFLGVLRGDNTGKMIVKL

SEQ ID NO: 13306 - protein, 97 aa, Streptomyces avermitilis
VVAGHHVVPDGVDLPEHPEGVRLQVCGPDGNASNTACCSGGGSICCTEWKRGSCSSGSPRKKSSPYGARTRSSYISWSVRPVTRRTTSPVSAPITRA

SEQ ID NO: 13307 - protein, 79 aa, Streptomyces avermitilis
VQDGTLELDREVASYWPEFAAEGKGAVTLRELLAHRAGIVGADTGFTAGELADDRVTPSGWRASGRSGGRVRPSAITPW

SEQ ID NO: 13308 - protein, 320 aa, Streptomyces avermitilis
MAGRPRARMPGWCLPGGPDGACWTRHRARRGDPMSPIPSLPSRDDVVRMARSTTDITGQLLDTAGNITKIAINTFDPRDGSGAEALRVLRQTTAELAEASASPQAQEAFYRIVDTLTRLGTSGAPLAVHPVSEPAQALLAALGDTLLPVLDAVEPAVREASAALGELVDATSPLLPAAAGAAAGTLLALTPLIRAAADVLRDSSPELRRVADALTAALTPLLPLQVALAERAAAAGAGVVRAALPPLADLTEAAATTAKAARPLLIAGEERLVAGLEQIQPLLVATASRTGRAARAVAVRVSAAVSPAADQGVVVAVTPV

SEQ ID NO: 13309 - protein, 238 aa, Streptomyces avermitilis
MRDLGAGFGYLLKGQRWVARHGKQYGFGLLPGLITLVLYAAALVALAFWGEDFVAWATPFADDWSSPWQGLFRGFLTVVLFALSLLLSVLTFTAVTLLVGQPFYESLSEKVDQDVSPDGTAPESGLPLWRELWISARDSLRIVVRAVLWGILLFALGFIPFVGQTVVPVIGFFVTGFFLTEELTAVALQRRSVQLRERLALLRSRKLLVWGFGTPLGLAFLVPFVAVFLMPGAVAAPP

SEQ ID NO: 13310 - protein, 443 aa, Streptomyces avermitilis
LTSIRVRIGIPPLALLALLTGLVTPGTATADAAPTTTVEERRLDKAVPQEILRRSGFDSVAPGFARALGSAHSYAQARRIVVQQGSRLWQRAVDRAQGRGPAGGDLSRDDDRPLYWARLGMTREVRLWEPEFALSDTQRARLLSGLEVSSRGQNAVRYPHGRGVKRILVTGFDPFTLDRDIRISNPSGATALALDGTTIETADGPARIETAVFPVRWQDFADGTVERALRPQLPRVDLFTTVSQGRVGRFDVERTNGAWRGGFPDNDTIGRTETVPVTDPASQPQWTTTTLPYRAIVAADTGRFPVYDNTSVTEIPAGGTAEVVRPDGPTPGSTARAGGGGNYLSNEIAYRATLLRDRLGLHDSLPGGHVHTPVLEFGTGNTDPATGTVTDPEFIRNRLDIIGQVRSILTVAADSVGAGSVATDPVGTDPVGTDSVATERARG

SEQ ID NO: 13311 - protein, 326 aa, Streptomyces avermitilis
MSELFGTLLDGAAVRRWTLERGGVRVRVLSYGGIVQSAEVPDRDGRTADVVLGFDGLDGYLAHPEPYFGALVGRYANRIAGGRFSLDGREYRLARNNGPNSLHGGERGFDKRVWEAEPVEHGVRLSRVSPDGEEGFPGRLEISVTYTLGADAALRIAYEAVTDAPTVVNLTNHSYWNLAGSGNAGGHALRIAASRLTPVDGNLIPSGAFDDVSGTRFDFRRPRKAGSGYDHNFALDKGVTRAPEPVAELHDPSSGRVLTVATTEPGLQLYTADHLDASVPFAPGDGIALETQHFPDSPNHPDFPTTQLRPGEVFRSETVYGFGVRD

SEQ ID NO: 13312 - protein, 300 aa, Streptomyces avermitilis
MRNRGHRSWAVLATVAAVLLGGAGCDAVGGDASGAHSTGTKGRPSPKPTPVWDRSPASLAAVGDSITRGFDACAVLSDCPEVSWATGSDADVDSLAVRLLGPVGAAERSWNYAATGARMADLPEQMERAVARKPELVTVMVGANDACRASASAMTSVADFRADLEDAMATVRQALPKTQVYMSSVPNLKRLWSQGRTSALGKQVWKLGICPSMLSDADVVDATATKRRDKVQARVEAYNAVLKDVCAKDRRCRFDGGAVFDYRFGTAQLSHWDWFHPSKNGQAQLAAIAYRTITARRAVS

SEQ ID NO: 13313 - protein, 164 aa, Streptomyces avermitilis
VTTRGVLYVHSAPRALCPHVEWAVASVLGTRVSLDWIRQPAAPGTWRSEFSWQGEAGTASKLASALRGWQLLRFEVTAEPCPTAEGERYSCTPDLGIFHAVTGIHGDILIPEDRLRAALVRSQRGETDLEAELSKLLGKPWDDELEPFRYAGEGAPVRWLHQVV

SEQ ID NO: 13314 - protein, 423 aa, Streptomyces avermitilis
VSPTNRTVVVTGIGATTPLGGDVASTWEGLVAGRSGVRPLEQEWAAEQAVRIAAQIAVEPGEVIPRPQARRLDRSAQFALIAAKEAWADAGFTDKAGADPAVDPDRLGTVIASGIGGVTTLLDQYDVLKEKGVRRVSPHTVPMLMPNGPSANVGLAVGARAGVHTPVSACASGAEAIGYAIEMIRTGRADVVVAGGTEAAIHPLPIAAFGNMMAMSKNNDDPQGASRPYDVARDGFVLGEGAGVIVLESAEHAAKRGARVYAEAVGQGISADSHDIVQPEPEGRGISHALQNLLDSTDLNPAEIVHVNAHATSTPAGDVAELKALRKVFGDDADHFAVSATKSMTGHLLGGAGGVESVASVLALYHRVAPPTINVDNLDPEAEANADIVRGEARKLPVEGRIAALNDSFGFGGHNVVLAFRTV

SEQ ID NO: 13315 - protein, 82 aa, Streptomyces avermitilis
MAATQEEIVEGLAEIVNEIAGIPTEDVQLDKSFTDDLDVDSLSMVEVVVAAEERFDVKIPDEDVKNLKTVGDAADYILKHQA

SEQ ID NO: 13316 - protein, 355 aa, Streptomyces avermitilis
MSKIKARKGAPYARILGVGGYRPVRVVPNDVILEKIDSSDEWIRSRSGIETRHWASDEETVAAMSIEASGKAIADAGITASQIGAVVVSTVSHFSQTPAIATEIADKLGTNKAAAFDISAGCAGFGYGLTLAKGMVVEGSAEYVLVIGVERLSDLTDLEDRATAFLFGDGAGAVVVGPSEEPHIGPTVWGSEGDKAGTIKQTVPWDRYLPHSRLRSSGGTPTGDVSPLPLDSEGNVKFPAITQEGQAVFRWAVFEMAKVAQQALDAAGITSDDLDVFIPHQANERIIDSMVKTLKLPEHVTVARDVRTTGNTSAASIPLAMERLLATGEAKSGDTALVIGFGAGLVYAATVVTLP

SEQ ID NO: 13317 - protein, 316 aa, Streptomyces avermitilis
VLVLVAPGQGAQTPGFLTPWLELPGAADRVAAWSDAIGLDLAHYGTQADADAIRDTSVAQPLLVAAGILSASALGDVAPGAVAGHSVGEITAATFAGVIDDTAALTLVRTRGLAMAEAASLTPTGMAALLGGDPETTIPHLEKLGLTPANVNGAGQIVAAGTLEQLAALEAEKPEGVRKVIALKVAGAFHTPHMAPAVDALARAAEALTPADPVVSYVSNKDGQEVATGAEILSRLVGQVANPVRWDLCMETFKKLGVTTLVEVCPGGTLTGLAKRAMPGVKTLALKTPDDLDAARELIAEAVTSAAVPAGVREGA

SEQ ID NO: 13318 - protein, 401 aa, Streptomyces avermitilis
VPEPQSSSPEPAARDAHSHAATLKRLEKSSGSLAAQAITRMDETLPWYRAMPPENRSWIGLVAQAGIAAFTEWFRHPDTPQAISTDVFGTAPRELTRAITLRQTVEMVRTTIEVMESAIDEVAAPGDESVLREALLVYAREIAFATAQVYAQAAEARGAWDARLESLVVNAVLSGEADEGAVSRAAALGWNSPDHVCVVLGTAPEGDSELTVEAIRRAARHAKLQVLTGVLGNRLVVIAGGSDNPLAVAKSLIGPYAAGAVVAGPVVPDLLAATRSAQAAAAGLKACFAWQDAPRPVLADDLLPERAIAGDPSAREQLVEEIYRPLEEAGSALLETLSVYLEQASSLEGAARMLFVHPNTVRYRLRRVTDVTGWSPSDVRSAFTLRIALILGRLAGGDPQT

SEQ ID NO: 13319 - protein, 217 aa, Streptomyces avermitilis
VTDVRRAGERYRGGDPAAGISSLHAFSFGPHYDPDNLRFGAVIACNEERLAPGAGFDEHPHSHTEIVTWVVEGVLTHRDSTGHESLVRPGDVQRLSSAGGVRHVERNDGPDPLTFVQMWLAPLEPGGEASYEVVHGIADSTPYAVPEAAAMLHVRRLSAGERTAVPDAASVYVHVVRGEVRLDGEELRPGDAARITAAKDLEAEAVTAAELLLWEMA

SEQ ID NO: 13320 - protein, 276 aa, Streptomyces avermitilis
MSLQSLALIENWPVSTAAAAVVRADGTVLAAHGPVDHRFPLASVTKPLAAYAVLVAYEEGAVELDEPAGPPGSTVRHLLAHTSGLAFDEHRVTSAPGERRLYSNAGFEVLGDHIAKATDIPFAEYLRQAVLEPLGMTRTSLDGSPARDGVSTVADLVRFAAEVQAPRLLDPRTVAEAMTVQYPGTKGVLPGYGHQNPNDWGLGFEIRDAKSPHWTGTSSSPGTFGHFGQSGTFLWIDPVARVACAALTDRAFGPWAAEAWTPFTDAVLTELRAGRA

SEQ ID NO: 13321 - protein, 160 aa, Streptomyces avermitilis
MTVMESTAEAAGTGTTTDVCAAPPQRHRRPDGQDSYTISEVVAFTGLTAHTLRWYERIGLMPHIDRSHTGQRRYSNRDLDWLAFVGKLRLTGMPVADMVRYAEMVREGDGTYTQRYEILESTRRDVLARIAELQDTLAVLDHKISFYADAGRALTSERSR

SEQ ID NO: 13322 - protein, 338 aa, Streptomyces avermitilis
MTDSRIATAQLGTDGPTVGVQGLGCMGMSFAYGPADAGESRATLERALELGVTFYDTADAYGAGENEKFLSPFFKAHRDEVVIATKFALSIPPGEPTKRVIRNDRPYIRQAVEASLKRLDVDVIDLYYMHRRDVNVPIEETVGAMAELVREGKVKHLGLSEVTGGELRTAQAVHPIAAVQSEWSLFSRDIEAGVVPAARELGVALVPYSPLGRGFLTGSFANAEKDLTADDFRRLQPRFTGDNAAANAALLEPVRAVAKAHDASLGQIALAWVQQQGAVHGLPVVPIPGTSKRARVEENATATRIVLTEEELGLLEPIAAKVAGDRYADMTFTSAGRE

SEQ ID NO: 13323 - protein, 287 aa, Streptomyces avermitilis
MGDVLAGFHAAWEFESDSVLIRFERGIRSPKLFQALGERRVPLEAIAGVTLTPGKRGTVVLHAVPRAGADPLMEAAAGQLKDTCDPYRLVLPAERETLAEYYADELRARLADDDTPAERYLVAPPEAPLQFKAYDGKASFDGKRVSFRWSWTGASSAKWKAGDQNFPVTGLSGVEWRSPEVFEGHLRLLPREPAGAKPDQPGQPDQDPAAVVFGLGYGPVHESLPFAAAVLAAVRSAGGGAPALASVPRRDPADIAERIRHLGELHRAGLVTDSEFATKKAELLAEL

SEQ ID NO: 13324 - protein, 402 aa, Streptomyces avermitilis
VTSFDASPPLNVWRALLALAVVFVMLATTGWTAVHSHRRDTPLQASRSAWQHGSIGGRHLPDANSAPGRIARFFASLDASQRSRLAHRYPLAVGNMNGAPVKLRYRANHIALGQQRKVERGRMHDNRLSTVGQQDAGSRMHRFEALMGKKRQILAFDPEGSGRIAEVYGKLDKAQRISVVVPGVDTDLLTFQRTFRKYSAPVGMARSLYRAERAASPTTRTAVIAWADYTSPSGLGIDSATAMRAADGAVRLDALVRALPGRSPVALYCHSYGSVLCGIAARSLPSRVSDIAVAGSPGMRAEKVSGLGTSARVWAMRDSDDWIQDVPHLEVGGLGHGADPVSRAFGARLLSATTAKGHGGYFEPGTDSLRNFAEIGVGAYHSVRCADDDDVCRAGLSGGATA

SEQ ID NO: 13325 - protein, 226 aa, Streptomyces avermitilis
MDTAARPGLRERKKRRTRDALLRAALELFLAQGYERTTVDEIAEAVDVSQRTFFRYFAGKEEAAFLTQRIAESHFVAAVRERPPHEAPLEALRRAVLESWETIGEAIEQVVPVELHMRTYQLIESTPALLAVHLRHSAELEEELARIIAGREGLDVDADPRPRVAVAVFGGVIRVTGRLWGAGGNLSVKAIREQTVAHLDAVGPVLAEKWGTQAPPRPADDPLPVE

SEQ ID NO: 13326 - protein, 540 aa, Streptomyces avermitilis
MTSQTTIDTTGPGDKAPLAPSDKAPAKGLRGHPWYTLITVAVGVMMVALDGTIVAIANPTIKADLGASFADVQWITNGYFLALAVTLITAGKIGDRFGHRQTFLIGVVGFAAASGAIGLSDSIALVITFRVFQGLFGALLMPAALGLLRATFPAEKLNMAIGIWGMVIGASTAGGPILGGVLVQHVSWQSVFFINVPVGALALVLGLLILLDHRAENAPRSFDILGIALLSGAMFCLVWALIKAPTWGWGDGKTWAFLIASLVGFALFGFWETRVREPLIPLALFRSVPLSAGVVLMVLMAIAFMGGLFFVTFYLQNVHGMSPVDAGLHLLPLTGMMIVGSPVAGMLITKTGPRIPLAGGMALTAIAMYGMSTLETDTSGAVMSLWFALLGLGLAPVMVGATEVIVGNAPMELSGVAGGLQQAAMQIGGSLGTAVLGAVMASKVDNDLAGNWADAKLPPLTGAQLDQASEAVQVGVAPVPKGTPAAIAEQITGVAHDTFISGMSLASLVASGVAAVAILVAMLTKRGENADAAGAGAGHI

SEQ ID NO: 13327 - protein, 103 aa, Streptomyces avermitilis
LMMAGFGHGTRRYPRSRGRTWSRTGPDRATLGIVGLVCAIAGFFVLGIILGPVAIVCGWLGMGRSWAGARPLPALIALVLGAIDTLLAVIWLIGMASPGNGLL

SEQ ID NO: 13328 - protein, 275 aa, Streptomyces avermitilis
VDVRGSRGGWAAGSPRPLRGALGTYDAGMKEQSAQARWEQHTQRPLLALAVAFAVAYAVPIVDSDASRSLTGVCTAVEWVVWGSFAADYLVRLAITAERREFVRTHWLDLCAVVLPILQPLRLLRLVSTLMLLGRRARMASQIRLTTYVAGSVIGLLMFGSLAVLSVERDSPNGNIRTLGDAVWWSFTTMTTVGYGDHAPTTGLGRMIAVGLMLSGIALLGVVTANIATWFISRFEKDDVEERRQTAAIEALTEEVRALRAEVAALSGAAEKQPR

SEQ ID NO: 13329 - protein, 915 aa, Streptomyces avermitilis
VASGSDRNPIIIGGLPSQVPDFDPEETQEWLDSLDAAVDERGRERARYLMLRLIERAREKRVAVPEMRSTDYVNTIATKDEPFFPGNEEIERRILNATRWNAAVMVSRAQRPGIGVGGHIATFASSASLYDVGFNHFFRGKDEGDGGDQIFFQGHASPGIYARAFLLDRLDERQLDAFRQEKSKAPYGLSSYPHPRLMPDFWEFPTVSMGLGPLGAIFQARMNRYMEARGIADTSKSHVWAFLGDGEMDEPESLGQLSIAAREGLDNLTFVVNCNLQRLDGPVRGNGKIIQELESQFRGAGWNVIKLVWDRTWDPLLAQDRDGVLVNRLNTTPDGQFQTYATETGDYIRRHFFGDDHRLRAMVEHMTDDQILHLGRGGHDHKKIFAAFSAAKAHKGQPTVILAQTVKGWTLGPNFEGRNATHQMKKLTVADLKGFRDRLHLPISDKQLESGPPPYYHPGRDSEELQYMHDRRKGLGGYVPTRVVRSQPLALPDDKTYAGVKKGSGQQSIATTMAFVRLLKDLMRDKEIGKRFVLIAPDEYRTFGMDSFFPSAKIYNPLGQQYEAVDRDLLLAYKESPTGQMLHDGISEAGCTASLIAAGSAYATHGEPLIPVYVFYSMFGFQRTGDQFWQMADQMARGFVLGATAGRTTLTGEGLQHADGHSQLLASTNPGCVAYDPAFGFEIAHIVQDGLRRMYGSSEEYPHGEDVFYYLTVYNEPIQHPAEPENVDVEGILKGIHRFSEGTAGSIPAQIIASGVAVPWAVEAQRILAEEWNVKADVWSATSWNELRREAVEVERHNLLHPEEEQRVPYVTQKLSAAEGPFVAVSDWMRSVPDQISRWVPGTYQSLGADGFGFADTRGAARRFFHIDAQSIVVGVLTELAREGKVDRSVLKQAIDRYQLLDVAAADPGAAGGDA

SEQ ID NO: 13330 - protein, 159 aa, Streptomyces avermitilis
VAEDIYQDMIRRQPVSATADHAEERTNPAARLGFQPEQVVQEIGFDDDVDQELREAIEEVIGSELVDEEYDDVADAVVLWFRDEDGDLTDALVDATTYVEEGGTILLLTPKTGRDGYVEPSDISEAATTAGLSQTKSVSVGKDWSGSRLATPKAAKSKR

SEQ ID NO: 13331 - protein, 152 aa, Streptomyces avermitilis
MAIQVGDKAPDFELKDNHGATVRLSDFRGEKNVVLLFYPFAFTGVCTGELCALRDELPKFVNDDVQLLAVSNDSIHTLRVFAEQEGLEYPLLSDFWPHGNTSRAYGVFDEDKGCAVRGTFIIDKEGVVRWTVVNGLPDARDLNEYVKALDTL

SEQ ID NO: 13332 - protein, 191 aa, Streptomyces avermitilis
VGVSLSKGGNVSLTKEAPGLTAVIVGLGWDVRTTTGTDFDLDASALLTNVEGKVANDQNFVFFNNLKSPDGSVEHTGDNITGEGEGDDEQIKVDLATVPADVDKIVFPVSIYDAENRQQSFGQVRNAFIRVVNQAGGAEIARYDLSEDASTETAMVFGELYRNGPEWKFRAIGQGYASGLRGIAQDFGVNV

SEQ ID NO: 13333 - protein, 191 aa, Streptomyces avermitilis
MGVTLAKGGNVSLSKAAPNLTQVMIGLGWDARSTTGAPFDLDASALLCREGRVLGDEWFVFYNQLKSPDGSVEHTGDNLTGEGEGDDESILVDLSTVPAQVDKIVFPVSIHEADNRGQTFGQVSNAFIRVVNQADGQELARYDLSEDASTETAMIFGEVYRYGGEWKFRAVGQGYASGLRGIVQDFGVSVS

SEQ ID NO: 13334 - protein, 381 aa, Streptomyces avermitilis
VLLKTFGWSFAVTALGLVAAVIYGGWTAFGIVAILSILEISLSFDNAVVNAGILKKMSAFWQKIFLTVGVLIAVFGMRLVFPVVIVAVTAKKSPIEAVNLALTDKDQYQQLVTDAHPAIAAFGGMFLLMIFLDFIFEERDIQWLRWIERPLAKLGKVDMLSVCIALVVLLVSSMTFAVHAHQHGGAHVDKAQTVLISGIAGLITYMVVGGLSGYFEDKLEEEEEREHEEEEEAARTGKKKPAVVLAGQAAFFMFLYLEVLDASFSFDGVIGAFAITNDIVLMALGLGIGAMYVRSLTVYLVRQGTLDDYVYLEHGAHYAIGALAVILLVTIQYEIHEVITGLVGVILIAWSFWSSVRRNKALAEAEGKATASDKTEVSSGV

SEQ ID NO: 13335 - protein, 244 aa, Streptomyces avermitilis
MSFWDDLWRGRSTEFDSGSAATNAIELTKRHQRVSLTKQGAATGNLRINLSWRMRTSDIGGPERGSLLRHPFRLFTPEVVQAHTQSMVNVDLDLGCMYELADGTKGVVQPLGGFFGELNDPPYIKLSGDDRFGSGSGETIFVNLDHRDDIKRLLIFVYIYDQTPAFDRTHAIVTLFPSNGPRIEIGLDERHPQARSCAVVLIENVKSELTVRREVKFVYGFQAELDRLYGWGLQWGRGYKSADR

SEQ ID NO: 13336 - protein, 308 aa, Streptomyces avermitilis
MTHAMLKGSNIPLDATAVRAVLRWTPGQGVPEVDASALLLGPDGRVRSDEDFVFYNQPRHPSGQVRLLGKKREAEALTDTIQTDLTGVESAVGQILLVASADDVTFDRVRSLRVLLYDAAAPDGEPLAYFDIKPQTGQETALICGELYRRGEGWKFRALGEGYLNGLQGLATDFGISVDESDPTAGSAPSGPKSAPAATAGAAPSAWSGPVSAAPEASVPLPPEQPAPMPQQSTYGYPPEPTQQPPAQPAYGYPQPAAAAPTTQPAYGYPQPQTAAAVPPAYGYPQAVGAAPDPDFRLPPQGPQFIGR

SEQ ID NO: 13337 - protein, 387 aa, Streptomyces avermitilis
MRHFGHIAPEERQRLFYREPAVFSADSPARVLAAALGATLYSPATRPQLADDVVKQAGRGVVSMVLCLEDSIDDADVVDAEENLVRQFTDLAGRSDVPLPLLFVRVRTPEQIPDLVRRLGPAVRVLSGFVLPKFTEERGVPFLEALTAAETASGRRLFAMPVLESPDLLHLESRRETLAGIFRTVDKFRERVLALRLGVTDFCSSYGLRRAPDMTAYDVQIVASVIADVVNVLGRADGTGFTVTGPVWEYFRLQERMFKPQLRRSPFTPEAEQLRDTLIEHDMDGLLREIALDRANGLLGKTCIHPSHVLPVHALSVVSHEEFSDAQDILRPERGGGGVLRSAYTNKMNEVKPHRAWAERTLQRAEVFGVANEDIGFVELLAAGLPD

SEQ ID NO: 13338 - protein, 822 aa, Streptomyces avermitilis
VRRRTDKESMNNVVWSGTWVAERLGVELVGDEKLSDLLGLALRRNPKRAHLLVSNVLGKHVPQSPSVVYGYGVALGRRVRELLGADEARTAVVLGYAETATGLGHSVADGVGLAPYLHSTRRSVAGVARAGGFEESHSHATSHLLLPEDPALLAGDGPLVLVDDEFSTGNTVLNTIRDLHERYPRGRYVVVALVDMRSPADLGRLDEFAREIGARVDLITAASGTVKLPEGVLEKGQELVARHERAVPAEPAPRDLGPVTRVALGWPRDLPDGGRHGFTPEHRARLDRALPAMAARLAEAIPGEARRILVLGFEELMYAPLRLAHELEQAVRGEVRYSTTTRSPVLAVDDPGYAIRSRIVFPAHDHPDDGPGERYAYNVAGAGFDAVVAVVDSAADTPALHAPDGLLAQLAAHTPSVLLAVVPSYVPGPSHGPERPPMLPEPLRGPAFSSYAPDEVGWLLQDLSDVTLEAPTEEREEAIQRGGAHYAESLPVEYQPSEQYQALFQAALDDSATRIAEAVGAVTEIVLAERSPRPVLVSLARAGTPVGVLMRRWAQHRHGLDLPHYAVSIVRGRGIDANALRWLADRHDPADVVFVDGWTGKGAITRELADAIREFEESDGISGFDPEIAVLADPGSCVRTYGTREDFLIPSACLNSTVSGLISRTVLRADLVGPHDFHGAKFYRELAGADVSVDFLDAVSARFAEAEDTVDARVKELLSADRAPTWEGWAAVERISEEYEIHDVNLVKPGVGETTRVLLRRVPWKILARAGAGADLDHVRLLAEQRGVPVEEVAELPYTCVGLIHPKYTRGATGADGKAVTV

SEQ ID NO: 13339 - protein, 272 aa, Streptomyces avermitilis
MARPTVLVASDLDRTLIYSAAALALTMPDARAPRLLCVEVHENKPLSYMTETAAGLLTELGDAAVFVPTTTRTRKQYQRINLPGPVPKYAICTNGGQLLVDGVPDPDWHDVVTGRLADECAPLDEVQAHLAETADPVWLRKQRVAEDLFVYLVVERELLPEAWVKELAVWAENRGWTVSLQGRKLYAVPKPLTKSAAMREVARRTGAGLTLAAGDSLLDADLLLAADRGWRPGHGELADAEWAAPAVAALSERGVLAGERILREFLRGVREG

SEQ ID NO: 13340 - protein, 75 aa, Streptomyces avermitilis
VRMPRYEYRCRTCGDTFELSRPMAESAAPAACPAGHDDTVKLLSTVAVGGSAPAPSPAPRAGGGGGGCCGGGCCG

SEQ ID NO: 13341 - protein, 226 aa, Streptomyces avermitilis
MATHTHGLRRGSQRSRRSRRTRRINLDEHLPVDHGLSKFYRVGAGLMGLVLLAFGVLGLINRIGFFNTHGDTVAGLNTNGALSALSICVGLLLFVGMVIGGNVASTLNMVLGILFILSGFVNLALLDTGFNFLAFHIQNVLFSFVVGVLLMFFGMYGRVGSALPHDNPYWRARHPEQVEREQRMRTSSVESLRRAHDVRQLATLREAEVRRRAKASGALRPPGDAG

SEQ ID NO: 13342 - protein, 474 aa, Streptomyces avermitilis
VTATPSQPYTPFAPRAHRPGGPLGPGGRSRRISSGAVRDVLTLVALPLVAALALPAAFAGGGTRRWFGGRAEGQRAEAQAAKDAAAAAFYELDTAQRDLRISIETITAVDDSPAARRAVSDFETLGRRIDEASHQYIEAVDAHDLDRVDLEAATASRARAELTAARDELGRVKQELDRFEQGLGPLLGKAETQLARLAPAVERARQALLAASNALDAVRESGLKADDLAARLAALAPELTKLNQGAGQHGVPGTLERAERVARNAEAVRAEAERLPERAAEIDHRLVSLRTRAQALTTRAGQVDPMLSELRRRFSAACWQDLQHVPEHTAENVRQAELKLKEAQAARDAQRWPDATSLLSTVRALLNNTDEAVSAAGDRLRRLNAVAKDPQQEIDRTRFAIRDAQRLAMAGRNTPDPRHARPLDDSVARLDRAIGTLEGRHPDYWHFLTELEAVRQSVARVVSQIREERGTGGP

SEQ ID NO: 13343 - protein, 266 aa, Streptomyces avermitilis
MAGTVRTRPARGTARIRRTRALAVTGVVAVLVATAAACGADATEDKDPEHRSFALPGRTLTVDSDDSALEVVSADVDKVEVTRWFRGSVMVGRDPRVTWTMKGNRLVLRMKCSGMVADCAAKHRIEVPRGVAVTVEDGDGSVRARGFKEALRVSTSDGSVRVTDSTGPLTLHTADGSISAAGVGSHRVEADSQDGSIHLELGVVPDLVKSRSQDGSISITLPHAAYRVTTGSDDGSVHVSVPRDETSSHVVDAHTKDGAVTVRTAG

SEQ ID NO: 13344 - protein, 142 aa, Streptomyces avermitilis
MRRLPSWLHTCGPLPSKASGRRIAKTAEHLAEYASAGRTGLVFVGARGGVLRRNNFRRIWLRALDATGLGDVHFHDLRHTGNTLAATGGATTRELMHRMGHSSVRAALIYQHLVNGRDHQIADYVDGQIRKVKRPPRGPSGT

SEQ ID NO: 13345 - protein, 106 aa, Streptomyces avermitilis
VAETYDFPSDLRAGQEELHQVRAELLALLKRLPWSVEQLDGFSDTNGWRKVERPASPDWTEDEQAEVEKLRQRERELAVFVTCHRFWAEIAPEKKVDARMKLKHAR

SEQ ID NO: 13346 - protein, 318 aa, Streptomyces avermitilis
VRRPRREDGGIMTNSELTVAVLGPGGVGGLLAALLARSGHRVICLAGDDTARALREHGIQVRSRQFGEFTARVEADTELREPVDAVLVAVKHTALEAALERVPAKALGDGAEAGLVVPLLNGVEHPAALRARYGGEHVAPAVIRVESTRVAPGVIEHSSPFAEVDLTGASVPRERLDRLAGALESAGLRVRVSADGNDEAATLWAKMSFLTPFALLTTRYGVPLGEVRTHHREELVALTEEITAVSRACGSPADAAAALARYDAFPPETRSSMQRDAEAGRPLELDAIGGALLRAAEQHGVAVPVAARLIREVGDGVR

SEQ ID NO: 13347 - protein, 136 aa, Streptomyces avermitilis
VTAVPALHGPEGSEPIVGEVTGFVLSGEGLPTVYVSGDNASLDVVRAIAGRLGPFDVAVLFAGAARTPLVPDAPLTLTSEAAARAAEILGARHVVPLHFEHWGHFTQDGATLTKAFAQAGLTERLHLLEPGGSVRL

SEQ ID NO: 13348 - protein, 87 aa, Streptomyces avermitilis
VQSMTTVEILYVGGPTAVVELGGVRLLTDPTFDAPGEYPVGSRKLVKTAGPALPPTDLAPVDAVLLSHDQHPDNLDGAGRAYLTEAP

SEQ ID NO: 13349 - protein, 84 aa, Streptomyces avermitilis
MCRSIKTLRPPVLPEEATEEEIRAAALQYVRKVSGFRAPAAHNREVFEHAVEAIAVATADLLGGLEVRGGARTPAATPATPGGA

SEQ ID NO: 13350 - protein, 203 aa, Streptomyces avermitilis
VLESVGSLTGSPWIYAVVAASVLLDVFLPVLPSGVLVITAATAAAAGSATKAVPHDAPDILALTLCAVTASVAGDLVAYRLAWRGGDRLDRAIARSRRLSSAQERLGAALSRGGGTLVVLARFAPAGRSVVSLGAGAAHRRVREFLPWSVLASVSWAVYSVALGYFGGQWLGATWLATGVSVAALFGAGAGAAYFMRRPALQE

SEQ ID NO: 13351 - protein, 151 aa, Streptomyces avermitilis
MTGRLNSAQPFAIGLFRIVVGLLFACHGAASLFGVLGGAMGSNGGTIPAGTWPGWYAAVIQLVGGSLVALGLGTRAAAFISSGSMAYAYFDVHQSAALWPIQNGGELSALFSWSFLLLVFTGSGAFGLDRLLAGRSAAAEESKPASEPVAA

SEQ ID NO: 13352 - protein, 664 aa, Streptomyces avermitilis
LRPTRPGVTLLSSATVSSVPVSVALVGAGPRGTSVLERLCASAPELLAPGVRLTVHVVDPAPPGPGRVWRTAQSPELLMNTVACQVTLFTDESVECAGPIRPGPSLYEWASGGGIGAGVGVGEELGPDDYPTRAQYGRYLEWVFAEAVRGAPPAVRVEVHPARAVRLDDAPDGRQTLTLATGRTLEGLAAVVLAQGHLPTVADPAARRLAAQAARHGLRHIPPANPADVDLSPLAPGEPVLLRGLGLNFFDHMALLTTARGGRYERTARGLVYRPSGREPKLYAGSRRGIPYQARGDNAKGPYGRHRPLLLTDEVMARFRKRADSGEAPDFLAEIWPLVAKEVETVYYECLLNRRDRLPEHPASPPDRPAFRDRFLAAALGSPEESAVLDEFGVRGADRWSWDRISRPYTGHTFDGPAAWRSWLLARLREDAEQAALGNVEGPLKAALDVLRDLRNELRLIVDHGGLSGASRRDHLDRWYTPLNAFLSIGPPRRRIEEMTALIEAGVLDVLGPRLEVRAEDGAWVARSPDVPGSAVRAITLVEARLPEPDLRRTADELLAGLLKTGRCRPHTVDGYETGGLDVTPRPYRLIDRQGAVHARRFAFGVPTEGVHWVTAAGARPGVDSVTLSDADAMARAVLRAAASVAGPETEPDPWLNVELASID

SEQ ID NO: 13353 - protein, 544 aa, Streptomyces avermitilis
MAGLRLGPLLRYIDDSSATVWVEASRPCTAEVRCPGGAGGTARTFQIAGHHYAIVPVSGLAPATDTSYEVLLDGTPVWPLPDSPFPPSVIRTPDGGTVRVAFGSCRWAAPAEDEKDTVGPDALDTLATRIAAAPEGERPDVLLLLGDQVYADETSQATQHWLAARRDLAEPPWKQVADYEEYTHLYDESWLDPEIRWLLSTVPSCMIFDDHDIVDDWNTSAAWLAEMRATPWWRERLMGGLMSYWVYQHLGNLSPAELADDPLYAAVRATPDGTDVLRAYSAQADADPASVRWSYRRDFGRVRVLMLDTRAARVLDEQNRSMLDPGEARWLREQACADPGSYDHLLIGTSLPWLLPHLVHDAETWNAALCRGNRGARWTRFGERLRRRADLEHWAAFPESFEALAAVIAEVGAGADAPATVCVLSGDVHHAYVAEPTWPGPGPDARVLQLTCSPVHNSVPLSIRLGFRFGWSGLGRILGRRLVRHGRWEHTALGWRKTGGPWFGNQLMMLTLRGRSASLRLEQARADRNGGARLDAVTESVLTE

SEQ ID NO: 13354 - protein, 214 aa, Streptomyces avermitilis
MPKVYARRRLSILAAFTGLIALAGIFNGPAASAALPTPVSAATARTYLASLTVATENRTGYDRDLFPTWITISGTCNTREYVLKRDGSNVVTNSACTATSGSWYSVYDGATWTAASDLDIDHLVPLAEAWDSGASAWTTAQRQGFANDVTRPQLIAVTDNVNQSKSDQDPAEWMPPLSSYTCTYVRAWVQVKYYYNLSVDSAEKSKLSSVLSGC

SEQ ID NO: 13355 - protein, 193 aa, Streptomyces avermitilis
LISFSVMALVFGVVFLAELPDKTALAGLVLGTRYRASYVFAGVAAAFALHVALAVAAGSVLTLLPQQIVHALTGVLFLGGAAVLLMKKGEGEEEIRKPENQSFWKVSSAGFMLILVAEFGDLTQIMTANLAARYDDPLSVGLGAVLALWAVAGLGIVGGRALMKRVPLRLITKVAALLMLALGAWSLYEAVAG

SEQ ID NO: 13356 - protein, 220 aa, Streptomyces avermitilis
MPAAATVLTARALLLDMDGTLVNSDAVVERCWRRWADRHGLDADEVMKVVHGRQGYASMAVLLPDRPMEQNFADNARMLAEETADMDGVVEIPGAFAFLASLAGLPHALVTSADVGLSTARMAAAGLELPDVRVTAESVGASKPDPEGFLKGAAELGVAPEDCVVFEDSGAGIEAGRSAGMRVVGVGPRAAAHRPDVVVRDLTQVRVESATDGTIRLHVG

SEQ ID NO: 13357 - protein, 334 aa, Streptomyces avermitilis
VSGSNGHACPECGAPRQPNGTPSCGCTRRASDALRDARTAQAAAAEDFDPLRIRPYVELGGAAAGAKPAGPSDETVPMVAVPAEAGASGAGLFPEGDVPDGDFPVGDFPEGAAEPGYGSSGPGAPVPPARDEPPLRRRRTVLLASGGVLAAVVAAAGLAGGFFSYDAPQRDGALPDDVRASVPEASSTAASVSAAGSESAARPSAGSASPSPSASSSPSASASSRAPSRSGPATPSGTPTTARATGSVRPTSGNDRDQPASPVLQRGDKGPEVTELQLRLSQLLLYTGNADGTYSSQVETSVRNYQLARGITTDDQGVYGAATRASLESETSEP

SEQ ID NO: 13358 - protein, 695 aa, Streptomyces avermitilis
MTGDAQGTPGERQHAAATAVRRRPAPDGVPGSVLVPIGALLLGLLLAALDQTIVSTALPTIVSDLGGLEHLSWVVTAYLLASTAATPLWGKLGDQYGRKKLFQTAIVLFLIGSALCGMARNMPELIAFRAVQGLGGGGLIVLSMAIVGDIVPPRERGKYQGLFGAVFGATSVLGPLLGGLFTEHLSWRWVFYVNLPVGVAALAVIATALHIPKRSARHVIDYLGTFLIASVATCLVLVASLGGTTWGWSSPQIIGLAVLGVVLVAAFVAAERRAAEPVLPLKLFRVRTFTLAAVISFIVGFAMFGAMTYLPTFLQVVQGVTPTMSGVHMLPMVAGMLISSTASGQIVSRTGRWKVFPVTGTGVTALGLLLLHQLDEHSSTGRMSVYFFVFGLGLGLVMQVLVLIVQNAVSYEDLGVATSGATFFRSIGASFGVAIFGSVFASRLGDKLTAALSGRPLPAGITPDTLKSDPRGIANLPSSLRPSVLQAFAASITDVFLYAAPVALLGFVLAWFLHEDRLRGSVTAPDVTETLASNPVERSSYDEVCRALSLLGSREGQSAIYEKITARAGYDLLPAASWLLLRIKKYGWAEPAQLAEDSSVPLTVVLDAARQIEERHLVLREGLDLVLTEGGREVAGKLSEARAESLAELLGDWWGPDRPTDLTSLVEELNTELCGSDAERPRAEGTTSRPYGGPA

SEQ ID NO: 13359 - protein, 180 aa, Streptomyces avermitilis
MMRTTPGWTVAPEPFDSPVAAALWRAYYTEVSDRWYQLHEGHATDPAELEREIAADPGAYLAPPDGVLLVARYEGEPVGTAGVRLLAANTAELKRVFLLKETRGRGGAAPLVAAAEDAARALGAERIVLDTRGDLVEARALYARLGYAETEPHNDEIYADHWFGKSLVQAGQAGQAGQAG

SEQ ID NO: 13360 - protein, 244 aa, Streptomyces avermitilis
MSTGVIIALIVIVAAVVVVAAALLLRARRPQGGRSLQRRFGPEYDRTLARHDGDAKAAERDLAERVRRHGSLETRPLEPAAREQYAARWTAAQERFVDSPRDAVAEADQLLAELAGERGFPDGGRYEEQLEALSVHHAHHVHGYRRVHRFAQADTAGAPENGAGTEEMREAMIEARALFEDLVSTNGHRAGIGAKTEQSQTGTKSATDTRAVEGASAPAHTDRTAAGGRTNLSWAFNRRHAKGS

SEQ ID NO: 13361 - protein, 256 aa, Streptomyces avermitilis
VTPDEGAVRREPTRIDEAKAGPGRGREARDLRDTRETRTSGIAPTHGDGFGDGVGGAEGRPAGSPRDTGRQADGPGAGSRAAGAGTGSAKPGIPQAQSPQPENLRTGIPQEQAPQPKSLRTKIPQSDLPQSDRSQSDRPRSDRLHSDGSHPQHPGATAHEAPFLPHDECDKLSLRLHHAVAGFVDEPRAAVEEADHVLEEVAARFADAVARQRRTLRTSWSAAGESGSGGHPTVDTEQLRLTLRDYREMTERLLHM

SEQ ID NO: 13362 - protein, 137 aa, Streptomyces avermitilis
MTERKPPGVSFESFVDKQIRDAEARGEFAHLPGAGKPSPAVTGTSYDELWWIKQKMAREGLAVLPPTLALRKEAEDTLAAAAGAPSERVVRRLLEEINVKIRDMMFKPPPGPPLGLKPYDVEEIVREWRERRAGQTP

SEQ ID NO: 13363 - protein, 153 aa, Streptomyces avermitilis
MRRRGADHGATAAGHPVLEGAHVLELTMASVSGADAGATAGMLMADAPSEPGAVLRVGRDKAVCRLATPDDWLFVSRVHLEFLCGPDGTWQVTWLRGSHAEPSSEVVLTLAGLQPQPLPYGGTAKLPGGGSGELVVQDRSEPRSVNVGFYHDA

SEQ ID NO: 13364 - protein, 224 aa, Streptomyces avermitilis
MSESQQLWDDVDDYFTTLLAPEDEALTAALRDSDAAGLPHINVAPNQGKLLQLLAEIQGARRILEIGTLGGYSTIWLGRALPRDGRLISFEYDAKHAEVARRNLARAGLDGISEVRVGPALESLPKLADERPEPFDLVFIDADKVNNPHYVEWALKLTRPGSLIVVDNVVRGGGVTDAGSTDPSVRGTRSALELIAEHPKLSGTAVQTVGSKGYDGFALARVLP

SEQ ID NO: 13365 - protein, 398 aa, Streptomyces avermitilis
VPSETLSDSTTEGSRGMWDFVRGVVRGRVLVVVLALSAFQLGSLLAPAYACGCGAMVPDGRQYVTVNREVSAVRWDDGREQIAMSLTVSGDARRAAWIMPVPHRATVRLGDRALFDQLAEATAPEYRTRHYFWPRDGDWPFDKSDNAAAAPGAGAAAPPVGVVDRERLGPFDVARLTATDPGALGTWLTDNGFHLPDRLDRALRPYVDQGWEYVAVRLAPKSADAALGGTLDPLRLTFASDRPVYPMRLSRLARTPQSLRLYILAAHRTEPRSAIGGDRPRVWFAGRVTAASGPLAGLTEGGTDFLTTVDQEFPRPSRISGDHELRRTAADTTRRQIIYRDELLTAGGIPVWQLTVAGALAVAVMVLLVLLRSRRRRPVPPPPPVMPPPPAHAPPPIG

SEQ ID NO: 13366 - protein, 490 aa, Streptomyces avermitilis
MVAFRLTSGERPPVRPSGPVPVPDERQASGVLTLAPAAPVAPPVPSTTDVTVTDPALVKRAVKAAALGNAMEWFDFGVYSYIAVTLGKVFFPSGNPTAQLLSTFGAFAAAFLVRPLGGMVFGPLGDRIGRQKVLALTMIMMAAGTFAIGLIPSYATIGVGAPLLLLLARLVQGFSTGGEYAGASTFIAEYSPDKKRGFFGSWLEFGTLAGYIGGAGLVTLMTALLSSGDLLSWGWRIPFLIAGPMGIIGLYLRMRLEETPAFAAELAKASKKEQDRPKVPLRAMLSGQWRALLLCMGLVLVFNVTDYMLLSYMPSYLTSELKYDETHGLLVVLGVMALMMIVQPFAGALTDRIGRRPVIAAGCVGFLFLSVPAILLIRQGSLLAVALGMGALGLLLVCFTSAMPAALPALFPTKVRYGSLSIGFNVSVSLFGGTTPLVVTALIGATGNMMMPAYYMMAAAVIGGAAVWFMAESAGRPLPGSAPSVEPAER

SEQ ID NO: 13367 - protein, 301 aa, Streptomyces avermitilis
VGLWLIAAVLAMRQVAVVLGTPRGERLTELETWVGPDGVLHVKGSLYDSTQFTGTPFGGLVLKPLTKAAEQALGWGWAFGTLLLVVALGLVAARALPQPVTRRTSLLAAPVAISLLMLSLSVRNTLYLGQTSVIPVLLVLLGCFTVRGERASGVLIGVGAALQPTVLLFAPLLWFTGRSRAAVSTGGTFAACTALAWAALPHDSYTYWVHHVAGVGLGGNADDLANQSLHGALLRLGLEGPLEIGLFLLLGAVVAVLGLRRAVHCAADGQLLLAVAITGCVAVAVSPTTWQHRARPGHCVR

SEQ ID NO: 13368 - protein, 414 aa, Streptomyces avermitilis
MPCPALPDGFDLTDPDLLHQRVPLPEFAELRRTAPVHWVPQQHGLAGFQDDGYWAVTRHADVKYVSTHPELFSSYLNTAIIRFHETMQREQIDAQRLFMLNMDPPEHTRVRQIVQRGFTPRAIRALEDTLRRRARSIVETALADAGPDGSFDFVTQVACELPLQAIAELIGIPQDDRAKIFDWSNKMIAYDDPEYAITEEVGAESATELIAYAMNMAADRKQCPAKDIVSTLVAAEDVGNLASDEFGFFVLMLAVAGNETTRNAITHGMHAFLTHPDQWDLYKRERPATAAEEIVRWATPVVSFQRTATQDTELGGKQIRKGDRVGIFYSSANHDPEVFEHPDVFDITRDPNPHLGFGGGGPHFCLGKSLAVVEIDLIFGAIADVMPGLRLTGDPRRLRSAWLNGVKGLQVSAG

SEQ ID NO: 13369 - protein, 389 aa, Streptomyces avermitilis
MAAEPVIVEAVRTPIGKRGGALAHLHPAYLLGETYRELLGRTGIHADCVEQIVGGTVTHAGEQSMNPARTAWLTMGLPYETAATTVDCQCGSSQQASHMVANMVAAGVIDVGISCGVEAMSRVPLGSGSKHGPGKPFPDEWNVDLPNQFEAAERIARNRGLTRENVDSLGLISQERAGAAWSEERFKRETFAVQVPTTEEEQRAGQGMWRLVDRDEGLRDTSMEALAGLKPVMPTAVHTAGNSSQISDGAAAIMWASKRMARALKLRPRARIVAQALVGADPHFHLDGPIDATRAVLGKAGMSLKDIDLVEINEAFASVVLSWAQVFEQDLGKVNVNGGAIALGHPVGATGARLITTALHELERRDKEFALITMCAGGALATGTIIQRL

SEQ ID NO: 13370 - protein, 246 aa, Streptomyces avermitilis
VDLSAPCPSPPTGGSMSAESTETQPHDPEARGLRLVTVLLGLTVVSGLIDAVSYLGLGHVFTANMTGNVVVLGFAAAGAPGFSVPHTLTSLVSFLVGAVAGGRVAVRFGGGSRRAWARGTLAVEAVLVGAASAVAFAAPGATGTKYTLIALTAFAMGLRNATVRKLGVPDLTTTVLTMTLTGLASDSRVAGGGAHPRSPRRTASVVAMFAGALLGAWLVIHHGLGIPLVIAAVMAGVFALTASGRE

SEQ ID NO: 13371 - protein, 416 aa, Streptomyces avermitilis
MRDDTRKTHETRTSWRTRRGLAGGAALLLTGIAVAPVAAAGERSAPGTRRGALVSVTPVADRDAGEVRAFLAGRDIATDSVRYGVRAYRLTYRTVDPYGKPTTATGLLTLPAGGGHRLDLVSDTHGTMVNRGYAPSAGDDFGRVPSYLNAGAGRAVAAPDYLGLGEGPGRHPYMDTRSSVTASVDMLRASRTAARQLGRPLTGDVYATGFSQGGQVAMALGRALRQGADHTFRLKALAPISGPYDLEGQEIPALYDGRVNDVSGVFYTSYWLVAQNRLHSIYQDPAEVFRAPYASRVEGLYDGTHEEEEIVTALPRSVKELLTPAFYERMRHPTGGLLAAMRVNDHTCDWKPDVPVRLYTGTGDTDVPIGNTHSCVAQLAERGKRARLVNQGDVDHFGVFKESAPQVVRWFDAVRD

SEQ ID NO: 13372 - protein, 153 aa, Streptomyces avermitilis
VGKRATPCSRRKALRVTVSVIRRIASPKKALAGFAVAAATTGMVFAAAPAQAATPTSGSSAQAVAHKMIPDAAQYNAFSKIVEHESGWNPAATNSSSGAYGLVQALPASKMASAGADWKTNPATQIKWGLDYMNSRYGSPTAAWSFWQANGWY

SEQ ID NO: 13373 - protein, 321 aa, Streptomyces avermitilis
MNRHPAEPLPQAHSQAHSQPRPQPRPQIQSRPIRLGPRSIAALALVSAVGVAGFGWPLVAGPGSQLSAHAQDAPWLFAGLLVLLVGVVTATISESGLGPKAVAMLGVLAATGAALRPIGAGTAGIEPMFFLMVLSGRVLGPGFGFVLGAITMFASALLTGGVGPWMPFQMLSMGWFAMGAGLLPGPMGVPPARAKPRAWGRLRGRGEVGMLAAYGFVAAFAYGTVMNLAGWPFMDSLASTVAFDPHDGLGGNLARFLAYCLATSLGWDLGRAVVTVVLTLALGPTLLKALRRATRRAAFESPVTFEPGRSAAPVTPDDRTP

SEQ ID NO: 13374 - protein, 561 aa, Streptomyces avermitilis
MIRFEDVSVTYDGAAEPTVRGVDFTVPEGELVLLVGPSGVGKSTVLGAVSGLVPHFTGGTLRGRVTVAGRDTRTHKPRELADVVGTVGQDPLSHFVTDTVEDELAYGMESLGIAPDVMRRRVEETLDLLGLAELRDRPISTLSGGQQQRVAIGSVLTPHPKVLVLDEPTSALDPAAAEEVLAVLQRLVHDLGTTVLMAEHRLERVVQYADRVALLPAPGAPLTLGTPPEVMAASPVYPPVVDLGRLAGWSPLPLTVRDARRRAGALRERLAATETPTPTATATATAAPAPSPSRPRRPRLLRKRAPVPSAALPVAAVEALAVRRGRVEALRRVDLTASPGEIIALMGRNGAGKSTLLGALVGLVPPAGGSVRVGGAVPHRTAPRDLVRRVGLVPQEPRDLLYADTVAAECVAADGDAGAEPGTCRALVSELLPGVADGTHPRDLSEGQRLALALAVVLTARPPLLLLDEPTRGLDYAAKGRLVTLLRALAADGHAIVLATHDVELAAELAHRVVILAAGEVVADGPTAEVVVASPSFAPQVTKILAPQHWLTVTQVREALA

SEQ ID NO: 13375 - protein, 381 aa, Streptomyces avermitilis
VGTMTAATAADRRRARRDRWAQPTANRTNALHPGAWWLWALGLGTAASRTTNPLLLALLVAVSAYVVAARRTSAPWARSYNAFVRLALAVLGIRLGFAVFLGSPIPGTHTVVVLPEVPLPHWAQGIRVGGRVTAEGLVFALYDGLKLATLLICVGAANTLANPARLLKSLPGALYEAGVAVVVALTFAPNLIADAQRLRAARRLRGRPDRGLRGLLHVGLPVLEGALERSVALAAAMDARGYGRSAEVPPAVRRTTAALTLGGLVGVCAGTYGLLTAEGGGYGLPVLGAGLAAALGGLWLGGRRSLRTRYRPDVWGVRAWLVAGCGVAVAALLIVSAAYDPAALHPGVVPLTAPALPLLPAAAILLGLLPAFVSPAPKESA

SEQ ID NO: 13376 - protein, 224 aa, Streptomyces avermitilis
VSLRGTSALVLAVLLLVLGDAGRAGATGYRYWSFWDRVGGSWTYATQGPSTARPSDGDVQGFRFSVSADSQDSAKPRGTAGFAVICARTPAREGRKRVALVLDFGTRADAPRGETPSAPRTACARIPDDATTADALAAVARPLRYDTNALLCAIAGYPRTGCGEQVTTPKEPTAKEPTATSDEPTATSDKNAPRPGPSVGLLAGVAAVALLGAAAIWRARRRRG

SEQ ID NO: 13377 - protein, 425 aa, Streptomyces avermitilis
MIVRRSAAVLALTAVIGGATAPVALADDASPSASPSRAFPSALYGSTDPTYDGVWRQSLALLAQHTVGVRPAAKAVDWLTGQQCASGAFAPYRADASAKCDAKTMVDTNSTAAAVQALAALGGHDAEVGQAVRWLKDVQNKDGGWGYTAGGASDANSTSVVIGALAAAGDEPKKQVKNGKSPYDALLALSVPCDKTGGGAFAFQPDKKGALAANADATAAGVVGSLGKGFVIEAAGKASKGSGESKASGQSKGSECASGDSFTPADAAHNGASYLAASLAKAPYLKSAMPGAKPQPDYGNTADAVVALAAAGSTSATAGPLAWLEKNSGVWAAKAGPAAYAQLIFAARAAGAQPRDFGGVDLVEKLGATGPAAQAPSRDSAASEPDAKKVDHKSAFNVWWLVGVCLVAGIGIGFLLSRRNKRQQL

SEQ ID NO: 13378 - protein, 372 aa, Streptomyces avermitilis
VRTGRGTERSTRAPIETCSSYSDRNAAIGEPMAQVSDHGGGVRSIKVPIPDNPLGHTLVYVVDTDRGPVLIDTGWDDPASWDTLTEGLTACGTSAAEIHGVVITHHHPDHHGLSGRVREMSGAWIAMHAADTAVVRRTREARPERWFSYMTAKLMAAGAPEAHVAPLRAARPRALPGLSPALPDREIVPGDLVGLPGRRLRAIWTPGHTPGHVCLHLEEEHPAQLPGHGRLFSGDHLLPRITPHIGLYEDPDDTTVTDPLGDYLDSLERVGRLGPAEVLPAHQHAFTDAPARVRELLTHHEERLTGLLTLLDTPLTPWQLAERMEWNRPWEHIPHGSRNIAVSEAEAHVRRLVKLGRAEAVPGSDPVTYVAV

SEQ ID NO: 13379 - protein, 502 aa, Streptomyces avermitilis
VRPGRQSAMTELVEHGQLFIGGVLADPLGKDVIEVISPHTEEVIGRVPHASTADVDRAVAVARKAFDEGPWPRATLDERIEVVTRIKDAIAVRHEEIARVISSENGSPYSWSVLAQALGAMMVWDAAITVARNFTYEETRDGVLGKIVVRREPVGVVAAVVPWNVPQFVAAAKLAPALLTGCTVVLKPSPESPLDAYLLGEIAREAGLPEGVLSILPADREVSEYLVGHPGIDKVSFTGSVAAGRRVMEVASRNLTRVTLELGGKSAAVVLPDADITTSVPGIVSAAWMNNGQACVAQTRILVPRSRYDEFADAFAAAASALVVGDPLDPATQVGPLVARRQQRRNLDYIRIGQEEGAKILTGGGRPPGLDRGWYVEPTLFGDVDNSMRIAREEIFGPVICLLPYGDETEAVKIANDSDYGLSGSVWTADVEHGIDVARRVRTGTYSVNTFSLDMLGPFGGYKNSGLGREFGPEGYGEFLEHKMIHLPAGYEAPTGVEGAGA

SEQ ID NO: 13380 - protein, 77 aa, Streptomyces avermitilis
MGDRWHIEVDRSVCIGSAQCVHHASVAFRLDSARQSRPAEPETDANEQILAAAESCPVEAIVIRVLGSGEPVFPPEE

SEQ ID NO: 13381 - protein, 218 aa, Streptomyces avermitilis
MPAEAKVEASTGARAARPAVQPASPPLTERQEARRRRILHASAQLASRGGFDAVQMREVAESSQVALGTLYRYFPSKVHLLVATMQAQLEHMHGTLRKKPPAGDTAAERVAETLMRAFRALQREPHLADAMVRALTFADRSVSPEVDQVSRQTTVIILDAMGLDDPTPEQLSAVRVIEHTWHSALITWLSGRASIAQVKIDIETVCRLIDLTEADETP

SEQ ID NO: 13382 - protein, 491 aa, Streptomyces avermitilis
VTAEAMEAGPQEGSAADGDVPLRIALLTYKGNPFCGGQGVYVRHLSRELARLGHRVEVIGSQPYPVLDEGLPGLSLTELPSLDLYRQPDPFRTPGRGEYRDWIDALEVGTMWTGGFPEPLTFSLRARRELRARRGDFDVVHDNQTLGYGLLGDVGAPLVTTIHHPITVDRQLELDAAEGWQRKASVRRWYAFTRMQKRVARRLPSVLTVSGTSRQEIVDHLGVSQDHVHVVHIGADTDLFSPDPAVPQVPGRIVTTSSADVPLKGLVFLIEALAKVRTEHPGAHLVVVGKRAEDGPVAQAIERYGLHGAVEFVKGISDAELVALVRSAEVACVPSLYEGFSLPAAEAMATGTPLVATTGGAIPEVAGPDGETCLAVPPGDAGALAAGLSRLLGDPALRTRLGSAGRERVLARFTWAKAAEGTAAHYREAIARSTAPAGAGRTAVAVGTATAAGPVKAAGAMKAAGAGTADGAAAEEAEEIVVSDRESRATC

SEQ ID NO: 13383 - protein, 248 aa, Streptomyces avermitilis
VLTVDFSRFPLAPGDRVLDLGCGAGRHAFECYRRGAQVVALDQNAEEIREVAKWFAAMKEAGEAPAGATATAMEGDALALPFPDASFDVVIISEVMEHIPDDKGVLAEMVRVLKPGGRIAITVPRYGPEKVCWTLSDAYHEVEGGHIRIYKADELLAKIREAGLKPYGTHHAHALHSPYWWLKCAFGVDNDKALPVRAYHKLLVWDIMKKPLATRVAEQALNPLIGKSFVAYATKPHLPVDAAAVDAS

SEQ ID NO: 13384 - protein, 356 aa, Streptomyces avermitilis
VTTPRTEHLVLPGVLTAEEAGATVRGILGVQRPDGAIPWFRGHHLDPWDHTEAAMALDAAGEHEAAERAYTWLAAHQNGDGSWYAAYADGDFEDVTDRSRETNFCAYVAVGVWHHYLATGDDTFLDRMWPTVYAAVEFVLRLQQPGGQIGWKREDDGKAVDDALLTGSSSIHQALRCALAIAEQREEPQPDWELAVGALRHAIRRHPERFLNKDRYSMDWYYPVLGGALTGAEAKSRVEEGWERFVVPGLGVRCVVPNPWVTGGESAELALALWVMGESDRALEILQSIQHLRDPETGLYWTGYVFEDEAIWPRELTSWTAGSLLLAVAALGGDEATCAVFSGDRLPRGLDPDCCE

SEQ ID NO: 13385 - protein, 97 aa, Streptomyces avermitilis
MSPRYRNGSNQAGTVIAIVADVMAVILGLWILMYLLDANRANDLVQFVHDVASWLAGWSRDLFTFDKAWARVVAGYGLAAVVYLFIGHAIANRMHRH

SEQ ID NO: 13386 - protein, 186 aa, Streptomyces avermitilis
VPVPIRRLIVALTLCCTLFVGATACGSDSTDQQTSAAAATATPTGTSSAEKQKFAKTRFVANAGLAAGATYQWIVKPWKAGKFKKGAKGRKVALVKAGLAGGFSYNRLKAALKNAQGDPTLAKAVAPLTAGIEALKSLPAKLRKGDSTDAAANTYDDIINKVKDAGKSAGAEVKDQVPSASELTKG

SEQ ID NO: 13387 - protein, 216 aa, Streptomyces avermitilis
MSAAPKPEILAAFEAAKGFMPRHEGLALYAAATEAGRLGLPLLEVGTYCGRSTILLADAARAAGVTALTVDHHRGSEEQQPGWDYHDPDTVDPALGLMDTLPAFRRTLHTAGLEDHVVALVGRSPQIAKIWGTPLGFVFIDGGHTDAHASADYEGWAPHVADGGLLLIHDVFPDPKDEFTGQAPYRVYLRALESGAFTEVSATDSLRVLRRTGAGI

SEQ ID NO: 13388 - protein, 332 aa, Streptomyces avermitilis
VSYVGPDFDPPQPRRFRRAPLTVALAALVPGALLGWLVYEAVGAPGGGDGSDKAAGGTTSASASKKSSASSSSAGGSGSPAASATDDGEKPGTSSSTPASPTSGPAASGPLRGKVVVIDPGHNSGNFQHTADINRKVNIGTNWKECDTTGTSTNAGYTEARFTLDVARRLRTILQKEGATVKFTQDGDRSWGPCVDERARIGNRAHADAVVSIHADGSAAGNRGFHVILPGAVHGGAADTRPIVASSRDLGERIAGNFVRVTGSAPSNYVGDGTGLVTREDLGGLNLSTVPKVFIECANMRDGKDAARVTSDAWRQKAAQGISDGIVNFLQP

SEQ ID NO: 13389 - protein, 211 aa, Streptomyces avermitilis
VQPVRREPPTAGCGSPGHSGEPRPGPMGKRTPLSYRWLYLKQTPIGLYAFFPVWKVIQLPPVVPWTSNFLPEYFAYAFRVPYLPRGTSLEPLTVILRDFVTSQPTPTLMAPLVASICFESVVLTASVWSMRSIIAPRPEASASGVFPHEVPMDRTLISLSASQPPPIFDTCASAVVAAASRGAACTVAFTPIRPRVIAATAAPRRIVWNFN

SEQ ID NO: 13390 - protein, 265 aa, Streptomyces avermitilis
VNIRSLTRGDGVVIGAAVLLFIASFLDVADCSGSYCGSADFPNAWSSSLGLGLGTYMIGVVGAALILIPRALPQPRKVAGLDMGTVGVALTVASAWSLLWWTIDANGAGAGLILGMIAALILAGAAIATPLVPALKTALVGAPRPVAPQPYGAQPPSGYGYPGAQQPGQPYGGQPQPQPGQPFGGQPQAPQQAQAAQPAGDFSPFWFAVPVARPLYAEDGSPTPIAELAPGTWYLAVEQRGAALVAQTQDGRRGVLQDASGIQRG

SEQ ID NO: 13391 - protein, 336 aa, Streptomyces avermitilis
MRLGLALGYWGRGPDPSHLPLAREAERLGYHSVWTAESWGSDAFTPLTWIAAHTSRIRLGTAVAQMAARSPTTTAMHALTLDHLSGGRMMLGLGLSGPQVVEGWYGRPFPRSPLTATREYVDVVRQVLRREAPVALDGRCHPLPYRGEDGTGLGRGLKPITHPLRADLPVLLGAEGPKNIAQTARIADGWLPLYWSPTRTEAYEAALADRREGFLVAPMARARVCDDVTEGLLPVKAMLGFYIGGMGHAARNFHADLMARMGYEEEARRIQELFLAGRREDAVRAVPDAFADEISLVGPRERIAERLESWRKGPVTDLLVLAPDPHTLRVLAELNA

SEQ ID NO: 13392 - protein, 583 aa, Streptomyces avermitilis
MTHTSTDQPARRATGALVPVLAFAGIVVAVMQTLLVPVIKDLPTLLSTSPSNATWVLTSTLLSGAVATPIMGRLGDLFGKRRMLFTSLAVMVAGALVSALTSTLLPMIVGRTLQGFAMGAIPLGIGLMRDMLPREKLGSAMALMSSSIGVGGGLALPAAALVAQHTDWHALFYGAAGLGVVSIVLTFLVVPESPMRAEGSFDYLGALGLSVGLVLFLLPITKGSDWGWSSATTLGLFGAAVAVLLLWGLMELKVAAPLVDLRTTARPAVLFTNLASIMVGVSFYVVSLVLPQLLQLPAATGYGLGQSMVVAGLCVAPLGLTMMFTAPVYARISAKYGPKVTLIIGMVIIAVGYGGGLGLMNAAWQTIVISVVLGAGIGLAYSSLPALIVGAVPASETGAANGLNTLMRSIGTSVSSAVIGMVLANTAHHVGDVAVPTMHGFRVSFLIATGAVAVGLVLALFLPRQRQATKPQLRASSEEDAALERAAEVLGGFRGRVLNAGGDPVARAKVTLIDRRGRQAGATLSAEDGSYALAVPAQGAYVLAAKAAGHGPLASSATHAGDDRPVDVDLSLPGADRNSGVPA

SEQ ID NO: 13393 - protein, 412 aa, Streptomyces avermitilis
MERVLIFRGMKAYIAGVGMTRFEKPETRDWQYWDMVREAGGKALGDAGIAYTEVEQVPVGYCFQASTAGQRAAYELGLTGVPVYNVNNNCATGSTALMLARQFVEGGISDCVLALGFEKMTRGSLGSGADGGDFRSSPVARHYGVMAARHGFEATPPTAQIFGDAAREHMEKYGTTEAQLAAVGAKNHRHSAHNPYAQFQDVYTVDEILASRPVHRPLTKLQCSPTSDGAAAAVVVSERFAQRHGLGDRVVEIVAQAMTTDTEESFASGSCIDVVGRPMSREAARRVYERAGLGIEDVDVVELHDCFSINELLTYEALGMCVAGESGKLVESGATTYGGRWVVNPSGGLISKGHPLGATGIAQIAELTWQLRGEAGARQVPGARVGLAHNIGLGGAAVVTLLRADRPVALGA

SEQ ID NO: 13394 - protein, 484 aa, Streptomyces avermitilis
MTSMLRAAATEDSRTTTSRAAPPAWVVVALACAGQFLVVLDVSVVNVALPSMRADLGLSAPGLQWVVNAYAIAFAGFMLLGGRAGDLYGRNRTFLAGLALFTLASLGGGLAQEGWQLLVARAVQGLGAAVLAPATLTLVTSAVPEGAARARAIATWTAVGAGGGAAGGLVGGLLVDGLTWRWVLLINVPVGAVVLAGAARWLPESRARDGRRLDLPGALLVTAGLATLAYGIVQTEAEGWTAAATLVPLCAGLALIGLFLAVEARTKEPLMPLKLLGRRPVASANVAMFVNGSAMFCMWFFMTLYAQNVLGYTPLGAGLALVPSSLAVLLGAKLAPRLMPVVGPRNVAALGTLVAAAGFGWQSTMTADGTYATAIMFPGILMMLGGGLGATTLASLATSGASPMDAGLVSGLINTSRTMGGSLGLAVMSTIAAARTGSRGSAQALTEGYALAFRTGGCVLLGGALLMLLWLPRSTVVTGSTGAR

SEQ ID NO: 13395 - protein, 210 aa, Streptomyces avermitilis
MPQDHRPAKSVRVLLAEDQGMMRGALALLLGLEEDIEVVAQVGAGDAIVDAALAHRPDVALLDIELPGMSGLEAAAELREQAPGCRVLILTTFGRPGYLRRAMEAGAAGFLVKDGPVEDLAAAIRRVLTGETVIDPALAAAALSAGPNPLTARECDVLKASVDGATVADIAAKLRLSESTVRNYLSSAIGKTGTRNRMEAMREARQQGWL

SEQ ID NO: 13396 - protein, 457 aa, Streptomyces avermitilis
MTGNSDPMTCRIHEVREARRAWKEAWPPRRAAFRARRKSGEPAPEEMGPPHSGFALLPWLLMGMGAFSNLLQGTTPNPWIGGMGLLAFNSLYISVVFRAFVKEKRDAPATRWVLVAMLAITSGLGIGYGGSWLYFFPLLGLAVGAVTRGRTLPKLAFALSALAGTIAGFRDGWGAVGIGYATFLSTAVTAAILSLSEAVRELRAAREELARRAVEKERLRFSRDLHDLLGHTLSVIVVKSEAARRLAHRDLEAALLQVTDIESVGRQALTEIREAVTGYREGSLTTDLDGARSALSAASVDPVVRRSGPPLTPQTEALLGWVVREAVTNVVRHSDATRCEITVDGTPDRVRLKITDNGTGATVSEPLEGLGGTGLKGLTERLAAAGGSLEAGRAPRVGFLVTAELPVDATEPANAESANGELADREPANAESASTEADSGGAGARGATEVSEREQLA

SEQ ID NO: 13397 - protein, 285 aa, Streptomyces avermitilis
MPIDAAKAVAAEPRSAEISWDHKDVLLYHLGLGAGIPATGPDELRYTLESRLHVLPSFATVAGAGSPGVIGGLSMPGVDVDLARVLHGGQTVELHRPIPVTGTANATSRIAAVYDKGKAAILVMRTEVSDAEGPLWTNDAQIFVRGEGGFGGDRGPSTRLEPPVDEPTAVVERPIREDQALLYRLSGDWNPLHADPEFAKLAGFDRPILHGLCTYGMTLKAVVDTRLAGDVTRVRSYRTRFAGVVFPGETLRIRMWQRDGQVQVSVTAVERDDAPVLADTVVAHS

SEQ ID NO: 13398 - protein, 358 aa, Streptomyces avermitilis
MRAAVLHEIGQDKLEVLDDVESVGFGPGRVRIRVRATGLCHSDLSAMSGVLPQPAPFVPGHEGAGEIVEVGEGVSHLKPGDRVVVCWLPACGVCPACKRGQSQLCLAGFMNAGTPNFRRPGGDVFGFAGTGTFAEEVVVDAGSAVPIPDDVPFDIAALIGCGVTTGLGAALNTADVAAGSSVAVIGCGGVGISAVQGARLKGAAEIVAVDPVASRRESALRFGATQAVSPDELAAAKQAVTGGEGFDYVFEVVGRSATARTAYENTRRGGTLVVVGAGALDDFLQLNMFELFFDEKRILPSMYGGGDVLRSYERTIALWRAGRIDLEGLITHRVPLAEINEALDQMRTGTALRTCIEI

SEQ ID NO: 13399 - protein, 324 aa, Streptomyces avermitilis
MSLPLEGLTAIVTGAGRGLGRAEALELARLGAVVVVNDYGQPGRDGSGAASGTPAEEVAAEIRAAGGRAAAHTGDVADHEQARALVELTVAEFGKLDILVNNAGILRDRMIFSMSEDEWDSVVRVHLKGHFNTTHFASVHWRARSKAADGPVYGRIVNTSSEAFLAGSAGQPNYAAAKGGIVGLTTSTALALAKYGVTANVICPRARTRMTEDVFAGFAEPDEGLDPLAPAHVAPLVGYLASPAAAGVNGQLLVVHGGMVAIVERPRVAAKFDTKQDTFTYDELDALLTPHYADRPKGETFAAVEVLGLRRGRDAAVSPASPGR

SEQ ID NO: 13400 - protein, 54 aa, Streptomyces avermitilis
MNDTSTTCPPLPEAQEAADHGHGRHRGPVSAQDDEATPRGRHRKPSDYQADPWH

SEQ ID NO: 13401 - protein, 443 aa, Streptomyces avermitilis
MTVCAWESVAESGNERGARPGCVITADGSYAARLALDGESWFPERWTLDGPEPYAVPLPGNQPEEPGTEVLPMSDGRVLIHRVADRRHTFSLLYPTGPATGELPLGAVECPDEGTRLRLLPPAPGGDRAYALAVGGGSTAVWLVAAGAFGPEHLAEVPGHCSGGVWLDATGRLLALDRTLNGRTKTVVVDLERGGEMSPLLQIAEHSDDRLLLADADSGLLLIRSDAPSPGHDRLGWGVLGSTLPVRFPESLRLTGPPSPLGVNGGAPLVLTPFAIQPGQVLTPERCAVALRVDGPAGSWVGVWRPAERQIHHLPAPEGWLAGTGLWTEDGVLHLPFATAAVPCGVARVAAPTGTGPGDPERYGPAAPTAGHTPPEPQAPDPSGPAAPRPVPLQQASLAGRLLRRSAPSAPAHPEEPAPPHAEHSPLPAETPPATPTPAVAAR

SEQ ID NO: 13402 - protein, 287 aa, Streptomyces avermitilis
VPRLSEVIAALENLWPAEWAESWDAVGTVVGDPDQEVARVLFAVDPVREIVDEAVHLGADLLVTHHPLYLRGTTTVAASTFKGRAVHTLIKNDIALHVAHTNADRADPGVSDALAGALDLRVVRPLVPDPGDPDGRRGLGRVCALDHPVTVREFAARAAARLPATAQGIRVAGDPEALVRTVAVSGGSGDSLFDDVRAAGVDAFLTADLRHHPASEFMADRAHSPLALLDAAHWATEWPWCELAAAQLDEISDRHGWDLRVHVSKTVTDPWTAHAASTTTDSLGAPN

SEQ ID NO: 13403 - protein, 196 aa, Streptomyces avermitilis
VAAQTEESDTSREQTKAEQDVDQVRQRAVRDQQRLDSGAVTSPKDLENLQREIVSLAKRQGDLEDVVLEIMERRESAQERVAELTGRVSSVQAKIDDATARRDAAFESLDGEAASVTKEREVISASVPADLLKLYDKLRAQQGGVGAARLYQRRCEGCHIELNITELNDVRSAPRDTVVRCENCRRILVRTSDSGL

SEQ ID NO: 13404 - protein, 438 aa, Streptomyces avermitilis
VVREFIVEADGGSRGNPGPAGYGAVVIDAATGETLAETAEYIGVATNNVAEYRGLLAGLKAARALDPAARIRVRMDSKLVVEQMSGRWKIKHPDMKPLAREAAAVFPPSQVTYEWIPRERNKHADRLANEAMDAGKRGERWSPSTSTAELSARTPAPAAPEPTGPPGDAAAGAARARAALAGGRVATSPAVPEPGGTAADTGARAARDVASVPADADVRAARNVASPPADLGAPATFVLLRHGETPLTPQKRFSGSGGSDPALSDVGRRQAELVGAALAARGTIQAVVSSPLARCRETAGIVAARLGIEVSVEEGLRETDFGAWEGLTFGEVRERHPEDMNAWLADPEAEPTGGGESFAAVARRVATTRDKLLAAYAGRTVLLVSHVTPIKTLVRLALDAPPQSLFRMELSAASVSAVAYYADGNASVRLLNDTSHLR

SEQ ID NO: 13405 - protein, 219 aa, Streptomyces avermitilis
MTSPLPPAELPSSPRASVLDLAPVVPVVVVEDAADAVPLARALVAGGLPAIEVTLRTPAALDAIRAVAAEVPDAVVGAGTVITPTQVADCVAAGARFLVSPGWTEELLAAMQGSGLPFLPGVSTTSEVVALLERGVREMKFFPARAAGGTDYLRSLAGPLPQARFCPTGGIALASAPAYLALPNVGCVGGSWMLPGDAVAARDWLRIEELAREAAALGR

SEQ ID NO: 13406 - protein, 266 aa, Streptomyces avermitilis
VLVLLPPSEGKAASGRGAPLKPESLSLPSLGAAREAVLDELVELCAADEDKAREVLGLSEGLRGEVAKNAGLRTAGARPAGEIYTGVLYDALDLASLDPAAKRRAGRSLLVFSGLWGAVHIGDRIPSYRCSMGVKLPGLGALGAHWRTPMESALPEAAGGGLVLDLRSAAYAAAWKPKGEVAGRTATVRVLHSQIVNGVEKRSVVSHFNKATKGKIVRSLLAAGTAPKNPAELVEALRDLGYAVEAQAPAKAGKAWALDVVVTEIH

SEQ ID NO: 13407 - protein, 451 aa, Streptomyces avermitilis
VPGTFPPEALAEAERAATAPVPPSYDATDIPLFTIDPPTATDLDQAMHLSRHGGGFRVRYAIADVAAFVVPGGALDAEAHRRVNTLYFPDEKVPLHPPRLGEGAASLLPDQTCPAVLWTIDLDADGRTAAVDVRRALVRSRAQLDYEGVQKQIDTATAEEPLALLEDIGRLRENLEIERGGISLDVPEQEIVEHDHTYALAYRAPLPADRWNAQISLLTGMAAAELMLAHGTGILRTLPAAPDGAVGRLRRTAHALRVDWPHHVSYARLIRSLDPRLPHHAAFLLECTTLLRGAGYTTFRDGALPAITTHAAVAAPYAHCTAPLRRLADRYASEICLAAVAGQAPPDWVLAALDDLPKEMADGSHRAATVERECVDIVEAALLKDRVGDVFDGCVVDVKEREPTVGTVQLESPAVVARIDGGTAKLPLGERLRVRLTQADPGTAKVRFAPA

SEQ ID NO: 13408 - protein, 282 aa, Streptomyces avermitilis
VGQEGRQVSAREQALWTRAHLGRCGPPLDLLTARFDQHRYAPHAHEEFTIGVCVGGSEIIDYRGGHIRTGPGSIVVLAPGEMHTGGPGACDGYAYRALYAQTPLLTDGTLGGLPHFREPLLDDPELAAALRAAHTELSLCPDPLEAESRLPWLLTALARRHSTARQVSDTVPGAGHIAHAVRDRLADELTTPPSLADLAADLGLSRYQLLRAFRTTMGIPPYAWLAQYRVVRARGLLESGLRPAEVAGLVGFADQAHLTRWFRRVLGVTPAAYRNSVQDRGC

SEQ ID NO: 13409 - protein, 358 aa, Streptomyces avermitilis
MTARGWFLFSLMGVLWGIPYLMIKVAVDDMSPSMVVFTRCALGAALLLPFAVRQGGLTRVVRAHWRPMLAFAVVEIIGPWWTLTDAERHLSSSTAGLLIAGVPIVGIPLARFFGDTERLGARRTTGLALGLAGVVVLTVPHLTGGDARSLAEVLLTVLGYATAPLIIARYLKPVPTLQLIAPCLVLAALVYAPAAALTRPTAVPSASVLASLAGLGVICTALAFVVFLELIREAGPTRAMVFTYVNPAVAVAAGVALLDEPLTAGILAAFGLILLGSFLATAATSPRPDPAPASAPVSAPASAVVAASGPTSGPTSGARRVARPVAWSTRQTSRADGRVGVLEDLPEERPGSTGQGGG

SEQ ID NO: 13410 - protein, 387 aa, Streptomyces avermitilis
MTDPASERRRMAAVLSNKGVLKSPWLRGAIETIPREQFLHPGVFLDEGRTWRPVTALGTAPDEWLKIAYSVDTLTTQLDGHLTADRAGGPVVGVPTSSSTDPTTVIGMIEALDLTAGHRVLEIGTGTGYSTALMCHYLGEDNVTTVEVDPQVAARADAALESVGYSTWTVTGDGLLGHPHRAPYDRVIATCAVRRIPYTWVRQTKPGGIVLSTVGSWPWGTGLAKVTVCDNGTAEGAIIARSSFMQARSQAVTPLAGDLSARTAYADSRRPALVSPLVLEEWMPAFLAQLAAPGAQFVRAARSDGSPLRYLFDPERESFVEFISDGESWTVRQGGPVALWDGIERSVVAWQDAGAPDIDAVRLRVTDQSHEYWIDSCPSLRLEHRLA

SEQ ID NO: 13411 - protein, 321 aa, Streptomyces avermitilis
MTMTDERPVLVATEADDITADMVITELNRRDVPVVRFNLADIGEGLTVSARFGTCPAPVVGQVRTSSRTADLTRVRSVYWRRPEWPSFPHLSPDDSRFAAAQVRYGLGGTLYALDHPLWVNHPLRIAAADYKPAQLALAQQLGFTIPTTLVTNDPAEAREFIRTQGDVIFKTLRWTPYTRDGVPVTGWADPVTADEIDDNVRITPHLFQARVDKVTDLRVLIVGQHTFAVRIDSELLDWRRDYSVLTYTVEHLPDSVDKALHAYLDRLELVSGSFDLTVDRAGVYWWLELNPNGQWGWLEKETGLPMSAAFADLLVQGDRQ

SEQ ID NO: 13412 - protein, 86 aa, Streptomyces avermitilis
MTASVALPAPTRPWGVGRLAPYPTTIRQPHATVAIDPTTQLGVFRDRAGQVVEMGKHGTSSGTETSTTTNSDSKNDQGHDQDSSQD

SEQ ID NO: 13413 - protein, 68 aa, Streptomyces avermitilis
VNPVGPDGYEQHPLLNTNVRDVASRGEGVLVAVTHELHSHGTVRVARIRPESGVEWTTAAGNIQAARL

SEQ ID NO: 13414 - protein, 381 aa, Streptomyces avermitilis
LGKWPCQQPHQRLKIASLLGATLSELEGLLFEEQPAETAVLPDTPPLLDGDDDDMKRRDVLGLLAVTGALVTLPGSDEAPRGHTVAALLETGEELHRSLWQVFTLSDSKPTVFPAVHKQLDVLTKGLAETRTAADRARLCTMTADLYQLAGELFFDANRYTDAAQCYTLAANAAHAGGDHDLWACAMTRHAYVELYARRAPAAQPLLAVASRIARRGDSALSTRHWVAAVQAQVCAAVGDIDGCARALDEAEKVHSLDGHSHNGGWLRFDGSRLPEERGACYLQLGRPDLAEDALTAALAQPLSLRRRAAVLSDLAVLGAHRGDVDQVVQYAEAVLGLADRSNSGFVGKKLDGLRGRLAPLMSDGRVSDLDHRIAALSRTA

SEQ ID NO: 13415 - protein, 117 aa, Streptomyces avermitilis
MSDGRIFREAWIAGVNKHYPGEPKPGYVTPWDETPVWEREAAAAVYGQVRDFIRISEGHATRLTREQKGRFVAISWTAQMFKHFEDPKPGYVADWADLPTWQQETDSDIFERIEQTV

SEQ ID NO: 13416 - protein, 105 aa, Streptomyces avermitilis
MSSSRQLAAPGAQFVRATRSDGAPLRYLFAPERESFDEFIADGESWTVRQGGHPMALWDAIERALVARQDNGSPGIETVRLRVTDRSHLYWIDSSPLLRWEHRLA

SEQ ID NO: 13417 - protein, 271 aa, Streptomyces avermitilis
MSDPVTTPEPAKQQKIDTSVPHSARIWNYWLGGKDNYPVDEAAGDAYTEVFPGIVTIARSSRAFLRRNIAYLVSEAGIRQFLDVGTGLPTAQNTHEVAQGLAPEARIVYVDNDPMVLAHARALLYSTDEGATAYIDANVTDPEHILEVAAETLDFGRPTALILSNILGHVADCDQARSIVTRLMEALPSGSYLSINDGSRGIDPVFEQAQDAYNNSGAVPYNLRSIDEITAFFDGLELVEPGVVSVTEWRPEPGSGVPEVIAEHGGLARKP

SEQ ID NO: 13418 - protein, 179 aa, Streptomyces avermitilis
MRRIGTALAAMMLAGGGLLAGTVPAVAAPTAVDCAVTWGSLDKTGDSAASRRLTDVRAGQHECFDRLVFDAQGTAADPIGYTVRYVDVLHQDPSDVVVPIKGGAILEISLFSPRYDPATGQPYPPLPSVDVTGYRTFREFKFTGGSEGYTQAGLGVRARLPFRVFQTANHLVVDVAHTW

SEQ ID NO: 13419 - protein, 272 aa, Streptomyces avermitilis
MRSKTVAKTTTRSRGSGAGSGTGRTMTAAARAAAKRAERGHREPDPASTDEVAPGRPEAPAAGRTVLIEAPDEDGWDDPPEPSPECFEEDPAQEEGEPGRGTATRHGRRRLLTAALCVLLLAGLVAATVLGWRYREGVRAEQARGQALAAARQAAPVVLSYDYRHLDRDFAAARARLTGHFRDEYRKTTTTVVGPTARKYHGVVKATVTQPTGGSPAASVISASADRAVVLLFVNQVTTSTQVSGSRVDLNRVRMTVALTSHGWRVSGVDAL

SEQ ID NO: 13420 - protein, 177 aa, Streptomyces avermitilis
MAMATRRTDGMSRAMRSVLSGRAWSVGLVVATVLATALTIWLSFGLYNQREAEQRRQDLLAAARQSALNFTSLDYRHYDRDSANVLEGATGDFRKQFAAQTEELTQLVTQNKSVSDGQVLEAGIVRSDEHSARVLVVADSKVTNTAAPKGEARTYRLQLDLVQRNGRWLTSDVEFVG

SEQ ID NO: 13421 - protein, 425 aa, Streptomyces avermitilis
VITRTVKAQLLAFATVTAVGVSYVGAEYTGLVDDVLGRGYTVRADFADSGGIFPGAEVTYRGVPVGRVGALRLTGSDGVSVALDIKDGVPRIPADTLAVVANRSAVGEQYVDLQPRTSHGPYLLDGSAIPRGSTRVPLPTTDLVLSLDRLVDSVGKDDLRVTVDELGKAFSGTGPNLSRLVDSGNALVESASESLPQTISLIEDSRKVLKTQADQGSSIKSFAHDLAALSAQLKSSDGDLRKLIGNATPAAQQVNSLLKSTGPRLSVLLANLISGGQVTLARLPGVEQSLVTFPALVAGSYTVVPGDGTTHFGLVVNADDPPPCTQGYGTTRRDPSDTSTREANTDARCTAPRGNKTSVRGAQNAPGASTTSGGTNQAAYVTPYDPETGTATGPDGRPVEIGSTGGQQAVFGRESWQWLLVGPMA

SEQ ID NO: 13422 - protein, 425 aa, Streptomyces avermitilis
MNALRKVGAVAWAAVGSLLLSGCEFNGWYDVQLPGGAAADGHAYHVTVEFRDVLDLVPQSAVKVNNVTVGAVEEVQLDGWHARVRLRVADSVKLPANAVAELRQTSMLGEKYVALSTPPGTAPVGRLGDGDRIPLSRSGRNPDIEEVLSALSALLNGGGVAQLKTITVELNKALDGREDRVRSLLKELNTFIGGLDGRRKDIIHALKAVDRLAGRLGKEKKTIAQAVDTMPPALKVLADQRRDLTRMLTALSKLGTTGTKVVNASHDDTVANLKQLRPILQQLNKAGADLPNSLELLTTYPFPRNAVDAVRGDYVNLDITADLDLSALYRNLAGGSDKSGGGNGESTQPETPDIPDLPDLPTVPTPTALPSAPSLPSSPSMPSAPSGGGGPLCPPVCTSSYTTRGEPPEGIDLALAELMLKGVQP

SEQ ID NO: 13423 - protein, 374 aa, Streptomyces avermitilis
VKNLKRRVAVVTALALVAALTYVLWPRSESVHVTAYFPRTVGIYPGSDVRVLGVRIGEVEKITPEGDRVRVELKYDEGRRVPADSKAAIINSSVVSDRYVQLLPVYRKGPVLRNGAVIPESRTAVPVELDRVFGSLHTTADALGPQGANKDGSLSRLLGVSADNLDGQGENLNRTVEDLSQAVTTLSDGRKDLFGTVRNLQVFTAALSADDKSVRSFNTGLAEVAGQLAGERKDLADALKNLGTALGDVSAFVKNNKRSLNSNVKGLSKVTKVLVTQRAALAELLEVAPTGLSNLNNAYNPSAGTLDTRNNAQQAQDPAALMCSVLKTTGDEGGKNPDCKELKKLFDSLPKVPQGSAVTGTVDRTLGGILGASA

SEQ ID NO: 13424 - protein, 392 aa, Streptomyces avermitilis
MTKHFLPRRTRKRRPEPLVKVRIDPPKLPKIRLLPRRAPRPRRPEPLVKVRIDPPRIRLPRIRRPRLTPFRERNPVVIGAVGLTFLALLTVAAFNADSLPLIGGGETYSAAFSEAGGLKPGDEVRIAGVKVGKVKDVDLDGDHVKVTFKIKGDPGFGTETGASIRVKTILGAKYLALRPKGPGQLKPGSEIPLKRTVPAYDVVQAFSDLTTTTEKVDTDQLAKALDTISTTFQDSPAEVRASIKGLSKISRTVASRDKALGELLDHANGVTGVLAEHSEDFTALVKDGGKLFKEISKRRKAIHKLLKSSAALGIELSGLVEDNDKEIGPALKGLNRVVQMLERNQSSLDRSVKLLAPYVRVFTNALGNGRWFDSYVQNLVAAPVVPRTGGAQ

SEQ ID NO: 13425 - protein, 363 aa, Streptomyces avermitilis
MRITRIMKTAKTARTTTSTRTSGARQAAAPLIKFSLFALVTMVATTLLAATIVNISLTPEHTYRAVFSDVTGLEKGDDIRVAGVRVGQVEGIRIKDRTLAEVTFTVGEDRPLLNSTGAVVRYRNLVGQRYVALTEGAGDATRLKPGATIPLSRTQPALDLNALLNGFKPLFAALSPQDVNQLATEIIRTLQGEGGTVNSLLAHTASLTTTLAGRDKLIGSVIDNLNTVLETLDQRGARFSGLLKQLRRVISGLSADRKPIGQSLVGIGDLTDATSGLLKDARPPLKDDIAELTDLTGTLNKNENTVEGVLKRLPNKLGELTGTASYGSWFNFYLCDFDGRIVLPKTKQVLTPELHVARARCGA

SEQ ID NO: 13426 - protein, 415 aa, Streptomyces avermitilis
VSRMRVLRLRLYGVVFLAVLALLLSLSVAVYQQVFTPAVRIKLEADSLGNQLDPRADVKLRGLLVGEVRAVHADGTKATLDIALKPEYVASIPSDAHARLLPKTLFGEKYVDLVAPARSSARPIRAGDVITQDRTRVGIELQQLMNDLLPLLRTVQPGKLNATLSAFATALEGRGDRIGDNLTRVEDYLHRLNPHLPSLTEDFARLADVAEVYGDAAPDLMEILRNTVTTSRTLVEQRDRLASALTTTATAAGTADDFLDANGDRLITLGRVSRPTLDLFARYSPEYPCLFAGLVREEQASEQAFRGGKMHITLEVVRQQGAYEPGEYPRYDDRSGPNCRDLPHPPVPAPGVHLNDGSTKGSASGGPGGVSATRAEQRSVGSLVAPVLGVPADQVPPVATLLFGPMARGTAVSVA

SEQ ID NO: 13427 - protein, 267 aa, Streptomyces avermitilis
VALLNRLEELGSQLSFYGRSLAWTGRTVRRYKKEILRLLAEVSFGRGALAVVGGTVGVIAFLSFFTGTEVGLQGYAALNQLGTSNFVAFLSAYFNTREIAPLVAGLALSATVGAGFTAQLGAMRISEETDALEVMGVPSLPFLVTTRMIAGFVAVIPLYVVGLLSSYFAARTITTGYYGQSAGTYDHYFQQYLPPVDVLWSFGKVLVFAVLIILVHCFYGYYASGGPAGVGVAVGRAVRTSIVAINVLDFFLSLAIWGAGTTVRIAG

SEQ ID NO: 13428 - protein, 256 aa, Streptomyces avermitilis
MRLSPTGALRHSGSLFAMALDVVRTIPRRPFQAREFIQQAWFVASVTILPTALVSIPFGAVIALQIGSLTRQLGAQSFSGAASVLAVLREASPIVTALLIAGAGGTAICADLGARKIREEIDAMQVLGIDPIHRLVVPRVLASMVVAVLLNGLVSVVGVAGGYFFNVVLQNGTPGAYLASFTTLAQLSDLWAAEAKALVFGAIAAIVASYKGLTAKGGPKGVGDAVNQSVVITFMLLFVTNFVMTAVYFQVVPQRG

SEQ ID NO: 13429 - protein, 326 aa, Streptomyces avermitilis
MSELLHGRRVDRMGVEICVEGLTKSFGQQVIWQDVSLTLPAGEVSVMLGPSGTGKSVFLKTLVGLLKPDRGSVKVAGRDVTKLREHELYEVRKLFGVLFQDGALFGSMSLYDNIAFPLREHTRKSESQIRRIVLEKMDMVGLIGSEGKLPGEISGGMRKRAGLARALVLDPEIILFDEPDSGLDPVRVAYLNQLIVDLNAQINATFLIVTHDIASARQVPDNIGLLFRRELVMFGPREELLTSDEPVVRQFLNGRMQGPIGMAEEKDAAQVEQELARLGDTDREPRHVGNDMTPRLMPGPGIARPARWEAIARREAELHRKAVTGA

SEQ ID NO: 13430 - protein, 344 aa, Streptomyces avermitilis
MATDMPDMPAEIQAAHDRWQRMWSHREQLLKVARRRSMSPEDAEDAVHEAMLRAAERPDLDDERLGAWLTTVTMRLCVDRYRQVNREAEVHRSPTLAAPGPVPVEEAVCDRAEARWLAVRSGELPARQAEALRLKSEDLDVGQVAVRMGLSYRTVESLLARARRTLRSSLAGTLGLALFLWGRGKPRAGGHTQAAVVTSTAATLVVAGFVLPYVHNGDGQGTAPRPSVSRMAQTTTQTVRPDGFGRVAAPNGRALSAASTSHAATPTVPPGDHDRSLLPLSVPPLPDASLSPVPSVPGVSDLPSVPGLSDLPTTSTVPTTRRALPEAPATPPAPADVPTPTVLP

SEQ ID NO: 13431 - protein, 350 aa, Streptomyces avermitilis
MAGHRVRGTRGTAIAAATMAVLTASQAPAAVPARASVPPRQAPAEHGPSASGDTRYRTELPPLRTRDRKGGASVAGAALPASVFAAYRHAEAELTRTAPGCRLRWQLLAAIGQVESGQARGGRVTADGTTLAPILGPRLDGGAFAVVRDTDGGAYDGDPAYDRAVGPMQFIPSTWARWGTDGNGDGRADPDNVFDAALAAGRYLCAGGRDLSDPAELDRAVLGYNHSEAYLHTVRAWYAYFLEGHRVVSDSSAKASTRPEPSQPKPTPKPAPSPRPRAFPSRTPSAPASPAPTRSRSAGGAEGTEQPQLPRPGTDIELPGDDLLPSDGPLTSNGVNSMASSPSTTADTGR

SEQ ID NO: 13432 - protein, 636 aa, Streptomyces avermitilis
MTTSDGTVQGHTQIFGSAPRNRAFTVVLLGDGFTAAQQTDFNNACAAFVTALRATPPYDELSPAINVWRVNVASTDSGADDPAAAGGTGATARTYFDASFGGNGIRRLLICNNSTVLTTAAAQVPEFSVAIVVVNSTVYGGSGGSVGTYSLAGGATEIALHEIGHTAYGLADEYAYYAGGNETGHDHHPAGEPAEPNVTLNTQRASLKWGWAVAASTALPTMSNPDCSTVDGRASTVPAGTVGCFEGAHYYHCGAFRPEYDCKMRALGIPFCRVCRQVIWNRIGPLATLPARPRTPISVVARYPEHLDVFAVAADGRTMSDWWDAGSGWAGWFQVSGGLASPGGAGSPVTSVARYAGHLDLFVVGTDSRVYSTWWDQSSGWAAWFRVGTLVARPGSTVNVVSRYSDHLDLFTTGSDGRTMSTWWDARTGWAADWFHVSGGVAANGATVTAVARHPFHLDVFTVGTDNRVYSAWWDERSGWSAWFALPGIVCRPDSTVTAVARHRDHLDLFTTASDGRIMSTWWDARSGWAPWFQVSGGAASAGSPVTAVVRYTNHMDLFVVGTDNRIYSTWWHDTTGWAAWFNVSGGVAKPGSQVAALSRVTEHLDVFAVGSDGLVHSAWWDASGGWSGWFQLGIT

SEQ ID NO: 13433 - protein, 185 aa, Streptomyces avermitilis
MSTAGRVPGRGRVSPLPCMSRARSIGGEPSPSWRIRMAAPQQTPASPAVRLIFEYEGDTVRLVSQQPVDAVISGFDAPPEVRPGNFVEVRDDSGRRLARVPARGAFVESAEVFPEDHAEPITRVDVEARGAFTVILPAPAAATQVAVVRVAPTGPEEGVAPGGGATSPPPGAAPAVDLATFRLER

SEQ ID NO: 13434 - protein, 483 aa, Streptomyces avermitilis
LAGAAESSRRHRADERVPVLDYVSPKGRRAVAVATGVLTLAIMGPGTGSQARAASFGTPGITLSAAYLSGAVGAAGDPAVTVTVAQSGADAGALTVTVTKSSRTSVATTADVAVTGTGATRRVAVAARGQGYTDLTLKVTGVDGQSASKTLHYAASAAVQHGADTRYFTGSSDASAAVDVGGGHVVVADDESNVLRLYDRSVSGAPLKTWDFSSRIGVSKEVDIEGAARVGDTIYWTGSLGNNKDGEYKSARNTLFTTKVTGSGASTSLSYGGSYAKLREDLVAWDEANGDRYGFAAGTADGQVPKQIDGFNVEGLEFAPGSTTTAYLGFRAPLAPAVPGGRALLVPVTNIDKVATGSSAVFGAPIELDLGGLSVRDIRRNAANQYLILAGSWAADDNSDPYALYSWDGVPAHAPVKRLDLPTSDPGGWESVVDVPDLTVSGARAQLLTDAGSADLYGDGTEAKDLTHDEWKKARTTWFTVTN

SEQ ID NO: 13435 - protein, 117 aa, Streptomyces avermitilis
MSDQGMAPDASADPWGSIEDLHSWLDAHRAHGGQEGLLLRVLKLSEEVGEVAQAVIGATGQNPRKGTTHTWEDVQAELCDVVITAMVALRTLGPDARDVFAAHLARVTERSLGPRTP

SEQ ID NO: 13436 - protein, 181 aa, Streptomyces avermitilis
VTCFDRSDLGLLLLRLGTGGVLAAHGAQKLFGWFGGAGLEGTGQFMESVGYAPGKASATAAGLAEAGGGTLLALGLATPAAGAAAAGAMVGAAAVHAPNGFFAQSGGYEYAATLALLGAGLAVTGPGRLSVDHRLGHAVNRGWMVPVALGVTAAGTAVVVGARNKRLRRAAQGEQEMLFEE

SEQ ID NO: 13437 - protein, 108 aa, Streptomyces avermitilis
MTIQVAKLSDPAVRAFVTAVNAHDRDAFQALLASGATMSDDGADRDLTDWTEREIFSSHGHMNVDNESKGGRALIARYRNDTWGEMRTKWSFVVEDNGRISHFETGQA

SEQ ID NO: 13438 - protein, 246 aa, Streptomyces avermitilis
MYKLTGVTKRYTRGKETVEALRGIDLVIEDGDQLVIQGPTGGGKSTLLQMIGGLDRPSAGSVELDGVDLASISEAKLTRLRAEKIGIIFQAFNLIPTLTAQENVETALVPLGVKPAERRERAADALRSVGLGERLSHVPTELSGGQQQRVAIARALVKKPKVLLADEPTGNLDEGTRDDIMGLLEGLWHEYGLTFIMVTHDSSIARRAPRLATIKAGQLTLTEQGGGLRRAAAPQYAEQGGGPYGQ

SEQ ID NO: 13439 - protein, 485 aa, Streptomyces avermitilis
MFGIYLKRELSRRKKAALVIAMGLALGIALVITVNSVSAGMQQAQDKVLKSLYGLGTDMTVTKAQAAPSGNASGRPKFDFDAKSDSSDTQSSDRVMTQGGQALKSSLVEKVAAQKGVASAVGALSLNVTKVDGSFTQGKAKSSTTQQQGGGQGGPGGGTSTGQPQVQGGGASFDVNSYSVAGVDVTHQDLGPLATSKITKGKTFTTSQTNAKVAVLSKSYAKENKYTVGKTIKISGTKYTVIGIATPDSSESTTDVYLPLKQAQTLGDSKNKVTTIYVKATDSKQIDTVKTTIQKNIDGTTVTTSADLADTVSGSLSTASNLATSVGKWLSIAVLVAAFLVAALLTSSAVSRRVREFGTLKALGWPSGKVTRQVVGESIVNGLLGGALGIAIGLAAAYSVTAISPTLTAQLGSGGGAMGGGPGGQGGPGRQAASTTMDIALSAPVSLTTIALAAGLAIAGGLIAGAIGGWRASRMRPADALRSVQ

SEQ ID NO: 13440 - protein, 446 aa, Streptomyces avermitilis
MTPPLPCLCHPAVGRHGLTLYGPRMRDSSRLSRRAVLGLAAAAPLAAAAPASASAATVIGGERLGRSGVQVSGASGLPKKLTARAWLVADHESGEVLAAYNAHRRLAPASTLKMLFADTVLKKFERAERHTVTADDLVGIPAGSSLVGVQAGTTYTVEQLWLGVFLRSGNDAVHVLSHMNGGVAETVAQMQAKAEDLQALDTHVVSPDGFDHKGQLSSAYDLTLFARHGLADADFRDYCATRTADFPAGRKKTFQIQNTDRLLTGAWGMETYDGLIGVKNGYTSHAGNTFTGAATRGGRTLLVTVMHPKSGGNGVYEETAKLLDWGFAHAASAKPVGTLVDPISEGGATATATPSAAAAKPAAGARASTAGGHSSWGLVAGAGGAVALLAGGAVALRTRRRRTEAGAETRTKTRAKAKGNAKGEGKAKAAAEKEPGAGETNGRARR

SEQ ID NO: 13441 - protein, 273 aa, Streptomyces avermitilis
MPDRPACVRTAPPAPPVRCGPMNAMQTKIAVVTGAGSGIGRAVAAELLRTGWSVALAGRRPDALADTAALVPEGDSLAVRTDVSRPDDVAALFAAVRERFGRLDLLFNNAGTFGPGGVPVEELSYDAWRHVVDTNLNGAFLCAQAAYRHMKEQDPQGGRIINNGSISAHTPRPQSVAYTATKHALTGLTKSLSLDGRPYRIAVGQIDIGNAATDMTERMRSGVLQANGELAAEPVMDVADVARTVRHMAELPLEANVQFATVLATAMPYAGRG

SEQ ID NO: 13442 - protein, 548 aa, Streptomyces avermitilis
MTPAGHQHPSQHAPELRAAARHLGRRRFLTVTGAAAALAFAVNLPGAGVAGAAEFDAAKLTDDPFTLGVASGDPLPDSVLLWTRLAPAPYQADGGLPPERVAVRWELAHDARFRRIVRRGTATAHPEFDHAVHVEVGHLDPDRVLYYRFRAGGWVSETGRTRTAPATRDRVAGLRFAAVSCQAYHDGYFTPYGHLAEDDVDVVFHLGDYLYEYAVNSAGGARKYTDRVLPDLFNHETTTLEDYRLRYALYKSDPDLRAAHAAHPFVVTWDDHETENNYAGDIDENEDPPEEFLLRRAAAYRAYWENQPLRRPQLPDGPDARMYRRLGWGRLAQFDILDTRQYRSNQAYGDGAHVPGPESDDPARTITGATQERWLIDGWRDSRALWNVVPQQVTFSQRKLDLNAAAKVSMDAWDGYRASRERVLAGAQSAGVENLMVLTGDVHVGYAFDIKDDFDDPSSATLGTEIVATSVSSGKDGAEKPANWNTYMTANPHLKFYNGRRGYVTVELGREAARADFKTVSAVTTQGAPLTTAASFVTEVGEQGLKPV

SEQ ID NO: 13443 - protein, 335 aa, Streptomyces avermitilis
VDMSSERVRWGILATGGIAAAFAADLVDLPDAEVVAVASRSEESAKTFAERFGIPRAYGEWGALAEDEDVDVVYVATPHSAHRAAAGLCLEAGRGVLCEKAFTLNAREAEELVALARRHDGFLMEAMWMYCNPLVRRLKALVDDGVIGEVRTVQADFGLAGPFPPSHRLRDPAQGGGALLDLGVYPVSFAQLLLGEPSDVAARAVLSEEGVDLQTGALLSWESGALASVHCSISGGTPVSASVTGSAGRIDIPHGFFFPDRFVLHRDGRDPEEFTADPAAGPRNSLKHEAAEVMRALRAGETESPLVPLDGTLAVMRTLDAIRERVGVRYPGEGR

SEQ ID NO: 13444 - protein, 479 aa, Streptomyces avermitilis
MPERGRTTPGQEGPAGDIPNTAVAAPAPVPSPRARQPAHTPSPKAPRPPRQPSGTARGAALRRTGLLVTFVLGGLTATPPLAMDMYLPSLPEVTRSLHAPAATVQLTLTACLAGMAFGQLVVGPMSDKWGRRRPLLTGLVVYIVATALCAIAPNVELLVAFRLAQGLAGAAGIVIARAVVRDLYDGVAMARFFSTLMLISGVAPIVAPLIGGQILRVTDWRGVFVVLTVVGIALTALVWTRLPETLDPAERHDGGVGEALRSMRTLLADAAFTGYMLAGGFAFAALFAYISASPFVIQEIYGASPQTFSLLFGLNSVGLVIAGQINGKVLVGRVGLDRVLAVGLGVITLAATALLLMSTGVFGHVGLAPVAAALFVLMSAMGLALPNTQALALMRTRHAAGSASALLGTCSFLIGAVASPLVGIAGEHTAVPMAVVQLASALVAVACFMALCRPWKRRASEQGGGTPGPSAAESVGEDS

SEQ ID NO: 13445 - protein, 349 aa, Streptomyces avermitilis
VRGLTEGERPWAAGAVVVAGRGPVIAVEEAAGWAVRYAAYDEKKDAGVELPPAARVPMTVHTPFDLASLTKLFTAVAAMQQLERGTLGIDARVAAYLPEFRAAAQHGITVRQLLTHTSGLRPELPLYDCPSDAARLALLHAEPPTSEPGTYRYSDLNMLLLQYVLERITGRSLDVLVRDGITRPLGMTATGFGPCPGAAATEDQRRPWAKADRGMLRGVVHDENAWALGGVAGHAGLFATARDLAVFCRTLLAGGSYGPARILGPDFVELMLAPPGLGFAIDQPWFMGALACRGAVGHTGFTGTSLVLDPATDTFLVLLANTVHPRRRPADSGPRAAAGTRLARAVRGT

SEQ ID NO: 13446 - protein, 332 aa, Streptomyces avermitilis
VNAPASATDTLRSALAGLLAGLPPKQAAQAVDRLIANYRGRTPTHAPVLRDRSDVAAYAAYRMPATFEAVCAALDAFADAVPQWTPASHVDIGGGTGAATWAVSATWDGERPVTVLDWAEPALALGREIAAANPALKSAEWQRSRIGAALTVESTDLVTISYVLGELTEADRTVVVDAAAAAAQAVVIIEPGTPDGYTRVIDARERLIAAGFRIAAPCPHSAACPIVPGEDWCHFSARVSRSSLHRQVKGGSLPYEDEKFSYVAAARFPVAPAPTRVVRKPQIRKGQVLLDLCGPDESLHRETVTKRHGPLYKAARDAEWGDGWPPPEDTST

SEQ ID NO: 13447 - protein, 219 aa, Streptomyces avermitilis
MVKKAVPDSTRRSTRSRRAIYDAALALVGEVGYPRTTIEGIAARAGVGKQTIYRWWSSKAEVLLEAFTDLSAQAAEAAARPGPEEGGQEGGQGENGIPDTGDLAADLKLVLRATVDELLDPKFDIPARALAAEGVVDEQVGAEFVTKLLEPQLQLYVRRLRSAQEHGDVRPDVDPRIALELFVSPLAQRWLQRTGPITHAYTDTLVDYALNGLAPRRPS

SEQ ID NO: 13448 - protein, 296 aa, Streptomyces avermitilis
MVTWITLTGVGLAGLAGLTPPALTGHGGGPAPLEWGTGPLTVASLPRVVQVAHRGGAREVPENSMAGLTAAYARGTAQVLDLDTRMLGDGTLVVLHDATLDRTTDTHGPVRELRLADWRKVRVRPEGRVPGTWRAERPPTVAEVLDRFGGRVVLMLEAKDPQSLGALAGLIRGRGLARSVFVNSNRPEVARRAHGLGLVTQLWRSAEQLRTDRPARWASYVDLLDVDHKARDADLVRAVRSGIPRVWAHTVVTPAQRDRVLALGCNGVVTDAPGRLARHPVKRPKGFRTAGAEPGR

SEQ ID NO: 13449 - protein, 242 aa, Streptomyces avermitilis
MSAEFGRRTSGQGRISQWLRGRRPKEAADNAGGREALLLAAADAGLPLAPAAHPAGYRCSCDRVGCPTPARHPVSFAWQTQSTTDRAQIERWARHQPQANFITATGMVHDVLDLPREAGDEALERLLASGIEVGPVAATGDGRLLFFTLTRGTPEDEDEWWPCELDCHPETMDEHPGLRWHCRGSYVLVPPAQLPGDLTVDWVRGPEHPLPDPLTLLEVLTDACARYAGADTDRLAAWPHQG

SEQ ID NO: 13450 - protein, 356 aa, Streptomyces avermitilis
LNPASARFPAPVGFASGKGKVKYLMSRDRGARGLRKYGRFALATGAATALSLTASGCVVVHGEREVLPAAKKSEATRALAGFLTAYNKAQKANDRSLDAGRVTGALADIDGAKLEAGHKTAPAGNTDYTPLKLTDAKFAIPAKAGWPRWFVADTASNRDKNRWVLVFTRGSANDVWQVSYLTALAPADVPRFKKDKDGWAEPVTADDAALAVRPQKLGAAYATYLKSGGDTFADGRFTSGLRAGRKKNASKPGLARQYMDEPLNSGDHAPLGLRTTDGGALVFFVTHHYEKQTAAQGVNITVNDPNIKALMTGDPKQSLTMEFVSNQAVLDPAKGSGDQRVTFLSKVAGLTAAKGE

SEQ ID NO: 13451 - protein, 288 aa, Streptomyces avermitilis
VLSNYLIGLREGLEASLVVCILIAYLVKTGRRDALRPIWIGIAVAVTVALGFGCVLEFGSQEMTFKAQEMLGGSLSIVAVGLVTWMVFWMRRTARHLKSELHGKLDAALAMGTGALVATAFLAVGREGLETALFVWASVHAASDGTPRPLIGVALGLATAVLLGWLFYRGALRINLAKFFTWTGGMLVVVAAGVLAYGVHDLQEADLVPGLTNLAFDISATIPPDSWYGTLLKGVLNFQPDPTVIQVTVWLVYLIPTLAIFLAPSGLLSRKGNGKGEAQSPPAVREEV

SEQ ID NO: 13452 - protein, 432 aa, Streptomyces avermitilis
VSEAPMTDTTNTTETTAEDAGAPAPSRRSLIGWGGAGLALGAAAAGGAVAMARTGNDVDPTAAETGAAIGFHGAHQAGIATPVQDRLHFAAFDVKTDDRAAFVQLLKDWTRAAARMTAGHAVGEGAYGGLAEAPPDDTGEALGLKPSRLTLTIGFGPSLFEKFGLADQRPEALVDLPKFPGDNLEKTRSDGDLCIQACADDPQVAVHAIRNLARIGFGKVAIRWSQLGFGKTSSTTPDAQTPRNLMGFKDGTRNIAGTETDRLKKFVWVGEDDGPHWMTGGSYLVARRIRMNIETWDRTSLQEQEDVFGRDKGEGAPVGKAKERDKPFLKAMKPDAHVRLAHPDSNDGATLLRRGYSFTDGTDGLGRLDAGLFFLAYQRDVRKGFIPVQRSLSRTDALNEYIQHVGSAVFAVPPGVRDKDDWWGRALFSKEA

SEQ ID NO: 13453 - protein, 382 aa, Streptomyces avermitilis
MRAVRLSVVTAAATAAALTAVTGCTEKSTASGSDAIQVTAADSKCETSTKSVPAGQVTLKIENKGSKATEVEIVFPDDRIVSEKENIGPGTKYTLTAEVKAGSYEIACRPGMKGHGVRQKLTVTGGKVAKRDPRLDKAVAAYREYAQEQADETLPKAEAFAKAVKAGDIEAAKKEFATSRLGWERTEPVAESFGDIDPKVDVREDGLEDGQDPATDWTGWHRLEKSLWQDKKIGDREKKLADQLVTDLTDWQKRVGKAEITPSSMANGAKELLDEVATGKVTGEEDRYSHTDLSDFKGNVEGAQKAYELLKPVAKENDAALATELDKQFTALNTLLDKYRTDKTSYDFTSYDKVGKADRKELSDAVNALAEPLSKLAAAVVK

SEQ ID NO: 13454 - protein, 84 aa, Streptomyces avermitilis
MGTVSRGGPVPVEGGAGQGRTPVMRWSRWGTVRGSPSSARTGSRFGAPGMPRPGVRRPRSSVSGSSRRSTDFLDSRLTFPWGLF

SEQ ID NO: 13455 - protein, 291 aa, Streptomyces avermitilis
MARARREERPPGGLVLDIRGRPGPPPLRFEAADGRMLLRQGERPVLLGRVEPPREGLFVHRLDGYRSPLPPLRSALTRDPGRGLLDQYARWLEDSAHGPLHDSRWLLSEARSFPPYVWHHDFARGWPGIHLDWCGGGWQGVVPLRRLSPPDAPRVRAYRKHARDGTLAPVLLWWVSSFDGWLLLDGHDRAVAALAEGRDPVCLVLSRAPDDEAWRRTADEVTASHERRVADLADRPRPWADRQRATMERAYGDVMAWLPYEHAPTRSWPLPGGPAAWDELAARVMFECRSD

SEQ ID NO: 13456 - protein, 214 aa, Streptomyces avermitilis
VTDYDVLRVFCGPGGGYGNELGVVREGSVLPECADRQALAAKLGFSETVFVDDPERGVIDIYTPTLRLPFAGHPCVGTAWLLDVPELVTPAGVVGTRLDGEFSWIEARPEWAPPRTLRQYATAAEVDALPVPPPGEWVYAWAWEDEAAGRVRARAFPGRDDGIEEDEATGAAALLLTDRLGRALNIIQGRGSQILTAPQPAGWVEVGGRVLLER

SEQ ID NO: 13457 - protein, 215 aa, Streptomyces avermitilis
MTAFSTLIRTASHEQHVEAETSTFMSDLLGGRLGVEAYARYTEQLWFVYRALEESAERLAEDPVAGPFIQPELMRVPSLERDLAHLRGADWRSGLTALPATREYARRVTECALTWPGGYLAHHYTRYLGDLSGGQIIRDKAEKTWGFARKGDGVRFYVFEQIANPAAFKRGYRELLDGIRADDLEKQRIVAECKRAFALNTGVFRALGEEFPLSA

SEQ ID NO: 13458 - protein, 285 aa, Streptomyces avermitilis
MSGQSLLVPGELSPTRPVPGNIRRPEYVGKPAPTPYTGPEVQTPETVEAMRVAGRIAAQAMAEAAKLIAPGVTTDELDRVAHAYMCDHGAYPSTLGYRGYPKSLCTSVNEVICHGIPDSTVLRDGDIVNLDVTAYIGGVHGDNNATYLVGDVDEESRLLVERTRESLNRAIKAVKPGRQINIIGRVIESYAKRFGYGVVRDFTGHGINSSFHSGLIVPHYDSPHATTVIQPGMTFTIEPMLTLGTHDYDMWDDGWTVVTKDRKRTAQFEHTLVVTDSGADILTLP

SEQ ID NO: 13459 - protein, 78 aa, Streptomyces avermitilis
MALFKKRTVGKPGEWYYCLVHRKVEEGPECPAKDRFGPYASREEAEHAMQTAQERNLEWETDPKWHDVNEPDAEEDKP

SEQ ID NO: 13460 - protein, 202 aa, Streptomyces avermitilis
VRMDAVRVALLREVLAGTEWLGATRRFAGTLRGSVVSHGGGLLLVGTADYEPWHLAAHLVDEAAWSGTPELSPTLVRHGARASDPAHLAVGLGRIEAARRGETLLVVSPSAPQAPLLERIHDARRAGATVLALDSGDRELGAMAHESLSVPPGPELDLDTVQHLVSAAAGENALPGPRGHRRLRDRLSRLADHLTAPPPARW

SEQ ID NO: 13461 - protein, 357 aa, Streptomyces avermitilis
MTEASTPFRGGREGYASYRIPAVVATGVGTLLAFCEGRVDSAHDHGNIDIVLKRSGDGGRTWGPLQAVAKNGDNLAGNPAPVVLDTGRVLLVHVRSAAGASEDAILRGKVKAADGRRVWVQHSDDDGLTWSGPREITGQVRKANWRWYATTPGHALQLTTGRVVVPGNHTVPPTGTDNGTEAKYNSGHCLLSDDRGASWYLGYLDENTNGYINVNETTATELPDGRVYFNTRNDSPSPGNRADAYSKDGGKTLVKPFRPQAGLTTPVVQGSVLQLRDPDLLLYSGPADPAFRALMTVRASADGGTTWRTAHPLDGLPAAYSDLVRVDQDTVGLLYETGDFGAYETITFRRIPVTALT

SEQ ID NO: 13462 - protein, 234 aa, Streptomyces avermitilis
MTSTDSAQKAPAKDPWDLPDVSGLVVGVLGGTGPQGKGLAYRLARAGQKVIIGSRATDRAQAAADELGHGVEGADNAETARRSDIVIVAVPWDGHGKTLESLRGELAGKLVVDCVNPLGFDKQGAYALKPEEGSAAEQAAALLPDSRVTAAFHHLSAVLLQDPEIAEIDTDVMVLGEERADVEIVQALAGRIPGMRGIFAGRLRNAHQVESLVANLISVNRRYKAHAGLRVTDV

SEQ ID NO: 13463 - protein, 60 aa, Streptomyces avermitilis
MPRLALYALVVCVLSVAAAVVSFVQGSWLGIVWVLMAGLSSNMTWYYARRGRGGRGSVTS

SEQ ID NO: 13464 - protein, 266 aa, Streptomyces avermitilis
MTTAASRRSDRRISPVFIGIVAVTAVTGWAAWTGFAAQPGIAVFLFVTAAWIVSLCLHEYAHARTALHSGDISIGAKGYLTLNPLKYTHALLSIVLPVIFVIMGGIGLPGGAVFIERQRIQGRWKHSLISAAGPLTNVLFAAVCTAPFWLHALDGVPRDFQYALAFLALLQVTAAILNFLPVPGLDGYGVIEPWLSYDIRRQVEPFAPFGLLAVFAILWIPSVNGVFFDAIDAILNGLGIDDIHRYCGQELYRFWQGDNEFCSVSL

SEQ ID NO: 13465 - protein, 184 aa, Streptomyces avermitilis
MGRWYVYYEDWQMECCGTPFSVGDEVSWPLLLMDADDVLAGDWERELSRLVGSVEAVRDEYGGVLRTLRTGPPAGPGLTAALNADAVDESGAEPAEPIRRVGLLTVERHGGEWPETTGRVRAIHLVHQEYAVLAPGSLTREPVPGTRSLEAVTSCPKWFGEGRSGVLVELDVPGAAPPEPRDRS

SEQ ID NO: 13466 - protein, 1176 aa, Streptomyces avermitilis
VTAPETMDPVRYRVLGTTQALRPDGTPVPVGGARLRALLTVLALRPARTLPAAVLVGEVWHGDPPADATGALQALVGRLRRALGADAVESVHGGYRLAAVADDVDAHRFERLAGEGLRALADGDPAKAAVVLDDALALWHGPALADLPDRTAEAARWETRRLDVRRARLTAALSLGQADQCLPELTALCDVHPLDEPLQALRLRALRDTGRPAQALAAYEDVRQLLADRLGSDPGPELRALHGELLSPAGEPTPGWGGGPGTRGTGGTGAVPAGERHGGTGAVPAYGGGRAEGAGPVAYGGGRAEGAGPRPDGLRGGVTAGGAGGAAGSVRTSRAPAAPVPPGNLRARLTSFVGRDADIGTIRGDLASARLVTLLGPGGAGKTRLSQEAGEAVAGGMPDGVWLAELAPVDDPEVVPEVVLTALGARETVLHGAGAEEMRAVAERRDDPLVRLAEHCARRRMLLILDNCEHVVDAAAHLVAELLARCPGLTVLATSREPLGVPGELLRPVEPLPEPYALRLLADRGAAARPGFRVQDDPEAAAEICRRLDGMPLAIELAAARLRMLTPRQIADRLDDRFRLLTSGSRTVLPRQQTLRAVVDWSWELLDADERGVLRRLSVFAGGCDLAAAEAVCGPAALEALGSLVDKSLVVASLADGGGNDGMRYRLLETVAEYAGERLDESGERTAAERDHLTYYRELARTTDPLLRGAGQRAAIERFQLEYENLRTALRHAVAARDEQEALCLVLSLCWYWQMRDQRIEARTWATAVMALGPDPFAAPARPAPVLRESCTDSPPPMRPEILDEARRGVHLVHLACMDMDLEMWDTPRAREKLRVISETYRPGQPQICRSPGFLWFFAVMLTGDLDSTRAVVDASVRTCRELGYSWELAQALQMRANVLANRSFWAADATRDADEALEIFIRIGDVWGAAEALSARGEARERSGDYPRAAADYEAAITYAERLGAHAQAAVLGARLGSVLIDAGQGERGEQLLREVLDEGQGMVSEAMPAARLFLAIRLGRTGRLAEAREQLGMLRTDFGDVRFVVFDGFVVGVEAWLDATEGRYAEAVEKVRRALARAADQVTRVIAPHMFSVHLTTAAIALTGLDGGLRAPDAARCLAVCDQLLPPGHLPSVMEREVRAEAEAGVRAVLGDAAYEAAYAEGGGLSLEEAAALV

SEQ ID NO: 13467 - protein, 272 aa, Streptomyces avermitilis
MSATTVPTPVAHDEGRIGLRGNLRHIGALVRRNLLWIRQDPESMFDAVLMPIVFCLLFVFVFGGSIAGKGHQHEYVNYVVPGLMAMMGMNIAMGVGTGFNQDFQTGVMDRFRSLPIARFSVLIAKITVEIGRMLVAVAVLLTVGFILGLSVSNVLGLFAAVGLAMVFGSGIMWIFLTMGVVMKNAQAIQGMGFLVLMPLQFGSSIFAPTDTMPGWLQAFTDYNPLSSLADAARGLMNGGQPVGHDVLVTLVWSVVLTAVMAPIAIHKFRTKS

SEQ ID NO: 13468 - protein, 346 aa, Streptomyces avermitilis
MTRIDNTPRQDGAGPSAAVVVRGLVKHYGETKALDGVDLEVREGTVLGVLGPNGAGKTTLVRCLSTLITPDSGHAVVAGYDVVKQPRGTRRVIGLTGQYASVDEKLSGYENLYLIGRLLDLPRKEARARADGLLERFSLTDAAKRPASTYSGGMRRRLDLAASMMGRPSVLYLDEPTTGLDPRTRNEVWTEVKRMVAEGATVLLTTQYMEEAEQLASELTVIDRGKVIAGGRIDELKARVGGRTLRVRPADPLELRPTAAALDDFGLTGPGSATVDPETGTVVVPILSDEQLTAVVGAVTARGITLAGITTELPSLDAVFLSLTGHKASAPQDASPASPEFAKAAV

SEQ ID NO: 13469 - protein, 131 aa, Streptomyces avermitilis
VLGAVARGGWVYEVHAAGAGTDLYRVSLLEGYQEQRPLSAAESAALPALLPLVHAESALSEMGYFHGVMGSTADTALAYDRFVGHTRWFGGEDGTRLLNRIRTRLQRPGPVRFWNGSSPPTGEDRRAALVP

SEQ ID NO: 13470 - protein, 287 aa, Streptomyces avermitilis
MTQLSAAQKPSDSSKALYGGKGTRRITIRDITTAKERGEKWPMLTAYDAMTASVFDEAGIPVMLVGDSAGNCHLGYETTVPVTLDEMTMLSAAVVRGTSRALIVGDLPFGSYQEGPVQALRSATRLVKEAGVGAVKLEGGERSHRQIELLVESGIPVMAHIGLTPQSVNAMGYRVQGRGEEAAQQLLRDAKAVQDAGAFAVVLELVPAELAAEVTRVLHIPTVGIGAGPETDAQVLVWTDMLGLTGGKVPKFVKKYADLREVMGNAAKAFAEDVVGGTFPLEEHSVH

SEQ ID NO: 13471 - protein, 530 aa, Streptomyces avermitilis
MTTPAAPTERRVPEAVHRRRWAILGVLMLSLLIVVLDNSILNVAIKTISTPAPTGLGATQSELEWAINSYTLVFAGLLFTAGLLGDRLGRKKMLLAGLAVFGIGSALAAESGSPVQLIAFRAVMGLGAAFVMPATLAVLMNVFERDEQPKAIGIWAGGVGIAIAIGPITGGVLLDHFWWGSVFLINVPIVVIALGLMVWLVPDSRDPNPGRVDPVGVVLSVIGLVLLVYGIIKGGQLADFTDPQVLATIAAGLAVLAAFVVFEKRSDHPSVDVTYFKNKVFSAAIAAIALVFFALMGVTFFSVFYTQSVRGYSPLQTGLLMLPLAAAQMIFAPRARLVVDRFGNKATTTAGLVVLAAMLAAFATLDADTPIWLLEVVFFLMGAGMAHVMTPTSVVIMQALPREKAGSASALSNTFRQVGGALGIAILGSVLSTTYRDGIEDKLSQLPPAVRHTAGESIEATLGVAAKLGPDGKALVAPANDAFLHAMHLTALCGAGVAVLGAVIVALFLPGRPPAPQEGQEETELVTADH

SEQ ID NO: 13472 - protein, 206 aa, Streptomyces avermitilis
VSLADSRARREGPARGRPRSEAVERSIIEGVMKLLEDGVPLADLSMERVARTAGVGKATIYRRWRDKEELFVDVLRAAEPADPELPGTSMRDDLVVMLESLRQRGLLARSSAILHNVYAQMKSSPRIWTAYHATVVEPRRRLGAEVLRRGQENGELRADLDIDFVNDLFVGPMLVRTVLRPDGDLPEELAEQIVDALLTGLRPTGP

SEQ ID NO: 13473 - protein, 345 aa, Streptomyces avermitilis
MAQAYVTETGSGGSESDRRGSRLRRLYDSLRGDRGIWRRGLVVAACAVVLALVMVLHAQIPNTIGNLGSLVETFLPWLGVFVPLLLALGLVRRSATAVIAVLLPTIVWLNLFGGLLTDRAGSGGDLTVATHNVNADNTDPSGTARDVAASGADVVALEELTATAVPVYEKALAATYKYHSVQGTVGLWSKYPLKDVRPVDIKLGWTRAMRATIVTPFGEIAGYVAHLPSVRVKLAAGFTAHQRDKSADALGEAIADETLRDVVLLGDLNGTMNDRSLSNITSQLRSTQGAAGSGFGFSWPASFPMARIDQIMVKGVDPVTSWTLPRTGSDHLPIAARVKISATAS

SEQ ID NO: 13474 - protein, 408 aa, Streptomyces avermitilis
MPLALLALAVGAFGIGTTEFVIMGLLPDVADDLHISIPAAGHLVSAYAIGVVIGAPLLAAVTARLSRRKVLIGLMGLFVVGNALSAFAPDDHWLLAARFLSGLPHGAFFGVGAVVATNLVAPERKARSVSLMFLGLTVANVAGVPVATLMGQHLGWRATFLGVSAIGLAAIASLALLVPHDHTHATSGGLRGELTALRSLPVWLALGTTVAGFGALFSAYSYITPMLTDAAGYAHGSVTLLLALFGVGATAGNLVGGRLADHSLRGTLFGGLVSLVVVLSLFPLLMTTQWSAALGVTLLGAAAFVTGSPLQLMVMEKASAAPSLASSANQAAFNLANAGGAWIGGLALAAGFGATSPALAGAALAVLGLAVAGTAYAVDRRRALAVAVTTSGRLVATHVPQRTESAHR

SEQ ID NO: 13475 - protein, 584 aa, Streptomyces avermitilis
VPQLRLALNQIDSTVGDIAGNAEAILRWTRHSAEQGAHLVAFPEMALTGYPVEDLALRSSFVEASRTALRELAARLAEEGFGELPVLVGYLDRSESAQPKYGQPAGAPRNAAAVLHRGRVALTFAKHHLPNYGVFDEFRYFVPGDTMPIVRLHGVDIALAICEDLWQDGGRVPAARSAGAGLLLSVNASPYERDKDDTRLELVRKRAQEAGCTTAYLAMIGGQDELVFDGDSIVVDRDGEVVARAPQFSEGCVVLDLDLPAAEAEPPTGVVDDGLRIDRLVISEEPLPAYEAELAGGYADRLDADEEVYSALVVGLRAYVAKNGFRSVLIGLSGGIDSALVAAIACDALGAQNVYGVSMPSKYSSDHSKGDAAELARRTGLNFRTVSIEPMFDAYMASLGLTGLAEENLQSRLRGTTLMAISNQEGHIVLAPGNKSELAVGYSTLYGDSVGAYGPIKDVYKTSIFRLAEWRNRAAAERGQTPPIPEASITKPPSAELRPGQVDTDSLPDYPVLDAILELYVDRDTGADAIVAAGYDRELVVKTLRMVDTAEYKRRQYPPGTKISAKGFGKDRRLPITNRWREHS

SEQ ID NO: 13476 - protein, 633 aa, Streptomyces avermitilis
MAATLPLLAGALALGIPAAHAADGPSRDTLAGTKPAWATATADKGATDNGSQVSARVYLAGKDAAGLAAYAKAVSDPNSASYGKYLSAQQAQARFGATKAQVAEVTDWLKSAGLKVTGSTQHYVTVTGDVAAAEKAFGTQLHNYVKGGKTYRAPAKTASAPAALDGAVLTVTGLDNAPHKATHADTLPPPDAVFHNSGPYSSYYGSKVATSLPKAYGKKIPYAVKGYTGKQLRAAYGAGKATGKGVTVAITDAYASPTIASDAATYAGKHGDAKYAKGQLAQVLPSDYTKTEECGAAGWYGEETLDVEAVHAVAPKANIVYVGAASCYDSDLLDSLNKIVDGHLADIVSNSWGDIEANETPDVAAAYDQTFKLGAIEGIGFYFSSGDNGDEVANTGTKQVDTPANSAWVTAVGGTSLAVGKGDKYQWETGWGTLKASLSADGKSWTSFPGAYSSGAGGGTSKTVAQPFYQRGVVPKSLAKANGSTPMRTVPDISAIADPNTGFKVGQTQTFPDGTQKYDEYRIGGTSLAAPVIAGVQALAQEQRGGRAIGFANPAIYDRYGSKLYHDVVDKPTGRDLAVARVDFANGFDAAEGLLTSVRSLGKDSSLKAVKGYDDVTGVGSPAPGYVTSYRRH

SEQ ID NO: 13477 - protein, 208 aa, Streptomyces avermitilis
VTRHIGWVAGSAAAVLVAAGAITYAVAEDGGSSATTPTAGSADAGFARDMAVHHQQAVEMSYIVRDRTKNEEVRRLAYDIAQTQANQRGMLLGWLDLWELPKVSADAPMTWMGMGDMASGKDGALMPGMATNTELKKLNTLSGEQAEVLYLQLMTDHHKGGIHMAEGCVAKCTVGVEKKLAQGMVDAQQSEIDLMADMLKERGAKARD

SEQ ID NO: 13478 - protein, 222 aa, Streptomyces avermitilis
MGSAKNTSNAQRKARIEEMRRAERSRERRNRILTIAASVVVVAGLVVGGVVLVKSQSDDKDTSASDSKTSSGHFVTGTDGVKTWKGKLGRTHVTKTVDYPMEPPVGGDHNQVWMNCNGDVYTKAVNNMNAVHSLEHGAVWVTYNSKASDADVKALAAKVKKTPYTLMSPVDDQKAPIMLSAWGKQRTVKSASDPDVDKFFAEFVQGKQTPEPGAACTNGLAQ

SEQ ID NO: 13479 - protein, 166 aa, Streptomyces avermitilis
MRIIYAGAMRLLRSTDLALRVLMRLAVTGDSSPTTREVAADMDVPYTHAAKVVAELQHLGLITARRGRGGGLALMEAGRTASVGAVVRAFEGDGDVVDCEGSTPCPLNSACRLRGALRRAQEAFFASLDPLTVQDMVAAPTGPLLLGITGAPQLSRASQRSGPNTS

SEQ ID NO: 13480 - protein, 400 aa, Streptomyces avermitilis
MLSEQSAATVRATLPAVGAAVGEITARFYDRLFAARPELLRDLFNRGNQAAGTQRQALAGSIAAFATYLVEHPDERPDAMLDRIAHKHASLGIAPGQYAVVHEHLFAAIAEVLGDAVTPEVAAAWDEVYWLMANALIAIERRLYAQHENTGDTGGRRPWRVVERVDETADVAAFRLRPADGRPLPDFRPGQYVSVRVELPDGARQTRQYSLVGAPGSPELRIAVKRVHGGTTPDGEVSNHLHARVREGSVLELSAPYGDLALEATDVPLLLASAGIGVTPMIAMLEHLALTGHRAPVTVVHADRSPAEHALRADHEAYAAKLADAAVHFWYEHPEPGHPADRTGLVDLTGVPVSAGTRAYLCGPLPFMRAVRTQLIEKGVAPADIHYEVFGPDLWLARES

SEQ ID NO: 13481 - protein, 453 aa, Streptomyces avermitilis
MDKQQEFVLRTLEERDIRFVRLWFTDVLGFLKSVAVAPAELEQAFDEGIGFDGSAIEGFARVYESDMIAKPDPSTFQVLPWRAEAPGTARMFCDILMPDGSPSFADPRYVLKRALAKTSDLGFTFYTHPEIEFFLLKDKPLDGSRPTPADNSGYFDHTPQNVGMDFRRQAITMLESMGISVEFSHHEGAPGQQEIDLRYADALSTADNIMTFRLVMKQVALEQGVQATFMPKPFSEYPGSGMHTHLSLFEGDRNAFYESGSEYQLSKVGRSFIAGLLKHAAEISAVTNQWVNSYKRIWGGSERTAGAGGEAPSYICWGHNNRSALVRVPMYKPGKTGSARVEVRSLDSGANPYLAYALLLAAGLKGIEEGYELPPGADDDVWALSDAERRAMGIEPLPQNLGEALALMQRSELAAETLGEHVFDFFLRNKKQEWEEYRSEVTAFELRKNLPVL

SEQ ID NO: 13482 - protein, 103 aa, Streptomyces avermitilis
MDAFAFVHGSNLYELRPKPGQRHQAAREHGMHALRHFYASVLLDAGENTKALSHYLGHNDPGFTLRVYTHLMPSSDARARKAVDTLYSDTLSTPDGPQTAQED

SEQ ID NO: 13483 - protein, 79 aa, Streptomyces avermitilis
MSNQTLDWLKENEFDNTDEALKGIDKARDMGQHNAMIPLLNYAQTNGMSDDEIWDLSDEAEEAYNKGRTRSDTKDVRGF

SEQ ID NO: 13484 - protein, 219 aa, Streptomyces avermitilis
MMRVSASSLAVAALFLTATSCSTEGDASTSAADGCEEALGDSGIEWVESHADVAGGGELDRGGVDLKDARAQHYKQMESGGSDGSHWSSELCTITAFDAGKKKELKVEFGPSSLPFDFQTKGAEEGTNTPVNSDVKLHQVEDSRGVVRYGIYVKCKIPGTSSRQETETPLAGVMTDTLTSGTSARDHMKYLLHSARAMADALECRNEPTIPAEPGAAMP

SEQ ID NO: 13485 - protein, 543 aa, Streptomyces avermitilis
VGGLRKLAVPFVASGPSGVAVRTRLKQLAPADEEVLRLVGAHLGTLASRDLKARCADALAHDGEAWAARKREMTPLSSSRWAGAITKASHDQWALSRRCQLAHIQSLEAGISTIRHRLCLPLREKGGRRAPGGYHSRQEWHAKARRLHVLEDRLEQARTDRDAGVVHVVRGGKHLARTRHHLAAAQLTETGWRQRWEAERWFLKADGESGKRYGNETVRVSPEGEVSIKLPAPLKELANAPHGRYVLACQVHFPHRGQEWADRVEANRAIAYRIHYDTARGRWYLTASWQIPRTQTVPIEAALTQGVIGVDMNADHLAAWRLDVHGNPVGDPRRFPFDLSGPAGHRDAQVRHALTGLLHWARACGVTAIAVEDLDFTADKTRERHGRKRRFRQLISGMPTGRLRARLTSMADHTGIAIIAVDPAYTSRWGAQHWQKPLTSKIRKTTRHDAAAVAIGRRAQGYPIRRRTAPPPHDQSDRAGHRTVQARPGIPWREGTRPRIPGPRTRSVGPGRGANAGDQNAQHRSGHSAEHESWQQDSLPLSL

SEQ ID NO: 13486 - protein, 1045 aa, Streptomyces avermitilis
MTTELALLSQVAYHGREITAPRLRGLLALLAGDLRTGCGTGRLVEGLWPDELPERPGKAVQVLVSRLRAQLGAELIVSTPTGYRLALDEAQVDSSALLLYEAASAERARAGDHEGVLAQAEAGLALWDASVGAGAGEDLHDPVVALRADRVRAHRALVRFRALALARVGRREEAAAPLAGLARELPRDEELLAELLRCEAATAGRAAALTRYDAYRRRLRDELGTDPGPGLRSVYQELLRADVPTVRHGVPHEPNPLLGRDADVAAVSGLLREARVVTVVGPGGLGKTRLSHAVSRAAAQPVVHFVTLAGVLADDDVAGEVASAVGAGEGRFGGDAVGGIVAALGAGPALLVLDNCEQVIPGAADLVQALVSRSKELRVLATSRAPLGLTSESVYALPELSPATSVELFTQRARAARPGVELPADQVAEICRHLDGLPLAVELAAARVRVLSVADISRRLRDRFSLLRGGARDAPERHRTLQAVVEWSWNLLEADGRAAMRALSVFPGGFTEDAAQYALGESADALTLLEQLAGQSLIKVGDTPSGLRFHMLETLREFSAARRAEAGEEEAVTARFLLWARDFGRAHHDVLFSGGPRRPWIRIRAEQDNLVLALRYALARADGPTTAALTAALGSLWSTGSNYARLAVLAEETGGPLSHFRPGPENAEDVETARSAATVCTACLFMGRGPHAVRHLVTLRRLPPAPPDTLARALAIVLCAFPEMHPPQYTRLRELCDADAPMLAGMAAGVASYVWETEHETERALECARRMLDTLGSLENPAMRLISHGRISELCLKSGHGAEAYDHLRAALSALDEVGDWSDTIGVRWGLVLACLQRGEVDEAEYWLGLAALEQQPESAESFSTDLPARAEIALARGLTEVGLGLWRQAVERIREGSLLHADDPFVDPWSLEIQSAALAAHAQRGRLEPVAGLAERLRERLLGMLSRSSGDGSPAELPVYGTVLLALGFAGLAGGDPAAVRLVALAERMPAVREFPTLSSARSRQAAENADRAAYDDARSTYATLKREELRAAALHELSAAARG

SEQ ID NO: 13487 - protein, 264 aa, Streptomyces avermitilis
MSTASYAFRDNLTMLRRNLLHARRYPSLTLNLLLTPVILLLLFVYVFGNVMSAGINGGHANRADYVDYLVPGILLLTVAMTSLGTAVAVCTDMTEGIMARFRTMAISRASVLIGHVIGSVLQTLMALVLVLGIGLAIGFRPDASPVEWIAAAALMALTSLAMTWLAVGIGLVSPNPEGASNIGTPLVMLPFLSSAFVPVDAMPGWFRWFAEYQPFSPLIETLRGLLLGSGIGTRNAVLAVAWCLGLSLLGYLWSKARFNREPRH

SEQ ID NO: 13488 - protein, 332 aa, Streptomyces avermitilis
MTTTNHEPAIAATGLRKSYGDKTVLDGIDIQVPAGTIFSLLGPNGAGKTTVVNILSTLISADGGQARIAGHDLAAEAQAVRSAIGVTGQFSAVDGLITGEENMLLMADLHHLSRAEGRRVTAALLERFDLVEAAKKPASTYSGGMKRRLDIAMTLVGSPRIIFLDEPTTGLDPRSRHTMWQIIRELVSGGTTVFLTTQYLDEADQLADRIAVLNGGKLVAEGSAEELKRLVPGGHVRLRFSDPVAYERAATALRETNRDDEALTLQIPSDGSQRELRAILDWLDAAGIEADELSVHTPDLDDVFFALTGSPVPADTNAGKDTDNDNAKETVR

SEQ ID NO: 13489 - protein, 313 aa, Streptomyces avermitilis
MHQPEETNAPAQQDTQQATQDDARAIRALWAEMARGWAAGDAALFAASFAEDCDFTTVRGDKPSGRTGIEAGHDALFHGPYAGTVLDARVVAVRFLRPDLATVEAESTITAPDGEPLATTHALAVVERTAERRWSIRAFHNMLPAPRPAQQAPGPRESTAHEPAVNEPAAHEPTANEPAANEPAARPKLRHLAIVARDPEKLAEFYSSVFAMELFHRDPDGSCFLSDGYLSLALIKHRLDGDTPVGFNHFGFHIEDTAATSEALVAAGTPKPAERFTNRPFAEYRAMDPEGNWFDLSEHGFGGPRPPSDSTGS

SEQ ID NO: 13490 - protein, 218 aa, Streptomyces avermitilis
MSAATNAFGSGLPDARCSTPAPTVLMDDQALGDFLDAAIGEYQLITAEAPLPCFALLLGNAEATTYHVQRIAFGRNARTSDPAARREFRETIVPKFGPAYENEHRGWWMDSRDLLRASREADALGMDLLGSIHMHPDWHRLGPPSERGQTLSERPTPMDRHLFGRTEWPLNIICYLERRGGVFYHALAAWAPPPRRSSEGTECLEVALRIRTSSLTRA

SEQ ID NO: 13491 - protein, 178 aa, Streptomyces avermitilis
VPTHSSGLARYWHTAFVACLLALALALTGCNPHMYDEVPALHDVKRAEVSGSWIGYDRTNVVFRPDGKADIRLLDGQEWDFDDRWRLSGTGTWKLTDKRTGWNDGQHVQLTLTSRTAVATRAPEPNEPLDPSADRPETPKTYTWTFELRRDDKEALKLYFFFGDPDSRSTYILQTDAP

SEQ ID NO: 13492 - protein, 244 aa, Streptomyces avermitilis
MPTKTLRIPTTDGQADAFAAFPDHSERYPGVLMYADGFGIRPVLREMALELAGHGYYVLVPNSFYRHGPAPLVELPEYIGEGIRPAVFAQLMPLIEAHTAERVLSDADAYLRFLTTQPEVGAGPVAVTGYCIGGLYAMRTAAAHPDQVAAVAAFHGPVGVDGANLFSKLTAQVHLGHAEGDMTPEALGELNQALDAAGVGYTSEIYPGTIHGFTMSDTDAYSAFGLKRHWDRLLPLLDRTLANS

SEQ ID NO: 13493 - protein, 69 aa, Streptomyces avermitilis
MSVESVPGGGTQLEWFKSSYSSGEPGSDCVEVATAPDTVHIRDSKNKEGAQLAFPKGPWADFVAHTAKG

SEQ ID NO: 13494 - protein, 70 aa, Streptomyces avermitilis
VIVVIAGHHLDLDVPELPDLQQPFELTYAPDAESGRGLILVEAYADRWGVDDGPAPCKTTWAELDLGHVS

SEQ ID NO: 13495 - protein, 76 aa, Streptomyces avermitilis
VMPSDHDDHAGLTGGFRVFKLRSGTSLGYTEVLHITRLISEPREVQFLEMQYGSIRAQALTPRESLAFIEKVLGET

SEQ ID NO: 13496 - protein, 340 aa, Streptomyces avermitilis
MTLRTRILVLISALVVLAGVATASVLHASARADQRDRAQPGGPRITAGTVALTGDSGRLIFRNMAWGPHRDELTTVQASDPAGPRTASTVKCLRFHAASGTGVCLRAVHGTVQDTYRAVVLDAHLHETAHYDVPGIPSRARVSPSGRFAAWTAFVGGDSYAGTNFSTRAAIVDTRTGKLTPSLEAYRIVKDGRTYRAADVNFWGVTFAADDRAFYATLATRGRTYLVRGDLHTRTVTTLHTNVECPSLSPDGTHIAYKKRVKGLPKDAPWHLYVLDLRTMRETALAEPRSVDDQAVWRDDQTVVYALPGDYGADLYSLPSDGTDTPRRLLTAGVSPVYLD

SEQ ID NO: 13497 - protein, 439 aa, Streptomyces avermitilis
MYVADSRAGTPDSPAPESAPASAEGAARPRAGRRRAAVAPTVLALGTVSLITDVSSEMVTAVLPLYLVTGLGLSPLGFGLLDGIYNGFSALVRLAGGHLADRGGGRHKWVAGAGYALSAACKPLLLLAHTLTPIGLILAADRTGKGLRTAPRDALISLSSTSQTRGRAFGVHRAMDTAGALFGPLVAFLILRATVDGYDAVFTVSFCVAVSGVLVLVLFVPGGSTRPPATTDTPGPTPRPTLRAALALLRRPALRRLAVCALLLGLATVSDSFVYLLLQRRLGVPDRWFALLPLGTAAAFLLLAVPLGRLADRVGRWRVFLAGHGALLLTYGLLLSSWHGTALPYAVLVLHGGFYAATDGVLMAAASDSVPDELRSSGLALVQTGQALARFVCSIGFGAAWTAWGDRTALTASAMALAVCALFSLGLRPPRPPRSEGLA

SEQ ID NO: 13498 - protein, 297 aa, Streptomyces avermitilis
VSGRNVYRRSRALVASAAAFAAAAVGLWTGFGGSSPAQAAAAAAVPSPDHVVVVVFENHAYSQVINSSSAPYINSLRTGGANLSQSYAETHPSQPNYFALFSGSTQGVTDDSCYTPGFSSAPNLASELLAAGKTWASYNETLPSQGSTTCSSGTYARKHNPWFGFSNVPTSSAKTFTQFPTDYTTLPQVSFVVPNLCSDMHDCSVATGDTWLKNKLGAYASWAKTHNSLLVVTFDEDNRLSGNRIPTVLYGQQVTAGSSSSATYNHYDLLRTLEDMHGLPHAGNAASGKDITGVWTS

SEQ ID NO: 13499 - protein, 1000 aa, Streptomyces avermitilis
MTAPGRRSSTFSRLLRHGFTDPSAAERLLESAELEPVKADPVLLEALGATADPDLALLGLVRLVEAQDDHTARRELLDTLIAAKPLRDRLLGVLGASAALADHLARHPRDWQALVTYEPRDLHPGVEEFERGLAEAADPVSLRVAYRRCLLSIAARDVCGTTDLAQTAAELADLATATLRAALLIARTAAPDDAAICRLAVIAMGKCGGHELNYVSDVDVIFVGEPANGADEGKAVQAATRLASHMMRICSETTVEGTIWPVDANLRPEGRNGPLVRTLSSHLAYYQRWAKTWEFQALLKARPVAGDIGLGEEYVATLAPLVWQAAERDNFVADVQKMRRRVVANIPAAEIERELKLGPGGLRDVEFAVQLLQLVHGRADASLRSGTTLDALKALAAGGYVGRADAVQLDEAYRFLRTMEHRIQLFRLRRTHLVPEDDADLRRIGRSLGLRADPITDLNREWKRHATVVRRLHEKLFYRPLLDAVAQLAPGEARLSPNAARERLVALGYADPAAALRHLEALASGVTRKAAIQRTLLPVLLGWFADSADPDAGLLNFRKVSDALGKTPWYLRLLRDEGAAAENLARVLSAGRLAPDLLMRAPEAVALLGDGDGGRGGLEPRGRAQLEQEVLAAVGRAGGSEQAVTTVRGVRRRELFRTAARDIVSSYGTEETPAEADQGALVDLVGGAVSDLTAATLAGTLRAVVREGWGDTLPTRFAVVGMGRFGGYELGYGSDADVLFVHEPREGVDEQEAARAANAVVSEMRRLLQIPSADPPLLIDADLRPEGKSGPTVRTLTSYEAYYRRWSLVWESQALLRAEFVAGDEELGQRFIELIDPFRYPAEGLGDDAVREIRRLKARMEAERLPRGADPTLHTKLGRGGLSDVEWTVQLLQLQHGWVEPGLRTTRTRPALAAACAAGLLTGEDAAILDEAWVLATRVRNAVMLVRGRAGDTFPSDGRELAAVGRYLGYGPGHVGDMLDDYRRITRRARAVVDEQFYGA

SEQ ID NO: 13500 - protein, 329 aa, Streptomyces avermitilis
MPPQLTTALRMGTLALLWGSGFLWIKLALNHGLSPAQITITRCALGTLVLLALARRSAQRLPRDRATWARLAVAALLCNAVPFALFSVGEQTVDSGVAGVLNATTPLWSLLIGVLLGTDRVLHPLRLTGLVLGFAGTLLIFAPWHRSGLMSWGALALLGAAASYAVAFAYMARKLTGRGAPMAVSAAQLLMATAWSTLALPAAGPVHADATALLAVTVLGVFGTGVTFYLNYRLIADEGPTSAATVGYLLPVVSVALGALVLGETIGLRVLAGMAVVLAGVAMTRGVGTRGGSPAGADGAATTGSSRTGADEVPSASARRRTGAAPHAP

SEQ ID NO: 13501 - protein, 297 aa, Streptomyces avermitilis
MLDVRRMQVLRAVVLSGSVTAAAADLGYTPSAVSQSVAALEKQTGTELLERTGRGVRPTAAGLLLTEYADAIGRQVAEAETALADLRAGRTGRLAVRYFATAGAPLVAPALARMRAEHPGVRVEVKLIDPEDPLPDVKEGRADLALVVRSGEAGHEGIRLVHLLDDPYRVVLPEGHRLADREVVELSELAEEPWVGSEWPGPCLDAQLDACAAAGFRPGFVVESGDYLTAQGFVAAGLGVSLIPRLGLGGRPAGVVVREVRGPEPVRRIYAAVRETAPPQPALRGLLEALREAAGAH

SEQ ID NO: 13502 - protein, 291 aa, Streptomyces avermitilis
VPMGETTVTTLDGRDPADPQPVAEESRDRAEERFLRRLRAPRRPRFWFEILLIAVSYWTYSVIRNAVPEQRAQALSNADLLWRVEHHLGIAVENSVNHAVNSVTWLIVGMNYYYATLHFVVTLGVLVWLYHSHPGRYAAARLALFATTAVALVGYYFYPLAPPRLMNGAAFVDTVLVHQTWGSMASGDLKHMSNQYAAMPSMHIGWSLWCGLTIFALASAPWARILGLLYPAGTLLVIVATANHFWLDAVGGMLCLSFGFLLARLWYGTLPYALPRWVPGTRGAPLLPAET

SEQ ID NO: 13503 - protein, 344 aa, Streptomyces avermitilis
VTTRLADIAAQAGVSEATVSRVLNGKPGVAATTRQSVLAALDVLGYERPVRLRQRSEGLVGLITPELENPIFPALAQVIGQALTRQGYTPVLATQTPGGSTEDELTEMLVDRGVAGIIFVSGLHADTSADMQRYDQLRAQGVPFVLVDGFSPKVQAPFISPDDRAAMTLAVTHLVSLGHTRIGLALGPKRFVPVQRKIEGFVRSVQEQLGLSPDDVERELVQHSLYTLEGGQAAATALMDRDCTAVVCASDMMALGAIRAARQRGLDVPKDISVVGFDDSPLIAFTDPPLTTIRKPVPAMGQAAVRTLLEEIGGTPAPHSEFVFMPELVVRGSTASAPGDRNRP

SEQ ID NO: 13504 - protein, 423 aa, Streptomyces avermitilis
MRRGIAATALVASLALAATACGGDSGSDKADGPVTITWWDTSNATNEAPTYKALAKKFEAANSNIKVKYVNVPFDQAQNKFDTAAGSKGAPDILRSEVGWTPAFAKKGYFLPLDGTEALADQDKFQASLIKQAQYDGKTYGVPLVTDTLALVYNKKLFQKAGIGTAPSTWDELKTDAATIKKKTGVDGYWGSTQAYYAQTFLYGEGTDTVDATAKKITVKSAAAVKGYKTWQSLFSGKGLHKADTTADAYAHIQDAFVNGKVAAIIQGPWEITNFYKGSAFKTKDNLGIATVPAGSAGKGGAPTGGHNLSVYAGSDKAHQEASLKFLKFMTSASSQEAVALKNSTLPTRDDAYTTQVKSDPGIAGYQGVLAAAQPRPALPEYSSLWGPLDTELPKIAGGKESLDKGLSNAELAIAKLVPDFSK

SEQ ID NO: 13505 - protein, 334 aa, Streptomyces avermitilis
MTVAIDRATGKRRGDRAPRPGLVQRVKNGYQKHWYAYVMIAPVVIVLGVLVGYPLVRGIYLTLTDANSLNSARTIGVNHIDATYKFIGLDNYTDILFGPTAYDRFWSHFLWTVFWTAACVALHYTIGLGLALMLNEKLRGRTFYRLLLVLPWAVPTFVTVFSWRIMLADSGVLNQVLGALHLPQPQWLEDTFWQRFAAIMVNTWCGVPFMMLSLLGGLQSIDSSLYEAAEMDGANAWQRFRHVTLPGLRAVSSTVVLLGVIWTFNQFAIIFLLFGPTGAPDAQILVTWAYFLGFGQQPRDFAQSAAYGVLLLSILTVFTSFYFRWLKRNDQLAV

SEQ ID NO: 13506 - protein, 302 aa, Streptomyces avermitilis
MSTTTFEKAPAGPVSDPQPRSGRPPRRGERRPLRAALLHGGLAVASLIALAPVAWLFFLSLGPDKDDYLHPGKILGKLSFSNYSFVLENTGFFDWFKSTMIVALGTTLIGVFVAATTGYAVSRMRFPGYKQLMWVLLLTQAFPIAILIVPMYEIFGQLGLIDTYWALIVINCTTAVPYSAWLLKGYFDTIPFEIDEAGRVDGLTPFGTFFRLILPLARPGLAVAAFYNFITAVSEVAFATTFMLDDSKYTFAVGLQTFVSQHDAQWNYMAATAVLIAIPVSVFFYVVQKNLVTGLTAGGTKG

SEQ ID NO: 13507 - protein, 616 aa, Streptomyces avermitilis
VAAAVSSPKHFEQGGTPDPAGTAAASLPAPYTRLYDPTPPPLSAALERGDPHRIKDAMSQHSADQAPTSALATVAAHRDWWRDAVIYQVYPRSFADSNGDGMGDLEGVRSRLPYLRDLGVDAVWLSPFYASPQADAGYDVADYRAVDPMFGNLLDADALIRDAHELGLRIIVDLVPNHSSDQHEWFKRALREGPGSPLRERYHFRPGKGKNGELPPNDWESIFGGPAWTRVTEPDGTPGEWYLHLFAPEQPDFNWEHPAVGDEFRSILRFWLDMGVDGFRIDVAHGLVKAEGLPDLGAHDQLKLLGNDVMPFFDQDGVHDVYRQWRTILDEYAGERIFVAEAWTPTIERTANYVRPDELHQAFNFQYLGTYWDAAELRSCIDRTLDAMRPVAAPATWVLSNHDVTRHATRFANKAGLGTQIRTAGDRRLGLRRARAATLLMLALPGSAYLYQGEELGLPDVVDLPDEVRQDPAYFRGEGQDGFRDGCRVPIPWTREGSSYGFGSGGSWLPQPAGWGELSVEAQQGVTGSTLELYRTALAVRSERPDLGAGDSVTWLEAPAGVLAFRRGEFVCTANTGAAAVTVPAYGSVLVASGEGTVVGTDEAQLPADTTVWWAV

SEQ ID NO: 13508 - protein, 460 aa, Streptomyces avermitilis
MARKALAVSLALAAGLTVPPAVSPTTAAASPPGTKDVTAVLFEWKFDSVARECTNTLGPAGYGYVQVSPPAEHIQGSQWWTSYQPVSYKIAGRLGDATAFQNMINTCHTAGVKVVVDTVVNHMSAGSGTGTGGSAYTKYNYPGLYSSYDMDDCTATITDYTNRANVQNCELVGLADLDTGEEYVRKTIAGYMNTLLGYGADGFRVDAVKHIPAADLANIKSRLTNPSVYWKQEVIYASGEAVQPTEYTGNGDVQEFRYAYDLKRVFNNENLAYLKNYGEGWGYLNSSVAGVFVDNHDTERNGSTLNYKDGANYTLANVFMLAYPYGAPDINSGYEWSDADAGPPGGGTVNACWQDGWKCQHAWPEIKAMVAFRNATRGESVTNWWDNGGDAIAFGRGAKGYVAINHESGSLTRTYQTSLTAGTYCNVQNNTGVTVDSSGRFTATLGANTALALYSGKSTC

SEQ ID NO: 13509 - protein, 1806 aa, Streptomyces avermitilis
VDLIPRGSAPRTRRTHRHSRTAAAVAAAALAVSLAQPLEARAATPPAPPSDAKLAAEPARHDATREQFYFVMPDRFANGDTSNDKGGLTGSRLSTGYDPTDKGFYQGGDLKGLTRKLDYIKGLGTTSIWLAPIFKNQPVQGTGKDASAGYHGYWITDFTKVDPHFGTNKDLETLISKAHAKGMKVFFDVITNHTADVVDYEEKSYGYLSKGAFPYLTKDGRPFDDAGYTDGPRKFPAVDGDSFPRTPAVAARKKNAKVPSWLNDPTMYHNRGDSTFAGESSTHGDFSGLDDLWTERPEVVRGMEKIYEKWVRDFGIDGFRIDTVKHVNTEFWTQWATALDAYAKKRGKDDFFMFGEVYSADTSVTSPYVTQGRLDSTLDFPFQDAARSYASQGGSAKKLASVFGDDYKYTTDKANAYEQVTFLGNHDMGRIGYFLNQDNPKATDAELLRKDRLANELMFLSRGNPVVYYGDEQGFTGSGGDKDARQTMFASKVADYLDDDEIGTDRGHASDAYDTSAPLYKEIAALSKLRKDNPALADGIQTERYAADGAGVYAFSRTDARTGTEYVVAVNNADKASAATFATGSADTAFKGIHGTDDVLKSDADKKITVTVPAGAAVVLKAAGRPGTPAAKPSLTLKAPDAGATGTVELSADVDGGRLNRVVFAAQVGNAKWRTLGSADHAPYRVTQTIGKDVPAGTALRYKAVVIDAAGRTASATAASTTGTPPAAETPTASSRDYAIVHYKRPDGDYTDWRLYAWGDLADGESTTWPAGHDFVGRDAYGAFAYVKLKPGASTVNFLVIDKDGDKDVSADRTIDVTKAGEVWVEQGKETVRTERPDYPAQDKTKAVIHYHRADGDLTGWGLHVWTGAATPTDWSKPLEPVRTDAYGAVFEVPLTDGATSLSYIIHKGDEKDLSADRSLDLTADGHEVWLLNGQENHLLPQPAGSAAALDLTTSKAVWIDRNTVAWNGSDAAASTQLLSSRDGSIAVKDGSLTSDDERWLRLSKTSLTDAQKAAFPHLKSYTAWSVDPRDRDRVREALAGQVVASQRAANGAVLAATGVQLAGVLDDLYDATKADLGPTFRGGHPTLAVWAPTAQSVSLELDGAHVRMKRNNATGVWSVTGPASWKGKPYRYVVKVWAPTVRKVVTNKVTDPYSVALTTDSERSLVVDLDDRSLAPSGWSSLKKPKAVPLRDAEIQELHIRDFSVADRTVPAKDRGTYLAFTDKNSDGSRHLRQLAESGTSYVHLLPAFDIATIAEKKSGQQATDCDLASYAADSEKQQECLTAVAAKDAYNWGYDPYHYTVPEGSYATDANGTRRTVEFRRMVKSLNQDGLRVVMDVVYNHTAAAGQAGTSVLDRIVPGYYQRLLADGSVATSTCCANTATENAMMGKLVVDSLVTWAKEYKVDGFRFDLMGHQPKANILAVRKALDALTVAKDGVDGKKIILYGEGWNFGEVADDARFVQATQKNMAGTGIATFSDRARDAVRGGGPFDADPGVQGFGSGLYTDPNSSDANGTPAEQKARLLHYQDLIKVGLSGNLAKYRFTDSSGKEVTGSEVDYNGTGAGYADAPGDALAYADAHDNESLYDALTYKLPKGTPAGDRARMQVLAMATAALAQGPSLSQAGSDLLRSKSLDRNSYDSGDWFNAIHWNCQDGNGFGRGLPMAADNKSKWPYATPLLTSVKVGCDQIEGTSAGYQDLLRIRTTEPDFSLSTAGQVQSKLTFPLSGKDETPGVITMKLGDLVVVFNATPDQQEQTVAALAGKDYALHPVQAAGADPIVKSASYTAKSGMFAVPGRTVAIFSQVAR

SEQ ID NO: 13510 - protein, 534 aa, Streptomyces avermitilis
MDANGRQTDSTVMVVDDVPTSRYAMGAVLRRAGHSVVPVASAGEALVELDVLLRAGSLPDVALVDVGLPDMSGFELCRRLKSQPPTAALPVVHFSAAALAPGDRCQGLDAGGDAYLSVPAEPEEIQAVVRAAVRGARLRTGAEALARRLTLLSETIVAVQAARCPTELAHAAAQGTARLTGDFAAVFVLGEDGELYPGLSRRRARTSLPGPGAHEAVARLIRGTTAGHAGVRSIVVPAPLWPAGFLRPGVSEDARVVLAQTQEGKPAVCLATPAHARAQETGALVARLAQATALAAEPLLMYQVERHVALTLQHSFLPQKPADLPGMEVAVRYVPASRQTEIGGDFYATLRTSRGVLTGVGDVVGHSLDAATVMVEIRHALRAYCVEDPDPAVLVTRLDRMLQHYHPEATATVCLALVDPDSGHVSIANAGHIPPLIVHDDGTARYPGAAGPLLGLGLERPPATEEFLTPRHRLLMVTDGLIETRGTDLSVSMEQLRMAAADGPSGVGALCDALLDCFGRDREDDIALLALRLG

SEQ ID NO: 13511 - protein, 118 aa, Streptomyces avermitilis
MPQITVDYSAELAPGFDRPGFARALHEEVVRTAAAKPEACKTQFRRGEDTTVGADGEGHAIVHVTLGLLAGRSDETKARLTEAALELLRQYVKPDGGLALHASAEVRDLDPSYRKFDA

SEQ ID NO: 13512 - protein, 233 aa, Streptomyces avermitilis
MTTGVRRRMGVEERRQQLIGVALDLFSRRSPDEVSIDEIASAAGISRPLVYHYFPGKLSLYEAALQRASDDLAGRFVEPREGPLGARLLRVMRRFFDFVEEHGPGFSALMRGGPAVGSSTTNALVDGVRQAAYVQILSHLKVTEPPVRLELVIRSWISLVESTALIWLDGRRIARGELEVQLVHDFAALAAISAAYDDELAALLRDVLRDEAPDGPFSDLVVRLIALTSPPTA

SEQ ID NO: 13513 - protein, 638 aa, Streptomyces avermitilis
VQSQDVAPRPTPASGPVVDVEQAEAALVEHYPRLVRLAYLVLPPSLGRNRRVLTAHALTQRALPRGRTSAAVIPAQAKGRDGDPGYALVRLHVVRTALEAGLPLGRMAWPKRSQLPPLLPQVWGLRLFPRSGGADELALDQRLSALSGPARAAHVLRGLEKLSEDSVRRVLDAAGVADPAAAIAEAAKVPAPDALLDSPEFDPCSLHARPTDLMRRRQHMKAALAAAAAVAVCGALLGLPGGGWAPDGAAAPSYAENPAARAALDPARLTKTAATAWKTSARTDFSVWPARGDRTGDTALLRRALAVWARPGEAVRVSATPGTPSGAPAGPPQLLYAGDVDSAHVVLLYDGLRIARYAEPKDGTGAAALDFARVDGASGAEAEALVLGRADGNVRYLTAPWVTGAAERDLMKPASGAMDLNLTDGVAAPLAGSAQRTGACTSWNALQLTDGSGTRLLTDLGELIPAHLTTGRPSAPREASRTAALHSWAPFACSLASVRSQGVRSVNAWQFAQQALPDGSGSAGWVCTRADTWRGGGTRVLAQFHTPGGAYGAVAAKAEDSPACGARDPHVLAGVLWKSGTGAWYLLAAGSSDTASIRATGGIDGAAEGNLLTVRTERGARAGLKGVLADGRPISGLR

SEQ ID NO: 13514 - protein, 170 aa, Streptomyces avermitilis
VGPVTTENWDERVAAAWATFDDYAEKDAADFRAVVDALVAELPADSPFGPFEQACAWDSTGHSDKAVPLYREALARGLSGYRGRRAKIQLSSSLRNIGQAEEGVKLLTPELEGPSDELDDAVRACLALCLADLGREREGLSLVLGALAPHLPRYQRSMANYARLLVEPED

SEQ ID NO: 13515 - protein, 1038 aa, Streptomyces avermitilis
MNGPSRRTVLGTAGAIGLGTTLGTAIPAHATESPGEGPALDTAPARSALNRLLPGHAGQFRLSLVGRTRGRDRFRVTGGTGRIQVSGTTPAVLLTGVHWYLKYVCGAHLAWNGGQLDLPRRLPAPARPLERSTALSHRFALNDTNDGYTAPYADWSYWEHQIDLLALHGCNEVMVIAGTEAVYHRVLKDFGYSDTEARAWLPAPSHQPWWLLQNLSGYGGPLSPELIAERAGLGRRICDRLRALGMAPVLPGYYGHVPKGFVERNGGDAHVVPQGIWHGFERPDWLDPRTASFAAVAKSFYRHQKDVFGKAAHFKMDLLHEGGTAGDVPVPGAARGVEKALQAAHPGATWVILGWEANPLPALLDAIDKKKMLIVDGVSDRYTSVTDREKDWGGTPYAFGTIPNFGGRTTIGARAHLWNEKFFAWRDKAGSALAGTAYLPEAADRDPAAFELFSELAWSAGKIDRAAWFSSYADFRYGGRDASAQKAWRALHDTAYQQHAVERSDAHDSLFCARPDLAANRAAEYAPRALTYDPGRFDAALSGLLGVAGGLRGSAAYTYDLVDVARQALAHRSRQYLPLLRAAYARKDAAAFTSLATLWLRLMGLSDEVTGTHPAFLLGPWINDARLLATDAGERAEFERTAKVLLTVWGGRATSDAGDLHEYAGREWNGLMADFYLPRWKKWLDALADALATGTPPAAVDWFAVEEPWTRERKDYPLRPVGDPYRTAARVRDVLARAPYQGSLKVTAEPAAFPPGGHARVTAVFTNVNGLRSTGRVDFALTGIDAEPQGPTSLAGVPAAGSGTVRWRASAPGTPLDRPLRPLPYTITVTYGPTGEDRVSGAFDGTLFEAGPLAAGWKTYTNNAAVIGQLGDRFAIDGAGADLWKGTAEFGTAYRAKALRDGGSVTVKVDAQAVTGAWARAGIVVRDSLATPGSAGFLDLAVTPANGVVLSYDTNGDGTLDTYKRITGIKAPVLLRLTRAEGSYTGACSTDDGATWRTVATVRVPGAADTQDVGLFMSATNGGSGARGTVEFSGWKLG

SEQ ID NO: 13516 - protein, 155 aa, Streptomyces avermitilis
MRLTREKLVAGAAVALLALTGCGGSSGSDDGAAKAVPATATGSLEDLAAEVKCKPDIQTDADEIRQAVCKSTSRKFILATFATDRGQREWLNEAKDYGGFYLVGAKWVAVGDQKVVKTLRGQLGGTMEEGTSHASHSSGTGSDASHEGTHSGHSG

SEQ ID NO: 13517 - protein, 514 aa, Streptomyces avermitilis
MGRNTRKRRSSLANKAIAASAALALGGGGLIWANFYASAHETNSNSWKNNTKAAAATVATISCPDIGQKLTKVPRGARSGVYKELATLDKQITEAYARLASTRQAQTKDANFVQNAILGPLKQKRTAVIGRIKIDFKRVGAAAPNSLDALAACTGSGANQTTAGGQNNNGQQQNNGGQQQNGGQQQNNGGQQQNGGQNNGQQQGNGGQAGNGPVAADFVDITKVQANVQAKARAQGGGSTGTFTSSCGVNANKKFNTDNVIVAPGVTNGAHHLHDYVGNQSNDAFANNDTFAAAQTSCSNQGDKSSYYWPVVRIQNGTQDFDQNNDGGGKEGNVGQIQQAKQASIKFVGNAKSKVVAMPKFLRIITGDAKTLTNGLANANAHWSCTGFENKVQLTEQYPICPQGSSVVRSFAFQSCWDGQNIDSANHRTHVAFADAQGNCANGFKAIPQLTMRLVYDVPAPTIENGQIKNAYAVDGFPEQLHKASTDHDDFINVFDENVMNQMVNCINTGKKCK

SEQ ID NO: 13518 - protein, 217 aa, Streptomyces avermitilis
VRVVLAEDLFLLRDGLVRLLEAYDFEIAAAVESGPELTRALAELTPDVAVVDVRLPPSHTDEGLQCALQARRDRPGLPVLVLSQHVEQLYARELLADGTGGVGYLLKDRVFDAEQFIDAVRRVAAGGTAMDPQVIQQLLSRRSAGSKPLGRLTARELEVLELMAQGRSNAAIAGQLVVTERAIAKHTSNIFAKLGLEVSDDDNRRVLAVLAYLDQGR

SEQ ID NO: 13519 - protein, 426 aa, Streptomyces avermitilis
MEISSGGSGMATRARGVVRDGTRALVLAVVGLPGALVLYVLAVVSLLLVPLGVGIVTTPWVLAGVRGFADWRRVVAAEWCGVRIPSGYRPVPVDANPWGRCFRLLSDRATWRDLIWLQVDMTAGFVTALLPAALLFYPLEGFALAAGLWRVFTDGTYIGWWYAFVPVSGQASALAAGALGVVFLVASYHLTPSLLRVHFLLTRAVLAPGQGELAERVRVLTETRRAAVDTSAAELRRIERDLHDGAQARLVAMGMDLGTIEALIEKDPAKARELLARARKSSADALTELRDLVRGIHPPVLAERGLGDAVRALALRVPIASEVNVDFDGRRAAAPVESAAYFAVSEVLTNAVKHAGADRVWIDLRHSDGMLRIAVTDNGRGGARIGTGSGLAGIERRLGTFDGVLAVSSPAGGPTMVSLEIPCELS

SEQ ID NO: 13520 - protein, 339 aa, Streptomyces avermitilis
VVGMRLLMLGGTEFVGRAMVEAALGRGWEVTVFHRGRHQPPPGVRSLIGDRTAPDGLAALAEAVAGGAQEWDVVVDTWSAAPRAVRDTARLLAGAARRYVYVSSCSVYAWPPAAGYTEEAPLVADASADAEQTDYARDKRGGELATLDAFGAERSLLVRSGLILGPYENIGRLPWWLTRTARGGPVLAPGPRELPLQYVDVRDLAEWTLGAAERGLNGAYNLISPQGHTTTGELLDACVRVTGGAAELRWTDPEVILDAGIEPWTQLPVWAPPKSEGHAALHSADVSRALRDGLRCRPVAETVADTWAWLQDIGGVAPGRPDRPPVGLDPEVEAKVLGV

SEQ ID NO: 13521 - protein, 194 aa, Streptomyces avermitilis
MANTRSFSSVATVPSPAPSPGSARHRLRAVDRDEVVDVADFLPPGATWLPAPQHTLPTLPGQPPMIGYLVLVPADQQTVLPVAVPDQPEASDLTAGDGPLIRVDTVQRTAEVDGQPLDLTYLEFELLAHLVAHPHRVHTRDQLVTTVWGYGHVGDGRTVDVHIARLRRKLGADHRQTIQTVRRVGYKYTPPTGR

SEQ ID NO: 13522 - protein, 69 aa, Streptomyces avermitilis
VRNVNFTPRKRPSSERSLLPGPGVCFNGSMASFQKYTATGRHDLEPFWPSRQHHDFDRVCCRAMNAPAL

SEQ ID NO: 13523 - protein, 306 aa, Streptomyces avermitilis
MEIDGALAIKVETENWQRHARISAERLRELVGRIGTAGDRWLVVQRIPDIPDVFAQVWHEEGGDYRLEHRLTEDAFFGTDLTDPDRVADLLTGWARQEAAWDAGVTWEPVDLGPQEEVPELADDVRGKVEDRVRTRLRCGYDDRKVLAEIAEEYLVDGGDRPVSKAQARRLVDRLWLERLAEQETWEGVTDPERLALAFAALEASGITARENFACCRGCGMAEIGAEREDARGFVFFHQQVTEHAADGYGLTLYYGGFDGAEQTTVAVGHEVVAALTAAGLSAQWDASPDKAISLTPLTWQRRLVG

SEQ ID NO: 13524 - protein, 342 aa, Streptomyces avermitilis
VTFKAEYIWIDGTEPTAKLRSKTKILADDAKGAELPIWGFDGSSTNQAEGHASDRVLKPVATYPDPIRGGDDVLVMCEVLNIDMTPHESNTRATLAEVEEKFGAQEPIFGIEQEYTFFKGSRPLGFPEGGFPAAQGGYYCGVGSDEIFGRDVVEAHLENCLKAGLGISGINAEVMPGQWEFQVGPLAPLEVSDQLWVARWLLYRTAEDFGVSATLDPKPVKGDWNGAGAHTNFSTKAMREGYDAIITACESLGEGSKPLDHVKNYGAGIDDRLTGLHETAPWNEYSYGVSNRGASVRIPWQVEKDGKGYIEDRRPNANVDPYVVTRLLVDTCCSALEKAGQV

SEQ ID NO: 13525 - protein, 231 aa, Streptomyces avermitilis
MSRRRTLSTKKKLALLLSAAAVAGGGAFALAATSNAASVQNASNSTVCQGLATAIGNNQKFIDGQRAKPDAQSEARIANREAVIAEIKRQQEASGCEVGESAQAADGSAAAGGSAQDSQATQPSQAATAPADNASATAPAENAGGNAASGEQVCKGSTVTLSGEGGAPAASSNQFPAGTKLKVTNLDNNKSTTVEVTSVSGSCALLNNAAFEQVREPGKFLIRRAVIEKVG

SEQ ID NO: 13526 - protein, 119 aa, Streptomyces avermitilis
MEIWINPACSKCRSALSLLDAEDAEYTVRRYLEDVPSEDEIRGVLQRLGLEPWDITRTEEAVAKELGVKEWARDAGSRDQWVRALAEHPKLIQRPIITADDGTALVARTEEAVRDALSR

SEQ ID NO: 13527 - protein, 102 aa, Streptomyces avermitilis
VPAAALKPKPTQSTSRRPVPLDLPYQPVEKRPLPPGRPREWYMTHNRRLKAMRLAIALLDSGVYVPNQARNETIRSTAETIGVHPPSDTTCHMVRALIRYSR

SEQ ID NO: 13528 - protein, 558 aa, Streptomyces avermitilis
MNGGMSELLSFAYEHDGERLSGMYGGDDDGDDAGGVEGGRESPTVVLLHGAGDGCAGRLLPLLAEFVARGCRGLAFDFSGHGQSTGALAESSLRRRFAQAVAVIDARVPGDGPLVLVGFSMSGQTVADLAAHYGERVAALGLCAPAVYAAAAWPVPFGAGDGRFSEIIRAADSWRESPALDVLRAYGGRAVLAVPGTDTVIPPAVTAAVTAALATNAQFSLVELPDAEHTLGLWFRDHEDDRRRFVDAVLTGRGEGGWTATRAWVAKQLPAGRRVRDSARLRGGWSSQIRRLTLDDGTGLVLRTFVRPFFRRHAPGLLSREASVLALLAAQDGTPVPEAVAVDATGEHCDHPSLLMSLLPGAVRVDEEDLDRRLDLLARQLVRIHTVVPDERPRPYQAWTSPERVRTPGGALWDRAVAVLRREPPAYEGCFLHRDFHPGNVLFDGAGDTLRISGVVDWVETSWGPADLDVAHCSTALALLHGEAYGLGFRERYEAHGGRRLADGADHLYWRLLDTLAYSPDAEKLAAPWHELGRTDLTREVLGARLEAYVGGLLRRYG

SEQ ID NO: 13529 - protein, 213 aa, Streptomyces avermitilis
MGFLDILLGRTKPVAPDLDRLFGLPSAAVTLEAAAGFTPTGTGAVCFSTVEGAAFAEAHQEVRALLDADSERRNSPLPEQGRELGGGPPVELSRDEYGYSWLVSRRTPDDLPALVSDLHAVNSALEGSGFGPQLLCSVAGFRSAATGRDGGLRRLGLVYLYKRGTFYPFAPLAGAGRRRDNALELQVKAALADDLRIEQDLTRWFPIWGAPGL

SEQ ID NO: 13530 - protein, 310 aa, Streptomyces avermitilis
VMQMQSRFQSDRRLTARMTVTLFLLGLLYLAFVAALIVLLKSWVLVVVIAAAFLGAQYWFSDRIALYAMRGRIVEREEYPQLHGVVDRLSAVADMPNPLVAVSDLEMPNAFATGRNADHAVLCVTTGLLRRLEPDELEGVLAHELSHVAHKDVAVITVASFLGVIAGLIVRFAFYSQFFGVRGRKDQNTVVIFMAVLAVSAAVYALSFLLIRALSRYRELAADRAAALLTGRPSALASALTKVTGDIARIPTKDLRSAQAFNAFYFTPALGTTPGLERLFSTHPSLEQRLEQLGRISAELGEAATPGKAR

SEQ ID NO: 13531 - protein, 107 aa, Streptomyces avermitilis
VPRKDRTGGWKEDSPMKAQRARRLFAVSAVGVLMAGGAAIGAAGTASAAAPAQAPTQVTTHGCSNWGGRGFVSNCGFGFNNGFNNGFGFNNGFGNGFGGGVVVILVS

SEQ ID NO: 13532 - protein, 469 aa, Streptomyces avermitilis
MFQNADEAKKYIADEDVKFVDVRFCDLPGVMQHFTIPAEAFDPAEELAFDGSSIRGFQAIHESDMALRADLSTARVDPFRRDKTVNINFFIHDPITGEQYSRDPRNVAKKAEAYLASTGIADTAYFGPEAEFYVFDSVRFKTAENESFYHIDSEAGAWNTGAIEDNRGYKVRYKGGYFPTPPVDHFADLRAEISLELANSGLQVERQHHEVGTAGQAEINYKFNTLLAAADDLQLFKYIVKNVAWRNGKTATFMPKPIFGDNGSGMHVHQSLWANGDPLFYDEAGYAGLSDTARYYIGGILKHAPSLLAFTNPTVNSYHRLVPGFEAPVNMVYSQRNRSAAMRIPITGSNPKAKRVEFRAPDSSGNPYLAFSALLLAGLDGIKNKVEPAEPIDKDLYELAPEEHASVAQVPTSLPAVLSALEADHEYLLQGNVFTPDLIETWIDYKRTNEIAPLQLRPHPHEFELYFDV

SEQ ID NO: 13533 - protein, 163 aa, Streptomyces avermitilis
MRAQYRGRVDNRQVIGSWLSGPREAAEQAGADFGYRGEQLGLPEEGPGSIARPGRRFGALAVDWGLCLLIAYGLLTHGYNQTTGNWALLVFLGLGFLTVGTVGFTPGKRLFGLRVVAEGTGRVNPLRAVVRTVLLCLAIPALIWDRDGRGLHDRLARTVEVRI

SEQ ID NO: 13534 - protein, 233 aa, Streptomyces avermitilis
MARKEPAADAANPGRLKQIALTYKMTRKADSKIGLVLAAVGIITFGVFLAIGFLIGHPYYLGILGLLLAFLASAIVFGRRAERAAFGQMEGQPGAAAAVLDNIGRGWTTTPAVAMNRSQDVVHRAVGKAGVVLVAEGNPNRVKSLLAAEKKKMARIVADVPVHDVLVGTGEGQVELKKLRTTLLKFPRVLTGPQVTATNDRLRALGDLMSNMPLPKGPMPKGMRMPRGGPKAR

SEQ ID NO: 13535 - protein, 65 aa, Streptomyces avermitilis
MQAAPVRATAIPSFTDALRAVESLLMSGGQRTARRNAWTSVQEDRRRAKDRVEAQRVLEAVSTRP

SEQ ID NO: 13536 - protein, 328 aa, Streptomyces avermitilis
VSAVAPDGRKMLRLEVRNAQTPIERKPEWIKTRAKMGPEYTKMQNLVKSEGLHTVCQEAGCPNIYECWEDREATFLIGGDQCTRRCDFCQIDTGKPEALDRDEPRRVGESVVTMDLNYATITGVARDDLEDGGAWLYAETVRQIHAQTAGREAGRTKVELLAPDFNAEPDQLAEVFSARPEVFAHNVETVPRIFKRIRPGFRYERSLKVITEARDYGLVTKSNLILGMGETREEVSEALRQLHDAGCELITITQYLRPSVRHHPVERWVKPHEFVELKEEAEEIGFSGVMSGPLVRSSYRAGRLYQMAMELRQSAAPQGGAQVASQAV

SEQ ID NO: 13537 - protein, 265 aa, Streptomyces avermitilis
VSELRFVHMGFGAEAVEYQAAWDEQRRVHAARFLDEVPDTCLLLEHPPVYTAGRRTADNERPLDGTPVVDVDRGGKITWHGPGQLVGYPIQKLPRPVDVVAHLRRLEEVMIRVCAEFGVATSRVEGRAGVWVLGDPVEQRPSLGGLSLDFDPRLADDEFDPRLNGPEYAPSNAGQRREDRKICAMGIRVAKGVTMHGFALNVNPDTSSFDKIIPCGIRDAGVTSLAYELGREVTIGEVLPVAEKHLRDVLENADLKPREVERASA

SEQ ID NO: 13538 - protein, 479 aa, Streptomyces avermitilis
MTERPAQRTPNRQLAALIAEAGFSNAGLARRVDQLGLEHGLDLRYDKTSVTRWLRGQQPRGTTPALIAEVFTRRLGRRLTAQDLGLDACAPVYAGLEFAATPEEAIDIVGGLWRKDSGSHAELRKIAFTPAGLVVPSRDWLIGRADDRVGRGDPPAARVPAQGRPAVPRQRSQTERGPGQKVTGGDIAALRSVGELFRALDHAYGGGHARQALVRYLEHEAEPMLRGTYGEQTGRRLFAAASDLTRLAGWTSYDIGAHGLAQRYFVQALRLSQAAGDRAYGSYVLVTMSRQAVYLGHGREAVQLARVAQQGVGASAPPVVQALLHSVEARGHGVLGEVRACTASLVRAERSLEAARPGDEVPYWARFFDEAQLADEFAHCHRDLQQFRAAAQHAERSLQLRAPGYARSRLFCRVVLATARLGLGELDQACLLGAEAAGQAAEMRSVRAIEYVRDFERRLEPYRDAAPVRGYRDRVTALQ

SEQ ID NO: 13539 - protein, 465 aa, Streptomyces avermitilis
VLESVHQASAYTADVQPADVVIVGAGAAGLAAAHHLTRAGLTTAVLEAAPNVGGRMSTEKVDGFRLDRMGQLLSTAYPELRSTPGLDALPLREFSPGVLVHSDGHLHRVGEPGTPRSARGALTAARALASAPRQQRTPRAPRTQGASRPGLLGSPVGQSRLAGALARLAATPPDRLLSRPELPAARALSALGLPPRTIDGFLRPLLAALLCDPALETSSRCADLALRAFVTGRLCVPEGGADVLPELLAATLPPGTVHTGVRVTAVSTTSVTTKDHGELRCRAVLLATGARAAARLLPGLRVPGFHPVTVLHHTTDEPPLGDPALVLDAERGGPVAHTAVISRVDPSRAPAGRALVSSTVLGTPPPPDRLEAAVRAQLARLYRTSTARWELLAIHHDSEAVPAMPPPHDPRRPVRLLAGLYICGDHRDTSTVQGALRSGRRAAHALLTDVGAGQTSLEEPLETAA

SEQ ID NO: 13540 - protein, 306 aa, Streptomyces avermitilis
MNSDAPLPPGSRVAIAGASGLIGSALARSLTADGHEVVRLVRRAPRGKNEVRWDPGEQRIDSAGLVGCAAVVNLAGAGVASRRWTDAYKQTIRSSRVLGTATLAEAIASLDEPPAVFVSGSAIGFYGDTGDRAVDETAPPGDGFLPALCVEWEEAAEPAQEAGVRTVFTRTGLVVAAGGGAWGRLFPLFKAGLGGRMGDGRQYWSYISLHDEVAAIRHVIDTASLSGPVNLTAPTPLTNAEITAAMGRVLHRPTLFTAPAPVLRAALGDMAGDILGSQRVLPARLLESGFAFAFPGIEETLRSALR

SEQ ID NO: 13541 - protein, 172 aa, Streptomyces avermitilis
VILMPDPHIRFATHDDEDGLARLDRVTWSTLHAVQPRPQPPYDPFYSDRFGPRDHLVAELGGRLAGYIRLGYPTPLAANSHVRQIQGLVVAEEARGAGVGRALLRAVQEHAARQGARRISLRVLGHNTPARKLYESEGFEVEGILPEEFLLDGQYVDDVLMGRALRPAVPRS

SEQ ID NO: 13542 - protein, 394 aa, Streptomyces avermitilis
VDLLDFLLLLVILAYAASGYRRGLVAGCVSLAGFVGGAVVGVWILPWVMKLVTPGTSAATLTAVLTVLAPAVVGHELAGRLALRLRRELDRGPLRVADGVGGAAANTVAVLLVAWVAASVLGASSTSMITTSIRNSALLGAVQNTMPDTTPTWFSRATSALTQAGFPQVFNPFENEPTTGVAKPSGDSVTPAATNAAKLSTVKVEGIAGSQGREGSGFVYAGQHVMTNAHVVAGIDEPTVRVGGVGRAYEARVVLFDPNKDVAVLYVPELKAPVLRFDDSAARGGSAVVAGYPQDGGLDLQAATVAGRINATGQNIYNSDTVTREIYSIRSTVRPGNSGGPLLTTDGRVYGVVFARSTSDNETGYVLTADEVSDDARRAAAATDPVGTGDLVTS

SEQ ID NO: 13543 - protein, 317 aa, Streptomyces avermitilis
MRGPVKTSRTRAMVPPGGTAHIAAGRDRRQGEGMRVLRGARRVLGRVRVPVRIPQVPGPGGARRSPWLRRTALVALACGPGLAAVLALVLCAAGVDRTVAAHPAPVVGRPAPAHTTARPPIVPRSRWIDDRTHKQPPPRYDDKVVAVFVHHTDSPNTYDCADAPRIIRSLYAGQIGPRQWDDLGYNFVVDRCGTIYEGRAGGVDRAVTGAHAQGFNHRTAGIAALGTFTEGTPVPRAVTDAIAALAAWKLGLADVDPRSRVRLVSTSGQSRYAAGTIATLPVLSGHNDGFPTTCPGAALTAHLPALRQAAARLQGRT

SEQ ID NO: 13544 - protein, 75 aa, Streptomyces avermitilis
MSSSRTRTTEQAGGWTKAARSPWTVVCAVATVVLGPGAVTASALDQANAAPLHHAVRADHAQAYIPADLSRRRAA

SEQ ID NO: 13545 - protein, 173 aa, Streptomyces avermitilis
VMDETEFWELVDTTREAADGDPEDHADLLVERLVRMDPDSVLDFARHFESRYNRAYRWDLWGAAWVLLDGASDDAFDFFRCWLIGQGREVFEGAVHDPDSLAELLDEFDEELDGDGEELGYAADEAYEQLTGVVAPDLGIPPAAPEPAGTPMNLENESELAERYPRLWERFKG

SEQ ID NO: 13546 - protein, 323 aa, Streptomyces avermitilis
MRAARLIKMVLLLQSRPTMTGAELARELEVSERTVTRDAQALSEAGVPVYADRGRAGGYRLVGGYRTRLTGLARSEAEALFLSGVPGALREMGLEDAASAARLKVSAALLPSLRDASRTAAQRFHVDAPGWFKEPDTPELLPAVAQAVWDDRRITARYRHGDTGVERELEPYGLVLKAGVWYLCARVPEPGSFRVYRIDRFTAVAADGERFGRDEDFDLPGFWEEQAERFARSLLRAEVVVRLSALGLRRLPSALDPASVRLARQTCGEPDERGWVTVTLPVESEEVAHSQLTALGAEAEVLSPVTLRERFAGDAARQAELYR

SEQ ID NO: 13547 - protein, 900 aa, Streptomyces avermitilis
MTDPTAIQPSELDQLPDRDPEETAEWQASLDAVTQAAGPHRAAYLMRRTLERAEGNGIALPKLLETDYVNTIPTSAEPVVDGDEEMEHRITAWNRWNAAAMVTRGSKYGVGGHIATFASAAWLYETGFNHFFRGKEADGSGDQLYIQGHASPGIYARAFLDGRLTEHHLDHFRQESGGNGLPSYPHPRRLPWLWEFPTVSMGLGPLSAIYQARFNRYLTSRGIKDVSQSHVWAFLGDGEMDEPESTAALALASREGLDNLTFVINCNLQRLDGPVRANFKIVQELEAQFRGAGWNVVKTLWGSAWDELFQLDTTGALVRRLREVPDAQVQTYQTRDAAYIRQDFFGADPALVEMAKLIGDDKILECFHLSRGGHESRKVYAAYRAAVSHKGAPTVILAQTVKGHTLGEGFASKNANHQMKKLSTDEFKQMRDLLELPISDSQFVDGVVPYGHPGADSPEVRYLQERRAALGGPAPARRTHPLAPLPAPADKTFASFDKGSGSQNVATTMAFVRLVKDLVRDKQTGRRWVPIVPDEARTFGMESLFPSLGIYSPKGQTYEPVDRDQLMYYKEAKDGQILNEGITEAGSMADFIAASTAYSTHGEAMIPFYIFYSMFGWQRTADQMWQLGDQLGRGFLVGATAGRTTLTGEGLQHADGHSPVIAATNPAALTYDPAFAYEIAVIVKDGLRRMYGEAAPGEDPNVFYYLTVYNEPVPQPAKPAGLGIDEGIVKGLYRFNTAESADLSPAANAPRIQLLGSGTAIHWVLQAQRLLAEEWGVAADVWSATSWTELRRDALEADAALLRGEERVPFVRQALHGAEGPVLAVSDYMRQVPDQIAQWVEQDYSSLGADGFGLSDTRDAARRHFGVDAESIVVAALAQLARRGEVKATAVKEARERYGL

SEQ ID NO: 13548 - protein, 207 aa, Streptomyces avermitilis
MTAPVVHSLREQIREHIVEGIVSGRWKPGERIVERRIATELEVSQTPVREALRELESLRLIESAPNKGVRVRNLTAADLEESYPVRAGLEAIAAELAAGRLAEDCSALEPHVAALYEADRHADGTAQVRHTVAFHRELVRAAGNSVLLHTWEGLGIEVFTALSIRWLGTVQQSYAEEHEALVDAFRRRDPLIAELVKAHVLGCAPRA

SEQ ID NO: 13549 - protein, 419 aa, Streptomyces avermitilis
VLLEIVVGEDETAEVGAKLAVIGAPGAAPAAAPAQAAPAPAAAPAAPAPAPAAPAPAAPAPAPAAPAPAQAAPAAPAAPAQAAPAPAAPQAPAAPAPAPVTPAAAPAATSGDDGAYVTPLVRKLAAENGVDLATVKGTGVGGRIRKQDVTAAAEAAKAAAPAPAAAPAAAKKAPALEVSPLRGQTVKMPRIRKVIGDNMVKALHEQAQLSSVVEVDITRLMKLRAQAKDSFAAREGVKLSPMPFFVKAAAQALKAHPAVNARINVDEGTITYFDTENIGIAVDSEKGLMTPVIKHAGDLNIAGIAKATADLAGKVRANKITPDELSGATFTISNTGSRGALFDTIIVPPNQVAILGIGATVKRPAVIETEEGTVIGVRDMTYLTLSYDHRLVDGADAARYLTAVKAILEAGEFEVELGL

SEQ ID NO: 13550 - protein, 304 aa, Streptomyces avermitilis
MPVSVTLPALGESVTEGTVTRWLKAEGERVEADEPLLEVSTDKVDTEIPSPAAGVLASIKVAEDETVEVGAELAVIDDGTGAPAAAPAPAAEQAAEQVAPPAPEPAPQATPSTEQAAPAPAPTAEAAAGAGSAEGTDVVLPALGEVGHRGHRHPLAEGGRRGGLGGRAAARGLHGQGRHRDPGARLRPCCSRSWSARTRRPRSARSSPSSVRPVPLRRPPRRRPRPRPPPPRPPRLPPRLPRLRPLRLRLRPPRPRLRPPPRRPPPRLRPLRPRPLRRPRPPRRRPPSPRPRRPPRPPVTTAPT

SEQ ID NO: 13551 - protein, 500 aa, Streptomyces avermitilis
MGSRQDRAPTTGPKKSGRTPAADRSLTTGVAHMHGGRDVANDASTVFDLVILGGGSGGYAAALRGAQLGLDVALIEKDKVGGTCLHRGCIPTKALLHAGEIADQARESEQFGVKATFEGIDVPAVHKYKDGVISGLYKGLQGLIASRKVTYIEGEGRLSSPTSVDVNGQRVQGRHVLLATGSVPKSLPGLAIDGNRIISSDHALVLDRVPESAIVLGGGVIGVEFASAWKSFGADVTVIEGLKHLVPVEDENSSKLLERAFRKRGIKFNLGTFFSKAEYTQNGVKVTLADGKEFEAEVLLVAVGRGPVSQGLGYEEQGVAMDRGYVLVDEYMRTNVPTISAVGDLVPTLQLAHVGFAEGILVAERLAGLKTVPIDYDGVPRVTYCHPEVASVGITEAKAKEIYGADKVVALKYNLAGNGKSKILNTAGEIKLVQVKDGAVVGVHMVGDRMGEQVGEAQLIYNWEALPAEVAQLIHAHPTQNEAMGEAHLALAGKPLHSHD

SEQ ID NO: 13552 - protein, 513 aa, Streptomyces avermitilis
VTALTLSTAAASGLRADAIVVGVAKSPKGDKGLVVAPGAEAVDKGYDGKLAAVLETLGASGAEGEVTKLPAPSGFKAPVVVAVGLGAAPEDGQDKGTAFDAEALRRAAGAAARALAGAKKAAFALPVADAADAGTIGEGALLGAYSFDAYKENGRNAKNGKAPLAEVVLLGGKPRDKAFKAAVERAVAVTEELNRARDLINTPPNDLNPESFAAVAQAAAKEHGIKVQVLDEKALTKGGYGGILGVGAGSAAGPRLVKLSYTSSKAKKHLAFVGKGITYDSGGISLKPAGHNETMKCDMSGAAAVFAAVVAAARLGLEVNVTGWLALAENMPSGTATRPGDVLRMYSGKTVEVLNTDAEGRLVLADALWAASEEKPDAIVDVATLTGAMMLALGNRLFGVMANDDAFRTAVVEAAEEVGEDSWPMPLPEHLRKGMDSPTADIANMGERMGGGLVAGLFLREFVGEGITWAHLDIAGPAFNEAAPFGYTPKGGTGTAVRTLVRLAELTAAGDLG

SEQ ID NO: 13553 - protein, 260 aa, Streptomyces avermitilis
VPKPPLLDGLRFAFGTLTVLPVRVTRWDRAAARGGMLCAPVAGLVVGLLAAALGTLLLLLGASPLLAAVATAAVPAVLTRGLHLDGLADTADGLGSGKPAEDALRIMKQSDIGPFGVITLVFVLLAQVAALAQAYETSWARGAFAAVVSAGAARLVLTLAARTGVPPARPEGLGAAVAGTVPVTGALLTAGAVIAAAAGAGALFGTYDVVRTALAVLLAVAAAELLLRHCTRRFGGVTGDVFGGLAETAATTALVVLSLA

SEQ ID NO: 13554 - protein, 254 aa, Streptomyces avermitilis
MGHWLHRNIIEPGKLPLLLALASFVLTFVITRVITRLIRAGKGPFGNVKAGGLHIHHVVPGVVLIVIGGFGAVASERHGFGSAAFAVVFGIGAGLVLDEFALLLHLDDVYWTEEGRKSVEVVVVTAALVGLALAGFLPFGVNDLSQEELRDRGGVILSVGLNFVFALLALSKGKGRTAIFGVIVPLVALVGAIRLARPGSPWARRFYRKRPRARARSSLRAYRHDRRWAGPRRKFQDWIGGKPDSENLPIPPAS

SEQ ID NO: 13555 - protein, 223 aa, Streptomyces avermitilis
MRALARLARAEWGALAVTVRTALAERRGRAIPLTIGAVCLTALLQFVQNQSWGFGFVQNIGAVRAEEPLWPALLRTPLSLFVPALDLPVWGALAQILVVFGIAEICLGWWRTLVVAYVATLAGTLYARVCLTLDPESLFGLPATDAQVVDTGPSAAVVGLAVFVCWRYRAYTTAGVVIASMVIEVALKGNLAGKEHLAAIAAVLVLCGISALRHRRAVRTRAG

SEQ ID NO: 13556 - protein, 644 aa, Streptomyces avermitilis
LPPSGTAIFGRTGRLPTGPPAPGTSRRIVRRSAPPHAPRRPISSPFMGDARITAEQERTPARSGGGEGRSTGTSQRAAAFVVWYLRAVTFINFLSAVWVSLGQDVRRHNQENYFTPYLLTAGFASGVFTMFLAITMRRRKRAAWILNLVLSGLFLLLFAFAMSFPEIRQYAQNWISIVLTAAFVGSLVLGRREFYAKGDRSNPKLAAAVAVGGLLASSLLAALLVTTTNQAPDAYRSTFLERWNYGTQRLVSVAADGSHFPGITTPNWVNVVINVLSTLLVLAVFYAAFRSRRAVDPLSEDDEKRLRALLDKNGDRDSLGYFALRREKSVVWSPTGKAAVAYRVVGGVSLASGDPIGDPEAWPGAIAPWLDEARAHGWIPAVMGASEEAGTIYARHGLDALELGDEALVETAEFTLEGRAMRTVRQAYNRIARAGYKVRIRRHEDIPADEMAYFLKRADDWRDGATERGFSMALGRLGDPDDGQCVMLECRDAEGELRALLSFVPWGPRGLSLDLMRRDRACENGLMEFMVIELLRRAREIKITQVSLNFAMFRSVFERGARLGAGPVLRLWRSLLSFFSRWWQIESLYRANAKYRPIWEPRFLLFEKSADLLRIGVAAARAEGFLEAPGLPKWLHRRHLESHR

SEQ ID NO: 13557 - protein, 375 aa, Streptomyces avermitilis
MSSLNLDDFSDLIERPDGGVRRDAEARRERQIVPPGSLGRLDDLGEWLAAAQSAVPVRPVERPRVVLFAGDHGVASLGVSARPAGSADQLVRAVLEGASPASILARRLNVPVRVVDMALDCEPDALPESVVRHRVRRGSGRIDVEDALTLEEAEAAFRAGVAVADEEADAGTDLVVLGDVSVGGTTAAAVLIAALCGTDASVVTGRGGLAIDDLAWMRKCAAVRDALRRARPVLGDQLQLLAAVGGADLAAMTGFLLQSAARKTPVILDGVVSAACALVGQRIAFRAPDWWLAGQNSGEPAQAKALDRMALEPLLNHGVTVGEGAGALLALPLVQAAAALAAELPEKPEELEAGEGPEAAEESSPEPENPEALAE

SEQ ID NO: 13558 - protein, 403 aa, Streptomyces avermitilis
LSYAPMCTCRPTGAAMPPTPQAIAARRAAYLGELAQGTDRFHEPRRENCPWCGSKRLRTRLRTPDLRQHKPGSFVVDECRDCAHTFQNPRLTTEGLAFYHRDFPEDPEGRDFPEDPEGREGPEGHERPGGFAERIVAARGSLPRALGFARAGRHLRRHRTAAHAMLSIPEPESWLDVGTGHGHFPESAREIHPYTAFDGLDPTPRVERARAAGRVEEAHRGHLTDPEIIQRLRARYDVVSMFHHLEHTPDPREELRAALAVLRPGGHLLIEGPDPACAFGRLLGKWWMPYGQPRRLHLMPLSNLLAELEARGCVIVRTDRREPHTPYDITGAVSLALARLLPAADAPWRATPPSELRRRLRTALLRVTTPLVVSAAALDHALAPLLSRTRFSNTYRIIARREE

SEQ ID NO: 13559 - protein, 439 aa, Streptomyces avermitilis
MGNLPALSWGPAGPLARTCGTSYGASDAQDLRRHAKIGSVELTLLGTGAPAGLPRPDCPCAACATALGEAARAATALLVDGTVLLDLTPGAAFAAARAGRSLGGVRQVLLSHPHNGPAVEVPAGLPQPARVPDGRELALLTGHRVRAMPMDAPGTGYAVTGPDGQRLLYLPPGGAPAGLDETVQPYDMVAADVVGRPDALARLRAVGALGPTTDVIAVHLDHDVPPGVELRRRLAAAGARAVPDGTTLTVGVYEDVPDVPRRTLVLGGARSGKSVEAERRLESFPDVLYVATGGSRGGDTEWAERVSVHRERRPGSWRTVETCDLVPLLKEDGPPLLIDCLSLWLTDAMDSVNAWDDDEWAGGGERALRGRVEELTAAVRETGRTVVAVSNEVGSGIVPATASGRRYRDELGRLNAAFAAECEHLLLVVAGQAMVLRGG

SEQ ID NO: 13560 - protein, 74 aa, Streptomyces avermitilis
LEAYMAAWTWRFEKADGAEVQPAVAPEEFTTQGDAESWIGEYWKDLKEGGADQVRLFEDTTEIYGPMSLHAEDA

SEQ ID NO: 13561 - protein, 237 aa, Streptomyces avermitilis
VARQLDEQIAGRFPVGQRLRVLDVGMGQGTQALRLARAGHQVTGVEQDATMIAVARETLAAEPEGIRSRMRLVQSDGRDTGVHFLPGSFDVVLCHGVLMYVEDPDALLAGLARMLAPGGLLSLLVRNADALAMRPGLAGDWASALTSFDTTAYTNRLGLDVRADRLDALTSTLAGIGAPLHAWYGVRVFTDTAADGAELPADVETLLAAEERAGRTDPYRQVAALLHLCGVRGGGAP

SEQ ID NO: 13562 - protein, 208 aa, Streptomyces avermitilis
MPRHPVPLGFVFRSRAKEEKAPADKAPVTDSKQPRHPQAPKGRPTPKRSEAQTQRRSVANTQTTRKEAAKRQRDERRVQLERQRQALASGDERYLPVRDKGPVRKFARDFIDSRFCVAEFFLPLAVLILVLSVLKVAQLQNIALLLWLVVIVLIVIDSIISAFRLKKQLDARFPDVPKKGAIPYALMRSLQMRRLRLPKPQVKRGERP

SEQ ID NO: 13563 - protein, 256 aa, Streptomyces avermitilis
MIFRAKANKALDRAEDPRETLDYSYQKQLELLQKVRRGVADVATSRKRLELQLNQLQSQSSKLEDQGRKALALGREDLAREALSRRAALQQQVTDLETQHQTLQGEEEKLTLAAQRLQAKVDAFRTKKETIKATYTAAQAQTRIGEAFSGISEEMGDVGMAIQRAEDKTAQLQARAGAIDELLASGALDDQSGLAKDDIQSELDRLSGGTDVELELQRMKAELAGGSSSSQQAIEGGTGQSPSQQQPQDTPRFDKQ

SEQ ID NO: 13564 - protein, 92 aa, Streptomyces avermitilis
MIVRIMGEGQVRLDDSHLTELNKLDDELLAEMESGDEEGFHRTLGSLLGAVRRLGDPLPDASLEPSELILPSPDATLDEVREMLSDDGLIPG

SEQ ID NO: 13565 - protein, 406 aa, Streptomyces avermitilis
VSTLERTRCRLRAHPFALDAVLAAGVLACMLSASFVDPHGGNGATWGARAPGALSLTLMGLAAAALVFRRRAPMAVLAATGAVSLVELVTGDPRAPVAMSAVVALYTVASTKDRPTTWRVGVLTMTVLTASAMLAGPLPWYAQENLGVFAWTGMAAAAGDAVRSRRAFVHAIRERAERAERTREEEARRRVAEERLRIARDLHDVVAHHIALVNVQAGVAAHVMDKRPDQAKEALAHVREASRSALNELRATVGLLRQSGDPEAPTEPAPGLHRLDELADTFRNAGLPVEVARADHGTTLPAAVDLAAYRVIQEALTNVQKHAGAGAKAEVSVVRVGPNVEITVLDNGAGTDQGPENGGGHGLLGMRERVTAIGGTCTAGRRYGGGFRVHAILPVKNRTTAPEETV

SEQ ID NO: 13566 - protein, 227 aa, Streptomyces avermitilis
MTIRVLLADDQALLRSAFRVLVDSEPDMEVVGEASDGAEAARLAGETQADVVLMDIRMPGTDGLAATRLISADPGLTHVRVVMLTTFEVDEYVVQSLRAGASGFLGKGAEPEELLNAIRVAAGGEALLSPAATKGLIAKFLAQGDGLDDERDPARAERLDALTGREREVLVQVAGGHSNDEIAERLEVSPLTVKTHVNRAMAKLGARDRAQLVVIAYESGLVRPRVD

SEQ ID NO: 13567 - protein, 1053 aa, Streptomyces avermitilis
MSWLSRFSLAQRALIGLMSIVALAFGAIAIPQLKQQLLPTIELPMVSVLAPYQGASPDVVEKQVVEPIEDNLEAVDGITGVTSTASEGNAVIRASFDYGNDTKQLVADVQQAVNRARVQLPDAVDPQVIAGSTDDIPTVVLAVTSDKDQQALADQLDRTVVPALKSIGGVGQVTVDGVRDLQVTVTPDDKKAAKARVTSAAIGQALQAGGATVPAGSFDEDGHNRTVQVGGGLTSLGQIRDLMVMGGAGKKPVRLGDIATVEQEPAKADSLTRTDGRPSLAVNVTMDHDGSAVAISEAVKDKLPGMRKDLGSGATITVVSDQGPAVSKSIDGLTTEGALGLLFAVLVILVFLASVRSTLVTAVSIPLSVVLALIVLWTRDLSLNMLTLGALTIAIGRVVDDSIVVLENIRRHLGYGEERQEAILRAVREVSGAVTSSTLTTVAVFLPIGLVGGMVGELFGSFSLTVTAALLASLLVSLTVVPVLSYWFLRAPKGTPDDAEEARRTAEEKEARSRLQRVYVPVLRFATRRRLTSVLIAAAILIGTFGMAPLLKTNFFDQGEQEVLTVKQELKPGTSLAATDAQAKKVEKMLDGVKGVKDYQVTVGSSGFLAAFGGGTDTNQASYSVMLDDSASYEDVQNSVEEGLAKLSGIGTTTVSAGDGFGSQDLSVVVKAADADVLRKASDQVRAEVAKLDDVTDVSSDMAQSVPRLSVRANDKAAAAGFDDTTLGAAVTQAVRGTTSGKALLDDTERDIVIRSAKPAETSAQLRNLRLGAVKLGDIATVKLVDSPVSMTRIDGRRAATITARPTGDNTGAVSTKLQSKIDALKLPTGATAEIGGVSQDQDDAFKNLGLAMLAAIAIVFMLLVATFRSLVQPLILLVSIPFAATGAIGLLVATGTPMGVPAMIGMLMLIGIVVTNAIVLIDLINQYRKQGYGTVDAVIEGGRHRLRPILMTALATIFALLPMALGVTGEGGFIAQPLAVVVIGGLITSTLLTLLLVPTLYTVIEVRKERRAKKKAAKRAAKSGNPSSPTGTPTETEAETDADAGQPEPAQA

SEQ ID NO: 13568 - protein, 414 aa, Streptomyces avermitilis
MSRWIASMIQASRRTERVRVVTTAQPQELDVQPTPLALLLLGREADPRSERGVECPGDLPSPSDPDLVERARAAKEKLGDKVFVLGHHYQRDEVIQFADVTGDSFKLARDAAARPEAEYIVFCGVHFMAESADILTGDDQKVVLPDLAAGCSMADMATAEQVAECWDVLTEAGIAEQVVPVSYMNSSADIKAFTGRHGGTICTSSNAQRALEWAFEQGSKVLFLPDQHLGRNTAVRDMGMSLDDCVLYNPHKPNGGLTAEELRSAKMILWRGHCSVHGRFSLDSVNDVRERIPGVNVLVHPECKHEVVDAADYVGSTEYIIKALEAAPAGSKWAIGTELNLVRRLANRFAPEGKEIVFLDKTVCFCSTMNRIDLPHLVWTLESLAEGNLVNRIEVDRETEQFAKLALERMLALP

SEQ ID NO: 13569 - protein, 118 aa, Streptomyces avermitilis
MSVSDETTTVSDGIILSDAAAAKVKALLDQEGREDLALRVAVQPGGCSGLRYQLFFDERSLDGDVVKDFDGVKVVTDRMSAPYLGGASIDFVDTIEKQGFTIDNPNATGSCACGDSFS

SEQ ID NO: 13570 - protein, 485 aa, Streptomyces avermitilis
VVVASVAAAVLLVGGGGAYFTATATGGSGGRSTGPGGDGTPPPLALDGYSEGGRPGIAVGEPNPYGASYRADGKLPDGPDSAPVYRATGEVTKDEVARLAQALAVDGTPRLTGDAWTVGAVKDGSGPTLRVTKRAPGIWTFSRYTPGTDNLCTSTKACPSESSGRSAADPVSEAAARKAAAPVLKAVGQDDAKLNAGQVMDRVRVVNAEPKVGGLPTHGWTTGIQVGADGQVVGGSGNLKAPVKSDTYPVISAQKTLDLMNGSATGDGRKGIGGCASPVPLKDKDETPCEASTATPTPEPVAVEGAVFGLASQVVDGQPALVPSWLFDVRPKGADDTFTVTHPAVDPRYVAAPGASQPTEPSQAPSGSPAPRPSDGSTSAPTKRDVKVDGYTADGKDLTVSFTGGVCGDYAASASESSDEVKVTVTETPWQDKVCIMIAKEYHRTLHLDAPLGDRKVVGSDGTQIPKETAAEHRLPKSAQSAQPQ

SEQ ID NO: 13571 - protein, 69 aa, Streptomyces avermitilis
MTNLKVHGSVPLDLEGDLASLRGDGARMAPHWAAPDRITPRPVSPSLIHGVTVPPASARLLDAMSDYGD

SEQ ID NO: 13572 - protein, 338 aa, Streptomyces avermitilis
VNCQSLPPQERVLAVRIAVTGSIATDHLMTFPGRFADQLVADQLHTVSLSFLVDNLDVRRGGVGANIAFGMGQLGTSPILVGAAGSDFQEYRAWLDRHGVDTASVRISEVLHTARFVCTTDADHNQIGSFYTGAMSEARLIELKSVADRVGGLDLVLIGADDPEAMLRHTEECRSRSIPFAADFSQQIARMNGDEIRILLDGATYLFSNEYEKGLIESKTGWSDEEILSKVGHRVTTLGAQGVRIERAGQDPIEVGCPEEERKADPTGVGDAFRAGFLSALAWGVSLERAAQVGCMLATLVIETVGTQEYQLRRAHFMDRFTKAYGDDAAVEVRRHLA

SEQ ID NO: 13573 - protein, 460 aa, Streptomyces avermitilis
VSYFDAASAAPLHPVARQALQASLDEGWADPARLYREGRRARLLLDAAREAAAEAVGCRPDELVFNSSGTRAVHSGVAGALAGRRRVGRHLIVSAVEHSSVLHSAEVFETEGGTVTRVAVDRTGTVAPASYAEALRPDTALACLQSANHEVGTEQPVAAVADVCRAAGVPLLVDAAQSLGWGRVAGDWSLLTASAHKWGGPSGVGLLVVRKGVRFAPQGPTDERESGRAAGFENLPAIVAAAASLRAVRAEAAEEAVRLRELTDRIRVRVPELVGDVEVVGDPVRRLPGIVTFSCLYVDGETLLHELDRAGFSVSSGSSCTSSTLTPSHVLRAMGVLSEGNVRVSLPLGTPAEDVDRFLEVLPGTVSAVRDKLGAPVSAPATAVRAESLVVDSLGKRCPIPVIELAKVIGDVPVGGTVRVLSDDEAARLDIPAWCEMRGQEYVGEEPADHGSAYVVRRLS

SEQ ID NO: 13574 - protein, 319 aa, Streptomyces avermitilis
VSPNGSDRSPRRPMRRKLLQALTAGLVLATATGCTYKDFPRLGMPTPVTEEAPRILSLWQGSWAAALATGVLVWGLILWATIFHRRSRTKVEVPPQTRYNMPIEALYTVVPLIIVSVLFYFTARDESKLLDLSKKPDVTVNVVGFQWSWGFNYIENVDGSTGNAKTDKNLAAIPDRFKEAFPANAGGVYDVGTPGTRNPQTNNPGPTLWLPKGKTVRFVLTSRDVIHSFWVVPFLMKQDVIPGHTNSFQVTPNREGTFLGKCAELCGVDHSRMLFNVKVVSPERYQQHLKDLAKKGQTGYVPAGIAQTSHEKNRETNNL

SEQ ID NO: 13575 - protein, 579 aa, Streptomyces avermitilis
VSILNEPQGAAAAEDSYENELPVRRKQPGNVVVKWLTTTDHKTIGTLYLVTSFAFFCIGGVMALLMRAELARPGMQIMSSEQFNQAFTMHGTIMLLMFATPLFAGFANWIMPLQIGAPDVAFPRLNMFAYWLYLFGSLIAVGGFLTPQGAADFGWFAYSPLSDAVRSPGIGADMWIMGLAFSGFGTILGSVNFITTIICMRAPGMTMFRMPIFVWNVLLTGVLVLLAFPVLAAALFALEADRKFGAHVFDAANGGALLWQHLFWFFGHPEVYIIALPFFGIISEVIPVFSRKPMFGYMGLIGATIAIAGLSVTVWAHHMYVTGGVLLPFFSFMTFLIAVPTGVKFFNWIGTMWKGSLSFETPMLWATGFLITFTFGGLTGVILASPPMDFHVSDSYFVVAHFHYVVFGTVVFAMFSGFHYWWPKFTGKMLDERLGKITFWTLFVGFHGTFLIQHWLGAEGMPRRYADYLAADGFTALNTISTICSFLLGLSILPFLYNVWKTAKYGKPVGVDDPWGYGRSLEWATSCPPPRHNFLTLPRIRSESPAFDLHHPEIAALDQLENAGHGEKAAVAGGKEAGK

SEQ ID NO: 13576 - protein, 132 aa, Streptomyces avermitilis
VKIQGKMFIWLAVFILAMAIIYGVWSKEPAGTTALFLAFGLSIMIGYYLAFTARRVDAGAQDNKEADVADDAGEVGFFSPHSWQPLALGIGGALAFMGVVFGWWLLYFSAPIILIGLWGWVFEYYRGESRTQ

SEQ ID NO: 13577 - protein, 421 aa, Streptomyces avermitilis
MNHSPRNRTVVSCTLLVIALGAAGLTACTSDGHPLSAKPYDAAGQIAFNAPVGDSKKADPDKPLEITASGSDGRITDVTATDASGRYVAGELAADGSRWHSTSPLAAGSRYTVRVSTEDEDGAPGRKDITFTTSVPKTKKELGVAFGPEAGTYGVGQPVTATLSAPVKDKAARTVIERALKVDSKPVVEGAWHWVDDKTLHYRPKEYWPTHATITAHSNLKGVKVAERLWGGDVKPLKLTTGDSLIAVTDAAAHSMTVFRNGKEINQIPVTTGKAGFETRNGVKVVLGKEYFVRMRGTTVGIAEGSSDSYDLPVYYATRVTWSGEYVHAAPWSVGSQGSANVSHGCTGMSTSNAEWFFDTVREGDIVKVVNSNGDNMDPFGNGYGDWNLDWKNWRTGSALMAGTPDGPSPADRAKLRPETV

SEQ ID NO: 13578 - protein, 132 aa, Streptomyces avermitilis
MQPTATVLVYSDDSNTREQVRLATGRRPAPDVPVVEFLECATPAAVIAELDKGGIDVCVLDGEAVPMGGMGLCRQIKDEVFNCPPVLLLIGRPQDAWLATWSRADAAVTLPVDPVEFAAALASLLRQKALIG

SEQ ID NO: 13579 - protein, 206 aa, Streptomyces avermitilis
MSVVATATTVETGHAHPSVNRPNLTSVGTIIWLSSELMFFAALFAMYFTLRSVTGPEHWKEMASHLNFPFSATNTTILVLSSLTCQLGVFAAERGDVKKLRMWFIVTFIMGAIFIGGQVFEYTELVKKDGLSLSSDPYGSVFYLTTGFHGLHVTGGLIAFLLVLGRTYAARRFTHEQATAAIVVSYYWHFVDVVWIGLFATIYMIK

SEQ ID NO: 13580 - protein, 269 aa, Streptomyces avermitilis
VKKLSARRRHPLAAVVVLLLALAATGGLYAAFAPASKAQADDTAQSLAIDEGKKLYAVGCASCHGAGGQGTTDGPQLVGVGAAAVDFQVGTGRMPAQQPGAQVPKKKVIYTQAEIDQLAAFIASLGAGPSIPTKNQVSPEGADIAKGGELFRTNCAQCHNFTGKGGALTHGKFAPSLEGVDPKHIYEAMQTGPQNMPSFPDTTLSEKNKKDIIAYLDAVNGDETVEPGGLSLGGLGPVSEGLFGWVFGLGTLIAVAVWVAARTAKAKKS

SEQ ID NO: 13581 - protein, 357 aa, Streptomyces avermitilis
MSSQEIPEENRPAERATDEDAHGHGAVAVADEQNPFANPGLPPHEHRVQDIDERAAQRSERVVAFLFTVSMLATVAFIASYVAIPKEEAIYVFPIGHISALNFALGLSLGVALFTIGAGAVHWARTLMSDVEIADERHPIEAPPEVKAKVLADFKEGAKESVLGRRKLIRNTMFGALALFPLSGVMLLRDLGPLPETKLRHTMWRKGLQLVNMNTNEPLRPADVAVGSLTFAKPEGLEEHDEDFQKEIAKAALMIVRLQPDNIKDKKELEWSHEGIVAYSKICTHVGCPISLYEQQTHHVLCPCHQSTFDLSDGARVIFGPAGHALPQLRIGVNDEGYLEALGDFEEPVGPAFWERG

SEQ ID NO: 13582 - protein, 548 aa, Streptomyces avermitilis
MSATSNTPSPDSRARGKAPAGERVADWADGRLGIYSLAKSNMRKIFPDHWSFMLGEVCLYSFIIIILTGVYLTLFFHPSMNEVTYNGSYVPLQGQLMSEAFNSTMHISFDVRGGLLIRQIHHWAALIFLAGMFVHMMRVFFTGAFRKPREVNWLFGFLLFVLGMFTGFTGYSLPDDLLSGTGVRFMEGAVLSVPIVGTYLSFFLFGGEFPGGDFVARFYSVHVLLLPGIMLGLVVGHLILVFYHKHTQFAGPGKTNNNVVGMPLLPVYMAKAGGFFFLVFGVIAAIAAIASINPIWSMGPYRPDMVSTGAQPDWYMGFSEGLIRVMPGWEINLWGHTLVLGVFIPLVIFPLVLAAIAVYPFIESWVTGDKREHHILDRPRNVPTRTGFGAAWISWYFVLLIGGGNDLWATHFHLSINSITWFVRIGFFVVPVLVFVITKRICLGLQRRDRDKVLHGRESGIIKRLPHGEFIEIHEPLSQDALHTLTAHEQYEPAAIGPVVDENGVERKPKVTEKLRAKLSGAYYGDDNQIPKPTVEEYKEITSGHGHH

SEQ ID NO: 13583 - protein, 354 aa, Streptomyces avermitilis
MSAVNPAGGDIAAGRSWPEVLNGLLDGRDQSADDTAWAMDRIMRGEATDAQIAGFLVALRAKGETVEEISGLVRAMYEHANLIEVPGATVDIVGTGGDGAKTVNISTMSSIVVAGTGAKVVKHGNRAASSASGSSDVLEKLGINLQLTPKRVAEVAEEAGITICFAVKFHPALRHVAAARGQLGIRTTFNVLGPLTNPARVKAQAVGVADPRMAPIVAGVFAERGNSSLVFRGDDGLDELTTTSTSRVWVVREGKVTEESFDPRDVGLDLVPVEALRGADAAYNADVARRLLNGETGPVRDAVLLNSAAALVALSPGAGTLAEQLRAGMAQAAEAIDSGAAKRALERWVAASNA

SEQ ID NO: 13584 - protein, 457 aa, Streptomyces avermitilis
MSVSTAAADQTVCCDISGHLPVLGREVTVPLVTGGEVTYAALDYAASAPALQRVWDDVAAYAPYYGSVHRGAGYLSQLSTDLFENARRTVAEFLDCRDGDQVVFTRSTTDSLNLLAAALPADCQVFVFETEHHASLLPWRDARVTYLNAPRTPQQAVETLERALAGRDPHGPALVCVTGASNVTGELWPVRELAAAAHAHGARIVLDAAQLAPHHPVSVRELDVDWVAFSGHKLYAPFGSGVLAGRADWLRAAEPYLAGGGASRKVTRRTDGGVDVEWHESAARHEAGSPNVIGAYSIASACKALTEAGYDNLVAREQQLIGTVRAGLAEVPEVRVLSLFGDDAPRVGVISFVVEGWNSSHFAAALSAEYGIGVRDGLFCAHPLVRTLLGSDPQVQGECGAPEAAPGEKSLNAIRVSFGAGTPDEHVERFVRAVKELVREGARWQYRTEDGRCVPAV

SEQ ID NO: 13585 - protein, 93 aa, Streptomyces avermitilis
VITAIVLIKTSVDRIPEIAESIAALDSVSEVFSVTGTYDLIAMVRVKAHDDLADVIPGSISKIPGVEATDTHVAFRTYSQHDLEAAFAIGLDS

SEQ ID NO: 13586 - protein, 247 aa, Streptomyces avermitilis
MLCSVISRWSTTVGSAVRAQSAPVTYGLIGLCCLIFAIGPAAGLNPAHGTGEGLLAAQQTYFARWGVVPAELFSGAPRAALTPATALFVHGSWIHLLGNMLFLYVFGAMAEERLGHLEFALFYLGCGYLALLGYAAANAGSTQTLVGASGSISAVLGAFLYLFPGARVTSLFPFLFFLPLRLPAWVVLPFWAALQWLAASRVATGPSVAYLAHLVGFSLGFLYAWVRYGRTTRVKTPAAAPEGENQP

SEQ ID NO: 13587 - protein, 92 aa, Streptomyces avermitilis
VSDSRRLEGTAATMTVPLPTAETRWRCTLCGNLTRFDVTRSSKVVEYVHLDLAGEPSVEERDVVSETIESVRCRWCNAVDQVELVDRPGAGS

SEQ ID NO: 13588 - protein, 449 aa, Streptomyces avermitilis
MVETTGGGPGDGTAEVLDRPLPDGVRRRVVQIVSDGFGGLTVAELPAQLRQYARFAPNRRAKFAGNAMAAALETDPIFRQRIAEKLREAQPELAGALDSGSPPPAADPLDVAAAAYVLRPMGWVKLVTAAGEEAQRADAERADDETRAELERLREELAEARGRTKAETERLRAELESTKKEAESLHRKLRGAFSDVKRGEAALRKVQSEIEAVRAEGQAQVSAAESETRRLKARLGETEAALEASRKAAREGRSVEDMRVRLLLDTVLDAAQGLRRELALPPVSVRPAETVDAVEPGRMTPKDIAARALSENDPAIIDQLLALPQAHLVVDGYNVTKTGYPQMPLEKQRLRLLGQLSQLAAQTGAEVTCVFDGAELAAPVLLAPPRGVRVLFSKAGVTADELIRQLVRAEPPGRPVIVVSTDREVADGIAKAGARPVASVVLLKRFSRG

SEQ ID NO: 13589 - protein, 346 aa, Streptomyces avermitilis
VASHRRPKQPSRTRVTVLTTAAAAAVVLSANAANAAPSEKPSKDEVKSKVDKLYEEAEKATEKLNGAKEKQDKLEKQIGTLQDNVARGQEELNNLRDGLGSLASAQYRTGGIDPSVQLFLSSNPDDFLDKASTMDQLSSQQVDALKKIQEKQRSLAQQRKEASEKLADLADTRTELSKKKKEVQGKLAEAQKVLNTLTAKEKAALAAEQSRASRASERSALDDSGSAKPASGRAASAYAAAQSKIGSPYVYGASGPSSFDCSGLTSWAYAQAGVSIPRTSQAQANAGTRIYSQSDLQVGDLVIFYGDQHHVGFYAGNGQVLHAPRTGTVVRYEAIGNMPFQFGVRI

SEQ ID NO: 13590 - protein, 337 aa, Streptomyces avermitilis
VGSHRRLAPSGFNRGAGAAVCALSTAAAALGAVPADAAPHDDTRARVDRLYEEAERATEAYNKADERADVLREQVSQAQDEIARQQERINTMRDALGSLAGAQYRSGGLDPSLALLFSDNPDDYLDRAAALHRVSARQATRLKDFQHAMRDVAQERAEAAGRLAELEKSRKAVARHKRTVEQKLAAARRLLNALPDAQRAAFERASRAGRSGMPDLTGVLAPGGRAGAAVAAARSALGRPYVWGANGPGGFDCSGLMQWAYAQAGVGLPRTSQEQRYAGRQVPLSQAQPGDLVVYRSDAGHVGMYVGNGQVIHAPYPGAPVRYDPVGMMPVSSVTRP

SEQ ID NO: 13591 - protein, 406 aa, Streptomyces avermitilis
VAGRGRTSGVLASCLLLLAALVGCGGRPARDASAAEVQRVLDRRAAAVLHRDRSAFLATESPVAPAAGQLATGAEEFGNLRGVPLASWSYRVTAFHRSGERATATAELHYRLKGYDRAPVTAGRMLRLTRGDGGWYVVSDEPAKKSSEQLWEQGAVRIVRGEHSLVLGVGQPDSVLRGYANLADRAVPAASQAWGADWAGRVVVLVPKSLDGMAGLLGAPASGYRGIAAVTTGEAGGAAKAPADRIVVNPDAYGVLGDFGRQVVLTHEATHVATRAHTTAATPLWLSEGYADWVGYRGSGRTAAQIAPELDRAVREGQLPAALPADADFGFSGDAGKLAKAYEGGWMACRMIADHWGEVRLDDFYRAVGDHRKRAGAVEGALKDVLGTTPRKFTAQWRAYLKAQLG

SEQ ID NO: 13592 - protein, 448 aa, Streptomyces avermitilis
MNAHRAQLISLARPVYFSLLASVAAGIINTVWVSRLGGPAVAAVAVATNTENVLLGVALVFASGTTVLVAHARGAQDPGAVRAAVRGGWALCAVVTPVVAGCGYLLREPLARLVLGGEGPALPLAVGYFAISLPGITVFYAQNLVDGILKGAGDTRTPMRLALLANGLILALDPLLIHRYGVRGAAVSTVLCRCAALGVGLLALRRNALLRGAAAVRPAEATGAALRRTLSTGLPMSADFTVRQGGALVLVAIVARLGVTAVAAYSIAYKVMYVATMAFYAVRQAASIHTAHTRGADRRASSRSAGAGSGGERRAIGRQAVVVSGTVGLLASALLCVLAPWVMRAFGAGPEVAHQGVLFLRCVGPYLLLMACFIALGGVFEGSGGAPVLLRVTLLGTAVQLPLAYALSGLGLPGICLALALAMVVQCAALLPGVRRQEDARDSLVRVA

SEQ ID NO: 13593 - protein, 410 aa, Streptomyces avermitilis
VDIAGTRRFPAWLLASWGLTRLALLLFVFKVFVFPGPDVTGDVSVIYQGWYETLRTGTFPLDDVTWQYPPAAALAILSPALLPFLDYASAFFVLAFLADLAVFCLLQYTGLRPGRTLRGAWVWVVGVALLGPTVYARYDVMVTAVAVAALLAGARHPRVTGALIGFGALLKVWPVLLLVGAARRRVWASATVTVVAVASLFALAMPGAFAFLTFQRERGTEVESLGSLVFHVARHFGWNGQVLLNYGSVEFLGPYVGAVSTAALFLTAVAFGWLLLWRLRAKRFLAHTLADAAFTAVLMFTATSRVISPQYMVWLVGLAAVCLCFRGSRMTVPGGLVLAACFVTVLEFPVWFSHVVGSDWMGITLLFARNGLLMAAALTAALELWRGTVLPPVPTVPGQATRTRESLASS

SEQ ID NO: 13594 - protein, 380 aa, Streptomyces avermitilis
MHKTLIVTNDFPPRPGGIQAFLHNMALRLDPERLVVYASTWKRGREGVEATAAFDAEQPFTVVRDRTTMLLPTPGATRRAVGLLREHGCTSVWFGAAAPLGLMAPALRRAGAERLVATTHGHEAGWAQLPASRQLLRRIGESTDTITYLGEYTRSRIAAALTPEAAGRMVQLPPGVDEKTFHPGSGGAEVRARLGLTDRPVVVCVSRLVPRKGQDTLILAMPHILAKEPEAVLLIVGGGPYEKELRRLADETGVAGSVRFTGAVPWSELPAHYGAGDVFAMPCRTRRGGLDVEGLGIVYLEASATGLPVVAGDSGGAPDAVLDGETGWVVRGGSPEAAADRVVTLLGDPELRRRMGERGREWVEEKWRWDLLAEKLKTLL

SEQ ID NO: 13595 - protein, 544 aa, Streptomyces avermitilis
MTEKLTHRHLTRRQILGMAALQTAATLGFTRIGLQSARAAEPDAVETAPAIVVGSGYGAAVAALRLGQAGLRTLVIEMGGLWNTPGSDGKVFCSTSAPDRRSMWFRTRTEAPLAEFLWLDVVNKDISPYPGVLDRVHFANMSVYVGRGVGGGSLVNGGMAVTPLQSYFAEQFPTVDAAEMYSTYFPRARTMLGVNTVDPAWFESTEWYRFTRTSRKAATNTGLKTTFVPNVYDFGYMQREAAGTATKSALAGEVIYGNNYGKRSLDKTYLASALGTGNVTIHTLERVREIRRASDGTYLLTADRIDTTGAVVETKQYSCTYLFLGGGSLGTSELLVRARETGALPALDASVGTGWGTNGNVMTGRANHIWDTVGANQSTMPVMGIDDWANTSNPVFAEIAPLPMGLEHWISLYLAITKNPERASFTYDAASDSAKLGWSAAQSAVSVSMAKKLFDRINSANATIYRYDLFGNNKTFADDFTYHPLGGCVLGKSTDNYGRVKGYSKLYVTDGSLVPGSIGVNPFVTITALAERTMARVLAEDTAP

SEQ ID NO: 13596 - protein, 598 aa, Streptomyces avermitilis
LREFSLPALYEVPADGNLTDIVRRNAAQHPDVAVIARKVGGSWQDVTATAFLAEVRAAAKGLIASGVQPGDRVGLMSRTRYEWTLLDFAIWSAGAITVPVYETSSPEQVQWILGDSGATACVVELDTHAASVESVRDRLPALKHVWQIDTGGVEELGRLGRDVSDATVEERSSLAKADDPATIVYTSGTTGRPKGCVLTHRAFFAECGNIVERLRPLFRTGECSVLLFLPLAHVFGRLVQVAPMMAPIKLGCVPDIKNLTDELAAFRPTLILGVPRVFEKVYNSARAKAQADGKGKIFDKAADTAIAYSRALDTPSGPSLGLKIKYKTFDKLVYSKLRAVLGGKGEYAISGGAPLGERLGHFFRGIGFTVLEGYGLTESCAATAFNPWDRTKIGTVGQPLPGSVIRIADDGEVLLHGEHLFKEYWNNEGATAEALADGWFHTGDIGTLDEDGYLRITGRKKEIIVTAGGKNVAPAVIEDRIRAHALVAECMVVGDGRPFVGALVTIDDEFLGRWAAEHGKPAGSTAASLRQDPDLLAAVQSAVDDGNAAVSKAESVRKFRILSSQFTEESGHLTPSLKLKRHVVAKDYADEIEAIYQK

SEQ ID NO: 13597 - protein, 265 aa, Streptomyces avermitilis
MALSPGGNRRKRIHVVSDVHGNARDLARAGDGADALICLGDLVLFLDYADHSRGIFPDLFGVANADRIVELRTARRFEEARAFGAELWSGIGSDRAAAIEKAVRKQYAEMFAAFPTPTYATYGNVDMPTLWREYAGPGTTVLDGERVEIGGWTFGFVGGGLRTPMRTPYEISDEEYAAKIEAVGEVDVLCSHIPPEVPELVYDTVARRFERGSRALLDAIRRTRPRYSLFGHVHQPLVRRMRIGATECVNVGHFAGSGKPWALEW

SEQ ID NO: 13598 - protein, 147 aa, Streptomyces avermitilis
MAEHTSSSIMIEAAPADVMEVIADFARYPDWTGEVKEAEVLGTDGQGRAEQVRLVMDAGAIKDDQVLAYTWTGDHEVSWSLVKSQMLRSLDGSYLLKPAGSDATEVTYQLTVDVKIPMLGMIKRKAEKVIIDRALAGLKKRVESEEK

SEQ ID NO: 13599 - protein, 389 aa, Streptomyces avermitilis
MRTLLITGPGGSGRTTVAAATALRASRTGTRTLVLSADRTDTLGAALGVPTGGAPVEAAPGLTAWRPDAADRFRADLTAFQDRAATALDFLGAARLDAEELTPLPGAEELALLRALRDAALSEAYDLLVVDLPPAPQALALLALPEELRRYLRRLLPPERQAARALRPVLGRLAGVPMPADWLYETAARWDVELAAVEAVVEDRATTVRLVAEPGPAGADAVRAAATGFALRAVRIDTLIANRLLPEEADDAWSAGLAAQQRKFLEEWRGEYRLHELPHLGHDPRGADDLAALAVPGVNDAPGPVEWSVADRLADDGVLVWHIPLPGAIRDELDLLRRGDELVVTAGQFRRIVPLPSALRRCTVAGAALREGELRIRFAPDPDLWPRER

SEQ ID NO: 13600 - protein, 171 aa, Streptomyces avermitilis
MSEERPTSDAAQEDAADETRVPPGRAESSARGSAADGDAWAKACAEDLAAEKARRRAQYGAQPGSAAEELRKLVDAVAEKLSGLQSPLIDAATSGTAQQMVSQVVRQAKAVVEPVIERNPDVFDHLAAAGSELLAAYRSAVEAQEKRWTARDHDPRHRGGDQGPGEHIDLD

SEQ ID NO: 13601 - protein, 317 aa, Streptomyces avermitilis
MGLTIGVDIGGTKIAAGVVDEEGNILSTFKVPTPTTPQAIVDAIAAAVEGARAGHEIVGVGIGAAGYVNRQRSTVYFAPNIHWRQEPLKDEVEARVGLPVVVENDANAAAWGEYKFGAGKGHRNVICITLGTGLGGGIIIGNKLRRGHFGVAAEFGHIRMVPDGLLCGCGSQGCWEQYASGRALVRYAKQRANATPENAEVLLALGNGTPDGIEGKHISVAARQGDPVAVDSYRELARWAGAGLADLASLFDPSAFIVGGGLSDEGELVLDPIRKSYKRWLVGGNWRPVADVIAAQLGNKAGLVGAADLAREPDPIM

SEQ ID NO: 13602 - protein, 257 aa, Streptomyces avermitilis
LIAMPTSPAASPLPPSRTEPDGSAVIRVLSYNIRSMRDDTAALARVISACEPDLVLVQEAPRFFRWRKKLAPLASACGQVVLSGGATAAGPALLCSLRATVERTEDVLLPLTPGLHRRGFATAVVRFGRARLGVLSCHLSLQKNERYEQGGMLLDHLARLGTPHAIAGGDLNERPDGRTFKRLASELRDCWATAPWGAEYTSTPADPHQRIDAILATPGIEVLACGVPLGHPGVTEADLRAATDHLPVLAALRVPAS

SEQ ID NO: 13603 - protein, 353 aa, Streptomyces avermitilis
VAPIRRLSGRQTPMHDSPELDQLRDWDAGAPPLDDETRHRVRVRLFAAMNDPAPVVRRRRPVVRIALTATVAAAVAATVLVAVRDDDGGARRTATPPSSSSPALRNVSARTVLYGAAAFSREHETAVAPRDDQFIYTKEIIKETERETGAKKTYVDETWRSVDDTKPSWIMEIGKGWWSVPYKKRPGDHVESVSMWPPQDWDTLKSLPTDPAKLILKLNFGGRTPHSIDEIGDQEWSQIHFSLVGLLMLVPVMPEDLRPAAYEALAMVPGVKAVPNQKDAAGRRGVAITFDDRFSHRSNAETGAGNSFIFDPDTYEFLGFRDTRTSHGRTYDQFSYLDSWAVTDKAKQRPQAG

SEQ ID NO: 13604 - protein, 206 aa, Streptomyces avermitilis
MTVGPDVVAREEHREESDARVIERSRDEPELFAALFDRYAGAVHRYAARRLGPEAAEDLTAETFTTAFRQRHTYDLGRADARPWLFGIATNLVARHRRAEARRFKALARVPQPVEHEEPVADRAVARAGATGVRRELAAALSGLSARHRDVVLLVAWGGLDYEEAAQALGVPVGTVRSRLHRARGRLREALGGTDPTAFREADAHA

SEQ ID NO: 13605 - protein, 214 aa, Streptomyces avermitilis
VAEHDSDREPEEKGVPIDEEAAWAAIVAGYGEEPPDPPGAKPFKSIEDLALLDPETNDGDAGAGSGADPGSESDADPGSDSASDAGSGSGSADKPSAGKPLGSSVAFAPGIGGGPRDYAAPDASEDDFDEDDEGHFVPPEPPPLPAADATAKFAWLGVVGGPILLLLAVLLGWDMTWWLTTVGIGGFLGGFATLVMRMRTGDEDDEDPGRGAVV

SEQ ID NO: 13606 - protein, 305 aa, Streptomyces avermitilis
VRSRTVKYASKPRGTLVVLFVITPLMNTHLMNRRPKVPVLPGAEPYRHEGGEVGVLLCHGFTGSPQSLRPWAEYLAERGLTVSLPLLPGHGTRWEDMQLTGWQDWYAELDRELRALRDRCTQVFVFGLSMGAALAMRLAAKHGDEISGLVLVNPANKVHGPAAYALPVLRHLVPSVKGIISDIAKEGGVEIGYSRVPLHAAHSMRNLYALVDGELPQVTQPMLLLHSPQDHVVPPADSARILSRVSSTDVTESLLEQSYHVATLDHDADRIFEESYAFLGRLAPAVGKKSGVGHVDQQEGTATGG

SEQ ID NO: 13607 - protein, 260 aa, Streptomyces avermitilis
LIYGAMKFSIGGPLKLAFRPWVEGLENIPAEGPAILASNHLSFSDSFFLPAVLDRKVTFIAKAEYFTTPGIKGRMTAAFFKGVGQLPVDRSGARGAGEAAIKSGIEVIERGELFGIYPEGTRSPDGRLYRGKPGGLARVALATGAPVIPVAMIDTEKIQPPGKVMPKLMRPGIRIGKPLDFGRYSGMEHDRFVLRAVTDEVIYEIMKLSGQEYVDMYATAAKRQIADAAKAEKQAQKDAEKQAQKELEARQALEKERSGS

SEQ ID NO: 13608 - protein, 410 aa, Streptomyces avermitilis
MAKRVRVMSMSVEQPLWRALTGYRVLTMLYAVGLFATAYGTFDRPWVAVAYYAVLCGWTLATLPKVANAASCTKRFLAADLTIALVGILLTPLADAHERIVAGGPTLPSIWTAGSVLAFAVKGGWRWAAFASTAVAVANVFERQAPARDTVHNVILVWVASIAIGYVVEVARASERTLARALEIEAATRERERLARDIHDSVLQVLAMVQRRGAVLGGEAAELGRMAGEQEVALRTLVAGGLLPASRVSEDESQGAVVRAVEEPDEEGPLDLRALLVPYATAKVTFSEPGAPVRLAHAAAKELAAAVGAALDNVRKHAGDSARAWILVEDEPDAVIVTVRDDGPGIPAGRLAQAEGEGRLGVAQSIRGRLRDIGGTAELISVPGQGTEVELKVPKDPGHPKAARGKAERG

SEQ ID NO: 13609 - protein, 215 aa, Streptomyces avermitilis
MVVDDHPMWRDAVARDLAESGFDVVATAGDGEQAVRRARAAAPDVLVLDLNLPAKPGVQVCKELVGANPALRVLVLSASGEHADVLEAVKSGATGYLLKSASTEELTDAVRRTAVGDPVFTPGLAGLVLGEYRRLASEPAPATGAGEPRAPQLTDRETEVLRLVAKGLSYKQIAERLVISHRTVQNHVQNTLGKLQLHNRVELVRYAIERGLDEA

SEQ ID NO: 13610 - protein, 342 aa, Streptomyces avermitilis
MRVGVLTGGGDCPGLNAVIRGVVRKGVQEYGYDFVGFRDGWRGPLEGDAVRLDIPAVRGILPRGGTILGSSRTNPLKLDDGIRRIKENLAKQEVDALIAIGGEDTLGVAARLTDEYGVPVVGVPKTIDNDLSATDYTFGFDTAVGIATEAIDRLHTTAESHMRVLVCEVMGRHAGWIAIHSGLAGGANVILIPEQRFDVDQVCAYVTSRFKASYAPIVVVAEGAMPKDGQMVLKDESLDSFGHVRLSGVGEWLAKEIEKRTGKEARTTVLGHVQRGGTPSAFDRWLATRFGLHAIEAVRDGDFGKMVALRGTDIVRVPIAEATAKLKTVDPKLYEEVGVFFG

SEQ ID NO: 13611 - protein, 661 aa, Streptomyces avermitilis
MITNDHEGRGTMDLTRLLHEDRPFALLRRRTPGRSTEDSATVEVLLGPVATYERLADLPDEGLALIPFRQIRERGFDVRDDGTPLLVLTPEESHEIPLEQALSQLPTHDVRVEDGGFDVADDEYAEIVGRVLREEIGRGEGANFVIRRTYEGEIPGFGRADVLALFRRLLVGEQGAYWTFVVHTGTGKGPAGSSPEGRETGGRTLVGASPEVHVRMSGGTVVMNPISGTYRYPAEGPTPEDLLDFLADGKEIEELSMVVDEELKMMCTVGDMGGVVVGPRLKEMAHLAHTEYELRGRSSLDVRDVLRETMFAATVTGSPVQNACRVIERYEPLGRDGVGRGYYAGALALIGRDAGGAQTLDSPILIRTADIDADGRLRVPVGATLVRGSDPAGEVAETHAKAAGVLAALGVRPARPRQEGVRPRLADDPRVRAALDGRRASLAPFWLRMQERTDALTGHALVVDAEDTFTAMLAHVLRSSGLEVTVRRYDEPGLRKAVLAHEGPLVLGPGPGDPNDPADPKMRFLRALTAEVLRGHRHGVLGVCLGHELIAAELGLEIVRKEVPYQGAQTGIDLFGRTETVGFYNSFVAHCDDETALELAAHDVEVSRSGTGEVHAMRGPGFAGIQFHPESVLSVNGTAVVRDLLDQLRGADTFFERRPAV

SEQ ID NO: 13612 - protein, 421 aa, Streptomyces avermitilis
VYTTWTPRRRRAARPLTALVAATALGAGTLGAAQAAPRSSDDTIRVTYRGYEFAVPAGWDVIDLDKDPGACVRFDQHAVYLGTPGDRQDCPARAKGRTEALLVQPAEAATAEVTENRTAGTYRAVADQIAVTAAYGQDREQIQEILRGAGLPVASARAESGAEVPAAPAVPDDATTFKGKGFDACTAPSQASMDAWKGTSGYGAIGVYVGGVNRACAQPKLTAKWVQTQYANGWRFFPLYVGRQPSADGGSCLGGCASITDPEPQGKDAADDAVRQAAAVGFGPGSVIYNDLEHYAGGTAVTTRVLTYLESWTTRLHELGYRSGAYGSVSSLITDLVKHADDRTLPDVIHFAHWNDEATTTDPVLPADLWADHQRIHQYAGNRTETHGGVKISIDRNKLDVGSGTGKRSSIERGPSQLMSR

SEQ ID NO: 13613 - protein, 450 aa, Streptomyces avermitilis
VTVNAKSSASAGNTWRDLPAAQQPEYPDAEALRDVIADLESYPPLVFAGECDQLRARLASVAKGEAFLLQGGDCAEAFDGVSADHIRNKLKTLLQMGAVLTYAASVPVVKVGRIAGQYSKPRSKGTETRDGVTLPTYRGDSVNGFDFNEKARIPDPERLKRMYNASASTLNLVRAFTTGGYADLRQVHAWNQDFVKSSPSGQRYEQLAREIDNALNFMRACGTDPEEFKTVEFYASHEALLLDYESALTRVDSRTGKLYDVSGHMVWIGERTRQLDGAHIEFASKIRNPIGIKLGPTTTAEDALQYIERLDPDREPGRLTFIVRMGADKVRDKLPELVEKVTASGATVAWVTDPMHGNTFEAASGHKTRRFDDVLDEVKGFFEVHKGLGTHPGGIHVELTGDDVTECVGGGDEIFVDDLHQRYETACDPRLNRSQSLDLAFLVAEMYRDQ

SEQ ID NO: 13614 - protein, 87 aa, Streptomyces avermitilis
VNRVYVCSCFGVTEAQVKKHADGGACTPRQIASACKAGTDCGGCVRRIQEILGRGACPRREPADRAQPLFARAEKADERVEVLDEAA

SEQ ID NO: 13615 - protein, 159 aa, Streptomyces avermitilis
MQGDPEVIEFLNEQLTAELTAINQYFLHAKMQENFGWTKLAQYTRRESFDEMKHAEVLTDRILFLDGLPNYQRLFHVRVGQTVTEMFQADRQIEVEAIDRLRRGVEVMRAKGDITSANIFESILEDEEHHIDYLDTQLELVEKLGEALYIAQVIEQPES

SEQ ID NO: 13616 - protein, 210 aa, Streptomyces avermitilis
MGQPVERESGEAAQSELPPGQRLQRGWPVTHYGPVPKFRPERWEFRVFGATADGEKHCWTHEEFTALPYASVVSDLHCVTKFSMLGAEWGGIPARTILEIAPPAPTVTHVMVWAEYGFSSNLRLADFASDRTIFATHKDGELLTAEHGFPLRLVVPHLYAWKGPKWVRGVEYMTADRRGFWEERGYHNVGDPWREQRYSYQEEPGEGPEL

SEQ ID NO: 13617 - protein, 198 aa, Streptomyces avermitilis
MGIPLGGMTLPIGTGTTTHSTSGAFMRHDAHAGHHGHAEPVGHEAHPPAHSPGKVGWAMAAQATLHCLTGCAIGEVLGMVVGTALGWGNVPTTILAIVLAFFFGYSLTLRGVLKAGVGFRTALRVALAADTLSIAVMELIDNGVIALWPAAMDAHLDDVLFWGSLALSLVAAFVITVPVNRWMIGRGKGHAVVHQYHH

SEQ ID NO: 13618 - protein, 310 aa, Streptomyces avermitilis
VNNQQSRGALGTSGATPDLPDATPGLSRNPVGGHVPVAGGLHSVGLAYARDLAAEAVQVFVANPRGWATPAGNPRQDEEFRAACAAESIPAYVHAPYLINFGSHTEATVEKSVESLRHSLRRGREIGALGVVVHTGSATGGRERSVALAQVREHLLPLLDELTHDDDPYLLLESTAGQGASLCSRTWDFGPYFEALDAHPKLGVCLDTCHIFAAGHDLTGPSGMHQTLDLLVDTVGEGRLKLIHANDSKDVVGAHKDRHENIGSGHIGEDPFRALMTHPATEGVPLIIETPGGKEGHAADVEQLKKLRDG

SEQ ID NO: 13619 - protein, 648 aa, Streptomyces avermitilis
VAARRLTCVDTTLQDPLLGQVLDGRYRVDARIAVGGMATVYRAVDTRLDRVLALKVMHPTLAADGSFVERFIREAKSVARLAHPNVVQVFDQGADGSYVYLAMEYVAGCTLRDVLRDRGALQPRAALDILEPVLAALGAAHRAGFVHRDMKPENVLIGDDGRVKVADFGLVRAVDTVTNTTGSVLGTVSYLAPEQIEHGTADTRVDVYACGVVLYEMLTGGKPHAGDSPAQILYQHLHEDVPPPSAAVPGLPATLDELVSSAAARNPGLRPPDAVALLAQVLEARAALSTEQLDAVPPQAIATQHGGAEDRTSVIPRSLTVPRPLPVNEDEQINRTSRFESPPVSPRRRSGRPRRGPLVIVAAVLLVLGLGAGVWYINSGQFTKVPPVLAKTQVEATAQLEKAGLDVKQVRHDYSDTVKRGTVIRSDPKPGARIRDNDSVTLTISDGPRTVKVPDLAGLPLSKARAELKADGLAPGMVSRAVSDDVPKGSVISTDPAAGTERRGGSAIAFTVSKGSPVEVPEVTGESVDDATADLEDAGLKVRISSQRVTSAEFEKGQVVEQSPGADDDKVAEGDTVTLTISKGPEMVEVPDVVGDSVADAQQTLEDAGFEVDKDRGLLGFFGDEVKDQSVEGGEKAPKGSTITIKIR

SEQ ID NO: 13620 - protein, 264 aa, Streptomyces avermitilis
MADDPFVLGDTPFSSRLIMGTGGAPSLDILERALVASGTELTTVAMRRVDAGVHGSVLSVLDRLGIRVLPNTAGCFTAGEAVLTARLAREALGTDLIKLEVIADERTLLPDPIELLDAAETLVDDGFTVLPYTNDDPVLARKLEDVGCAAVMPLGSPIGSGLGIRNPHNFQLIVEHARVPVILDAGAGTASDVALAMELGCAGVMLASAVTRAQEPVLMAEGMRHAVDAGRLAYRAGRIPRRHFAEASSPPEGRAHLDPERPAF

SEQ ID NO: 13621 - protein, 66 aa, Streptomyces avermitilis
MNISVNGERRRIAPGTALDTLVKTLTAAPSGVAAALNETVVPRAQWSSTALSEGDRVEVLTAVQGG

SEQ ID NO: 13622 - protein, 388 aa, Streptomyces avermitilis
MSPTHTSDVLVVGGGIIGLVTAWRAAQRGFATAVVDPDPGGGAAQVAAGMLAAVTELHYGEQTLLGLNLASARRYPDFAAELTEATGHDLGYRRCGTLAVALDADDRAQLRELHALQRRSGLESEWLNGRECRRLEPMLAPGVRGGLRVDGDHQIDPRRLAKALVVACERAGVVFHRVWAERLFLVRGRAAGVVTRDGAELAAGQIVLAGGSLSGQLAGVPDDVLPPVRPVKGQVLRLTVPKRYAPFLSRTVRAVVRGSQIYLVPRESGELVVGATSEELGWDTTVTAGGVYELLRDAHELVPGITELPLTETRAGLRPGSPDNAPLLGPTELDGLLLATGHFRNGVLLTPVTGDAMAHVLTTGELPDEARPFTPRRFSTAVLTEQSA

SEQ ID NO: 13623 - protein, 127 aa, Streptomyces avermitilis
VPFASVREPPAMARSLDGLVLAPVTDQAPGQVGTRTRFTYHEKDGEIWAEYAGGDVVRGHLVGRREGDRLDFRYVQLKHDGTTSSGHCVSTVIELADGRVRLQETWEWESQPGNGTSVVEQVTEHAP

SEQ ID NO: 13624 - protein, 409 aa, Streptomyces avermitilis
VSEQTQERGRTAARRVVVVGAGMAGVQTAVALREQGFTGGVTLIGAEPHQPYDRPPLSKAVLLGKAEGSAFDVDFEALGIELQLGREALGLRPEDHELDTDSGPVPYDVLVAATGAEPIQLPGAEGVPGVHLLRTLDDAERLRPVLAQQHDIVVVGAGWIGAEFATAAREAGCAVTVVEAADRPLAGALPAEVAAPMTAWYGDSGARLLTHARVERIEPGAVVLDNGSRVPAGAVVVGIGARPATAWLVGSGIALGAHQEVLADNHLRTSLPDVYAVGDCASFPSGRYEARLLVHHWDNALQGPRTVAANIIGEAPAAYDPVPYFWSEQFGRFVQYVGHHATADATVWRGDPEGAAWTVCWLREGRLVALLAVGRPRDLAQGRKLIESGAPMNPELLADASRPLKAAVV

SEQ ID NO: 13625 - protein, 121 aa, Streptomyces avermitilis
VTEIDAKIDALVPAWLTLPDIAEQFGVEVTRVRQLVKEGQVIAVRRGENRALHVPAAFIDGDKVVKGLTGTLTLLRDDGFSDEEMIEWLFTPDESLPGTPAQALSENRGTEVKRRAQALAV

SEQ ID NO: 13626 - protein, 225 aa, Streptomyces avermitilis
VSHRQRGNSTMPDTARDRLADARVYLCTDARRRQGDLAEFLDAALAGGVDIVQLRDKGMEAAEELEHLQVFADACRRHGKLLAVNDRADVAHAVDSDVLHLGQGDLPVPAARAILGADVLIGRSTHAEAEAEAAAVQEGVDYFCTGPCWPTPTKPGRHAPGLDLVRHTAALGTDRPWFAIGGIDLGNLDEVLEAGARRVVVVRAITEADDPKAAAEEFAKRLRHA

SEQ ID NO: 13627 - protein, 307 aa, Streptomyces avermitilis
MALGTASTRTDRARTVRDMLASGKTTYSFEFSAPKTPKGERNLWSALRRVEAVAPDFVSVTYGAGGSTRAGTVKETEQIVADTTLTPVAHLTAVNHSIAELRNIIGQYADAGIRNMLAVRGDPPGDPMGEWVPHPRGLTYAAELVRLIKESGDFCVGVAAFPEMHPRSADWEADVERFVDKCRAGADYAITQMFFHPESYLRLRDRVAAAGCETPVIPEIMPVTSVKMLERLPQLSNAAIPSVLQERILTAKDDPAAVRSIGIEFATEFCARLLAEGVPGLHFITLNNSTATLEIYENLGLHHPQQA

SEQ ID NO: 13628 - protein, 305 aa, Streptomyces avermitilis
MGWTVLYIAFGIVALWLLGEVLLQYKARLRWRLLAFGGFLGVVLGVLIPSVIVIGLGAAAFAVGQTYVTLSFRRGFAAGWAVGNRPRESGGSKRRRGEAARQEPTLEVTDLQPTAAGTYRREEAYDPDHDDVFTRPQPAEAAAESTAVYEPQPLPDDTGSYGVYSDAAYAAATDPSYAAAAQTPDQNFAYDGYAGYDQQQYGYDNGQQQYAAYSDPYIGTQTYGGGSYDASYGGQQQYGQQAYGQDSYATGTYGGETPPGGVWVPQQRTTDDAYGGELPPEQPYPYQGNGGGDGNAHGYDEQYRF

SEQ ID NO: 13629 - protein, 497 aa, Streptomyces avermitilis
MARIAVIGAGMGAMAAAARLAVAGHRVAVYERAATYGGAVGRFARDGFRFDTGPGLLPLPAVHRDLFVKTGKEPLEACVELVQVDPSSRHVFADGTAASLPNASRAGVVTALDEALGAGAGGRWGDFLVRAREAWDRTRRPLLEEPLWPNWEVLAERDPYPAVPHKRLLRTRRAGTLADIGAWELRDPRLASLLESHALAYGLDPRVTPASAAVLPYMEHAFGTWYVRGGIRELARAVHERCLARKVEFVFGAEVTGIVEKDGRAAGLELADGTVAEADHVVAGVAPGVLDRLTAGRAVRGDGDVGPRRGVPSRLTVLLALRGTRPEGTAHRTVVHTTDRQGELDRLFGEPAGLPATPTLTVLRPDDPGLVPDGGHEAVTLTLPAPSGLRVTESDVDRILGVAERAIPDLRDRLLWHETRTPDDIAQATGAPGGAIPAPALAAADGRLLHPANTTRMPGLFTVGGWSHPGGGLPHAGMSGALVAGLIVEGPDFRGSQ

SEQ ID NO: 13630 - protein, 217 aa, Streptomyces avermitilis
MPRPCCCRLVTIASVSVLPLVFTSGWASGINAYAVVLLLGVFGATGLSDDVPESLQRPEVLITAGVLFLCEAVADKIPYVDSAWDAAHTVIRPAAGAWVGALLAGQSGSLSDVAAGAIGGSTALASHAVKAGTRMAINASPEPFSNVIMSVAEDLGVGGIVTFAMFHPEAAAVIAGVLLLLGLLTLFFLVSRIRRFLRRRAQRREERRLARRLGPPG

SEQ ID NO: 13631 - protein, 227 aa, Streptomyces avermitilis
VTVRATVPVTINAMDSSKTKHGGTATAGGGRREATRQKLYEAAVTLIAEQGFSATTVDEIAERAGVAKGTVYYNFASKSVLFEELLRHGVGLLTASLREAAEKTAREGGSKVDALDAMIRAGLVFIDRYPAFTQLYVAELWRTNRAWQSTLMVVRQEAVAVVEDVLREGVAGGELSDEIDIQLTAAALVGMVLVAALDWQSFQPERSLDDVHAALSRLLQGRVSGSR

SEQ ID NO: 13632 - protein, 694 aa, Streptomyces avermitilis
MRSPKLAALELRRFGRGKLPRAALAALMLLPLLYGALYLWSFWDPYGRLDRIPVALVNDDQGATAAGKKVTAGDDITKGLRESETFQWHEVSAAEARKGVEDGTYYLSLTMPSDFSKRIASSSGDSPETGALQVRTNDANNYIVGQISRTVFSEVRTAASTKASRSFLDKIFISFSDIHGETEKAAKGADKLTGGIGKAKKGSKDLADGLKDAKAGSGKLSSGLKKLDTGAGDLQDGARQVAGGTQALADKVGGAADQVRPFLKNNGRTIADTATTVADSAGVIRKHLDAFVTTAPLAESGTRKASETLNGVYERRCENQLVPDPACDDLKKAKDAAADAARLTADVNTVVQDYHGDMTALEKDLVTLQRQARALAKAAPHLSEDLDDAVTKVDALNKGAAKVAKGAGTLHTGLGTAKTGAADLDTGVGKLQTGATDLTGGMYKLVDGSGKLAGGLHDGADQIPDYDKQDRDARTQVMADPVQLASRDLHNAPNYGTGFAPYFIPLSLWVGAMVAYMLIQPLNRRALAAGSSAWRIALAGWLPVAAVGVLQTAALMSVLHWAIGLEMARAAGTVGFLFLVTACFAAIVQWLNARFGAAGRILVLALLMLQLTSAGGTYPVQTSPGFFNALHPFLPMSYVVEALRRLISGGGLGPVWQACAVLVAFTAGALALTALSARRKQVWTLDRLHPELSL

SEQ ID NO: 13633 - protein, 340 aa, Streptomyces avermitilis
MADQRGHGGYVAGDVTGDVEGGVEGDMRENRPADTQRDTQADADADARTDTQADTQADTQGGLDGPRAPVGIAVGAENFGLKGPRGWAFRGVGFDAAPGSLIAVEGPSGSGRTCLLLALTGRMKPTEGHATVGSLRLPKQMSAVRLISAPAHVPGVTDLDPALTVGEHLGERALLERRYGGSLRGLLRPRAERTTEAKLRIDTALAAAGLDREALPKGSRTAVRDLERLQALRLSIALALIGRPRLLAVDDTDLKLSDAERAEVWTLLTSLTESGTTVVAVCSEAPAGAVVVSTRQAAEPTHGTPDAHETHETHAASKTPETLETNDKETADALPEAGRA

SEQ ID NO: 13634 - protein, 182 aa, Streptomyces avermitilis
MASSNAAAARRRRAPGPAPSLTGQAGDVHPVLRRATAPPAALDLLAQARAGLEEATGLDMANERYATAHLAALRTAAAVLAARARPEPNARRRARIRSAWEVLPEIAPELSEWSALFASGAGRRARAEAGIQGAASNRDADDLIRDVAMFLRLVERMLVLQPVLPQPRQDDDRGDREVPDAG

SEQ ID NO: 13635 - protein, 256 aa, Streptomyces avermitilis
VSDPMRPRASLRTAVVWEVLKDALDRRVKATGRDALDVLDTGGGSGNFAVPAARLGHRVTVVDPSPNALFALERRAAEAGVADRVKGVQGDAHGLFDVVERGGYDAVLCHGVLEYVDDPAEGVRNAVAALRPEGVLSLLAAGLGGAVLARALAGHFKEAKQALEDPNGRWGEGDPVPHRFTVEQLTALVEGAGLRVGAVHGVRVFADLVPGVLVDTEPGALDALLKLEEAAAEFPAFHSVATQLHVLGETQAAADA

SEQ ID NO: 13636 - protein, 130 aa, Streptomyces avermitilis
VPLSEHEQRMLEQMERALYAEDPKFATALEGSGLRTYTRRRVYQAVAGFLVGIALLMAGMVAQQIWISVVGFLVMLGCAVLAVTGWRKAPKPGEQSAAGAPGARRQPRRRRSMMDRIEQRWQRRRDEQGH

SEQ ID NO: 13637 - protein, 795 aa, Streptomyces avermitilis
MSGRARLALCAAAATLMASCALLPLVDPPTWLFQAAFLVAVQTGVGALTRRVPLARPLTIACQVLVTLLLLTLTFAREQALAGFIPGPDVFQRFGELLQSGTDDVGRYAIPAPLSPGIRLMMVGGVLVIGLAVDALAVTFRTAAPAGLPLLALYSVAAGLSDGAADWLWFVVAAAGYLMLLLAEGRDRLSQWGRVFGGAARAPGTDSGGAVAPVRTGRRIGAVALGVALIVPLGLPALDGGLLDGARTGVGAGTGDGGTISAVNPLVSLRDSLNVDQDRQVMSYRTNTENTRDMYLRIVSLDDFDGTSWKPAQRHIVGVPDTFQTPIGLGTDIRRTEIETRVSAADWYAQDWLPMPYPATGVQIKGKWRYEPIGRTLVGDHGQNTRGAQYTVKSLIVQPTAEQLALSPEPPAALKREFTKVPDSLPAVVARTAREVTDGSANHYEQAVKLQDYFAVNGGFTYDTQVQAGSGSAAIARFLKQKQGFCVHFSFAMAAMARTLGIPARVAVGFTPGSPQADGSMSVGLRDAHAWPELYFEGVGWTRFEPTPNRGTTPTYTQSDTPSGDSPDVPKPTRSASAAPSAAPSASASCSAQERKLEACPSQSAQAVAGSGDAGPPWYGILLWTLVGLVVLVLPFLPMLWRMRVRAVRLGTHGRTEESAAAHALAAWQEVTDTAWDHGIAPDESQTPRKAAARIARLGHLDPAAAAAVHRLAAAVEQVLYAPRPRPTAGLAEDARLVGSALNSTVSRPTRLRALLAPRSAVRMAWAVSDRWTALRTNLAARRPTLPRRPSSQNG

SEQ ID NO: 13638 - protein, 453 aa, Streptomyces avermitilis
VMTQGAPAPTPEEDKGGLRTALAGLTTRGRSFLAAGIAAAICAYVLGQSDLLRVGLLLAVLPLVCATVLYRTRYRVAGSRRLSPGRVPAGSEARVHLRMDNVSRLPTGLLMLQDRVPYVLGPRPRFVLDRVEAGGRREVSYRVRSDLRGRYPLGPLQLRLTDPFGMCELTRSFSTYDTLTVIPRVEPLPPVRLSGEAKGYGDGRQRALALAGEDDVIPRGYRHGDDLRRVHWRLTARYGELMVRREEQPQRSRCTVFLDTRGLAFQGAGPDSAFEWAVSGAASTLVHMLERGFSVRLLTDTGSSVPAEGADGFAGASQESADAAGLMMDTLAVIDHSDGTGLSHAYDVLRGGNEGLLVAFFGDLDEEQATVVAKMRPRSGGAVAFLLDSESWVREAADVPGPLDKSEERLRMLREAGWTALKVPRGAGLADLWRQADRQRMGIGAGSGTEGRS

SEQ ID NO: 13639 - protein, 343 aa, Streptomyces avermitilis
VTTYDDRASLTDLTATVERVRSSVEGVIEGKPEVVRLSLTVLLAEGHLLIEDVPGVGKTMLAKALARSIDCSVRRIQFTPDLLPSDITGVSIWDQQRREFEFKPGAIFAQIVIGDEINRASPKTQSALLESMEERQVTIDGHTYELPSPFMVVATQNPVEMEGTYPLPEAQRDRFMARVSIGYPSAEAELEMLDIHGGVNPLDDLQPVAHAHEIVKLVDAVRSVHVAESVRRYAVDLVAATRTHPDLRLGASPRATLHLLRAAKASAALSGREYALPDDVQALAVAVLAHRLLPTAQAQLNRRTAEQVVQEILQRTAVPATPQQQAGFTTGRGAFGQQPPRRL

SEQ ID NO: 13640 - protein, 182 aa, Streptomyces avermitilis
MTTSASVPTEPEDAISTDGTVTDRLIDANQRYAAAFSDPGMDARPVLHVAVVACMDARLDLHAALGLELGDCHTIRNAGGVVTDDVIRSLTISQRALGTRSVVLIHHTGCGLESLTEDFRHELEMEVGQRPAWAVEAFRDVEQDVRQSMQRVRTSPFLLHTDDVRGFVFDVKTGRLREIDPA

SEQ ID NO: 13641 - protein, 318 aa, Streptomyces avermitilis
LSQSRHVPVMLQRCLDMLAPALTEPGAVVVDCTLGLGGHSEALLTQFPEARLVALDRDKEALRLSGERLAPFGDRATLVHAVYDELPDVLDRLGVPRVQGVLFDLGVSSMQLDEADRGFAYAQDAPLDMRMDQTTGISAAEVLNTYPPGEIVRILRAYGEEKQAKRIVSAIVREREKEPFSNSARLVELIRDSLPQAAKRTGGNPAKRTFQALRIEVNGELSVLERAIPAAVKALAVGGRIAVLSYHSLEDRLVKQVFAAGAATTAPPGLPVVPERYQPRLKLLTRGAELPTEEEIAENRRAAPARLRGAQRIREDAE

SEQ ID NO: 13642 - protein, 175 aa, Streptomyces avermitilis
MRRRGGRVSGKPQLKGRAARLARLFPAGAGQAARAPFVLLVVLLLGGGLIGLLVLNSALSEGSFKLDDLQKETKSLTDEEQALQRDVDAYSAPDALQRRARELGMVPGGDPAFLDPDGTVKGVPRAAGQSSLRTSAVRPPEVLSPYPAPPPAQSHPLGAPATTTQPALPSSTTGR

SEQ ID NO: 13643 - protein, 653 aa, Streptomyces avermitilis
VTEVSDREPPRRRVPGPARPVRPGNQRRPGPGARPARRPAPSRGPAPRTIRLGSPRPRLRMVSLALTLVMIAFVVRLLQVQAVDASTYAAKADKNRYVGHVLTAERGGITDRGGVALAISVDANDITADPTMFTRKQLKIDDGPEQAAALLAPILGQDQATLTEKLRTSNTQYVLLARRQTPQVWKQIKDLKTALTKKAESDGSTVNVLAGVFQDPSSKRVYPNGDLAAGILGWVNAEGKGGGGIEQQLNKELTGKDGKIRYAQSGGRLVPTAGSTETPAVAGSDVELTIDRDIQWAAQNAITEQVEKSGADRGYVMVQDTRTGEILAMANSPGFDPNDLSKASSAALGNAALQDAYEPGSTAKVMSMAAVLEENVATPETHVVVPNRLHRGDRLFQDDIDHPTWNLTLNGVLAKSSNIGTILAAGQLGKTQKQANEVLYSYMRKFGIGLPTGLGFPGETSGILAPAAKWSTSQQYTIPFGQGVSINAMQAASVYSTIANGGVRVEPTLVRGTKGPDGRFTPAPRPKKTRVVSEKTAKTLAQMLESVVDDEEGTGAKARIPGYRVAGKTGTANRVDPATGKYHGYTSSFAGFAPADNPRITVYCAIQNATQGSYFGGQICGPIYKQVMEFALKTLQVPPTGAGAAHLPVTFTP

SEQ ID NO: 13644 - protein, 506 aa, Streptomyces avermitilis
VTYPGPPRPAHVSATPLAELAGQMGAATPERDAEVTGITHDSRAVRPGDLYAALPGARLHGADFVTQAAGLGAVAVLTDPTGADRAAATGLPVLVVDDPRGRMGELAATIYGHPGRDLLQIGITGTSGKTTTAYLIEGGLRTVRSTGLIGTVEMRIGDERIKSERTTPEATDLQALFAVMRERGVDAVAMEVSSHALVLGRVDGCVFDIAVFNNLSPEHMEFHSDMEDYFRAKAQLFTPQRSKLGVVNFDDEYGRRLVEEAGVPIVTFSAEGHPDADWRAQDVEVGPMDSTFTVIGPKEERITARSPLAGPFNVANTLAAIVALAAAGLDPQAAADGIAAVPGVPGRLERVDVGQPYLAVVDYAHKTDAVESVLRALRKVTEGKLHIVLGCGGDRDRTKRMPMGAAAARLADTAVLTSDNPRSEDPLAILATMLAGAAEVPSHERGEVQVFENRAAAIAAVVARARPGDTVLVAGKGHEQGQDIAGVVRPFDDRLVLREAIQQTQG

SEQ ID NO: 13645 - protein, 471 aa, Streptomyces avermitilis
VIALSLAEIAAVVGGQTYDIPDPAVQVTGPVVRDSREVESGSLFVAFAGERVDGHDFAAAVVEAGAVAVLASRPVGVPAIVVDDVQTALGALARHVVERLGATLVALTGSAGKTSTKDLIAQVLRSKAPTVFTPGSLNNEIGLPLTALSATEETKFLVLEMGARGIGHIRYLADLTPPKVGLVLNVGTAHIGEFGGREQIAQAKGELVEGLPPAEDGGAAILNADDPLVRAMASRTKARVILFGESDEADVRAENVRLTAGGQPSFSLHTPSGCSDVTMRLYGEHHVSNALAAAAVAHELGMSADEIARALSEAGSLSRWRMEVTERPDGVTVVNDAYNANPESMRAALRALAAMGKGRRTWAVLGKMAELGDEALAEHDAVGRLAVRLNVGKLVAVGGREASWLQLGAYNEGSWGEESVHVSDAQAAVDLLRSELRPGDVVLVKASRSVGLESVAQALLETGAEGEVVAR

SEQ ID NO: 13646 - protein, 357 aa, Streptomyces avermitilis
MMKQILFSGVIGLFLTLVGTPLLIKLLARKGYGQYIRDDGPREHHSKRGTPTMGGIAFILATIIAYFMSKVITGYTPTFSGLLVLGLMAGMGLVGFLDDYIKIVKRRSLGLRAKAKMAGQLIVGIAFAVLALQFADNHGNTPASTRLSFVEDFGWTIGPVLFVIWALFMILAMSNGVNLTDGLDGLATGAATMVFGAYTFIGVWQFQESCANAQTLTNPAACYEVRDPLDLAVVASALMGACFGFLWWNTSPAKIFMGDTGSLALGGALAGLAICSRTELLVALLGGLFVLITMSVVIQVGSFRLTGKRVFRMAPLQHHFELKGWSEVLVVVRFWIIQGMCVIVGLGLFYAGWAAKK

SEQ ID NO: 13647 - protein, 467 aa, Streptomyces avermitilis
VTNWQGKNVTVAGLGVSGIPAARVLHGLGAVVTVVNDGDDERSRAQAADLEALGITVRLGDGATLPEGTELIVTTPGWQPDKPLFAAAAEAGVPVWGDVELAWRLRGPGSAPWLAVTGTNGKTTTVQMLASILTAAGLRTAAVGNIGVSLLDAVLGEETYDVLAVELSSYQLHWAPSLRAHSATVLNIAPDHLDWHGSMEAYTADKGRIYEGNRVACVYNVADKATEDLVRAADVEEGCRAVGFTLGTPGPSQLGVVEGILVDRAFVEDRQKNAQELAEVADVHPPAPHNIANALAAAALARAFGVPASAVRDGLRAFRPDAHRIAHVADVDGVTYIDDSKATNTHAAEASLAAYGSIVWIAGGLAKGASFDELVAKSAQRLRGVVLIGADRALIREALARHAPEVPVVDLDRTDTGAMPAAVQEARRLAVAGDTVLLAPACASMDMFANYNKRGDAFAEAVRGLGA

SEQ ID NO: 13648 - protein, 449 aa, Streptomyces avermitilis
MPTSRTGRPPVQRATRRPAASRSRRENPVQSLYHRARRAWDRPLTAYYLILGSSLLITVLGLVMVYSASQITALQMSLPGSYFFRKQFLAASIGTVLLLTASRMPVRLHRALAYPLLAGAVFLMILVQVPGIGVAVNGNQNWISVGGPFQLQPSEFGKLALVLWGADLLARKQDKRLLTQWKHMLVPLVPAAFMLLGLIMLGGDMGTAIILTAILFGLLWLAGAPTRLFGGVLAIATTIGIILIKTSPNRMARLACIGATDPGPGDHCWQAVHGIYALASGGIFGSGLGASVEKWGQLPEAHTDFIFAITGEELGLAGTLSVLALFAALGYAGIRVAGRTEDPFVRYAAGGVTTWITAQAMINVGAVLGLLPIAGVPLPLFSYGGSALLPTMFAIGLLIAFARDEPAARAALAMRQPRFGRKRAGGPAGPRRWKTMRRRASAARSSGER

SEQ ID NO: 13649 - protein, 363 aa, Streptomyces avermitilis
VHVVLAGGGTAGHIEPALALADALRRQDPTVGITALGTERGLETRLVPERGYDLALIPAVPLPRKPTPELITVPGRLRGTIKAAEQILERTKADAVVGFGGYVALPGYLAAKRLGVPIVIHEANARPGLANKIGSRYAAQVAVSTPDSKLRGARYIGIPLRRSIATLDRAAVRPEARAAFGLDPNLPTLLVSGGSQGARRLNEVVQQVAPYLQQAGIQILHAVGPKNEMPQVHQMPGMPPYIPVPYVDRMDLAYAAADMMLCRAGAMTVAELSAVGLPAAYVPLPIGNGEQRLNAQPVVKAGGGLLVDDAELTPEWVQGNVLPVLADPHRLYEMSRAASEFGRRDADDLLVGMVYEAIAARHR

SEQ ID NO: 13650 - protein, 263 aa, Streptomyces avermitilis
VAGPTTAERGERQKLESGPPRLPRLRPRPRTFIILLCAVVLAGAGSVWVLYGSPWLRVERVSVSGTRVLTEGQVREAADVSLGSPLISVGIDEIEARLRQKLPRIDSVDVVRSWPHGIGLKVTERTPVLIVENSGNGGKYVEVDAKGVRFATVSDAPKGVPVLELAVSRSAAALRRFPEARLVREAVRVAGDLPAAVARDTGTVKVRSYDSISLELSGGRTVMWGSGEKGSAKARTLTALLKASPGARHFDVSVPTAPASSGS

SEQ ID NO: 13651 - protein, 396 aa, Streptomyces avermitilis
VAAPQNYLAVIKVIGVGGGGVNAINRMIEVGLKGVEFIAINTDAQALLMSDADVKLDVGRELTRGLGAGANPAVGRKAAEDHREEIEEVLKGADMVFVTAGEGGGTGTGGAPVVANIARSLGALTIGVVTRPFTFEGRRRANQAEDGIAELREEVDTLIVIPNDRLLSISDRQVSVLDAFKSADQVLLSGVQGITDLITTPGLINLDFADVKSVMSEAGSALMGIGSARGDDRAVAAAEMAISSPLLEASIDGARGVLLSISGGSDLGLFEINEAAQLVSEAAHPEANIIFGAVIDDALGDEVRVTVIAAGFDGGQPPSKRDTVLGSSSAKRDEPTPARPAESRPSFGSLGSVTPKEAPEPAPEPVNELPVSPPVPPSRTYSDSAAEELDVPDFLK

SEQ ID NO: 13652 - protein, 242 aa, Streptomyces avermitilis
VIGQRDTVSGAHFAFTDRWGGVSAVPYEELNLGGAVGDDSDAVRTNRELAAKSMGLDPARVVWMNQVHGPDVAVVDEPWGARPVAEVDAIVTRRRGLALAVLTADCTPVLLADPVAGVAAAAHAGRPGMIAGVVPAAVEAMVELGADPSRIVARTGPAVCGRCYEVPDAMRAEVAAVEPAAYAETSWGTPAVDVSAGVHAQLERLGVCDREQSPVCTLESGDHFSYRRDRTTGRLAGYVWLD

SEQ ID NO: 13653 - protein, 239 aa, Streptomyces avermitilis
MTDRKDQLAANLAKVEDRIAAACAAAGRGREEVTLIVVTKTYPAIDVRILSELGVRDVAENKDQDAAPKAAECSDLPLKWHFVGQLQTNKVRSVVGYADVVQSVDRPKLVTALSKEAVRAGREVGCLIQVALDAQEYGRGERGGVGPGGLEELGDLVAEAPGLRLDGLMTVAPLTGEYAGRQRAAFDRLMDLSTDLRRAHPAANMVSAGMSADLEEAVAAGATHVRVGTAVLGVRPRLG

SEQ ID NO: 13654 - protein, 213 aa, Streptomyces avermitilis
MAGAMRKMAVYLGLVEDDGYDGRGFDPDDDFEPELDPEPERDRRRHEPPHQSHQALHPQRDESVRVVQPPMQRDPVPHSASLPAESVRPARIAPVASITQERQSLEKNAPVIMPKVVSEREPYRITTLHPRTYNEARTIGEHFREGTPVIMNLTEMDDTDAKRLVDFAAGLVFGLHGSIERVTQKVFLLSPANVDVTAEDKARIAEGGFFNQS

SEQ ID NO: 13655 - protein, 94 aa, Streptomyces avermitilis
MSVVFDVIYIALMCFLIVLIFRLVMDYVFQFARSWQPGKAMVVVLEATYTVTDPPLKLLRRFIPPLRLGGVALDLSFFVLMIIVYILISVVSRL

SEQ ID NO: 13656 - protein, 408 aa, Streptomyces avermitilis
MPLTPEDVRNKQFTTVRLREGYDEDEVDAFLDEVEAELTRLLRENEDLRAKLAAATRAAAQNQQQGMRKPPEQQQDQQQGMRGPGSPVPAGISGPPQQQQMGGPMGGPPQLPSGAPQLPAGPGGGQGGPQGPGPMGQGQMGQGPMGQGQMGQGPMGQGQMGQGQMGQGPMGQGPGQMQGQMQQMGGPMGGPMGGPMGGHGPQMSQPGQGPGGDSAARVLSLAQQTADQAIAEARSEANKIVGEARSRAEGLERDARAKADALERDAQEKHRVAMGSLESARATLERKVEDLRGFEREYRTRLKSYLESQLRQLETQADDSLAPPRTPATASLPSSSPSMAPAGASAPSYGGNQTMGGPPAPAAPSYGGQQQMSPAMTQPMAPVRPQGPSPMQQAPSPMRGFLIDEDDN

SEQ ID NO: 13657 - protein, 1047 aa, Streptomyces avermitilis
MKPPQYRQVPAQVDLPALEHAVLDFWREQKIFAKSLEQSEGRPEWVFYEGPPTANGMPGAHHIEARVFKDVFPRFRTMRGYHVARKAGWDCHGLPVELAVEKELGFSGKQDIEAYGIAEFNAKCRESVTRHTDAFEELTSRMGYWTDLNDPYRTMDPEYIESVWWSLKEIFNKGLLVQDYRVAPWCPQDETGLSDHELAQGYETIVDPSVYVRFPLTSGPLAGRAALLVWTTTPWTLVSNTAVAAHPDVTYVVATNGEEKLVVAEPLVEKALGEGWETTGETFTGAEMERWTYQRPFELVEFPAPAHYVVNAEYVTTEDGTGLVHQSPAFGEDDLKVCREYGLPVVNPVRTNGTFEEDVPLVGGVFFKKADEKLTEDLQNRGLLFKHIPYEHSYPHCWRCHTALLYYAQPSWYIRTTAVKDRLLQENEKTNWFPESVKHGRFGDWLNNNVDWALSRSRFWGTPLPLWTCEEGHLTCVGSRAELSELTGTDQSNLDPHRPFIDAVTFACPQDGCGRTATRVPEVIDAWYDSGSMPFAQWGYPYKNKELFESRYPAQFISEAIDQTRGWFYTLMAVGTLVFDKSSYENVVCLGHILAEDGRKMSKHLGNILQPIPLMDQHGADAVRWFMAAGGSPWAARRVGHGTIQEVVRKTLLTYWNTVAFQALYARTSGWAPSEADPAPADRPVLDRWLLSELHALTDQVTQALESYDTQRAGKLLSAFVDDLSNWYVRRSRRRFWQGDKAALRTLHEVVETVTRLMAPLTPFITERVWQDLVFPVTPGAPESVHLASWPEADLSAIDPELSKQMVLVRRLVELGRATRAESGVKTRQPLSRALVAVAGFETLDRELHAQITEELNVTSLAALSEVGGSLVDTTAKANFRALGKRFGKGVQAVAKAVAGADAAALSLALREGTASVEVDGETVTLAPDEVIITETPREGWSVASDSGATVALDLEITEELRQAGLARDAIRLIQEARKNSGLDVADRIALRWTSTDPEVIAALSEHSELIADEVLATDFAQGEADDTYGEPFTDESLSLTFRLRKA

SEQ ID NO: 13658 - protein, 356 aa, Streptomyces avermitilis
MDAGGSGTEGTAEAAGASSAAGAAGAAGASGARKTGGTKSAAKKTTVAASAGAATKAAAKKITAKRTAVKKTTVKKSTAKKSTVKETGVRKTVAQKEAAASKVAPSKRPDEEEGPERPAAKNAAGTKAAGKKTAEKAAVARKTVARKSAAAKGGTTEATSPKSTSTKSTSTKSAAKKSTAKNAGAAAAAKQTGATTVVAKKTPGTATAAQNPTAVPKARIAAVEPGELAVRPGEDPWTPEEVAEARAELQGEAIRLSTEISSSEAALVGLMRDSGDGAGDDQADTGTKNITREHEMALAANAREMLEQTERALERLDAGTYGLCENCGNPIGKARMQAFPRATLCVECKQKQERRY

SEQ ID NO: 13659 - protein, 200 aa, Streptomyces avermitilis
VAEAERIIGTPDIPEAAGAEPEQADGESGGAGAGTERPKGRRRIAVLFAVAALAYAFDLVSKLIVVAKLEHHAPIEIIGDWLRFEAIRNAGAAFGFGEAFTVIFTVIAAAVIVVIARLARKLYSLPWAIALGLLLGGALGNLTDRIFRSPGVFEGAVVDFIAPKHFAVFNLADSAIVCGGILIVLLSFRGLDPDGTVHKD

SEQ ID NO: 13660 - protein, 314 aa, Streptomyces avermitilis
VSTIPEIRTLPVPDGLEGERVDAAISRMFGFSRTKAAELAAAGKVLVDGTVVGKSERVHGGAWLEVEMPQAPAPVQIVAEPVEGMEIVHDDDDVLVIVKPVGVAAHPSPGWSGTTVIGGLAAAGYRISTSGAAERQGIVHRLDVGTSGLMVVAKSEYAYTSLKRQFKERTVDKRYHALVQGHPDPTSGTIDAPIGRHPNHDYKWAVTAEGKPSVTHYDLIEAFRAASLLDIKLETGRTHQIRVHMSAHRHPCVGDLTYGADPTLGKRLGLTRQWLHAVRLGFEHPGDGEWVEFACDYPADLQQALDKVREESYA

SEQ ID NO: 13661 - protein, 163 aa, Streptomyces avermitilis
VPRAVSLQRAPHRPMRYPRLEELRSVHHVPQPLVETEGVGLGVQVDRREATRACRVLDGADQRRADTQAARVLRHGEPPEGAHGEVAVGLGGGRLPVQQPPGAERHPVVPDRQHMHGSGVVRVVLDVLRDALLDDEDLLADREARLTVGSTLRDPHLVRRAHA

SEQ ID NO: 13662 - protein, 531 aa, Streptomyces avermitilis
VLTVDQLALLFVLLLGAVVSVPVGDRFGLPAPVLMTLLGIGLAVADFVPNVDIPPDLILPALLPPLLYAAVRRTSWRQFTANKRPIFLLAVALVFVTTAVVALVAGAIVPGLPIAAAVALGALVAPPDPVAATAVAGQLGLPRRLVSILEGEGLFNDVTAIVLYHVAIAAAVSGTFSLPNAVLDLVLSAVVAVAVGLALGWAANRLMDLLDDVTLQIGLTLLVPYASYVLAEELHGSGVLAVLTTALFLAEYATDADDVMTRLAGHTFWNVVDTLVTGVAFGLIGLELHNALRTASGRWGEMLGWAAAIVAVVVLVRLAYLLPATWLTKRLHAKRDYDEEIPTSWRETVVMWWAGMRGVASAALALAIPLKMDDGSPFPDRDEIVFIAFGVIMGTLVLQGLTLPWLVKRLGVRADTGSEKAFEKALAIRAAKAAKRRLREIEDVEELPEELSEQLLRRAFDIGARISPDLGDEERREAHEQRVRRMKRVRRIQGEMMSAARHEVLAARSEPGADPEIVDRVLRHLDVRSLR

SEQ ID NO: 13663 - protein, 246 aa, Streptomyces avermitilis
MTRNVVISGGGTGIGLAAARAFAGDGDQVLLLGRRADVLEKAEVPGALTYAADLSDPHGVRGVAEFVAAEFGTVDVLVHSAGGAGNLEPRTETDDPLEAVAHNWTVNFRLNVLTAALLTEALRERLASPGGRLLFLSSIAAYRGSGSGAYAAAKAALHPYAFDLARELGPRGVTVNVVAPGYVEDTGFFGGEIEQARRERLVAETSTGRAGTPGDIAATLHWLASPGAAHITAQVIQVNGGAERGH

SEQ ID NO: 13664 - protein, 367 aa, Streptomyces avermitilis
MENVLRPLIVVGGSLVLTLVVGWAVDQLLRRADGRHHETPLWGLLRRGGVPFQLVLCSALFRGSYDQAKLLEDHRIGIGRALTLVLIGSTAWLVVRIAAAIVETSYWRYAAAHRDPARVRRVRTQVSLIQRVVSAIVGVVAVAAMLLTFPAMRAAGASLLASAGILGIVAGVAAQSTLANLFAGLQIAFGDMVRLGDTVVVDGEWGTVDEITLTFLTVRTWDERRITMPVSYFTAQPFENWSRGSAQMTGTVFFHVDHSTPVEEMRKKLQDIVRECPAWDGRDYGLAVTDTTPTTIQVRALVTAKDADDIWTVRVTVREQMVRWLTEQHPYALPRVNTADAVVPPGRTASRDGVAHRAFEPPRTGRG

SEQ ID NO: 13665 - protein, 189 aa, Streptomyces avermitilis
MNIMLFHSTYGLRPAVRAAADRLRAAGHEVWTPDLLEGRTFETVEEGMAFCDGIGKDELLKRAVLAAAPYSERGLVYAGFSLGASIAQTLALGDEKARGLLLLHGTSDIAESASVDELPVQLHVAEPDAFETDDWLGAWYLQLRRAGADVEVYRYAGAGHLYTDPDLPDYDAEAAEATWKVALGFLDSL

SEQ ID NO: 13666 - protein, 553 aa, Streptomyces avermitilis
VTSRHRSSDTAHTFSPRRRTVVKAAAATAVLAGPLAAALPARAATETPAFLHGVASGDPLPDGILLWTRVTPTAEAIPGSGLGPDTEVSWTVAKDKTFTAIVAKGSTTATAASDHTVKADIRGLQPATDYFFRFSAGGTDSPVARTRTAPAADAGVAGLRFGVVSCANWEAGYFSPYRHLAARGDLDAWLHLGDYIYEYKSGEYAARGKVVRPHAPANEILTLADYRTRHGRYKTDPDLQALHHKAPVVAIWDDHEFADNAWSGGAGNHTEGAEGTWTARQAAAKQAYFEWMPVRPAIEGTTYRRLRFGKLADLSLLDLRSFRSQQASTGSGTVDDPERTLTGRVQLDWLKAGLKASDTTWRLVGNSVMISPFAIGELSADLFKPLAKLLGLPQEGIALNTDQWDGYTDDRRELLAHLRNNAIRNTVFLTGDIHMAWANDVPFDAGTYPLSASAGTEFVVTSVTSDNLDDIVKVPEGTVSAVAAPLIRAANRHVHWVDTDRHGYGVLDITADRAQMDYYVLSDRTDPNATSSWARSYRTRSGTQKVERTYDPV

SEQ ID NO: 13667 - protein, 279 aa, Streptomyces avermitilis
MSKRNSQAAKTAARERLRVERERQAKRDKVKRQAKRDKVKRQGMVAGSLVAVLAVAGGIGYFVVQNNKPGYWEAAKNDKLVKPANTTGTNGTTVVFGKADAKKTLELYEDSRCPVCAQFEQTVGSTVDKAIADGTYKVQYIGATFIDNSDQGEGSKNALSALGAALNVSPEAFLEYKTALYSTKWHPDETDDKFKSDDYLIKVANTVDALKNNKAFQKAVTGGTYDKWALVMSQKFDKSGVTGTPTLKMDGKKLTGSDGQNAPMSVAEYTTAIDKALKA

SEQ ID NO: 13668 - protein, 228 aa, Streptomyces avermitilis
MDISGTHLRALRAALFTAVVVTLSTTSHVLLSRVPLPLSTVAAIAGTVFVVAYALAGRERGFGKIAALLVPLELAADTVFTMGQHVCYGKVGGPVAGPLRSVGLDVLCGGNGVGAPLARVTGGGSDRAAVLLAHADPAAAWLLLAAHVGTGLLAAAWLRRGERALAQLLRAAAVSAFRPLLLAVSAVTVRLTPVRRPARPARRISTVRTRLFVHSLGRRGPPRSAVFA

SEQ ID NO: 13669 - protein, 441 aa, Streptomyces avermitilis
MSVPQLSAEQRGEQILAVFDTAFGELLAADPAAFRVKFRKMAASAFAFYRGTACLFYHDLDADKRGGPYLDERTSRVWIHGDLHAENFGTYMDSTGRLIFNVNDFDEAYVGSFTWDLKRFSASVALIGYAKALSDEQITELVQVYAAAYRERIHALATGAKSDEVPPFTLDTAEGPLLDALRDARSLTRFGLLDSMTEIRDFERRFAPGGGSIELDAATRYKVLAAFDGYLETLPESSLARPDSYRVKDVVGRRGIGIGSAGLPSYNILLEGHSDALENDVVIYIKQAQTPAVSRHITDSSIRDYFQHEGHRTVISQRALQAHADPWLGWTELDGAGQLVAEISPYAVDLDWGDIDDPKEIAAVVADLGRATAAMHAAADDLSGQSLVPFSTERAIDAAVAADEDGFAGLLVDFAHEYGARARADHQIFVDLFRNGRIPGL

SEQ ID NO: 13670 - protein, 1179 aa, Streptomyces avermitilis
VSKPPFTHLHVHTQYSLLDGAARLKDMFNACNEMGMTHIAMSDHGNLHGAYDFFHTAKKAGVTPIIGIEAYVAPESRRNKRKIQWGQPHQKRDDVSGSGGYTHKTIWAANRTGLHNLFKLSSDAYAEGWLQKWPRMDKETISQWSEGLIASTGCPSGELQTRLRLGQFDEALKSAAEYQEIFGKDRYFLELMDHGIEIERRVRDGLLEIGKKLGIPPLVTNDSHYTYANEATAHDALLCIQTGKNLSDPDRFRFDGTGYYLKSTDEMYAIDSSDAWQEGCANTLLVAEQIDTSGMFEAKNLMPKFDIPEGFTEVTWFQEEVRRGMERRFPGGVPDDRQKQAEYEMDVIIQMGFPGYFLVVADFIMWAKKQGIAVGPGRGSAAGSIVAYAMGITDLDPIPHGLIFERFLNPERVSMPDVDIDFDERRRVEVIRYVTEKYGADKVAMIGTYGKIKAKNAIKDSARVLGYPYAMGDRLTKAMPADVLGKGIDLNGITDPSHPRYSEAGEIRAMYENEPDVKKVIDTAKGVEGLVRQMGVHAAGVIMSSEPIVDHAPIWVRHTDGVTITQWDYPQCESLGLLKMDFLGLRNLTIMDDAVKMVKSNKGIDLDLLSLPLDDPKTFELLQRGETLGVFQFDGGPMRSLLRLMKPDNFEDISAVSALYRPGPMGMDSHTNYALRKNGLQEITPIHKELEEPLQEVLAVTYGLIVYQEQVQKAAQIIAGYSLGEADILRRVMGKKKPDELAKNFVLFQEGAQKKGYSDEAIQALWDVLVPFAGYAFNKAHSAAYGLVSYWTAYLKANYPAEYMAGLLTSVKDDKDKSAVYLNECRRMGIKVLPPDVNESMSNFAAQGDDVILFGLSAVRNVGTNVVESIIKSRKAKGKYASFPDYLDKVEAVACNKRTTESLIKAGAFDTMGHTRKGLTAQFEPMIDNVVQVKRKEAEGQFDLFGGMGEEESDEPGFGLDVVFTDDEWEKTYLLAQEREMLGLYVSDHPLFGLEHVLSDKADAGIAQLTGGEHADGAVVTIGGIISGLQRKMTKQGNAWAIATVEDLAGSLECMFFPATYQLVSTQLVEDAVVFVKGRLDKREDVPRLVAMELQVPDLSNAGTNAPVILTIPALKVTPPMVSRLGEILSHHKGESEVRIRLQGPRKTTVLRLDRHRVKPDPALFGDLKVLLGPSCLAG

SEQ ID NO: 13671 - protein, 59 aa, Streptomyces avermitilis
MAKNKNRKQGSQQQRSSQAEQAQEHAQRSATEAQQSPMPHTQGSPADVARKQQKRFGHN

SEQ ID NO: 13672 - protein, 408 aa, Streptomyces avermitilis
VDRVDRCIVLVDAGYLLGAAASLLAGEPSRSRITVDHAALIQGLRERAEFDTERPLLRIYWFDGAPDRVPQPEHRRLRVMPRVTVRLGALTRSDGRWAQKGVDAAMHAELTELARNRACSDVVLVTGDGDLLPGMMAAKEHGVAVHLWAVQAADGDYNQSEDLVAEADERRVLDRAWITKAVRAKEVGGVCAPQPVPRPEIAAILSAPLPESSLAGAAERTAEEPEHRSAADAQNGAQERVSAPKGVPTPKDLAALRAPGTQSPQHPASATLRWSSDKGWVDRPGAAAESADAASLPTLAQLTSAEQRWADREEDITTVGGDPYEVGQVFARRWMERLTDQTHLQKLSAMYPRVPHRVDGELLRYAARFGLLAHKDDQIDEHDRYAIRAGFWREIDVRTAAEHAPAGD

SEQ ID NO: 13673 - protein, 379 aa, Streptomyces avermitilis
MYGRRRSTRRREISRGCRAGVLFQDGGWISGGLHHPVLSSLVSTRTAQACRQGGDVVCAVRGLTKTYPAVRGRRGAPGTPEVRATDGVRLDIRRGEVFGLLGPNGAGKSTLVRQLTGLMRPDRGSVDILGHDIVRHPERAARILAYLGQESTALDELTVSLAAETTGRLRGLDVRQARGERDAVLDELGLAAVAGRPLKKLSGGQRRLACFATVLVGERPLLVLDEPTTGMDPVARRAVWAAVDRRRAERGTTVLLVTHNVIEAETVLDRVAVLDSGRVIACDTPGGLKERVAGEVRVELVWRERAPLDVPEVAALRARAVESGRRWSLRLAPDEARAAVATVTGGAAFAALDDFTLATPSLEDVYLALGGNAQGLVKA

SEQ ID NO: 13674 - protein, 284 aa, Streptomyces avermitilis
MERGRSEEEQLDVSVVPAEVLPGVTALDDGARTEAPLGPRARLWPSLAAVYRAQLSRARVARIPLLFVATFQSVGIMIMMRGVVDDADEARAVVAGATVLVVAFVALNLLAQYFGQLRASGGLDHYATLPVPPAAVVLGAAGAYASFTVPGTVVTAVFGCVLFGLPLTHLWVLAAVIPLAGAALAGLGAAFGLLAPRPELATLLGQLGMSAALLLGVLPADRMPGVVQCARDLLPSTYGVEALARTFGGHPDWAFVLGDLAVCAAVGVASLAVATWAYRRAAVR

SEQ ID NO: 13675 - protein, 221 aa, Streptomyces avermitilis
VTAPLTPPPPPHDQPSQDPWQAPPAGGAVGVAGYEEDGPGMKTEVREAAVITVGLALCGVLLGVLWWWLAPHVPLMGGVVGKEWVVYLKDTEGEQAVGVDGTFTLLALAFGAVSALAVFLWRRRGGVPLAVSLAVGGVLGSLLAWRVGVWLGPTQNVLAHAKAVGKGVTFSAPLKLGAKGALLAWSLAALLVHLGLTALFGPRDPDPYASPYDAPPAPPAG

SEQ ID NO: 13676 - protein, 166 aa, Streptomyces avermitilis
VAKKSKKQQPGGTPATVALTAAGVPYTVHAYEHDPAHPSYGEEAAEAMGVSPDRVFKTLVADVDGALVVAVVPVAGSLDLKALATAVGGKRAAMADPVLAERTTGYVRGGISPLGQRKKLRTVLDASAAAHDTVCVSAGRRGLEVELSPDDLAKLTEAVPAPIARA

SEQ ID NO: 13677 - protein, 246 aa, Streptomyces avermitilis
VTTVRLPLFPLNSVLFPGLVLPLNVFEERYRALMRDLLKTPEDEPRRFAVVAIRDGYEVAPSAPGMPDPTAVPERGPAAGFGDDPVKAFHSVGCIADAATVRERADGGFEVLATGTTRVKLLSVDASGPYLTAELEELPEDPGDGAGALAEGVLRAFRQYQKRLAGARERSISTSADLPDEPSVVSYLVAAAVMLDTPAKQRLLQAPDTASRLREELKLLRTETAIIRNLPSLPASELTRGPTSLN

SEQ ID NO: 13678 - protein, 362 aa, Streptomyces avermitilis
MASTMALLRAILRTARMARNSPRLAVGLPADDEVLLDAPDEHLAPALVAAGRGEYEPAAELLAGSREAAEWENRDRYTTRLAAFARSRPEWLEEWRRARPHDPDALLVRAELAVRRGWESPARAELLRQVAPLITAAAEGAPRDPVPWRIALDHARGTNAGHAEFERLWGEAVRRSSHHYGCHVAALQYLSAACCAQRGDTPHTPRRSHRECFDFAETAAQDALPGSLVQMLPVRAAFAYLTEGGGAAVGRERLDAAADRAIALSNEYAAADPWPAEVRNLLTYVLVRLQRWEDALQQLRMIGPYATSFPWDRISDDPLGQFLELRDGVRLEVASGLPLGPPGERPRDPRSGHDGRSRSGDH

SEQ ID NO: 13679 - protein, 526 aa, Streptomyces avermitilis
VTEGAGIHAGDLPDDLTAAEAGMWQAFRNGTVYDLRAGNATVDDPHGGHPWGPERTVRARIVCWLLLDGPPALAGRVASLKLVGVQIKDSLDLSGGTVVPYLELKGCRFEKEVLLPEAHFTTVRFVDCSVPRLEAARVHTEGDLHLPRCRFHNGVRLTDAHIGTDLLLNQAVVYRDRRGRSLTGDGMTVGQDLQAEMMESHGELSLRSAKIGVSLSLRGALLTNSYTPLALNAPQLTVGRTLYLTPAGLGNPPLTSGATPARGTRVQRFACRGGIRLDDGRFGDAVDLERARFVFEDDQELSLRRVQTPELRFLSEHPERGRVVLSGARIVNLVDRAESWPGPGRLQMGGFGYENLVPHGRFPLTERLEWVAAATAEYNPEPYERLAAVLRNSGEDEDAREVLLAKQRRRRETLPVAGKLWGYVQDWAVAYGYRPGRAALWMAVLWAVTSVAFSHAGHPPVNGDGHPSWNASLFALDLLLPVIDLGQAGQWQLRGGWQWLAATVILLGWILATTVAAGATRLLRRS

SEQ ID NO: 13680 - protein, 441 aa, Streptomyces avermitilis
VISRIDLRGDALPEGSALRDLLPRADFDVSAALEKVRPICEAVHHRGDAALIDFAEKFDGVRLESVRVPARALADALEQLDPAVRAALEESIRRARLVHREQRRTTHTTQVVPGGSVTEKWVPVDRVGLYAPGGRSVYPSSVVMNVVPAQEAGVESIALASPAQAEFGGLPHPTILAACALLGVDEVYAAGGATAVAMFAYGTESCAPADMVTGPGNIWVAAAKRYFTGKIGIDAEAGPTEIAVLADSTADPVHVASDLISQAEHDPLAAAVLVTDSVELADAVEKELEPQVAATKHIDDRIVPALKGRQSAIVLVDGVDEGLRVVDAYGAEHLEIQTADAAAVADRVRNAGAIFIGPWAPVSLGDYAAGSNHVLPTGGCACHSSGLSVQSFLRGIHIVDYTKDALADVAHHVVTLAEAEDLPAHGAAIKARFGWKVPESK

SEQ ID NO: 13681 - protein, 369 aa, Streptomyces avermitilis
VSFGIDDLPVRDELRGKSPYGAPQLDVPVRLNTNENPYPLPEPLVERIAERVREAARHLNRYPDRDAVELRTELATYLTNTGKHPVGIENVWAANGSNEVIQQLLQTFGGPGRTAIGFEPSYSMHALIARGTGTAWISGPRGEDFTIDLAAARQAIAESRPDVVFITTPNNPTGTAVPPETVLALYEAAQAVKPSMVVVDEAYIEFSHGDSLLPLLEGRPHLVVSRTMSKAFGAAGLRLGYLAAHPAVVDAVQLVRLPYHLSAITQATALAALEHTDTLLGYVEQLKAERDRLVAELRAIGYDVTESDANFVQFGRFADAHEVWQQILDRGVLVRDNGVPGWLRVSAGTPEENDAFLDAVRELKKEQNA

SEQ ID NO: 13682 - protein, 197 aa, Streptomyces avermitilis
MSRVGRVERTTKETSVLVEIDLDGSGKVDVSTGVGFYDHMLDQLGRHGLFDLTVKTEGDLHIDSHHTIEDTALALGAAFKQALGDKVGIYRFGNCTVPLDESLAQVTVDLSGRPYLVHTEPENMAPMIGEYDTTMTRHILESFVAQAQIALHVHVPYGRNAHHIVECQFKALARALRYASERDPRAAGILPSTKGAL

SEQ ID NO: 13683 - protein, 54 aa, Streptomyces avermitilis
VSGLSTVLIVLGLFLLGGVYSFVKQKMPTSLIVVLSIGAVMCLAAGVVRLEVWN

SEQ ID NO: 13684 - protein, 215 aa, Streptomyces avermitilis
VELSTAKKVVVFDYGFGNVRSAERALARAGAEVEITRDFDTAMNADGLLVPGVGAFAACMKGLKEARGDWIVGRRLAGGRPVMGICVGMQILFERGIEHGVETEGLDEWPGTVGPLEAEIVPHMGWNTVEAPGGSQLFAGLDADARFYFVHSYAVHDWSLDVANPAMRAPLVTWSTHGKPFVAAVENGALWATQFHPEKSGDAGAQLLNNWIGTL

SEQ ID NO: 13685 - protein, 242 aa, Streptomyces avermitilis
MASKLELLPAVDVRDGQAVRLVHGESGTETSYGSPLEAALAWQRSGAEWLHLVDLDAAFGTGDNRALIAEVAGAMDIKVELSGGIRDDDTLAAALATGCTRVNLGTAALETPEWVAKVIAEHGDKIAVGLDVRGTTLRGRGWTRDGGDLYETLERLNSEGCARYVVTDIAKDGTLQGPNLELLRNVCAATDRPVVASGGVSSLDDLRAIAALVPLGVEGSIVGKALYAKAFTLEEALEAVAK

SEQ ID NO: 13686 - protein, 110 aa, Streptomyces avermitilis
VQLPNGLVLVSGCTSVIDGSIVDDGPYEQALNSFNVAFAALKELGLGRDDVVRTRMYLTHARDVEEIGRAHKQLFDSVRPAASMIIVSGFVDPRLVVEVEVEAYREAPQS

SEQ ID NO: 13687 - protein, 251 aa, Streptomyces avermitilis
MTLAVRVIPCLDVDNGRVVKGVNFQNLRDAGDPVEMAKVYDAEGADELTFLDITASSGNRETTYDVVRRTAEQVFIPLTVGGGVRTPDDVDKLLRAGADKVGVNTAAIARPELIREIAERFGRQVLVLSVDARRTESGSFEVTTHGGRKGTGIDAVEWAHRAAELGAGEILLNSMDADGTKDGYDLEMIAAVRAHVTVPVIASGGAGKLDHFPPAIAAGADAVLAASVFHFGDLRIGEVKETLRAAGHPVR

SEQ ID NO: 13688 - protein, 195 aa, Streptomyces avermitilis
VTAKENRPITDIGTLKALAHPLRMKLYRALCVTRTATASQLAEQVDEGVSLVSYHLRKLADHGLIEAARPQSGDGRERWWQPSSQGVSIKDKDFRDAPEKAAAHAAATRLFHEQRADLYRRYLDERPTWGPEWNSAAPDQESLLRLTPAELAELGAELLALARKYDEKGRAAEAAGDTEGRENVALHVYGFPFRP

SEQ ID NO: 13689 - protein, 410 aa, Streptomyces avermitilis
MVGDNVYYLALSWAAVQAGTPSQAGLVMAVSAVPRALLMLGGGVVADRFGPRRVVIGSDAVRCAAVLAVAALLFAASPGLWPLALLAVLFGTVDAVFMPAVGALPARVTGRDQLARVQGMRGLAIRFANVVGAPLGGLGVALGGAAAAFGLAGLLIAVSVPLLISVRMRDLPADGEGGGEADREAGGKADQEAGPHRMGAAQDTVPRTTPWQDLRDGLRYIRGHRVLAPLLVAIALGDLGFVGPLNVGLTLLAEQRGWGASGMGWVLSGFGTGAGVAALLLTVRGRLPHAGRVVAAAILPGSVAIGALAYAPSLVVAVGTALLVGLLAGLSGALCGALLQTQADPAYLGRVSSVAGIVSLGFAPLSMPLSAAAIGWWGTGPVFVTSAAVCGLGGVVVLCSGPLRRAQLPR

SEQ ID NO: 13690 - protein, 418 aa, Streptomyces avermitilis
MPNAVRARVRAVPGLPPASPPVRSLVDAEAVAVLRRAAAVLMDDLPEITERLLAVLQEQEPAYRAAFETDPSGLWQEVHRSLRHNVGSLLRPRECRDAARRCSWRIGAERAEQGMPLDALLHAFRLGGALVWRRLVEEAARRDPDDVRLLVHVASDVWNFVDEHCTLVADAYRHVERQLAWRRENRLRLMTTALLDGTTRIADLPDVATALDLPEQGRYAVVSVAVAHPAGHVGTQLLSVPPGMRALWHTGTDVEHGIVHLGEREPKDLVDRVTVPIGARVGISRAVDGLAAVGDARRLAETALRACPESGGTVLLDEHLPAALLVSAPALGTALVNRVLGPLLSLDPSDRDLLLDTVSAWLDNDGSAQRAASRLYCHRNTVLNRLRRFEQLTGRCLTRPADVVDTSLALTARRLLGD

SEQ ID NO: 13691 - protein, 363 aa, Streptomyces avermitilis
MPSLSSDGARQDIPLPGGPPPKDPPPNGPSVLHVRDLDVAYGRALTALRGVCLEVPAGGAVALLGANGAGKSTLLRSLSGTLRLHRGAITAGSVHYGDVRLTGQDPVAAVRAGVVQVPEGRRVFAGLTVDENLRAGGLGLGRRAPAVVKAAREQVFGLFPRLAERRAQRAGLLSGGEQQMLAIGRALMAAPRLLLLDEPSLGLAPLMVERIAEVIREINEQGTSILLVEQNAAMALALSDHAYVLEVGEVRLAGPAAELARTDAVRRLYLGEEAGPEAMGPGEATAAPDTPGPHPAPPGPPPGPEAGTDGAVGSSPGPEAGTDGAAGPPPDPDTGTEGAAGPPGGQRTTTEGQRTTAEGQGVA

SEQ ID NO: 13692 - protein, 264 aa, Streptomyces avermitilis
MSVSPPPLRVDDVTVKFAGLTALDSIGFTVAPGSVHALIGPNGAGKSTCFNVVSGLCRPTHGSVSLGDTELTRLPPHRIALLGIARTFQNIVTTAGTVGDNLMLGRHALSRAGFTATALRLPGTVREQRSHRARAREIAELTGLGTLFDTPVALLSYGDRKRVELARALCLEPRVLLLDEPVAGMNSGERARTVEVVRTVRAELGLSVLLVEHDMGLVMRLADEVTVLDFGRRIAAGTPDQVRQDPEVRRAYLGTPTTPQEHIA

SEQ ID NO: 13693 - protein, 296 aa, Streptomyces avermitilis
MSTALDTVLNGLALGSVYALVALGFVIIFKASAVMNFAHGSLLLLGGYLTAVLHDRLGFAGALALAVLATAAAAGLIDWLLLRRLDPHAAHVLTILTIGVDILLMTDLTRRIGGDLLTLGDPWGSDVTELGPITVADSRIASILVSLVVIAAVFAVFRFTSWGLSLRAAAEDHEAAALMGIRLARIRTLAWCLAGALAALAAVFLAAFPAPGLERTTGQIALKAFPAAILGGMASPPGALAGSLLIGVTEALAAGYQSELSALGEGFGDVVPYAVMVLVLLVRPAGLFGTREAARV

SEQ ID NO: 13694 - protein, 393 aa, Streptomyces avermitilis
VSRRLVMAGAAVLLCVLPFYLGAFWLQVGLFSMAAALGAVGLTLLTGTAGQLSLGHAFFLAVGAYGYVWLAGDPGPGLPPLLALVLAVCLSGLVGGLFSPVAGRVRGVYLGVATLALVFLGHHVMLNADSITGGFNGRSVPPMSLGGFTFTASDPQLTVLGVPFGAEERLWYLALILLAVGWFAARNLLNGRPGLALTALRDSETAAAVMGVPVARRRSAAFVVSSMYAGLAGVLLALVFRRIVPDYFGLALSIDYLAMIVIGGLGSVAGAAAGAVFVTALPLLMARYADQLPLVAAPGAAGHAVGPTEASRYLYGAAIVLVLLFAPDGLSGVARRAGAAVRRRRTAPPRTASADVASPASASPASESPASASPAASTPAASASDQRPKERTS

SEQ ID NO: 13695 - protein, 420 aa, Streptomyces avermitilis
VNTTGRTALATTLAAFLLAGVGCSTKAGDSGGDTAADGVKTGPGVTADKIGLGALTDLSGPYATLGKSIVQAQQMWADETNKKGGICGRKVEIVVKDHGYDVQKAVAAYTEISPDVLALPQVIGSPVVSALLDDVEKDHLLTFPQAWAASLLGKDAVQVLGTTYDIDMVRAVDFLTRKQGVKKGDKIGHVYFEGDYGSNALEGSSWAAKKAGLTVVGQKIKATDTDLSAQVTALRKAGVKAILISAGPSQTASLVGVAASRGLKVPVVTSAPGYAPQLLKTPAAPALLAMLHVVSSAPPVSSDLPAVKRMVTSYQKKYPGELVDAGTLSGYNAAELMGRDLKAACKAKDLTREGLVKAHRSQKAVDNGLGTPQDFSDASRPAAMAAYVTKPDKKATGGTVLVEDARALPAEQKFLDSRKK

SEQ ID NO: 13696 - protein, 211 aa, Streptomyces avermitilis
MSTHAKRERLLLADLLEAEGPDAPTLCEGWNTRDLAAHVVVRERRADAAGGLLIKQLAPRLERVMAEFAAKPYEELIQLIRTGPPRFSPFALKQIDEASNTVEFYVHTEDVRRARPDWTPRALDPVFQDTLWSRLERTARLVGRGAPTGLVLRRPDGQTVVAHKGTPVVTVTGEPSELLIFACGRQNVAAVELDGDKEAIARLHETKQLGL

SEQ ID NO: 13697 - protein, 133 aa, Streptomyces avermitilis
MTSTPQPSRPSSLDAEIAARLKRSADGLVPAIAQQYDTGEVLMLGWMDDEALHRTLTTGRCTYWSRSRGEYWVKGDTSGHVQYVKSVALDCDADTVLVKVDQVGAACHTGAHTCFDADVLLKDGDSGVPAADQ

SEQ ID NO: 13698 - protein, 493 aa, Streptomyces avermitilis
MDLETFRKLATDRRVIPVSRKLLADGDTPVGLYRKLAAERPGTFLLESAENGRSAFKWSRYSFVGVRSAATLTERDGQAHWLGTPPVGVPTDGDPLAALRATIEALHTPHEEGLPPFTGGMVGYLGYDIVRRLEKIGPGERDDLKLPELTMLLTSDLAVMDHWEGSVLLIANAINHNDLDTGVDEAYADAVARLDAMEADLSRAVAQPPAALPPSELPEYTALWGGPDFQDAVEDIKERIRAGEAFQVVPSQRFETPCTASALDVYRVLRATNPSPYMYLFRFEGFDVVGSSPEALVKVEDGQAMVHPIAGTRPRGATPQEDQALADELLADPKERAEHLMLVDLGRNDLGRVCEPGSVEVVDFMTIERYSHVMHIVSTVTGRVARGRTAFDVLTACFPAGTLSGAPKPRALQIIDELEPSRRGLYGGCVGYLDFAGDSDTAIAIRTALLRDGTAYVQAGAGIVADSDPVAEDDECRNKAAAVLRAVHTANRL

SEQ ID NO: 13699 - protein, 214 aa, Streptomyces avermitilis
VEYVTAVPTPRSEAAGPARSGRRSLAVALLCGALGAAVALLSSRQGWAAGTVAVAGGDFPLTAKGSDVTGVPAALAIVGLAALVAVFAVRSAGRLLVAALLALSGAGTIAAALLGVSDSAALDEKAAQASGDTSATAEALTHTAWPYVAVAGGALLLLAGLLALRYGRLWPAMSGRYERDGTPRPRQARVDPDRPEDLWKALDRGEDPTGPDPA

SEQ ID NO: 13700 - protein, 79 aa, Streptomyces avermitilis
MAGSSHGHTPAAWTGVIIAFIGFCVSGAFMVLANPLGFWAGMVIVVLGGVVGGIMRAMGLGQQKTTHPVHHVASAGAES

SEQ ID NO: 13701 - protein, 162 aa, Streptomyces avermitilis
MRGVNAQSQWVTRPGADQPGADQPDAGAGPTAVLRRLAVPGGVLAAVVGAFAYVGAVDPNQPGHYPVCPLLRFTGVYCPGCGGLRSAHAFVHGDLSAALTDNAVAVAGYFVFAVVWTFWVVRAARGRPVRIDLGPVHLWSVGALLLVFTVVRNLPFGGWLHP

SEQ ID NO: 13702 - protein, 269 aa, Streptomyces avermitilis
VSVLDEIIDGVRADLAERQARVSLDELKERVAKAPAAKDGVAALRGDGVKVICEVKRSSPSKGALAAIADPAALAADYEAGGASVISVLTEQRRFGGSLADLEAVRAKVDIPVLRKDFIVTSYQLWEARAYGADLALLIVAALEQPALESLIERAVSIGLTPIVEVHDEDEAERAVDAGAKVIGVNARNLKTLKVDRTTFERVAPEIPEGIVKIAESGVRGPHDLIAYANAGADAVLVGESLVTGRDPKAAVADLVAAGTHPALRHGRG

SEQ ID NO: 13703 - protein, 102 aa, Streptomyces avermitilis
MTTADRALAAVTVRPGSGLDGGGAVACVRSVVPVPVVAAQAPLSAARDPYARLARGCRPRGCRAPARRVHGRRVRYVIGDEPGQVNGMRWRRGARVRTLRAG

SEQ ID NO: 13704 - protein, 428 aa, Streptomyces avermitilis
MSSEFFIPDPEGQVPTAEGYFGAFGGKFIPEALVAAVDEVAVEYDKAKADPEFARELDDLLVHYTGRPSALTEVSRFAEHAGGARVFLKREDLNHTGSHKINNVLGQALLTRRMGKTRVIAETGAGQHGVATATACALFGLDCTIYMGEIDTQRQALNVARMRMLGAEVIAVKSGSRTLKDAINEAFRDWVANVDRTHYLFGTVAGPHPFPAMVRDFHRVIGVEARRQILERAGRLPDAAVACVGGGSNAIGLFHAFIPDTGVRLIGCEPAGHGLETGEHAATLTAGEPGILHGSRSYVLQDDEGQITEPYSISAGLDYPGIGPEHAYLKDSGRGEYRAVTDDAAMQALRLLSRTEGIIPAIESAHALAGALEIGKELGKDGLILVNLSGRGDKDMDTAARYFGLYDTDASVAADADSDIAEIEGDAK

SEQ ID NO: 13705 - protein, 277 aa, Streptomyces avermitilis
VSGAAFSRQRGQLLSDTLAAAKAEGRSALIAYLPAGFPTVDGGIAAIKAVFDGGADVVEVGLPHSDPVLDGPVIQTADDIALRGGVRIADVMRTVREAHEATGKPVLVMTYWNPIDRYGVERFTAELAEAGGAGCILPDLPVQESALWREHAEKHGLATVFVVAPSSKDARLAEITAAGSGFVYAASLMGVTGTRASVGEQAQDLVRRTRATTDLPVCVGLGVSNATQAAEVAGFADGVIVGSAFVKLMLDAEDEAAGLEAVRALAGELAKGVRGGD

SEQ ID NO: 13706 - protein, 276 aa, Streptomyces avermitilis
VDLGPGRRAVPPRFVLPDVSEKNREGKRTARERLVVEREKQKAAERRRRALIVGASVVCVLALAAVVGVLAANSGKDKKSASDGPAVAPSGATGKDGLAIPVGKDTAKSSLTVWEDFRCPACKIFETTYRPTLHELVGAGKLKIDYHLVTIIDDGRGGSGSRQAANAAACAQDAGKFTAYHDVLYDNQPDETVDSFADDSKLIELAGKVDGLDTPAFRKCVKDGTHNSWVVKSNAAFDSGGFKGTPTVLFGGKNLAADPTMTPAKLKQMVEAANKG

SEQ ID NO: 13707 - protein, 340 aa, Streptomyces avermitilis
MELAYIPSPARGVLYLGPIPLRGYAFCIIIGVFVAVWLGNKRWVARGGRPGTVADIAVWAVPFGLVGGRLYHVITDYELYFSEGRDWVDAFKIWEGGLGIWGAIALGAVGAWIGCRRRGIPLPAWADAVAPGIAFAQAFGRWGNWFNQELYGRETHVPWALHITSSTDGRVPGYYHPTFLYESLWCVGVGFLVIWADRRFKLGHGRAFALYVAAYCVGRAWIEYMRVDDAHHILGVRLNDWTAIAVFLLAVLYIVLSSRKRPGREEIVEPGASDTGTGADDPVDLGKDEDKATTDKATATDTSTTTDKSTDRGKNEDENEGEDAEPSEKTESAAESAKKV

SEQ ID NO: 13708 - protein, 285 aa, Streptomyces avermitilis
VTAESFPLTWLYAPGDRPEVVGKALACGADVVLIDLEDAVPPDRKDYARAATAERLTQRQPVPVHVRVNALDGPWLEADLKALTALPGLSGLRLPKVTSPADVVRVAERAAPTEGGTRAEGGAIPLHALLETALGVEQAFAIASAHPDVRGVSLGETDLRADLGVREDAGLDWSRARVVVAARAARLPPPTQSIHPDIRDLEGLAASCARGRALGFLGRAAIHPRQLPVIERAYLPTPQEIATAEEIVKAAARDPGAQALPDGRFIDTAVVTGAQRTLALARRLN

SEQ ID NO: 13709 - protein, 402 aa, Streptomyces avermitilis
MSTPPDTAAPLTGLRVVDLATLFAGPIAATMLGDFGAEVIKVEHPAKPDPSRGHGPSKDGVGLWWKLLGRNKRTMTLDLSRPGGRTTLLRLAATTDVIIENFRPGTLEKWDLGWEELSAANPRLVLARVTGFGQFGPYARRPGFGTLAEAMSGFAAITGEPDAPPVLPPFGLADSIAGLATAYAVMTALAARDRTGAGQVIDMAIIEPILTVLGPQPIWYDQLGHVQPRTGNRSANNAPRNTYRTADGSWVAVSTSAQSIAERLMILVGRPELIAEPWFATGADRARHTDVLDEAVGAWIARHTRTEVLEAFEKAEAAVAPIQDVRDVMTDPQYAALDTVTTIPDDPELGPLRMQNILFRLSSTPGAIRWAGRPHGADTEAVLTELGLAEAEITALRSEGAL

SEQ ID NO: 13710 - protein, 457 aa, Streptomyces avermitilis
VSALRLTWVQPEDLLGHELHQAAQDGREPYAIAARWRAAGGQKAPERAGASRGPVSPYLRILAEDLLAELADLPSRLADQEPTDLANIRARCPKWPSRPQPSPATPPAHDRLEAAWLGRAAGCLLGKPVEKLPLDGIRRLARATGNWPLHTWFTARGLPPELAAAHPWNRRSATTSLAENIDGMPEDDDLNYPLLNILLLQRHGKGFSTAEVARLWLDELPAGRTFTAERIAYRNLLDGIEPPRTARHRNPFREWIGALIRADVHGWTNPGDPAAAAAQAHRDATLTHTANGVYAAMFTAATIAEAATGHHGIHHCLRTGLTVVPPHSRLARAVRHAVHLAATTEDFDTVVDELHATHRGYHWVHAVPNTALIAAALTHADGDFSGSVCRAVAGGWDTDSNGATAGGIAGLLAGRPTALPDRWTTPLKNRLATSVADFNGVGFDTLAHLTHREAHRP

SEQ ID NO: 13711 - protein, 398 aa, Streptomyces avermitilis
MTPKSPLCETSPPPLDETSTPPLDARITGALVGAAVGDALGGPVEGYTPEQILERHGGRVHGVVGPWNGDAWRTARPIAPYHKGDGHVTDDTLLTHALVRVYATVRDHLDAYAIAEHLVPDLMTSPRWIPELEAEALPLQRIFLAEKWLVARLHYGHVDPREAGAGNIVNCGAAMYMAPVGLVNAANPAGAYAEALDIAGAHQSSYGREAAGVLAAAVAAACAPGATADSVVTACLALAKDGTRSAIEAVCEAASRHTDFESALGPLRAAVAPFDTVGPDYRTPSLGARRPSRLHAIEELPVALGMLVVAGGDYRHAVLGAVNYGRDCDSIATMAGAVAGALGAAVPHDWAKTVARASRLDLHAPARTLTEVTREIFERDVRRRRAHESAYATLADRR

SEQ ID NO: 13712 - protein, 169 aa, Streptomyces avermitilis
VHGARAMAAALALALAGADVDACADAALAELPESTEIGRNARHALRLARSGDGTFAIVPLLEHQIVDHVYSYGIAAAETVPVALALATAARGRIAEAVPAAACLSRVADSAPALAGALTGALGGGAEIPAAWRDACRTLSGCALPRLTGTDLVELAELLGATELTTPGG

SEQ ID NO: 13713 - protein, 305 aa, Streptomyces avermitilis
MRPGLVGDEPGESSGASAAEAHDPPPAPAADRALDIRAVGAPHPRRIEGLLLGLAAGDAAGWPAARHRAARMPEWTRRLTRELDTFAEQNATTTLPVPIALNQPPEPLRLGPSDDAEWAAFAAEAVLRAGDGNVLGDLSHERRMRAAIDLSWNAVASEVAAAAERAPEVESALLPLRARISVRAGLGNLATGAAPARHRPRQPPLLRRRGLRTGLRPGRRAPRRTPARRRAGRVRRPLHPGRRRSARRPRHGRRARARPRRGGRRRLRGRGPRRTPRVDGDRPQRPARAPAGPFGRRHVRHRAPP

SEQ ID NO: 13714 - protein, 428 aa, Streptomyces avermitilis
MASIACIPSVPAPGDAADLRERARGALLGLAVGDALGAPAENMKPSEIRARWGRITGYVADNPAGTDDTEYAIFSGLLLARHGSALTVAHVEAAWHQWIADRDEGPFKGAGFSERGTLENLRRGLAAPISAQHRHAWSDGLAMRAAPFGVFAAGRPAEAARLVAIDGSVSHDGEGIYGGQAVAAGVAAAMAGAPTIAVVASALAVVPEDSWTARSLRRAVAVAHRGERAVRSAVVIGGYPWTDLAPEAVALAFGAYAAADGDFTESVLTAVNMGRDADTTAAVAGALAGATRGASSIPAAWAAAIGPARGSCLPSMEGHHVLDIAELLTPGAEDEGKWGAGVLAPGWNGLDGPAGLAGLGGLAGLAGLDGLGGLGGLGGRGKEADGLVRGPGGLVRELPRRWPGPDPGVFVLASDAFVPAGDDDEVER

SEQ ID NO: 13715 - protein, 243 aa, Streptomyces avermitilis
MAIIETEATLHEAHRDNHTHRDVNGGWLRPAVFGAMDGLVSNLALMTGVAGGSVGQQTIVITGLAGLAAGAFSMAAGEYTSVASQRELVEAELDVERRELRKHPKDEEAELAALYAARGVEPELAREVARQLSRDPEQALEIHAREELGIDPGDLPSPAVAAVSSFGSFALGALLPVLPYLLGASALWPALLLALIGLFACGAVVARVTARSWWYSGLRQLALGGAAAGVTYVLGSLIGAAVG

SEQ ID NO: 13716 - protein, 1516 aa, Streptomyces avermitilis
MDARPAAQGMYDPRNEHDACGVGFVATLTGEASHALVEQALTVLRNLEHRGATGSEPDSGDGAGILSQVPDAFLREVAGFELPAAGAYAVGIAFLPEDGTDEAVSQIETIAGDEGLTVLGWREVPVAPELLGATARSTMPAFRQIFVSDGQSQGIDLDRRAFVLRKRAEREAGVYFPSLSARTIVYKGMLTTGQLEPFFPDLSDRRFASAIALVHSRFSTNTFPSWPLAHPYRFVAHNGEINTVKGNRNWMAARESQLVSEKFGSAGSGAKGLERIFPVCTPDASDSASFDEVLELLHLGGRSLPHSVLMMIPEAWENHDSMDAARRAFYQFHATMMEPWDGPACVTFTDGTQVGAVLDRNGLRPGRYWVTDEGLVVLGSEVGVLDIDPARVVRKGRLQPGRMFLVDTAEHRIIEDDEIKAGLAAEKPYADWLEAGEIELEDLPEREHIVHTHASVTRRQQTFGYTEEELRVILAPMAKAGAEPIGSMGTDSPIAALSERPRLLFDYFTQLFAQVTNPPLDAIREELVTSLRSSLGPQGNLLEPTAASCRSVTLPFPVIDNDELAKLIHINADGDMPGMKAATLSGLYRVSGGGESLAARIEEICSEADAAIENGARLIVLSDRHSDAEHAPIPSLLLTAAVHHHLIRTKQRTQVGLLVEAGDVREVHHVALLIGFGAAAVNPYLAMESVEDLVRAGTFLSDIEAEQAIRNLIYALGKGVLKVMSKMGISTVASYRGAQVFEAVGLDEEFVNKYFSGTATKIGGAGLDVIAKEVAARHAKAYPASGIAPAHRALDIGGEYQWRREGEPHLFDPETVFRLQHSTRSGKYDIFKKYTDRVNEQSERLMTLRGLFGFKSGREPISLDEVEPVSEIVKRFSTGAMSYGSISREAHETLAIAMNQLGGKSNTGEGGEDADRLYDPARRSAIKQVASGRFGVTSEYLVNADDIQIKMAQGAKPGEGGQLPGHKVYPWIASTRHSTPGVGLISPPPHHDIYSIEDLAQLIHDLKNANPQARIHVKLVSEVGVGTVAAGVSKAHADVVLISGHDGGTGASPLTSLKHAGGPWELGLAETQQTLLLNGLRDRIVVQTDGQLKTGRDVVIAALLGAEEFGFATAPLVVSGCVMMRVCHLDTCPVGIATQNPVLRDRFTGKAEYVVNFFKFIAEEVREILAELGFRSIEEAVGHAEALDVARAIEHWKAQGLDLAPLFYVPELPEGAALHQVIQQDHGLEKALDNELIKLAADALAANSVTDAQPVRAQVAIRNINRTVGTMLGHEVTKKFGGAGLPDDTIDITFTGSAGQSFGAFLPRGVTLRLEGDANDYVGKGLSGGRVIVRPDRGADHLAEYSTIAGNTIAYGATGGELFLRGRTGERFCVRNSGATVVSEGVGDHGCEYMTGGRAVVLGETGRNFAAGMSGGVAYVIDLDRDNVNVGNAGAVEELTEDDKQWLHDVVRRHAEETGSTVAEKLLAEWSVSAQRFSKIIPSTYKAVLAAKDAAERAGLTETEITEKMMEAATNG

SEQ ID NO: 13717 - protein, 486 aa, Streptomyces avermitilis
MADPKGFLTHGREVARTRPVEERVKDWNEVYVPGSLLPIISKQAGRCMDCGIPFCHNGCPLGNLIPEWNDYAYREDWTSASERLHATNNFPEFTGRLCPAPCESACVLGINQPAVTIKNVEVSIIDKAWDTGDVKPQAPERLSGKTVAVVGSGPAGLAAAQQLTRAGHTVAVYERADRIGGLLRYGIPEFKMEKRHINRRIEQMRAEGTKFRTGVEIGRDIDAAKLRRRYDAVVVAAGSTTARDLPVPGRELKGVYQAMEYLPLANKVQEGDFVAPPITAEGKHVVVIGGGDTGADCVGTAHRQGAASVTQLEILAKPGEERAAHQPWPTFPMLYKVTSAHEEGGERVYSVSTTHFEGDEDGNVQWLHLVEVEFVDGKLTQKPGTERRIPAQLVTLAMGFTGTDQDNGLVTQFGLGLDERGNIARDADFQTNVPGVFVAGDAGRGQSLIVWAIAEGRSAAKGVDRFLTGASELPAPIRPTDRSLMV

SEQ ID NO: 13718 - protein, 284 aa, Streptomyces avermitilis
MKRAALLLLTAVPAAVAAATAVYLFGLAPSDPDRTESPKPPSRQSSASAQGLNAPAKKELAQEIVASAENSTLDWRSAYGYVEDIGDGRGYTAGVIGFCTGTHDLLTLVERYTKDHPGNGLARFLPALRAVDGTDSHAGLGRAFTAAWRAEAGVAAFRAAQDAERDRVYFDPAVRLARHDGLGALGQFIYYDAMVVHGPGTDPHSLQGIRARALREADTPAEGGSETRYLDAFLDVRRTVMKSEKSHHDTTRIDTAQRRFLYDGNLDLRTPLEWRVYGERYRVP

SEQ ID NO: 13719 - protein, 321 aa, Streptomyces avermitilis
VEPKSPESPETPDSPESPESADSAVTTCYRHPKVESHVRCIRCDRYICPDCMREASVGHQCVECVKEGARSVRQARTAFGGRITTAPLVTYVLIGLNVLAYLGEVLRPALVDRFQMLGAGLAGPDGGHYLWQDPYPSSFHAEGVVGGEWERLLTGAFLHLPPTEGTFGILHIVMNMVSLWNLGRVVEAQLGRVRFLALYLLSALGGSVLVLLIAPDTPTVGASGAIFGLGAAYYVMARRLGADMRAVNRFIAGLLLWLLISAGLTSWQGHLGGLLAGGLVTLAYAYVPRGPRRGLLQAAACVGLLALLLVLTVGKVSGLTG

SEQ ID NO: 13720 - protein, 239 aa, Streptomyces avermitilis
MAAISLAKVEETAPALVSLYKSAGVSLHKHGLDGQRAAVYLVVDYSGSMRPYYKDGSVQALTDRVLGLSAHLDDDGTVPVVFFSTDIDAVTDIALADHQGHIELIVAGLGHMGKTSYHLAMDAVIDHYLDSGSKDPAFVVFQTDGGPTSKPAAERYLCKAAELPLFWQFIGFGDPGSRQFEFLRKLDELAVPHKRVVDNAGFFHAGTDPRKVSDGELYDRLVGEFPQWLAAARTHGIVR

SEQ ID NO: 13721 - protein, 204 aa, Streptomyces avermitilis
VAGGRPHPRDRPVTVLLPAAERVAVAWKNGGGVTREIAAAPPGADMAAFAWRVSLAEVAADGPFSAFPEVERTLTLVEGAGMDLTVGGRRRLVDTRYVPQDFPGDVPTDCRLLGGPVVNLNVMWRRGGAAPTVAVVRGRLRLPAAPALVVALDGGADLAGVRLGRYDALLLTGEDTVLHAHGPTAVVGLTPARGLAALTHDERH

SEQ ID NO: 13722 - protein, 319 aa, Streptomyces avermitilis
MRFLLSPQQRDFARSLDAMLTAADTPSVIRGDHTARRALWSRIAEAGVFAPAVPEAYEGMGPLPVDLAVAFVELGRHAVPGPVVETVLAAALLAALPEPGPAKRLLPGLAAGETVATVGAPYALDGDAADVVLAVRGGELWLAPGVADVRPSLDPGRRITTPLPGGERISSRVPGHAFDWARLATAAQALGVGLALLDRTVTHVTRRVQFGVPTGSFQAVKHRLADAKTALEFARPLLFGAAVTLAPRDVAAAKAAACEAAYATARTALQLHGAIGYTAEYDLSLWLTKARALRTAWGSPAECRADVLSADVLSAARRA

SEQ ID NO: 13723 - protein, 379 aa, Streptomyces avermitilis
VDLTHSPADEAFRTEARAWLAAHVPAVPLPSLETEEGFGAHRAWEAELAADRWSVVSWPAAYGGRDAGLLRWLVFEEEYYAAGAPGRVGQNGISLLAPTLFDHGTEEQRARVLPPMATGEVIWAQAWSEPGAGSDLASLTSKAVRTEGGWLVNGQKTWSSRAAFADRAFGLFRSEPRTPKPHQGLTYLMFDLRAPGVTVRPIGRLDGKPAFADIFLDDVFVPDEDVIGEPGQGWRIAMSAAGNERGLTLRSPGRFLAAADRLVELWRGRGSPSQERERVADAVIGARAYQLFAYAAAARFLDGEPIGPESSLNKVFWSEYDIALHETALDLLGRDGELADTDWAEGYVFALAGPIYAGTNEIQRDIVAERLLGLPKGRR

SEQ ID NO: 13724 - protein, 263 aa, Streptomyces avermitilis
MTDVEAPVYVSGHGLLQGRTAVVTAAAGAGIGGATARRFLEEGARVLISDAHTRRLKEYEAELAREFEGAAVAALPCDVTDEDQVRALFDTAVRLHGGLDIVVNNAGLGGTSDLVDMTDEQWSNVLDVTLNGTFRCTRAALRLLREQPGGGVIVNNASVVGWRAQAGQAHYAAAKAGVMALTRCAAMEAAGYGVRVNAVAPSLAMHPHLVKVTTPELLEELTGREAFGRYAEPWEVANVIVFLASGYSSYLTGEVVSVSSRHA

SEQ ID NO: 13725 - protein, 204 aa, Streptomyces avermitilis
VTAAPERRRELLDTAAEVFAEQGYNATTVRKIADHAGMLAGSLYYHFDSKESMLEEILRTFLDELWDGYDTVLDAELGPRETLEALVTESFREIDRHRAAVAIYQKESRQLVAQERFAFLAESQRRFEKAWLATLERGVAAEVFRADLDIRLTYRFVRDTVWVAASWYRPGGQHRPEEIARQYLSMVLDGIAVRTSPLTLPVRT

SEQ ID NO: 13726 - protein, 385 aa, Streptomyces avermitilis
MAEAYIVEAVRTPVGRRRGGLAGVHPADLGAHALTALVARSGIDPAAVEDVVFGCLDTVGPQAGDIARTCWLAAGLPEEVPGVTVDRQCGSSQQAVHFAAQAVLSGTQDLVVAGGVQNMSQIPIAFASRQAAEPLGLTQGPFAGSEGWRARYGDLPVNQFHGAELIAAKWGITRRDQEEFALRSHRRAVRASDEGRFDRETVAYGKVTADEGPRRDTSLEKMAALAPVIEGGTITAACSSQVSDGAAAMLLASERALREHGLTPRARVHHLSVRGEDPIRMLSAPIPATAHALKKTALAIDDIDLVEINEAFAPVVLAWLKETGADPEKVNVNGGAIALGHPLGATGVRLMTTLLHELERTGGRFGLQTMCEGGGQANVTIIERL

SEQ ID NO: 13727 - protein, 352 aa, Streptomyces avermitilis
MDTALTRLVGVRHPVVQTGMGWVAGPRLVSATANAGALGILASATMTPGRLRDAVREVRSRTDAPFGVNLRADAGDAGERVRIIVEEGVRVASFALAPSRELIAELKDAGVVVIPSIGARRHAEKVAAWGADAVIVQGGEGGGHTGEVATSVLLPQVVDAVDLPVVAAGGFHDGRGLVAALAYGAAGVAMGTRFLLTSDSTVPDAVKAAYLAATVKDVTVTTAVDGLPHRMLRTPFVGSLETAGRTRALVRAVRGAAGFRKLSGLTWSRMIRDGLAMKHGKELTWSQVLLAANTPMLLRSSMVDGRTDLGVMASGQVAGVIDDLPSCAELVERIMAEAERTLKGLERLRAAR

SEQ ID NO: 13728 - protein, 246 aa, Streptomyces avermitilis
MTLSRTATRAEHCVIACAEAWRDAGEILAAPMGPVPSVGARLARRTFSPDLLLTDGEALLVGPDGTPEGWLPYRQHLALVTTGRRHVMMGASQIDRFGNQNISCIGDWAAPARQLLGVRGAPVNTLNNPTSYWIPRHSKRVFVERVDMVCGVGYDRAAEHPGTARFHHIPRVVSDLGVFDFATPDHSMRLASLHPGVTVEQVRAATGFELTVPDGVPFTREPTPAELRLIREVIDPGNSRDREVRT

SEQ ID NO: 13729 - protein, 282 aa, Streptomyces avermitilis
VSDKTMTADEAVSRLRSGMTLGIGGWGSRRKPMALVRALLRSGITDLTVVSCGGPDVGMLAAAGRIRKLVAAFVTLDSIPLEPHYRAARERGALELMEIDEAMFLWGLRAAAGRLPFLPVRAGIGSDVMRVNPGLRTITSPYVDGETFVAMPALRLDAALVHLNRADRLGNGQYLGPDPYFDDLFCEAADTAYVSCERVVDTAELTKEAAPQTLLVKRHTVTGVVEAPNGADFTSCVPDYGRDEALQRYYATTPWPEFAERFLGGGEPAYRSAVQDWRKERI

SEQ ID NO: 13730 - protein, 252 aa, Streptomyces avermitilis
MTVSTSFPEKGIAVVTVDFPPVNALPVTGWQDLADAVRAAGRDPRVRCVVLAAEGRGFNAGVDIKELQANGHSALIGANRGCFEAFAAVYECEVPVVAAVQGFCLGGGIGLAGNADAIVASDDASFGLPELDRGALGAATHLARLVPQHLMRALYYTSRTATAAELRAHGSVWKVVPRAELHGAALELAREIAAKDGRLLRLAKAAINGIDPVDVRRSYRFEQGFTFEAGLDGVADRVRDTFGKPSEGQVPR

SEQ ID NO: 13731 - protein, 276 aa, Streptomyces avermitilis
MELNGKVAVVTGGTRGVGAGIARAFAAAGAEVVVCARRPPEVLLKGAEFARLDLRDPDAVGAFFGALPRLDVLVNNAGGTPYRRLADVDAARHARVVELNLVAPLTASLAAYEHLKRAGGAVVMVGSVSGGRPSPGSAAYGAAKAGLESLARSMAVEWAPEIRVNTLVLGMVRTELSHLHYGGAEGVAAVSRTVPLGRLAEPSDVGAAAVFLASDAAAYISGASLLVHGGGEPPAFLGAATANRGTRHEMPREKRREKRQEEEWARQEEEQEEEWG

SEQ ID NO: 13732 - protein, 315 aa, Streptomyces avermitilis
VGPTGGGAGGGVGMTGIAEGRVVIVTGAGRGLGRAHALAYAAEGAKVVVNDLGVGLDGAPGPDSPAGRVVDEIRAAGGAAVAHGGDIATSAGAASLVAAALETYGRLDTLVNNAGFLRDRMLVNLEEDDWDAVLRVHLTGHFLPLRHAAAHWRAETKAGRTPRARIVNTSSGAGLLGSVGQGNYSAAKAGIVGLTLVAAAELARYGVQVNAIAPAARTRMTERAFAGTMAAPDAGFDAMAPENVSPLVVWLGSAASAGVTGRVFEAEGGRITVMEGWRPGPTADKGARRTPAEAGKTARKLLAEAEVPGVVYGAG

SEQ ID NO: 13733 - protein, 308 aa, Streptomyces avermitilis
MNTQEPAGLFTAVYEGDENTVVRLLRAGTAADARDEDGQTALYLAAVSNEPGIVRLLLAAGADPDRLSADADSPLCGAACGGHAEVVRALLAAGATADLEEEFGFRALTWAVQRGQVEILTELLAAGAHPDRPGPTGEAPLVAAARRGSPGCVRALLAHGAGARSPALDEARRWPALDVEAELRAGLEQMYGSGHEMVTHRIPEDGGITVEVQLRTGERTMAGNDQQTGHAAIITLLEAALGIATPVPELADRALRCGDPANDDWTEAVSVLVRRAGGETFTAATAWSRSPDPLRRALGTEILRKLGR

SEQ ID NO: 13734 - protein, 298 aa, Streptomyces avermitilis
VANGGPVEHGYPHLDTVRAAITALYKRLSYDTIHTFAASVAPADVAFADHDDLHLGAQRVAHEMVRHYRLPDARMIVGFREMTHAANVELAAGPEYFIELNDRFRTHRRDIGAALAHEVMHVYLHRLDLSFPGTRDNEILTDTAATYLGAGWLLLDAFREDAASSQKLGYLTPEEFGYVLAKRALVFGEDPSIWFTSPQAYTAYTKGMAQARRDEQQPPLTAAGWAGRHRYAKDRRHAQDHRSPGPQPGVPYAFAPGDRGLLRVSFPCPTCHQRIRIPVRGRVRARCTLCRTVLECDT

SEQ ID NO: 13735 - protein, 291 aa, Streptomyces avermitilis
VHAIQAVRHAVRCSAVPPPGVQPPTRGTTLNIPKILKRFGGLKRALAVGAVTLAAVSLQPLSAQAAPQPVVGGTRAAQGEFPFMVRLSMGCGGALYTKQIVLTAAHCVSGSGNNTSITATAGVVDLQSGSAVKVKSTKVLQAPGYNGKGKDWALIKLAAPIEQPTLNIATTTAYNNGNFTVAGWGAARENGAQQRYLLKATVPFVSDASCQQSYGSDLVPGEEICAGFPQGGVDTCQGDSGGPMFRKDDSGAYVQVGIVSWGEGCARAGYPGVYTEVSTFAADIARAAAGL

SEQ ID NO: 13736 - protein, 151 aa, Streptomyces avermitilis
MTMDQQPSITASLQVGEKDSPLERRLDRELTAFNADATGAGEPAPLSVRVTDSAGDLVGGLTAWVWGSCCAVDMLWVREDQRHAGWGGKLLRAAEEESARRGCTEMIVSSFTFQAPDFYRGHGYRETGRTEGIPGGHQDVHFHKVLEPTAR

SEQ ID NO: 13737 - protein, 129 aa, Streptomyces avermitilis
MTNSNTRTGTGDVDPAVRAELARLRDSIDNIDAAVVHMLAERFKCTQQVGHLKAVHQLPPADPAREASQIARLRRLAENAKLDPAFAEKLLGFIIAEVIRHHERIADNTANGSVSAPPATEDDTTGPAE

SEQ ID NO: 13738 - protein, 185 aa, Streptomyces avermitilis
MPSDARILIVDDHEDTLYALESTLAPLGYLLSRATSGDDALKEVLRGQVGLLLLDVRMPGVSGLDVVRYMRRLEQTQHIPIILLTGFGLDAELTTTAFALGVADLVTKPVDPWSLRTKVRYLYDAHQRSQALEREVRELRALAKNEHPQPRSQAQPHPSPAQPQPHAHVPVPREPPAQKPAQDRT

SEQ ID NO: 13739 - protein, 846 aa, Streptomyces avermitilis
MSLMSVLTRDEAQTRASLLDVHHYAIALDLTVGDETFDSRTVITFTVRGDHDVADTFVELKPAELRSATLDGQPLDTATLVENRLPLTGLTQGEHELRIDTAMGYSRTGEGMHRFTDPTDGETYAYTQLFMDDVQRVFAAFDQPDLKAVFELEIKAPEGWTVLANGVTTDVGDGTWKATATPLISTYLVAVAAGPWHSVHTEHRGLPFGLHCRRSLAPHLDADADELLDITRACYDRYHEKFEEPYPFDSYDQAFVPEFNAGAMENPGLVTFRDEFVYRSAVTDTERQTRAMVIAHEMAHMWFGDLVTLRWWDDIWLNESFAEYMGYQTLTEASLGGSGGTPPRKWGTDTWTDFGVTRKPWGYDADQRPSTHPVAPEAVDDTASALLNFDGISYAKGASALRQLVAWLGEKDFLAGINTHFTRHKFGNATLADFIDSLAAATERDVHAWADSWLRTTGVDTLTPDITTAPDGTCALTVERDGSRPHRITVGLYDRDLNDEARLTLRRRLELDIPQDPAEPQPLGKRPALLLLNDGDLTYAKVRFDPESFTTVRAALSGLPDPLTRAVVWNALRNAVRDGHLPPTAYLQTARAHLPHETDLALVQGVLAFATTHVAGRYLSAADRPAALATLTDLCRDLIRRTEDGSQPGLRLTAVRHLIDVAAHPDTLSSWLSEGTVPGGPELDPELRWRILGRLAVLGAIDDDVIEAELVQDPSASGQEGAARCRAALPDPESKRRAWEEMFTTDHLSNYLFTATAQGFWQPEQADLVRAYVERYWTDAVAVAARRGPAIAAAAGRWAFPAHAVSPDTLRRGEQCLREADPIPALRRKLVDELDDLARALRVREA

SEQ ID NO: 13740 - protein, 480 aa, Streptomyces avermitilis
MSSPPLASGPEGPHALRPLLETVLDALTEGRQARGGPLPAGGPQAVAARVRATVGDALPQKGDPDAVRHLVRMLAEGAADPADPLCAAHLHCPPLAVATAADLAASALNPSLDSWDQAPAASELEALVTDALAAEIYAGTRTSDRARPTVDTSTSAPEANEPHTSTALVTTGGTESNQLALLLAREAHSGARLVCGANAHHSLTRAAWLLGLPEPVVVPAPAGTLDPAALDEALTELPGPRGSLVVAATAGTTDAGLIDPLTDIADLCAAHGARLHIDAAYGGGLLFSARHRHRLHGIERAHTVTLDLHKLGWQPAAAGLLAVRDPHDLHALHHHADYLNADDDTQAGLPDLLGRSLRTTRRPDILKIAVTLKTLGRDGLGTLVDQVCAHAQELARLIQAHPGFELYDPPTISTVLFRPAEASDDTVAAVRRTLLTEGRAVLGRAVLDGQLWLKATLLNPHTRPGDLAALLKLVEGHTPR

SEQ ID NO: 13741 - protein, 472 aa, Streptomyces avermitilis
MSPTPHPPRHEPEAPRDLAGIGIGPFNLSLAALAHPLTELDTVFYEQRPSFDWHPGLLIDGATLQVPFLADLVTLADPTSPWSFLNHLKTRDRLFPFYFAERFHIQRAEYDAYCRWVADSLPGLHFGHQVDAVRWNPERDVFEVDFTQLDTDGEAEALGRTYSKNIVLGVGTAPYVPEPLKPLVEAPGVPVIHAADYLQHRDRFLTAEHITVIGSGQSGAEVFLDLLRNRPAGHERIHWLARTEAFAPMEYSKLGLEHFTPDYTRYFHALTEPVRDRLVAAQWQLHKGIDADTIAAIHHELYRRTLHGGWPDAVLTPGVTVRTAGRLATTKVELHLEHAQQGTRSRLTTNAVVLATGYRERPLGRILAGLDPYLRRDSAERPRIDNQFRLDLDPSVTGTAYVQNAELHTHGIGTPDLGLAAWRSATILNSLTGKDLYPLPHRTAFTTFGLQQQPHIPPARQVHALTPLIDGR

SEQ ID NO: 13742 - protein, 606 aa, Streptomyces avermitilis
MPLNRRKFLKKSAVTGAGVALTGAVAAPAAQAAEVKGGAAKGAGKRPKRYSLTVMGTTDLHGHVFNWDYFKDAEYSDKAGNAQGLARISTLVDQVRKEKGRCNTLLLDAGDTIQGTPLTYYYAKVDPITAKGGPVHPMAQAMNAIGYDAVALGNHEFNYGIETLRKFESQCRFPLLGANALDAKTLKPAFPPYFIKKFHVPGAPPVKVAVLGLTNPGIAIWDKAYVQGKLTFPGLEEQAAKWVPKLRSMGADVVVVSAHSGSSGTSSYGDQLPYIENSAALVAQQVPGIDAILVGHAHVEIPELKVTNAKTGKTVVLSEPLCYAERLSLFDFELVFEKGKWEVESVVASLRNTNAVADDPRITKLLSDEHATVVKYVNQVVGTATETLTTVEARYKDAPIIDLITKVQEDVVRAALVGTQYASLPVIAQASPFSRTSEIPAGKVTIRDLSSLYVYDNTLVAKLLTGAQLRAYLEYSAEYFVQTAAGTVVDTEKLTNANNRPDYNYDYVSGLGYEIDIAQAAGSRIKNLTYNGAALDDAQQFVFAVNNYRANGGGAFPYVASAAELWSESTEIRTRIAEWVTAKGVLDPKDFASVDWKLTRDGSPVF

SEQ ID NO: 13743 - protein, 253 aa, Streptomyces avermitilis
MTSSHPTAPPSDRVGRMTPTAEEPRPTGPYGTPEAPRIAVRGEAHLEVDPEIARIGITVSARGTDRRDALTDLTRRNTTALDLVKTYGEAVERLETGAFSITPELTKHGRGERIRAYHGRVHITAELTDFTALGELTTRLADLDLTRVDGPWWALRPDSPAHRQARRQAVREAVQRAREYADALGTTLAALVELADIGADNLPPYPPAPGRAMRSMAYGAAAPEETAPLDLEPQRQNVYAQVNARFTMVPPRL

SEQ ID NO: 13744 - protein, 478 aa, Streptomyces avermitilis
MRRAKIVCTLGPATDSYDQIKALVEAGMDVARFNLSHGTYAEHEERYQHVRKASDETGRSVGVLGDLQGPKIRLGRFNEGPVLLERGDTFTITVEEGVEGDRQTCGTTYAGLAADVTPGERILVDDGKVCLEVTSVDGPRVHTTVVEGGMVSDHKGLNLPGVAVSVPALSDKDEADLRWALRQGFDVIALSFVRSGKDIKDVHRIMDEEGRRLPVIAKVEKPQAVENIDDIVAAFDGIMVARGDLGVEMPLEQVPIVQKRAIKLARRNAKPVIVATQMLDSMIDNSRPTRAEASDVANAVIDGTDAVMLSGETSVGKYPVETVRTMSRIVEAAEEDILATGLPPLTERNKPRTQGGAVARAAAEMGDFLGAKFLVAFTQSGDTVRRLSRYRSPIPLLAFTPMPATRSQLNLTWGVETFLGPHVDSTDAMVDQVDELLLKYGRCEKGDVVVITAGSPPGVSGSTNLVRVHHIGEDDSPK

SEQ ID NO: 13745 - protein, 270 aa, Streptomyces avermitilis
MRSRPVTQSGRMEQHSPSIRAHAVALMRQGIPNRIVAERLNVPRGTVGWWRSEDRRARGEAYEQPTDCPHCTGREFDHAAYAYLLGLYLGDGHIISKRKQHHLSVFCNAMQTGLITAAEEAMRKVMPLPSVKQRYKPGCVEVKSYTKHWTCMFPQHGPGKKHERPIVLEAWQQEIVDAHPWEFIRGLIHSDGCRITNWTTRLVGGERKRYEYPRYFFTNVSDDIRQLYTDTLDQLGIQWTHCTRNGNPYNISVARKASVALMDAHVGPKY

SEQ ID NO: 13746 - protein, 218 aa, Streptomyces avermitilis
VTAPESPQPVDAPDDDKSHVPPLTTRVVIAEDEALIRLDLKEMLEEEGYTVVGEAGDGEQAVELAREHRPDLVILDVKMPKLDGISAAEKIAEESIAPVLMLTAFSQRDLVERARDAGAMAYLVKPFSKSDVVPAIEMAVSRFAELKALEQEIVDLTQRLETRKLVDRAKSVLQTQYGLTEPAAFRWIQKTSMDRRMSMQQVAEAVIEDAEEKKSAKG

SEQ ID NO: 13747 - protein, 238 aa, Streptomyces avermitilis
VTALLEVEDLRVSYGKIEAVKGISFSVEAGQVVTLIGTNGAGKTTTLRTLSGLLKPTGGRIVFDGQPLTSVPAHKIVALGLAHSPEGRHIFPRLTIAENLQLGAFLRKDKPGIEKDIQRAYDLFPILGERRKQAAGTLSGGEQQMLAMGRALMSQPKLLMLDEPSMGLSPIMMQKIMATIAELKSQGTTILLVEQNAQAALSLADQGHVMEIGNIVLSGTGQDLLHDESVRKAYLGED

SEQ ID NO: 13748 - protein, 314 aa, Streptomyces avermitilis
VTDMTTTTATSTVLEASGVTMRFGGLTAVRSVDLTVNSGEIVGLIGPNGAGKTTFFNCLTGLYVPTEGKVSYKGKVLPPKPHLVTSAGIARTFQNIRLFANMTVLENVLVGRHTRTKEGLWSALLRGPGFRKAETASRERAMELLEFIGLAHKADHLSRNLPYGEQRKLEIARALASEPGLLLLDEPTAGMNPQETRATEELVFAIRDMGIAVLVIEHDMRFIFNLCDRVAVLVQGEKLIEGTSEVVQADERVIAAYLGEPFEGAPGDAEAAEVEAAEAHAEAAEAEAAEAADSTSETSTTGTTSTTGTKGDAQ

SEQ ID NO: 13749 - protein, 591 aa, Streptomyces avermitilis
MTTPATSTEKTAAGLIPLPQAAARLLIVIGALATIASAFMSWTWTAAFPGDLTVYGYPAGLQTLAIVGAVITLLLGLTRWDIPALRWANPANAASPIALAAASAFTVCWYTGIAIAVDLGGLANLDPGAYVAMAASLIALLGALALPTPGGTWRDYLAKAENIPPAGELAPWVQRLVITLATLLALIVFTYGIGVNDDESETFIGFLFLVVFGAWALFAAGLLDRFSTINAQHKGFATTLAFLAAAIFPFTQSDDHNANLGVNILIVGTVALGLNIVVGLTGLLDLGYVAFLGVGAYAAALVSGSEFSRFAGVQFPFWAAALTGMGASLVFGVLIGAPTLRLRGDYLAIVTLGFGEIFRIAVNSLDGSSGPNLTNGPNGISRIPDLEIFGFNLGISHDVGSFTVGRFANYFFLMLIITALVVLVFTRASDSRIGRSWIAIREDETAATAMGINGFRVKLIAFALGASLAGLAGTVSAHVGYSVNPAPYQFAGSVPPNSAFLLAAVVLGGMGTVNGPILGATLLYLIPEKLSFLKEYQLLAFGIALVLLMRFRPEGIIANRRRQLEFHETDQIDVPEQRLTEPTVGVTKAGA

SEQ ID NO: 13750 - protein, 310 aa, Streptomyces avermitilis
VHTLPQQLANGLFLGSMYGLIAIGYTMVYGIVQLINFAHGEIFMTGGFGALTVYFYVLPDGTSMWIALPAMLIGGGLIAVLIAVGAERFAYRPLRGAPRLAPLITAIGLSLGLQQVVFNFYPDAKTDRTFPQLGTESFNIGSVHIQSGQLFIIIAAPICMAALGFFVRLSRTGRAMQATAQDPDTAQLMGIDTNRIIVIAFAIGGLFAAVAAVAYGLRYGQIKYDMGFQMGLKAFTAAVLGGIGNIYGAMLGGVVLGVAETLATAYIDGIPGMQQLGGGSWAPVWAFVLLILVLLLRPQGLLGERVADRA

SEQ ID NO: 13751 - protein, 409 aa, Streptomyces avermitilis
LIVRHRSLLILTTVLTTGALTLTACGSRDDDKGSDSGSKTTVVIGVDAPLTGQNSATGLGIQYGVQIAVDDANKKNLVPGVTFKVKALDDKAVPASGQQNATALVANKDVLGVVGPLNSGVATQMQQVFDTAGLVQISPSNTAPELTQGKNWQSKKERPYKTYFRTATTDALQGGFAADYAYNTLKKRKVFIVDDKQTYGAGLAKLFKQNFKKAGGKVTAEDHISVGDTDFSSLVTKVKNSGADLFYYGGQYDESEKITKQLKDGGVDIPLFGGDGMFSDTYIETAGKPSEGDLVTSVGVPVTTLPAAKEFIATYKAKKYPGDYGTYGGYSYDAATAIIKAIGNVVKDGKVPSDARTKIVDEVQKTKFDGIAGPVAFDEYGDTTNKQLTVYQVVKGKWKAVKSGTYNAG

SEQ ID NO: 13752 - protein, 153 aa, Streptomyces avermitilis
MGEQHTPTFPQEVIDEYAALGVDLPALFSAGHLGTRMGVRILEASAERVVGTMPVEGNTQPYGLLHGGASAVLAETLGSVGSMLHGGSSKLAVGVDLNCTHHRGVRSGLVTGVATPVHRGRSTATYEIVISDEEGKRVCTARLTCLLRELPAK

SEQ ID NO: 13753 - protein, 760 aa, Streptomyces avermitilis
MATKPPKGDPVQDAPQVSEPKQAAAGLPAIKHTLRIAQQQMGVRRTALTLLRVNQKDGFDCPGCAWPEPEHRHTAEFCENGAKAVAEEATLRRVTPDFFAAHSVADLATRSGYWLGQQGRLTHPMYLAEGADHYEAVPWERAFDIVAEELAALGSPDEALFYTSGRTSNEAAFLYQLFARELGTNNLPDCSNMCHESSGSALTETIGIGKGSVLLEDLYKADLIIVAGQNPGTNHPRMLSALEKAKAGGAKIITVNPLPEAGMGRFKNPQTPQGMFKGAALTDLFLQIRLGGDQALFRLLNKLILETNGATDQAFIDEHTHGYEEFAEAARTADWAGTLAATGLTQQQIEEALRMVLASERTIVCWAMGLTQHKHAVPTIREVVNFLLLRGNIGRPGAGVCPVRGHSNVQGDRTMGIFERPAPAFLDALEKEFGFAPPREHGYDVVRAIRALRDGEAKVFFAMGGNFVSASPDTEVTEAAMRRARLTVHVSTKLNRSHAVTGARALILPTLGRTERDLQAGGEQFVTVEDSMGMVHASHGRLEPASGHLLSETAIVCRLARRVLGDKSRTPWEEFENDYATIRDRIARVIPGFDDFNARVTGSAGGFALPHAPRDERRFPTATGKANFTAAPVEYPALPEGRLLLQTLRSHDQYNTTIYGLDDRYRGIKNGRRVVLVNPEDAKALGAADGSYVDLVSEWQDGVERRAPGFRVVHYPTARGCAAAYYPETNVLVPLDATADTSNTPASKSVVVRLEQSTTD

SEQ ID NO: 13754 - protein, 907 aa, Streptomyces avermitilis
VAETASKKTEKTSGGARPRLMLMDGHSLAYRAFFALPAENFTTATGQPTNAIYGFASMLANTLRDEAPTHFAVAFDVSRKTWRSEEFTEYKANRSKTPDEFKGQVELIGELLDAMHAQRFAVDGFEADDIIATLATQAEAEGFEVLIVTGDRDSFQLVSDHTTVLYPTKGVSELTRFTPEKVFEKYGLTPAQYPDFAALRGDPSDNLPGIPGVGEKTAAKWINQFGSFAELVERVDEVKGKVGQNLRDHLESVKLNRRLTEMVRDVELPKSVAALERAPYDRTAVAMVLDTLEIRNPSLRERLLAVDPGGEEAEEAPVAAGVAVDGAVLGAGELKPWLAEHGTTVLGLATVDSWALGAGAVAEVALAAADGAAAWFDPSQLDEADENAFATWLADPAKPKVLHNAKGVMRVFAEHGWTVEGVSMDTALAAYLVKPGRRSFALDALSLEYLGRELEPAATADGQLAFGADEGAEADALMVQARAILDLGEAFGERLKEVGSADLLRDMELPTSALLARLERHGIAADKAHLEAMEQMFAGAVQQAVKEAHAAAGHEFNLGSPKQLQEVLFGELGLPKTKKTKTGYTTDADALAWLAAQTDNELPVIMLRHREQAKLRVTVEGLIKTIAADGRIHTTFNQTVAATGRLSSTDPNLQNIPVRTDEGRAIRRGFVVGEGFESLMTADYSQIELRVMAHLSEDEGLIEAFTSGEDLHTTVASQVFGVERSAVDAEMRRKIKAMSYGLAYGLSAFGLSQQLNIDAGEARALMDTYFERFGGVRDYLRRAVDEARATGYTETLFGRRRYLPDLNSDNRQRRETAERMALNAPIQGTAADIVKIAMLNVDRALQEANLKSRMLLQVHDEIVLEIAPGERAKTEELVRREMASAVQLRAPLDVSVGDGGDWESAAH

SEQ ID NO: 13755 - protein, 413 aa, Streptomyces avermitilis
MPVLRAGAACPCRWCHRRSTVLPGTVTQVTLRQLVSPGHPLVPDCRWPADCGAGRMREPGGSPHDFHAPLILDDCDRRTVVSGRRQPRRADLPFTLSHAAAVLPGVRGDGTGRGRLVPTVLVAGSFAPDMTYYAASVLSGAMEFGDFTHSFTGVLTFDVLVAWALAGAWLVLREPLVALLPRARQGRVAALLRCGVPRARMRASAVLWWYVSAALGALTHVVWDAFTHHDRWGIRLFPVLGQEAGGFPLYWFLQYGSSAVAAVVIAVFVVVALRRVPLPTPSPSPSPSPSGSGSGSGFGGPAGVPVLSGSDRWVAGAVIGGCAVVAAMQRASRWWEYWGATAKPWELIPTLCFGAGAGLVLGTLLYAVGIRVRRPAAAGGAGAGTEAGVGDEAGAGARTGNGAGKEPSRPAAS

SEQ ID NO: 13756 - protein, 569 aa, Streptomyces avermitilis
MAAHFGSRLRRGATTTAVAAAAVAALAASQAPGVTTDDQGRQTTGSEATPDGNGDGSATGNGRYYTDLPPLDSPTASPSPGTGSTTPAGTAEAGIPATVLDAYKKAETALRSSKPGCNLPWQLLAAIGKVESGQARGGRVDANGTTYSKILGPKLDGNGFALIADTDNGAYDGDSAYDRAVGPMQFIPSTWEWAGRDGNGDGAKNPNNIYDAALAAGHYLCRFDRDLSVQSELNKAILGYNNSQEYLNTVLSWLEYYRKGTHEVPDGTGTLPSHSNDDGQGASPAPSPSPPKTPKPPKTTKPTKPGTPGDGGSTSPSPSPPPPSTPKPPSPTPPTPTDTVDHLEDAGTAKLTATAGDTFDQKVAVRTETKAGKAVAKVRVRFTIVGDTDATFTGGETVATIVTNSAGKATAPALVAGQKTGDFTVRATVVGRSVAGLDYTATVTEPQADALARTSATELTCVPGGEFADQVEVKATYKNAVADGVAATATIVKSADDATENDKGPSFKDADGKTVRTLKDLKTDANGLLKLPKLYADDTVGTFLLRIDTTGGATLTVELKVAAATTTTP

SEQ ID NO: 13757 - protein, 330 aa, Streptomyces avermitilis
MRRKASLILLALAVFCTALSPLVRWYAFPRLAKIPANQYQDMVLEAKNATLLDYGTMKAKTVPKVTVVQTLRGNVEASQKIEKTAGKDVVVWDGLSYVQGPDGKMVSRIPERYIFDAHTQEPVHATGEMVDGDPVTRAGLEFKWPFLTERRDYEYFDAQARTTAPIHYKGTQDFRGVRVYYFEQTVPWTKVPFPKAMPVKGVTPRSLAKTGTTRWYTTVRKFWVEPVTGAPVYGEEIHKEELRGGTLLGGRDKVTAFAGHVKMREDYIRSTVALVKSNRTVVLLMTSYLPWGLLLLGLLLLTLSLWLEARGRRPADPAPTEASAPEPVSA

SEQ ID NO: 13758 - protein, 877 aa, Streptomyces avermitilis
VIRYDALDLPVRSALPGLNDALDAGGAAVLVAPPGTGKTTLVPLALAGLLGEGAAKGPVRRVVVAEPRRIAARAAARRMAWLLGEKAGDSVGYTVRGERVVGRHTRVEVVTTGVLLQRLQRDQELAGVDVVVLDECHERHLDADTAAAFLLDVREALRPELRLVAASATTDAAGWARLLGGAPVVEAAGVSYPVEVVWTPPVRPVRPPHGMRVDPVLLTHVASVVRRALAEREGDVLCFLPGVGEIARVAGQLGDLDGVEVLQVHGRAPAAVQDAVLSPGAGRRVVLATSVAESSLTVPGVRVVVDCGLAREPRVDHARGLSALTTVRASQAAGRQRAGRAGREAPGTVYRCWAEAEDARLPRFPSPEIKVADLTAFALQAACWGDPEASGLALLDAPPGGAMAAARSVLAAIGAVDSAGRATERGVRMSRLGLHPRLARALLDAAPEVGADRAAEVVALLSEEPPREYGDDLAAAWRAARRGGDAYAGRWRAEARRLRAGATDRARPPARDRDSAPRERDAGAPAGTGGQGSAPGPTGSEPTGSGAAGRAGSGDDRIAGLVAALAFPERLARAQGGSCLMVSGTRADIGDGSALRGAPWLAVAVADRPVGAGHARVRLAAVVDEDTARRAAAPLRSAGAEVHWADGDVVARRVERLGAVELAVRPLRDADPGLVRDALLEGLREEGLGLVRWSADAEVLRRRLAFLHLHVGAPWPDVSDDALHARVDEWLEPELSRARRRADLARIDAGQALARLLPWATGDAARLDELAPERIEVPSGSRIRIDYGNPEQPVLAVKLQEMFGRHESPRVAGVPVLVHLLSPAGRPAAVTADLASFWRDGYKAVRAELRGRYPKHPWPEDPATAEPTRYTNARLRR

SEQ ID NO: 13759 - protein, 289 aa, Streptomyces avermitilis
VTPPERVRRKCPQTNTREPIIQEPDTFEPEATRRDAGATESSRANRGWWDRNADDYQVEHGTFLGDDRFVWCPEGLDEVEAELLGPAEDLKGKDVLEIGAGAAQCSRWLAGQGARPVALDLSHRQLQHALRIGGDVPLVEADAGALPFADASFDLACSAYGALPFVADPVRVLREVHRVLRPGGRFVFSVTHPIRWAFPDEPGPEGLSVSASYFDRTPYVEQDEEGGAVYVEHHRTIGDRVRDVVAGGFRLLDVVEPEWPAWNTQEWGGWSPLRGNLIPGTAIFVCVRD

SEQ ID NO: 13760 - protein, 501 aa, Streptomyces avermitilis
MTSSTETTSTTPQVAVNDIGNEEAFLAAIDETIKYFNDGDIVDGVIVKVDRDEVLLDIGYKTEGVIPSRELSIKHDVDPNEVVKVGDEIEALVLQKEDKEGRLILSKKRAQYERAWGTIEKIKEEDGIVTGTVIEVVKGGLILDIGLRGFLPASLVEMRRVRDLQPYVGKELEAKIIELDKNRNNVVLSRRAWLEQTQSEVRQTFLTTLQKGQVRSGVVSSIVNFGAFVDLGGVDGLVHVSELSWKHIDHPSEVVEVGQEVTVEVLDVDMDRERVSLSLKATQEDPWQQFARTHQIGQVVPGKVTKLVPFGAFVRVDEGIEGLVHISELAERHVEIPEQVVQVNDEIFVKVIDIDLERRRISLSLKQANEAFGGDPASVEFDPTLYGMAASYDDQGNYIYPEGFDPETNDWLEGFESQREVWETQYAEAQQRFEQHQAQVIKSREADAQAEAEGAAAPAAGGSGAGVSGGSYSSESDDNSGALASDEALAALREKLAGGQS

SEQ ID NO: 13761 - protein, 312 aa, Streptomyces avermitilis
VLDPQGLYAWEPKGLAVVDMALAQESAGLVMLYHFDGYIDAGETGDQIVDRLLDSLPHQVVARFDHDRLVDYRARRPLLTFKRDRWTEYEEPTLDVRLVQDTTGAPFLLLSGPEPDVEWERFAAAVQQIVERLGVRLSVNFHGIPMGVPHTRPVGLTPHGNRNDLVPGHRSPFEEAQVPGSAESLVEYRLMEAGHDVLGVAAHVPHYIARSPYPDAALTVLEAITAATGLVLPGLAHSLRTEAHRTQTEIDRQIQEGDEELVALVQGLEHQYDAAAGAETRGNMLAEPVEIPSADEIGQEFERFLAEREGEG

SEQ ID NO: 13762 - protein, 213 aa, Streptomyces avermitilis
VASPRLVGMLKVGLTGGIGAGKSEVSRLLVEHGAVLIDADRIAREVVAPGTPGLAAVVEAFGTDVLAPDGSLDRPKLGSIVFADPDKLAVLNAIVHPLVGARSRELETAAAADAVVIHDVPLLAENGLAPLYDLVVVVDASPETQLDRLVRLRGMTEQDARARMAAQATREKRLAIADIVMDNDVPLEELERRVGDVWADLVHRAHQPGESQE

SEQ ID NO: 13763 - protein, 126 aa, Streptomyces avermitilis
VPETSGWTGRTPETHVIDFRAAEQLLAARDPRGAVKLLDPVIAAHPENTAARLLRARAFFAAAQLRPAELEFTIVLEREPDNAFAHFALARTYERQLRPDQAKRHFRLAAALDPNPQYLKAARFDS

SEQ ID NO: 13764 - protein, 91 aa, Streptomyces avermitilis
VVPMRTGSEPTTARSALRLRFWLSVWGLIWAIAGTAAFALAGRPGWAAACGVLWLIVTADMTMILRHIHQGPHWQPGRDVPPYRPPEHRHP

SEQ ID NO: 13765 - protein, 345 aa, Streptomyces avermitilis
VVHVHHGTVDGSTGEATMLLDALRADARLAEWLRDLESEGDPRVEVALPGADELPDVLLDLSVPHEDINEFVALRARLADDAEAMTLLARCVARFVRDMGEIGKGWEPPPFPTSTGDLGRCFPLYVFVGALPHVRAYHHRRGVPAEVSRRTLADLGRHVAVHRRRLGTGGLLFPWWIALPFHGELFQLGRLQFQRARLGQRTGRAVAGAGLGLGPGDPCLSLHIPDFRGPLSPSACERSLALAREFFARHYPDERYEVAVCHSWLLDPQLKRYLSAESNIVRFQERFEIAYAQTAPEDGVPVGFVFGDPELPVADLPRRNSVERAIGDHLRAGGHWYGGHGWAPL

SEQ ID NO: 13766 - protein, 227 aa, Streptomyces avermitilis
MREGYEGTGPGAITPDGCAVELYSRLPVGEEPDIIAAAVPTGARILELGSGVGRMTHPLLDRGFEVTAVDESSEMLARVRGARTICSPIEGLDLGETFDVVMLASFLVHAGDVEVRRGMLRACARHVAEGGCVLIQREGEDYHSNVPRERVDPSGFTLRILSAEPAGDGVNSVSAEYVFPDATWTHTFLARPLTKEQFEEALAEAGLRVDRYLTEDGVWVRAVPAEE

SEQ ID NO: 13767 - protein, 180 aa, Streptomyces avermitilis
VRGDELRASARSTSVTAIRNCFTEETPMSQTTAPVTRAASAASASGGTRSRRAEISLRALQIVLALFYGVASALPKLIAHPSAVESFDKIGWGSAGMYTIGALELAGAVALLIPALMSVAAVALSALMVGAFITQLTVFDGQYAATPLILIVPLALIAWARRKGTADGLGRLVRLVRRGA

SEQ ID NO: 13768 - protein, 212 aa, Streptomyces avermitilis
MASESADEETVGADAVDTGAAATDELDTDATVAADAAGPANGETVRIDSWIWSVRLVKTRSMGATACRGGHVRVNGERVKPAYAVRVGDEVRLRHAGRERILVVKRVIRKRVGAPVAVECYVDNSPPPPPREAVAPIGIRDRGTGRPTKRDRRELERLRGFGDPPDGEHGGTAAPDDPGKQNRPGKQSSSEKQSSSGKRSSSGKQSGPRTRG

SEQ ID NO: 13769 - protein, 264 aa, Streptomyces avermitilis
MEGTEGRDSSLAEGGRLAEGSSLSDLDEHITGCRACPRLVEWREEVARTKRAAFADWTYWGRPVPGFGPVDASLLVVGLAPAAHGANRTGRMFTGDRSGDVLYAALHDVGLASRATAVSADDGLELYGVRITSPVHCAPPANKPTPEERDTCRPWLVRELELLRPTLRAVVVLGAFGWQAALPALAEAGWAVPRPRPAFAHGVRVTLRPSAGPPAKSLDVLGCFHVSQRNTFTGRLTPAMLRDVLRTAAEAAGLPTLPDAGQYA

SEQ ID NO: 13770 - protein, 135 aa, Streptomyces avermitilis
VTTRTAIGAARTRPCTLVVCRGCCCGDPRKYPGYDHDWQLERLRAAAAASGGRITVRTTDCLGPCDQANIIVVQPSGEGRRRGGRATWIGWSMGDDCTDEIVRWAEAGGPGIAPPPATLELQFVSSAGERSRARR

SEQ ID NO: 13771 - protein, 195 aa, Streptomyces avermitilis
VVALRSANSNAPASPRRACSAGCPSAGRLSLNRRPARIPGDPVINRVTVPTLCPPPVYSHASVVEAGTRLAFLAGSVPLDADGKIVGEGDPVRQAAQVLANLAEQLRAVGSDLAHVVSTDVYVVSGEPAVLSAVWDVVEASGLSIGPHSSTLIGVACLGYTGQLVEITATAVVPEPGAESASASEPGPGPGPESA

SEQ ID NO: 13772 - protein, 125 aa, Streptomyces avermitilis
MSRTVHHVPTRHRTRPAYWPTGTAGPCTAHALTDHRYSRQELARARRAGRRPVPTRVDRSFAAYVFPRALGAHFWSPYESAARADLRTFRTAACKLLRAAPPGALLAAAEDLDHPPTRHRHRDLW

SEQ ID NO: 13773 - protein, 396 aa, Streptomyces avermitilis
MRIAHHRYVVVAATAAAILALADIPAEAQTGPAAAALPSSVSADTTGLAGLAESYLQQRADMLTTSPPTAKAAIAHVRATRSMAAQTQDDLAALAEKGKRYKEVDGGYTRAQVDVKVDDTTVDGGTATLQLTEHTRLRLPFTPQEVEEGAPEFEELSLPHTVKFTQGSDSAWLLSSDKADTAGGPTPTTQVSDTDAEATTDDGGGAPDEDEGGKDDAADTTPLPDSGASDTVKPGVSAAYSYNKMVAYADRYWDHHNGAYRTYGNDCTNFISQAMLAGGWGPKGGALIQRTSNKYWFYGPTKWTTSYTWAGAENWYWFAKKHAKRTKILGNVWQLAKSDVLQADWTRNNNIDHSMIVTKKYRGTPYLTYHTGDTHNKSLSKLLSDHPRAWWYAHRT

SEQ ID NO: 13774 - protein, 157 aa, Streptomyces avermitilis
MNKERAVERRRLLAVLAALAVATGCSTHDDKAEPSRSASSDGARHAVEAYVDALNSRSATGLIKVGGVKDESWSRQEAARMLADRGGREWKIKDVRIDHDMGPDTGSARLLAKDKAGKSLRDTFTVTREKGVWHLAVFTHQPDGKGKESSSTDKPAS

SEQ ID NO: 13775 - protein, 620 aa, Streptomyces avermitilis
VTRLSAAVPPWLAHALRAQRGPIPWSAVLRGALAGGPLLLAAVLSGRSSIGVVAALGAMLAGINDRPGSRRTSVKRLGVPALAGAAGLLVGSYAGQHASAAPLTLLLTCLGFFAGAVSAIGPVASGAGTQLLVASAIGAGMPLPEPGWQRALFFLAGAGWLLALRLVLPTPGATSGDYRFDGERTAVAAVYDAVAQLLDAVGAVDAGTRRAGLTAALDHAEDALAGPRLRRRAGSATERRLHAQYAVALPLAEAATALAWAGDAVPARAAEGPRRLAAAVRDSTHTGPLPAPARSAPALRALDDALLHAAEAFDRGAGGNLHTRRRTAASLVRTALDSGGREYGLRVALSFGAGVAVAQALNHARWYGLHTHWYWLPATAVFLVKPDLGPLASRVLCRAAGTVLGAVLFAGLAALLPRPEGLVALVVISGALIPVATRHFAAQTAVVTVLVLALVMVGGEPQASWNRIGETALACAIVLLVGHLPTPGQRGGGVRARLARAHDAAHAYLAHVLSGSGDRTGRWVLRREAYRALAEARAAIDLAAAELPALARHTEGTEEVAAVLERLVDTTTACAVHLDDAGRLPARHRERIAELLAELTDAHEHAGLDTPEAPRLPVAV

SEQ ID NO: 13776 - protein, 388 aa, Streptomyces avermitilis
MDPAEGLLADPYAVYDRLRDTAPVHRIAGTDGKPAWLVTRYDDVREGLANPLLSLDKKHALPGNYRGLALPPALDANLLNMDAPDHTRIRRLVGRAFTLRRVEQLREPVRETAHRLLDALGTHGSTDLIASYAAPLPITVICDLLGVPDEHRRDFRAWTDPLVTPDPARPDVARESVVSLLGFFTGLLADKRKNPADDLLSDLIAVQEEGDRLTEDELMSLAFLILFAGYENTVHLIGNAVLALLRHPEQLAALREDPARLPDAVGEFARYEGPALLAIRRFPVRDVTIGGVTVPAGETVLLSLSAANRDPSRFPDPDRLDLGRDAAGHLALGHGVHYCLGAPLARLETEVALAALLERFPDLALAETEPRRRPSLRARGLLALPVTY

SEQ ID NO: 13777 - protein, 57 aa, Streptomyces avermitilis
VNGRTVLERFPAGGPRGSWPAEEFAQACRLEGQAAEVVMDLSTDAFLVIVRGADRIE

SEQ ID NO: 13778 - protein, 151 aa, Streptomyces avermitilis
MGVRDTSASGSGAAQVLNLDTLVRLRRGQQGPASSGRLPIPEGMTLPLGCDAVAVPAHLGPLLMPRLPRVGCVYADSAYWWWIVPADSDVALEWPAPAHYATGAVVPVTPCVPALVHRPDGILPYTPPIPLYLALCRVMDTIPAWSRPISA

SEQ ID NO: 13779 - protein, 234 aa, Streptomyces avermitilis
VASVTPSAPLGTDAAEDRSGLRDAAGVRPHAAAERRFRFELAAHPGSVAQARRLTRARLTRWQVCEDTCDSAALVVSELVTNAIVHTASEHVVCELHDGDELVRIAVRDEGCAPGEPHPSPQRPEEEHGRGLLLIASLCRAWGALETGPGLLVWADLPRRAAPPAPRDLSRSGDRSRSTTAASYCLAADSDDASRSPAENTEARSDLGWSAKKTPAESRGTGAEASWGAEAGWV

SEQ ID NO: 13780 - protein, 286 aa, Streptomyces avermitilis
VSEPRSAPTVGQVVLGRRLLDLRERAGLKREEAARILRVAPATVRRMEMAEVSLKIPYLQLLLKAYGVGEEEAEAFVLLAEEANKPGWWQRFHDILPGWFSMHVSLEGAAALIRSYEPHFVPGLMQTEEYARVVLKSGAIGQTRPEDVDRYVALRMQRQELLTREDAPRIWAVMDETALRRPVGGPEVMRAQIDKLLEVTKLAHVTLQVIPFSSGPHPGTYGPFVLFRFAMPELPDMVYSEYLTGAVYLDARAEVATHLEVMDRMAAQAATAHRTKEILMDLRKEL

SEQ ID NO: 13781 - protein, 97 aa, Streptomyces avermitilis
MERAKPRIRNERPYSERISSERIYNGMPARELGSEGWHKPWSGGNGGNCLEAMKLADGRIAVRQSTDPDGPALIYTPDEMTAFIQGAKAGEADFLLS

SEQ ID NO: 13782 - protein, 271 aa, Streptomyces avermitilis
MTGQNPAPDEIVIDTGNPHPARMYDWFLGGKDNYPVDEEMGRQLLALDPRVPVMAKVNRAFMHRATRWLAMNGVRQFLDIGTGIPTEPNLHQIAQQVAPESRVVYCDNDPIVLAHAAALLRSTPEGVTEYVQADVRDPDTIVEQAGKVLDFSKPVALSLVALLHFVSDEDGAYELVDRLLAEVPSGSYLMLSHATADFTPKKSEEAGELYKARSLTLALRSRDEVARFFRDLELVEPGVEVPDKWRPELGEPVPGQDDEPIPGYAAVGRKP

SEQ ID NO: 13783 - protein, 470 aa, Streptomyces avermitilis
MAESWVNSAERIGADLHLELSAAGGRRASLIRALREAVRSGRLAPGTRLPPYRSLAADLGVARNTVADAYAELVAEGWLTARQGSGTRVADRAAPLGGAHARVPKKLPPRARGPRHDLRQGTPDASSFPRAAWLASYRRALQQAPNEVFGPGDPAGRIELRQALAAYLARARGVRTEPDRIVICSGFAHALRLLFPGVLKGPLAVESYGLGFHRELLAAASVRTVPLPLDEDGARVGGLGRERAVLLTPAHQFPTGGPLHPARRAAVVDWARARGGVILEDDYDGEFRYDRKPVGAVQGLDPERVIHIGSVSKSLSPALRLGWMVLPERYVDAVLAVKGEREAWVSVLDQLALADFVVSGSYDRHVRRMRQRYRGRRDRLVAALAERAPHIEVTGIAAGLHAVLRLPPGTERSAVKAATWQGVALDGLAEFRHPEATMAVTDGLVVGYATPAEHAYGAAVEALCGALPPG

SEQ ID NO: 13784 - protein, 171 aa, Streptomyces avermitilis
MVMTTNTTHTTHTTNTTDTVDTTGSRLNFAKAAPKVFRALIGFDAAAREGIDPALVELIQIRASHLNHCAYCLHMHTNDARKAGESEDRLHMVAVWREARHFFTPKEQAALALTEAVTLVADAGVPADVYAEAAAHFPEEELAHVLALILTINTWNRVALSTGKVAGTDER

SEQ ID NO: 13785 - protein, 496 aa, Streptomyces avermitilis
MADPKGFLTTPREEWPRRPVEERVRDWDEVYVPGALLPIISRQADRCMDCGVPFCHEACPLGNLIPEWNDLVSREDWRAASDRLHATNNFPEFTGRLCPAPCEAGCVLAINQPAVTIKNVEVAIADRAWADGFTPPCPPERLSGRTVAVVGSGPTGLAAAQQLTRAGHTVAVFERADRIGGLLRYGIPAFKMEKRHLNQRLEQMRDEGTKFRTSTAIGRDIGAEELRARYDAVVLAVGATAWRELDVPGRELAGIHQAMEYLPLADRVCEGDLEVSPLSAAGKHVIIVGGGDTGADCLGTAVREGAASVTQLDIYPLPEAERDEDIEPWPVYPKIYRMSPAHEEARDLKTAPAADADARLFAASTLRFAGDAAGHVRALHLVEVDARRRPLPGSGRTLPADLVLLALGFSGPDRDDGLVDQLGLALDPRGTITRDADFATNVPGVFAAGDAARGQSLIVWAIAEGRAVAAAVDRRLTGAASKLPAPIGPYDRPMRA

SEQ ID NO: 13786 - protein, 159 aa, Streptomyces avermitilis
MIDGPYFVLTVLGVLGTGLVAGVFCGFSTFVMKGLASLPPAQGVAAMNAINVAALTPAFMIVFVGSAVLCAVLAVVTFVLWPDAGTVELLVGSGLYLFGTFGVTAVANVPRNDALLKMDPGAPETATYWRSYVREWTIWNHIRAVASAGAAVSYVLALT

SEQ ID NO: 13787 - protein, 272 aa, Streptomyces avermitilis
VGGGSGPVAGMTVRSGCGHDGPAAGMTADETRGQRAGAGWGAEGWGDGGLRRSAPVLLVIQPITRRLCAECRSGPRSLLVWEEGAPRCLDCADLGHLVFLPRGHSALTRRSREESGLSAVVVRFNRRKSRYERQGVLVEEAALALAEERCLADAEARRRRRVRDARRRAAEDVRFTDAFAREIRRLYPRCPAERALAIAAHASLRGSGRVGRSAAGRALSGTAVASAVRASVRHKETPYDRLLMSGVPRHEARRRIAGVVEATLREWGGAPP

SEQ ID NO: 13788 - protein, 214 aa, Streptomyces avermitilis
MMGGVRLEAITWERLGDLLADRLLDLKPDDGSPWPRIAFDGAPAARPGDLAQRVSEALRIRGRPSLVVGAADFLRPASLRFEYGHRDIEAYYDGWLDTGALWREVFGPLEAGGSGRVLPDLWDPLTDRATRSPYAQLPPGGALLLHGPLLLRHWFPFDLTVHLLLSPGALRRRTPESEHWTLPAYERYEAEVDPVAAVDILVRADDPRHPAWRG

SEQ ID NO: 13789 - protein, 162 aa, Streptomyces avermitilis
VARLTERIWRGRPSLYPQDLLHACACSYSGPMTLSFDDSVRTLLDGKNFAGVATLGPDGAPQNSVVWIKREGDTVLFSSTAGRQKVRNLRRDPRISLSVFDLANPYTSVEIRGTAEILPDENKRLPYELSHKYLGIDPPAEKDDEVRVIIRVVPQKIVGFSA

SEQ ID NO: 13790 - protein, 157 aa, Streptomyces avermitilis
VCPAPRRPSGTGRYFMTTAGEIMHRGAQWIPAHETLDRAAQLMRELNVGALPISDENERLCGILTDRDIVVGCVAMGRDPARVTAGEMAQGTPRWIDASADVTEVLDEMQGHQIRRLPVIEDKRLVGMISEADLAQHLTDDQIAVWVESVYARSVTH

SEQ ID NO: 13791 - protein, 354 aa, Streptomyces avermitilis
VARLAQRRARVDLSHPARSPLGSAVVNCVMYQDGVRMPGGHDLVEAVERVRKKDDGFVWLGLHEPTDQEFAGIAELFDLHPLAVEDAVEAHQRPKLERYGETLFAVFKTVCYVEHTELTATSEVVNTGEIMVFIGPAFVITVRHGRHGSLGPLREELEATPQQLAKGPAAVLHAIADHVVDDYLSVTDAVQEDIDQVETDVFAASGARVDAGRIYQLKRELLELKRAVMPLSRPVQELATRPIRVIDQEIQAYFRDVSDHLLRVSEQIAAFDELLNSILQAHLAQVSVAQNEDMRKITAWASLIAVPTMVCGVYGMNFEFMPELHWRFGYPMVMAVIAVGCVTLYRGFKRNDWL

SEQ ID NO: 13792 - protein, 264 aa, Streptomyces avermitilis
MTRTDGYLLDNRQPEAGQSYDAVAAVFDPTTFRHIEGFGIGSGWRCWEVGASGTSVISWLAKKVGPTGKVVATDTDTSCAASAARHPVEVRTHDVGVEEPPGEGFDLVHARLVLVHVPDQERALRSMVKALRPGGRLLLEDADPALQPLLCPDEHGPEQQLANRLRDGFRLLLAERGVDLSYGRKLPRLLRAAGLRRVEADAHFPVTSPACATLEAATIRQIRDQLVSSGHATNADIDLHLANVAAGAMDLATAPMISAWGRKA

SEQ ID NO: 13793 - protein, 314 aa, Streptomyces avermitilis
MNAPGAGALLVVGDVVTDVVARHRGPLASGTDTAAAIRTVPGGAGANVACWAAHWGWADVRLLGRVGADGAAWHERELTASGVRPRLVVDPDVPTGTVICLVDTGASAERTFLTDSGASLRLAPGDWSNALLDGVVRLHLSGYLLFSEQSRALVAAALESARARGVPVSLDPASAGFLAELGVDRFLALIEGVDVLLPSRDEACLLTGLPDPADAAAKLSRHVPLVVAKQGAEGALVAEAGAVRARVPATPATPRDTTGAGDAFTGAFLAALLVGVEPAQAAAEGCRAGAAAVAGVGGRPPSGTRQNRGAVKLD

SEQ ID NO: 13794 - protein, 301 aa, Streptomyces avermitilis
VLVVSEEVREALAAHRPVVALESTIIAHGLPRPRNLQVALELEDVVRQEGAVPATIAVLDGHPRVGLDKEQLERVANEDGIRKLGHRDLPLAVAAGASGATTVSATALLAALAGVRVFATGGLGGVHREWTVTQDESADLGLLARTRITVVCAGVKSILDVPATLQRLETLGVAVAGYGTARFPGFYLSDSGYPVDWTLRSPRQVADVMRAQDALDGPESALIVAHPVPEDEQLDPELHARVLADALHACEAEGVTGQAVTPFLLDYLVRHTEGASLSANLAAVRGNVRLAGRIAAAWAGA

SEQ ID NO: 13795 - protein, 154 aa, Streptomyces avermitilis
LRAVGDGTSLRGMTDNSPRLDHVVLWVRDPVAAADFYEKTVGLEPLRVPGFAAGKDPFPSVRLNEETIFDLAPLSLVEHMNMLPGAADSAGHPVNHVCLSLQRDDFDALRARLEDRTVPVSDFSYDSFGARGKAKRSFYFRDPDGNVFEARHYE

SEQ ID NO: 13796 - protein, 120 aa, Streptomyces avermitilis
MTTNAQSTPSFAVHIPDAELEAEPLDPAQIVSGAPVVTGKVLWESADGKQVRGIWQITPGVVTDTEANELFVVVSGRATIEVEGGAVIEVGPGDAAVLREGDRTTWTVHETLRKAYHISL

SEQ ID NO: 13797 - protein, 184 aa, Streptomyces avermitilis
MKSVERSEQQVVWAVVGTDIGPLLLAATGDGLVNVVFHATDAVRDKALERLASRLGSEPVEDPGSPFLAEAIRQVTAYFAGERRDFELPLDWSLISGFNRQVLRELASGVPYGAVVGYGDLARRVGQPGAAQAVGMAMGSNPLPVVVPCHRVVESDGGIGGFGGGLEAKRKLLALEGVLPEPLF

SEQ ID NO: 13798 - protein, 290 aa, Streptomyces avermitilis
MHARVAAATTTALIGATVAILPTPHAGAAAGDGPVIVSHRGASAYAPENTLASIDKAAAMGFSWVENDVQRTRDGELVVIHDDTLARTTDVEQVYPNRAPWKVKDFTAEEISRLDAGSWFGSRYKGTRVPTLKQYMNRVSRNHQKLVLEIKNPELYPGIERQTLRLLGNEGWLKPGRLKRRLIVQSFSIGSLRTVHRLRPGIKTGYLGTPSIAALPAYAEFADQINASYTSISAGYVSALHSFDGPHGKPLEILTWTVNSGDTARRVTRYGVDGIITNTPDVVRRAVTAY

SEQ ID NO: 13799 - protein, 288 aa, Streptomyces avermitilis
MQGTVDGFSYGLVTPLVAYLMAFLGGALGLRCTTRSMLVARSWRAGWLALGSAAIGSGIWTMHFIAMMGFSVKETPIHYDQATTFASLGVAILMVGVGIFIVGYRGASGAALFTGGTITGLGVASMHYLGMAGMRLNGKLEYNTLTVSASVVIAVVAAIAALWAAGQVRGFMWSVGASLVMGLAVSGMHYTGMAALSVHLHGSAGAPAGDSPAALLAPLMIGPLVFLCLAGVVVLFDPMMVMGKPDWTPTENRPGVPAHPTVTHTGRRPASRPGERHGHRGPRTPQRW

SEQ ID NO: 13800 - protein, 713 aa, Streptomyces avermitilis
MRPVSKIERTVAPFEVVSPYQPSGDQPAAIAELDRRIRAGEKDVVLLGATGTGKSATTAWMIEKLQRPTLVMAPNKTLAAQLANEFRELLPNNAVEYFVSYYDYYQPEAYVPQSDTYIEKDSSINEEVERLRHSATNSLLTRRDVVVVASVSCIYGLGTPQEYVDRMVPLRVGDEVDRDDLLRRFVDIQYTRNDLAFTRGTFRVRGDTIEIFPVYEELAVRIEMFGDEIEALSTLHPLTGEIISDDQHLYVFPASHYVAGPERLERAANDIEKELGERLTELEKQGKLLEAQRLRMRTTYDLEMLRQIGSCSGVENYSMHFDGREPGSPPNTLLDYFPDDFLLVIDESHVTVPQIGAMYEGDASRKRTLVDHGFRLPSALDNRPLKWEEFQERIGQAVYLSATPGKYELSRGDGFVEQIIRPTGLIDPEVVVKPTEGQIDDLVHEIRKRTEKDERVLVTTLTKKMAEDLTDYFLELGIQVRYLHSDVDTLRRVELLRELRAGEYDVLVGINLLREGLDLPEVSLVAILDADKEGFLRSGTSLIQTIGRAARNVSGQVHMYADKITPAMEKAIDETNRRREKQVAYNKEKGIDPQPLRKKINDIVAQIAREDIDTEQLLGSGYRQAKDGKGAKAPVPSLGGKAAAKGAKSAKGKAKETVPTDRPAAKLAEEIEELTNRMRAAAADLQFEIAARLRDEVSEMKKELRQMKEAGLA

SEQ ID NO: 13801 - protein, 192 aa, Streptomyces avermitilis
VTVNMTKGQAISLQKNDGGTLTAVRMGLGWQAAPRRGLFGSRTREIDLDASAVLFADKQPVDVVFFRHLVSDDGSVRHTGDNLVGGVGQGGDDEAILVDLQRLPVHIDQIVFTVNSFTGQTFQEVQNAFCRLVDETNGEELARYTLAGGGQYTAQIMAKVHRAGAGWQMTALGTPSNGRTFQDLMPAILPHL

SEQ ID NO: 13802 - protein, 695 aa, Streptomyces avermitilis
MTAELVRGQNHPLPQARLEVRVSAGTPIVAGATLGDEQGKVRGVEWVAHPGAPTLPGLEVSKQAAADHRLAFDLDALPGTVHRVHVLLALPTGGGGPARFGAVAAPFVAVTGLDGAEIASYTITGLNAESAVVALELYRRQDAWKVRAVGQGYAGGLAELFADQGLPQAQQLAAGINEAVAQGLARSVAAPPRLPDGERTPPAASAPGSDQTHARPVSQGAAQVAADHVQPHQGTPGRPQPGSPYDGAGPQSGAAPQPDHAAGRSVPQEGHPGAPVRPDSAAARPATPGAGGPIDYSHPARQNVAPPPPPPPAAPGHSAQPVAGDATGWTMEERLYNQVWGMFEDLARATAAYRSAVDFADSRREQELDKALSDPRSRIGGQGDAVREAAQAKHAQLVDQARAALDRDLAQLMAESDVVEPALPPAYARWDNPVWHGYRVPMETPMAVRLGDLHLPESEGLRIPMLVRLPLERGLWIDSGRAGSRDGSLADADELRRLAMDTAVAHAARLLAVHPAGEFTVHVIDPAGSGASALAPLTQSGVLADPPAVGAAGVADMLARLIQRVDLVQMAVRGGAADSLPPDLDTAEQLLIVNDFPHGFDDRAVTQLRYLADEGPAVGVHLMMVADREDAAAYGPLLDPLWRSLLRLTPVPDEHLADPWVGHAWTYEPVTVPPGSQVLHQVLAHIAAARRAWNR

SEQ ID NO: 13803 - protein, 329 aa, Streptomyces avermitilis
VDVSLTLWVLTIVGLGALIAVDFFIGRKPHDVSIKEAGTWTIVWIVLAGLFGLGLLVFSGGQPAGEFFAGFITEKSLSVDNLFVFVLIMAKFAVPSQYQQRVLLIGVLIALVLRAIFIAAGAAIISSFAWVFYIFGAFLIYTAWKLIQEARADEPEEEFEENRLLKAAEKRFGVADRYHGTKLWIEQNGKRVMTPMLVVVLAIGTTDVLFALDSIPAIFGLTQDPYIVFTANAFALMGLRQLYFLIGGLLRKLVHLSYGLSVILGFIGIKLVLHALHESGVHVPEISVPASLGVICSVLVITTITSLIASRKQAAQKQTEGAPKDSIDV

SEQ ID NO: 13804 - protein, 366 aa, Streptomyces avermitilis
MIVRLRSLVMQWTAVVPVAAIVLLALTWGRDLPGAVVALVTLVLAGAVLAAVHHAEVVAHRVGEPFGSLVLAVAVTIIEVALIVTLMADGGGKSATLARDTVFAAVMITCNGIVGICLLVASLRHGLAVFNAEGTGAALATVATLATLSLVFPTFTTSKPGPEFSTTQLTFAALASLILYGLFVTTQTVRHRDYFLPITRHGEVIDAETHADAPTARTAGISLGLLGLALVGVVGLAKGVSPTIESGVEAAGMPQSVVGVIIALLVLLPETIAALRSARRDRVQTSLNLALGSAMASIGLTIPAVALASVWLSGPLVLGLGSTHMVLLLLTVVVSSLTVVPGRATPLQGGVHLVVFAAYLELAVNP

SEQ ID NO: 13805 - protein, 434 aa, Streptomyces avermitilis
MHDVRTVKAPSMLRLAAASLAGTAIEFYDFFVYGTAAALVLGPLFFPTFSPVAGTLAAFVTFGAGFVARPLGSVLFGHIGDRRGRRPVLVGSLLLTGAATVAVGCVPTYDRIGTAAPVLLLVLRFLQGLGLGGEWGGAVLLTAEHAPAGRRGLWSSFPQIGPSLGFVLANGGLLILSATLSEDQFAAWGWRVPFWAAGVLAAAGLWLRGSLVESPRFLEIDDHARVPFAEVVRGHWRLVLLTAGALAVGYAVFYAVTTWSLSYATEHLGVSRTVMLACIMAAVVVKGSLTPLAAHLSDRYGRRPLCLAGCAGAVLWMFPMVALLSTGEPVLMFLGILGALIAFITMFAVIAAYLPELYEPRVRCTGAAVGYNLGGVLGGALTPIVATALAQHEGRVPWGVGAYLTAIALLSLGCFALLPETRPVPRMTAVQATE

SEQ ID NO: 13806 - protein, 371 aa, Streptomyces avermitilis
LRTAARSRFITVRQTADRPYPPPMTAPSYPPKPVRGDRIAVISPSSGLPGLLPLPHELGLKRLREEFGLVPVEYPATRRMGSTPRERADDIHAAFADPTVKAVIASIGGEDQITVLPLLDRELIRANPKPFFGYSDNTNLHAFLWNTGIVSYHGGTVMVEFGRPGAMASISADSLRAALFTSGEYELKPAPRWGDVSRDWADPATFESEPETRPGYGWSWVNADRVVEGRSWGGCLEIVSWLLMADREISRDLAVYDGGVLFLETSEDMPSGEEVFIILRNMGERGLLRRFPALLMGRARTWSFERPNSPEEGARYAAEQRESVLRALKIYAPDTMAVFDVDLGHTDPQVVIPYGGVVRVDGPARRITVTY

SEQ ID NO: 13807 - protein, 159 aa, Streptomyces avermitilis
VPRTRTLANAPIMILNGPNLNLLGQRQPEIYGSDTLADVEALCAKAAAAHGGTVDFRQSNHEGELVDWIHEARLHHVGIVINPAAYSHTSVAILDALNTCDGLPVVEVHISNIHQREEFRHHSYVSLRADGVIAGCGVQGYAFAVERVAALAETGRADA

SEQ ID NO: 13808 - protein, 258 aa, Streptomyces avermitilis
MSTTSTDGSPVLRMESVRKTFGGSVVLRDVDLEVAPHTVTALIGASGSGKSTLLRCANLLEEIDDGAIWLDDEEITDPRADQDAVRRRIGVVFQAYNLFPHMTVLENITLAPRRVHGVGRAAAEEHARELLDRLGLGAKATEYPDRLSGGQQQRAAIVRALAVRPRLLLLDEITAALDPELVGEVLAVVRDLKDDGMTMVLATHEMGFAREVADQVCFLDGGVVLERGTAEQVFGDPQQERTRRFLHRIVEAGRLQEG

SEQ ID NO: 13809 - protein, 317 aa, Streptomyces avermitilis
VALRGRRRPGAQVTVTKEESGQEDADDRGDMSGGGDAYVPSPRRIERERYKRTRARRATAIAALSTLITGVVLYFVVVGAPGWPRTKETFFDAQYAREALPKVLEGLWLNVRLLLVCGAAVLVLGMLIAIARTLRGPVFFPLRALAAAYTDFFRGLPLIINLMIVVLGVPALRLQGVTVDPVLLGGTALTLTYSAYVAEVFRAGIESVHPSQRAAARSLGLTNRQALRHVVLPQAVRRQVPPLLNDLVSLQKDTGLVSIGGAVDAVRAADIIVGRSLNYTPYIVAGLLFVALTIPMTRFTDWVTARMDRQRAQGGTL

SEQ ID NO: 13810 - protein, 312 aa, Streptomyces avermitilis
MRTVAPVTSTNRTPHCHSPAMHLAQRALRRTASAATVALLAVAVGCAPQPEDKATASGTSAESCAKSTLQTKTSGKLTIATDEPAYEPWFKDDKPASGKGFESAVAYAVAKQLGYAKGNVVWQSVPFNKAFAPGEKTFDFDINQVSISTERKKAVDFSSGYYDVRQAVIALKSSKAAKAKSVADLKGLKLGAQVGTTSLDYINDVVKPTQEPAAYAKNDQAKSALKNGQVDAIVVDLPTAFYITAAEVTDAKIVGQFENQGGTPEQFGLVLDKGSALTSCVTSAVDALRKDGTLAKIEKQWLSEAVDAPVLK

SEQ ID NO: 13811 - protein, 218 aa, Streptomyces avermitilis
MTYSGAVKVGGPADVHELQDLMITKIAVGPMDNNAYLLRCRATDEQLLIDAANEAGTLLGMIGDDGIASVVTTHQHGDHWQALAEVVAVTRARTYAGRDDAEGIPVPTDVPVDDGDTIRVGRVELTARHLVGHTPGSIALVYDDPHGHPHVFTGDCLFPGGVGNTRKDPKAFASLIRDVETKIFDVLPDESWVYPGHGNDTTLGAERPHLPEWHARGW

SEQ ID NO: 13812 - protein, 261 aa, Streptomyces avermitilis
MPDATLDHIARAFDLRVRSATFTQTCGAAIVGPMNDHVRDLASVRDATERLLTAATKLDNARVTEPSRLPGWSRGHVLAHLARNADALTNVLAGRPMYASADVRDADIERDAPRPLDVQVTDVRESGARFQDEAAVPADWSRTVELRNGVTDSASRVPFRRWVEVELHHVDLGIGYELEDLPEGFTQREINFLAERFRGHPDVPALLVKQDDGRMISSGRREGEPLVVTGRQADLLGWLAGRRDGSALTVDGGPLPALPPL

SEQ ID NO: 13813 - protein, 1009 aa, Streptomyces avermitilis
VADRLIVRGAREHNLKNVSLDLPRDSLIVFTGLSGSGKSSLAFDTIFAEGQRRYVESLSSYARQFLGQMDKPDVDFIEGLSPAVSIDQKSTSRNPRSTVGTITEVYDYLRLLFARIGKPHCPECGRPISRQSPQAIVDKVLELPEGSRFQVLSPLVRERKGEFVDLFADLQTKGYSRARVDGQTIQLSDPPTLKKQEKHTIEVVIDRLTVKEGAKRRLTDSVETALGLAGGMVVLDFVDLPEDDPERERMYSEHLYCPYDDLSFEELEPRSFSFNSPFGACPDCSGIGTRMEVDAELIVPDEEKSLDEGAIHPWSHGHTKDYFGRLIGALADALGFRTDIPFAGLPQRAKKALLYGHKTQIEVRYRNRYGRERVYTTPFEGAVPFVKRRHSEAESDASRERFEGYMREVPCPTCQGTRLKPLVLAVTVMEKSIAEVAAMSISDCADFLGKLKLNARDKKIAERVLKEVNERLRFLVDVGLDYLSLNRAAGTLSGGEAQRIRLATQIGSGLVGVLYVLDEPSIGLHQRDNHRLIETLVRLRDMGNTLIVVEHDEDTIKVADWIVDIGPGAGEHGGKVVHSGSLKELLANAESQTGQYLSGKKSIPLPDIRRPRDPSRQLTVHGARENNLQDIDVSFPLGVLTAVTGVSGSGKSTLVNDILYTHLARELNGARSVPGRHTRVDGDDLVDKVVHVDQSPIGRTPRSNPATYTGVFDHVRKLFAETTEAKVRGYLPGRFSFNVKGGRCENCSGDGTIKIEMNFLPDVYVPCEVCHGARYNRETLEVHYKGKSIADVLNMPIEEAMHFFEAVPAIARHLNTLNDVGLGYVRLGQSATTLSGGEAQRVKLASELQRRSTGRTVYVLDEPTTGLHFEDISKLLVVLSGLVDKGNTVIVIEHNLDVIKTADWVVDMGPEGGAGGGLVVAEGTPEEVAGVPTSHTGKFLREILDADRISDAASVKAPRKTAARKTAAAKSTTKKTATVRTTNNTATKKAAAVTKKTAPAKKTTRARKA

SEQ ID NO: 13814 - protein, 303 aa, Streptomyces avermitilis
VIVVAGEALIDLVPQGAGALAGLKPALGGGPYNTAVALGRLGSPTAFCSRTSRDAFGEALLDGLRTAGVDVSAVQRGAEPTTLAVATIDEHGSAAYSFYVDGTADRQFAAPDRLPGATRAVSFGTCSLVLEPGASAYEELLRSAAAQGLFTTLDPNIRAGLIPDPDAYRARFKSWLASVTLLKLSEDDATWLGGSPREWLASGPSAVVLTRGGDGLTVFTRDGAEHSVPGEPVDVVDTIGAGDTVNAALLHGLAARDALSPEGLAGLDAEGWTELLRFAARAAAITCSRAGAEPPYASELGAF

SEQ ID NO: 13815 - protein, 349 aa, Streptomyces avermitilis
MATMADVARSAGVSVATVSHVLNDTRPVLPHTRQAVLDAVDELGYTPNTLARSLVTSRTRSIGLAVSAISNPYFTEILQGVEAGALEHGYSLLIADPHDDPKHEQRVVRLLHERRVDGMIVAPSADPGDLVAYLGRHDVPTVFLDRLVDVPSDGTARFDQVGAENAEPMARLVTHLADLGHRRIGLVAGLPGLSTTNERLSGYRHGLAAAGLPHDERLVARGDSEAAGAERATTALLSLAAPPTALVTANNAMTIGALRALRGRGLSVPDDLALCCFDDFAWADLFAPRLTVISQPSKEIGAQAVRLLLDRLAAPDRPSRTLRLPSTFVHRTSCGCPDHPHSSEKGPVS

SEQ ID NO: 13816 - protein, 141 aa, Streptomyces avermitilis
MPGRPAASRRTVLRGAALTPVAGLGLAACSSGADGGWPATPTAPVELGAESEIPKGAAKLYRDANVVVSRAGDGSLKAYSTICTHAGCAINKLAGTTLTCPCHGSEFDATNGKVLQAPATEPLHELSVEARNGKIVAGSGA

SEQ ID NO: 13817 - protein, 315 aa, Streptomyces avermitilis
MRHGTQHADLATDELETALRGGPFHVALRTAIAARGLPLQRVQHHLSRYGVKVGVTSLSYWQQGARRPQRPESLRAVRALEEILQLPDESLIRLLATADEQPGADRPGSRSYRSLVEASGVLERLFAELGSPLDGGLHTLGHHERVRIGAHRELLGRDSHHIVRAHKDGVDRYVAVHHGDPGCAPERMAVRALENCRTGRVRRHPETGVLVAELLFDTRLRSGDTFLFRYGFDDGTAGPSSEYVRGFGFPGGQYALQVRFDEAALPVRCHRFTQHSAAAPRSGRQELSLSGQHRSVHLVEPRVRSGIVGIGWDWE

SEQ ID NO: 13818 - protein, 681 aa, Streptomyces avermitilis
MADPSSYRPKPGEIPDSPGVYKFRDEHHRVIYVGKAKSLRQRLASYFQDLAGLHPRTRTMVTTAASVEWTVVSTEVEALQLEYSWIKEYDPRFNVKYRDDKSYPYLAVTMNEEFPRVQVMRGHKRKGVRYFGPYGHAWAIRDTVDLLLRVFPVRTCSAGVFKNAARTGRPCLLGYIGKCSAPCVERVSAEEHRELAEEFCDFMAGRTGTYIRRLERQMTDAAEEMEYEKAARLRDDIGALKKAMEKNAVVLADATDADLIAVAEDELEAAVQIFHVRGGRVRGQRGWVTDKVEAVTTADLVEHALQQLYGEETGDSVPKEVLVPALPDPVEPVQEWLTGRRGSIVSLRIPQRGDKKSLMETVQRNAQQSLALHKTKRASDLTTRSRALEEIAEALDLDSAPLRIECYDISHLQGDDVVASMVVFEDGLQRKSEYRRFQIKSFEGQDDVRSMHEVITRRFRRYLSEKERTGEWADGDLKDGELKDDEGRPKRFAYPPQLVVVDGGQPQVAAAKRALDELGIDDIAVCGLAKRLEEVWLPDDGDPVVLPRTSEGLYLLQRVRDEAHRFAITYQRTKRAKRFRASPLDDVAGLGETRKQALIKHFGSVKKLRSATIDQICEVPGIGRKTAETIAVAFAQAAPAVPAVNTATGEIMEDEEPGTTAGSSQEPVSAGTSDERRGQET

SEQ ID NO: 13819 - protein, 337 aa, Streptomyces avermitilis
MTEHEERQEERSAQGQEAHKESGEDQAPQQAAQENGAQVSTGIETAGVPDAVIPELVIISGMSGAGRSTAAKCLEDLGWFVVDNLPPALIPTMVELGARSQGNVARIAVVVDVRGRRFFDNLRESLADLESKNVTRRIVFLESSDEALVRRFESVRRPHPLQGDGRIVDGIDAERELLRELRGDADLVIDTSSLNVHELRAKMDAQFAGDEEPELRATVMSFGFKYGLPVDADLVVDMRFLPNPHWVPELRPFTGLNEEVSAYVFNQPGAKEFLDRYAELLRLIAAGYRREGKRYVTIAVGCTGGKHRSVATSEKLAARLAAEGVETVVVHRDMGRE

SEQ ID NO: 13820 - protein, 355 aa, Streptomyces avermitilis
MTGRALRLSRLRRMAPEERGGKAPEARGGKPRRRGAQPKVVALGGGMGLSASLAALRRITGDLTAVVTVADDGGSSGRLRDELGVLPPGDLRKALAALCGDDDWGQTWARVIQHRFQSQGDLHEHAVGNLLIVALWEQLGDHVQALDLVGKLLGAHGRVLPMSAVPLELQALVKGHDPDRPEDIDTVRGQATVALTPGEVQSVHVVPHDPPAVPEAVAAVLDADWVVLGPGSWFSSVIPHLLVPELLDALSQTKARRVLSLNLAPQPGETDGFSPQRHLEVLGRHAPKLALDVVLADEAAVPDRESLTDAAKRFGAAVELAPVARTDGSPRHDPELLAAAYDRIFRMHGRIGPWR

SEQ ID NO: 13821 - protein, 329 aa, Streptomyces avermitilis
MAMTAAVKDEISRLPVTRTCCRKAEVSAILRFAGGLHLVSGRIVIEAELDTAMAARRLKRDILEIFGHSSELIVMAPGGLRRGSRYVVRVVAGGDQLARQTGLVDGRGRPIRGLPPQVVSGATCDAEAAWRGAFLAHGSLTEPGRSSSLEVTCPGPEAALALVGAARRLSIAAKAREVRGVDRVVVRDGDAIGALLTRLGAHESVLAWEERRMRREVRATANRLANFDDANLRRSARAAVAAGARVQRALEILADEVPEHLAAAGRLRMEHKQASLEELGALADPPLTKDAVAGRIRRLLAMADKRAQDLGIPGTESNLTEEMADNLAG

SEQ ID NO: 13822 - protein, 984 aa, Streptomyces avermitilis
MRRRARSILAAGALLLGGAGMAPIAQADSGSSPKPDADAVKVFRAEVTKQQVPLLLAAGQDGHELGAQAPEKGTATVEVYLTDKQARKLEKQGVELTEHTLSAKAEARVEDAAQGVFRPYSGKGGLEEEIVRTGAAHPDLTKVVSIGKTLNGQDILALKLTKGAKKTKDGAKPSALYMSNQHAREWITPEMTRRLMHYYLDNYSKDKRIKKIVDSTELWFVLSANPDGYDYTFQNSDTRLWRKNLRDVNGDGTISTGDGVDLNRNFSYKWGYDDEGSSPNPTSQTYRGASPGSEPETKALDAFEKRIGFTYGINYHSAAELLLYGVDWQVATPSPDDIAYKSLAGTPDNSAVPGYRPQVSSELYTTNGEADGHASNVNGMAMFTPEMSTCQTASDIDPNDTWNAADCQSVFNFPDDEKLIKQEFEKNIPFALSVAETAAHPDKPSSTVGIDAPDFTPATFSTSYSRGADQEVSVVVRKSVRDKELKYRVNAGRTEDMALKAWKGGETYGGDDNLYFDEYRTKVQDGEPGDKVEVWFTGETRSGKKTSSAHFTYTVAERPKADTLVVAEEGATATQAQKYVDALKANGHKALVWDVATQGAPDALGVLDHFKTVVHYTGAARPGNPTQLQLRAFLNEGGKLIEAGELAGGSVDLGDGTLSNDFSQYYLGAYSRTSTPGANGFTGSGKLDGSTGALGDAPGNPLNAAGTYGVTSDELSVATYPQFASAGAGQFAGTVNPYGPHGGSSMAAAVHTDDAYKRLTRTIDLTGVGAADKPTLRTQLLWDTEPGYDHAVLEIHTTGADDWTTLPEAGGATGATVPADCEAGFLVAEHPWLKHYLTVAAGGCTATGTSGSWNSFTGASTGWQQVGFDLSAYAGKSVEVSLSYITDPSSGGHGVLADDASLVVGGTATQAEGFETSLGAWSVPGPPAGSPAVLKDWARSGALFKTYGAVTTRDTVLFGFGLEHVTAAADRTALIGKALTALGG

SEQ ID NO: 13823 - protein, 335 aa, Streptomyces avermitilis
VTIRVGINGFGRIGRNYFRALLEQGADIEIVAVNDLGDTATTAHLLKYDTILGRLKAEVTHTADTITVDGKTIKVFSERNPADIPWGELNVDIVIESTGIFTKKADAEKHIAGGAKKVLISAPASDEDITIVLGVNEDKYDPAKHNVISNASCTTNCVAPMAKVLDENFGIVKGLMTTIHAYTNDQRILDFPHKDLRRARAAAENIIPTTTGAAKATALVLPQLKGKMDGISMRVPVPTGSATDLVVEVSREVTKDEVNAAFKKAAEGELQGYLSYTEDPIVSSDIVGDPSSCTFDSAMTMVMEGTSVKILGWYDNEWGYSNRLVDLTVFVGNQL

SEQ ID NO: 13824 - protein, 403 aa, Streptomyces avermitilis
MKTIDELLAEGVDGKRVFVRADLNVPLADGLITDDGRIRAVLPTVKALAEAGAKVVVASHLGRPKGAPDPAFSLLPAAERLGELLGAPVAFAQDTVGPAAHDAVNGLQPGQVAVIENLRFNAGETSKDDAERGAFADRLAALADIYVGDGFGAVHRKHASVYDLPARLPHYAGYLIATEVNVLKKLTEDVKRPYVVALGGAKVSDKLAVIDQLLGKADRLLIGGGMAYTFLKAKGYEVGISLLQEDQIPTVKEYMERAEKNGVELVLPVDVLVSTEFPDLKTKAPANPTTVAADAIPADQEGLDIGPETRKLYASKLADAATVFWNGPMGVFEHPDYAEGTKAVAQALVDSQAFTVVGGGDSAAAVRILGFDETAFGHISTGGGASLEYLEGKTLPGLAALED

SEQ ID NO: 13825 - protein, 258 aa, Streptomyces avermitilis
VTSRMPLMAGNWKMNLNHLEAIAHVQKLAFALADKDYEACEVAVLPPYTDLRSVQTLVDGDKLKIKYGAQDVSAHDSGAYTGEISGSMLAKLKCTYVAVGHSERRQYHHETDEIVNAKVKASFRHGLIPILCVGEELEVREAGNHVTHTLTQVEGGLKDVPAEQAETIVIAYEPVWAIGTGKVCGADDAQEVCAAIRAKLAELYSQELADQVRIQYGGSVKSGNVAEIMAKPDIDGALVGGASLDADEFVKIARFRDQ

SEQ ID NO: 13826 - protein, 112 aa, Streptomyces avermitilis
LRGPRALKVSTHRAHRKSFGPRCRPSSSEEVGPAVVLGFSIALIVFSLLLMLLVLMHKGKGGGLSDMFGGGMQSSVGGSSVAERNLDRITVVIGLLWFASIVVLGILMKVNR

SEQ ID NO: 13827 - protein, 111 aa, Streptomyces avermitilis
VASGNAIRGSRVGAGPMGEAERGESAPRLRISFWCSNGHETQPSFASDAQVPDTWDCPRCGFPAGQDQDNPPDPPRTEPYKTHLAYVRERRSDADGEAILAEALAKLRGEI

SEQ ID NO: 13828 - protein, 456 aa, Streptomyces avermitilis
VPGRTCFARPRRSLRGRLSVVPVTVRRSGPGGGAVTTAEASGVAAPAWRGGFGRLWSAAVVSRFGDALRTAALPLIAVRLTDDPLVIASVTACGYVPWLLFGLLGGAVADRVDQRRAMWAVDTVRGALVASFALAVGLGHASIPLLFVLAFSLTTLQTLFDNASTALLPSLVDPEALGSANARLMTGQQLAGGLLASPFVPLLLAAGAAVPFAADAVTYLLAAALVAFLRIRAPERAPRPAGSTLRAEMADGLRALRRDRPLRAICAATLLCNIGMGALIATVVLHVTRWLHTGNAGYAAVMTAYSAGSLAGGFVAQRIANRVGRVRALLLCVGVQTSSLVLIGTVRQLAALIVGMALLGAMGMVWNVNQVTLMQQRSEPSMVGRIAAAFRTASTSGAPLGALLGGAVAQVYGLNGPALFAAVLFALAGTALIPALTPDVPVVEPDDGATTAHVTP

SEQ ID NO: 13829 - protein, 550 aa, Streptomyces avermitilis
MNADSRTRLNQRPEWTALAKHREELAGTHLRDLFAADPGRGAGYTLEVGDLHVDYSKHLVTDETLRLLRELAAATDVFGLRDAMFRGEKINVTEDRAVLHTALRAPRDAVVEVDGENVVPAVHAVLDKMSTFAERVRTGEWTGHTGKPIKNIVNVGIGGSDLGPAMAYEVLRSFTDRSLTVRFVSNVDGADLHEAVRDLDPAETLFVIASKTFTTIETITNATSARDWLLTELKAGQEAVAKHFVALSTNAEKVSEFGIDTANMFEFWDWVGGRYSFDSAIGLSLMIAIGPERFREMLDGFRIVDEHFESAPAEDNVPLLLGLLGIWYGNFHDAQSHAVLPYSHYLSKFTAYLQQLDMESNGKSVQRDGNPVEWETGPVVWGTPGTNGQHAYYQLIHQGTKLIPADFIGFAEPVADLLPGLVAQHDLLMANFFAQTQALAFGKTPDEVRAEGVPEQLVPHKTFKGNHPTTTILAKELTPSVLGQLIALYEHKVFVQGAVWNIDSFDQWGVELGKVLAKRVEPALTEGADVPGLDESTKALVAKYRQLRGR

SEQ ID NO: 13830 - protein, 768 aa, Streptomyces avermitilis
VRATLRWAQADLRTHRGEALFIVLATAGIVASLLLAAALFGYATNPWQRVFTQSHGAHVWIHTGPSADAARLAELDGVAAVSGPYPTAATTVESRGTRATVELRGTVEPPGSGRPLLTAGRWLDPAEPDGVVLESSLARSLWAEPGDILTLPGTVRTLTVLGVADSAEPRYRPGEQPGLVWSLPSTVRRADGRGGQVIGLRLDDPEDTDYAVQRAVTVLGSGAVSEVSDWRQARAAAQGDNRLLGQVLGLFGLGALVAAALAVHGAIGTRIRGHLRDISVLKAIGFTPGQVVRIFLLQHLAFALLGAVVAAALTQALGRLIPGRLGDAVGVWQGLPGHTAALFAVPVAAVLFIGATTGLAAWRAGRVPPVPVLRAAAPLGGRLSGVARGALGLRVLGLRLPPALVLGWHKAFTRRPRSLATVSRLALPLLLIVVALSAWTTIDRFHSRPEQIGLAAALTVRADESLSDPDARTLLAQNPRVAAVHPGVEVAALVPGQTGTIALRGLGTRRDPYPFSLAEGRPARGPDEAVAGQGLLDLLDVRIGDWVRMTVGAQPQILHIVGRSIEPENGGRVISTSLDTLRENDPGLRPTLYQLQLRPHADPHRVAAELTASAHGRFDVHPVTNPADGLSPLRGVVVGLIAVLALIGLIELLTAIGGTIREGERDLLALKAIGLSPRQITAVTVTATGCTALAAVLVGSTLGMPLAHWLIDVQGRSSGIGAGVAQGPSPVLLLLFGTAAVLGAAALAALPAARSGRRRLADTLSAVA

SEQ ID NO: 13831 - protein, 248 aa, Streptomyces avermitilis
VSHTAPLVRAEGLVKTHFGEGAPAYAVRGVDLAVRQGEFVAVTGPSGAGKSTLLHLLGGLQRPDSGSLWLDGECTDAYGEARWAVERRRRIGIVFQFFNLVSNLSVADNVELPALLAGVSPKRARAEREQLLAELGLEGKERSMPGELSGGEQQRVALARALVNHPPLLLADEPAGSLDSKGTREVMRLLTRFHQRGQTIVLVTHDARLASAADRVISFFDGRIADDAELDGTPSRGAGISGVLELRD

SEQ ID NO: 13832 - protein, 171 aa, Streptomyces avermitilis
VRLPLLALLARGPAHGYELKQDLEQMLGAAYPQPNVGQIYVTLGRLEKSGLIEGEEVEQSSRPNKKIYHLTDAGREALRAWYEETADEPRVRDEFFMKLALAPTTGLADRIALINKQRRQYLNTMRSLSKLAAAENRDNRIAQLLVEGAMLHLQADLDWLERCQEELEELE

SEQ ID NO: 13833 - protein, 442 aa, Streptomyces avermitilis
MASDSGRRCPAPVYREEPMRWIHAAGRGLLVAAVILTGYVASGTQSDGPREGGRGPLTLATAGDLTNYLGPLLDGWNRTHPGERVTLVELPDSADETHAQMTTDLRGGDRSRFDVLNIDVAWTSEFAAAGWIAPLERSRFPLGSFLPPVVDTATYDGRLYAVPYVTNAGLLLYRKDVLAKEGVPPPRTWAELERQARDIAPKYGLDGYAGQFLPYEGLTVNAAEAVYSAGGTILGDEGERVTVNSAAAREGIGFLARGVRDGWIPKTALAYKEEESKQAFQDGHLLFLRNWPYAYVGASGKGSAVAGKIGAVPLPGPDGPGASVLGGSNLAVNAHARHPGSAARLIAYLTSEPVQRQVLTRGALPPVRAALYRDPALIRKFPYLPTLRASVLAAAPRPKSPRYDQVSLAVQAVVRDAMTGHETPTTAVRRLARELADISHRG

SEQ ID NO: 13834 - protein, 568 aa, Streptomyces avermitilis
LTPLRHAYLTCMHNRWHEQTGRRVSLNTHHWWRDAVIYQVYVRSFLDSTGDGIGDLAGVRAGLPYLKKLGVDGIWLSPFYPSPQHDHGYDVADYCDVDPLFGDLAEFDLLMTDARRLGIKVLLDIVPNHCSSEHPWFSQALDSAPGSAARARFHIADGRGPDGAEPPNNWHAMFGGPAWSRITEPDGTPGQWYLHMFTPEQPDLNWRNPEVGAHFDHALRFWLDRGVDGFRIDVAAGLFKHPDLPDSPDPEADARTRDSVNPLAWNQPEVHDVWRHWRTVCEEYTARDGRERLLVGEVSVPTAREHAQYVRHDELHQAFFFDLLSAPWNDDAFRKVISEAMQDIAGTGSTVTWVLNNHDQVRTVTRYGELGTEGSGLGAARARAAALLMLALPGAAYIYQGEELGLPEVVDLPDDVLTDPIFHRTGSRARIRDGCRVPLPWSGHASPFGFTPGVESAKPWLPQPAYFAEYATDRALADTRSFWHLYRDGLHLRAGLPQLGEGTLRWLDTPPGVLGFVRGDGLVCAVNFGTAPTPAPVSGTPLLSSGPCAPGVLPGSTAAWWISDSTNP

SEQ ID NO: 13835 - protein, 440 aa, Streptomyces avermitilis
MRRRTTLLASCTALALALGATACGGGPVAAGGGGKSLSGQTITVAGVWSGSEQKNFQKVLDAFTEKTGASARFTSTGDNVSTVVGSKIEGGNAPDVVMVPQVGVLQQFAKKGWLKPLSRTAQQSVDANYASVWKKYGSVDGTLYGLYFKAAHKSTVWYSPDALDQAGVKPPKTYDAMLKAGHTVSDSGLAAFSVAGQDGWTLTDWFENIYLSQAGPEKYDALAAHKIKWTDPSVVEALTTLGRLFKDKQLIAGGQKGALNTDFPGSVEKVFGPEAQAGMVYEGDFVAGVAKDQFDKKIGQDADFFPFPAVDGGKAPVVSGGDAAVVLKDGKNQKAATRFLEYLATPEASAVWAGAGGFLSPNKKVDLASYGDDVTRETAKSLIAAGDSVRFDMSDQAPAAFGGTKGTGEWKLLQDFLRDPSDPKATAAELERAAAKAYQD

SEQ ID NO: 13836 - protein, 452 aa, Streptomyces avermitilis
MTATLVKETSPPAAPRADGRRRARRRGRIIALVFVFPALLLLGALVVYPVLFTVGRSFFDASGTRFVGGDNYAEMFRDPATLKAIRNTTIWVVVAPTLLTGLGLVLAVLVEKIRWATAFKLLLFMPMAVSFLAAGIIFRLAYDEDPDKGVLNAAVVGVHDAFAGTSSYPTARARDGQGLTRAGDGSYGTADGVSPGRTVSLGLVGVRPDDLPKDARPAYTAAGRTSAPDELRGVVYLDFTPGGGGRQGKADKAESGLPGMRVEAVRDGKTAARATTAADGSFRFGDLGSGSYTLRLPASNFAPPYEGVSWLGPALVTPAVIGAYLWIWTGFAMVLIGAGLAALPRDALEAARMDGAGEWQIFRRITVPLLGPVLTVVFVTLVINVMKVFDLVYIIAPGPVQEDATVLATQMWLVSFGGGNNQGLGSALGVLLLLLVIPAMVFNVRRFRGSQR

SEQ ID NO: 13837 - protein, 279 aa, Streptomyces avermitilis
MNALRRGLGNSLIQAFLVLVGLIWLTPLAGLFLSSLRSAQDQARGGWWTALTSPAQLSFDNYSALLGNAGMTQAFWNTVLISVPATTLVVVIAALAGYAFAWLEFPGREALFLLVVALLVVPVQIGLLPVAKLFGQLGLFGTIPGVVLFHVSYGLPFAIFLLRNYFAEMPREMLEAARMDGGSEWRIFTRLVLPVGRPAIASLAIFQFLWVWNDMLVALLFADSSAQPLTVELQSQIRQFGSNIDVLAPGAFLSLVVPVVVFFAFQRHFVQGVMAGSVK

SEQ ID NO: 13838 - protein, 260 aa, Streptomyces avermitilis
VSTPQLVVHRDKELMAQAAAARLITKIVDAQASRGYASVVLTGGRNGNGLLAALAAEPARDAIDWGRLDLWWGDERFLPEGDPERNDTQAREALLNAVPLDPKRVHAMPASDGPHGSDADAAAAAYAEELARAAGPENHGAVPTFDVLMLGVGPDTHVASLFPEHPAVRETERTVVGVHGAPKPPPTRITLTLPAIRAAREVWLLAAGEDKAEAAAIALSGAGELQAPAAGAHGRSRTLWLLDAAAASQLPRSLYPPALA

SEQ ID NO: 13839 - protein, 373 aa, Streptomyces avermitilis
MKIDLTDTTASKINKGLVQARRAIGTPAVGMVLTLVIVTDEENAYDALKAANDASRAHPSRTLVVVKRVSRSPRDRTKSRLDAEVRVGADAGTGETVVLRLYGEVANHAQSVVLPLLLPDAPVVVWWSVDAPRDPASDPLGALGQRRVTDSYAAEKPVDELRARAESYEPGDTDLAWARITPWRSMLAAALDQINCEVISAEVAGEEFNPSVELLAMWLADRLHVHVRRVISAGPGLTQVRMETTGGPITLHRSDGTMATLALPGQPDRAVALKRRETSGLLAEELRRLDPDDTYASALRFGVDRLGGTHSASRRSEAPAQATTPLPVRPVQESAEPSRTAASAPAPASPAGDSEVGRPSPAQMPPVKKADPQ

SEQ ID NO: 13840 - protein, 507 aa, Streptomyces avermitilis
LSSSNPLRDPADRRLPRIAGPSGLVIFGVTGDLSRKKLMPAVYDLANRGLLPPGFSLVGFARRDWEHEDFAQVVHDAVKEHARTEFREEVWQQLIQGMRFVQGTFDDDDAFERLRDTIGELDKAQGTGGNFAFYLSVPPSAFPVVIQQLKKHGLADQSDGSWRRAVIEKPFGHDLKSAEELNAIVHEVFGSDQVFRIDHYLGKETVQNILALRFANTMFEPIWNRSFVDHVQITMAEDIGIGGRAGYYDGIGAARDVIQNHLLQLMALTAMEEPASFDADALAAEKTKVLGAAKLPKDLSKNTVRGQYAAGWQGGEKVVGYLQEDGIDPKSKTDTYAAVKLEVDNRRWAGVPFYLRTGKRLGRRVTEIAVVFQRAPHSPFDHTATEELGQNAIVIRVQPDEGITVRFGSKVPGTSMEIRDVSMDFAYGESFTESSPEAYERLILDVLLGDSNLFPRTEEVELSWKILDPIEEHWDKHGKPAQYPAGTWGPVEADEMLERDGRSWRRP

SEQ ID NO: 13841 - protein, 372 aa, Streptomyces avermitilis
MTDALKRLSKEGVAIWLDDLSRKRITSGNLAELIDQQHVVGVTTNPSIFQKAISQGDGYDQQVSDLAARRVTVEEAIRMITTADVRDAADILRPVFDATDGQDGRVSIEVDPRLAHNTKATVAEAKQLAWLVDRPNTLIKIPATKAGIPAITEVIGLGISVNVTLIFSLERYRMVMDAYLAGLEKAKERGLDLSKIHSVASFFVSRVDTEIDKRIDALGTPEAKAARGKAGLANARLAYEAYEAVFSTDRWLALDKAQANKQRPLWASTGVKDPAYKDTMYVEELVAPNTVNTMPEATLEATADHGEIRGNTIAGTYEQARADLDAVEKLGIAYDDVVQLLEEEGVDKFEASWNDLLKSTEAELQRLAPSEG

SEQ ID NO: 13842 - protein, 695 aa, Streptomyces avermitilis
VSTKPTTTDLEWTELDQRAVDTARVLAADAVQKVGNGHPGTAMSLAPAAYTLFQKVMRHDPADPDWVGRDRFVLSAGHSSLTLYTELYLAGFGLELDDLKSFRTWGSRTPGHPEYGHTPGVETTTGPLGQGVANAVGMAMASRYERGLFDPDAAPGTSPFDHFIYAIAGDGCLQEGISHEASSLAGHQKLGNLVLLWDDNHISIEGDTETAVSEDTVKRYEAYGWHVQRVAPKPDGDLDPHALYDAIQAAKAVTDKPSFIAMRSIIAWPAPHAQNTEAAHGSALGEDEVAATKRVLGFDPEKSFEVAEEVLAHTREALDRGREAKAEWEKGFAAWRTAQPERAAEYERIAATELPAGWEEKLPVFEVGKGIATRAASGKVLQALGAVIPELWGGSADLAGSNNTTIDKNSSFLPADNPLPEADPYGRTIHFGIREHSMAAEMNGIALHGNTRIYGGTFLVFSDYMRNAVRLSALMHLPVTYVWTHDSIGLGEDGPTHQPVEHLASLRAIPGLNVVRPADANETAIAWREILKRYTKVFGKGAPHGLALTRQGVPTYEPNEDAAKGGYVLFEAEGGAPEVILIGTGSEVHVAVEAREQLQAAGVPTRVVSMPSVEWFEEQDQGYRDSVLPPSVRARVAVEAGIGLTWHRFVGDAGRIVSLEHFGASADGKVLFREFGFTPENVADAARESIAAAQR

SEQ ID NO: 13843 - protein, 285 aa, Streptomyces avermitilis
VALTKPRIIELLLITTVPVMFLAEQGVPSLRLVLLTCLGGYLSAGGANALNMYIDRDIDALMERTSQRPLVTGMVSPRECLAFGITLAVVSTLLFGLTVNWLSAWLSLGALLFYVVVYTMILKRRTSQNIVWGGIAGCLPVLIGWSSVTDSMSWAPVILFLVMFFWTPPHYWPLSMKVKDDYARVGVPMLPVVASNKVVARQIVIYSWVMVGVSLLLTPLGYTGWFYTLVALLAGGFWLWEAHGLQNRAKAEVTGGKLKEMRLFHWSITYVSILFVAVAVDPFLR

SEQ ID NO: 13844 - protein, 118 aa, Streptomyces avermitilis
MADTQQVDEGTDAKQAARAERKAAKLAKEINAFAKTHGGAEAHVAYIGQAGTRIVLVGEDDAWGDLVAPTYAVAEQAVEKAGVTVHEAFDGEFAAKVKTGPYEWTRMAGIQVGGPSNG

SEQ ID NO: 13845 - protein, 368 aa, Streptomyces avermitilis
MIETPSLVDQYCHGVLRTELGLGTFEAHLARTEGPPAPGTTLFDTQTGFAVRRWCPPLLGLEPHCPPARYLARRRELGVLESGRRLLRGSGITTYLVDTGLPGDLTGPGEMASAGAADAHEIVRLELLAEQVADTSGTVESFLANLAESVHGTAADAVAFTSVAGVRHGLALAPEPPGPGEVRGAAGRWLAGRRVGGPLSDPVLLRHLLWIAVASGRPLQLHSGLGEPGLRIDRTDPVLLTDFVRATAGLGTDLVLLHGYPYHRHAAHLAGVFPHVYADLGAALVRTGAGAAAVLSEILELAPFGKILFSSGAHGLPELHVVGAHLFRAALARVLGAWVAEGAWSLADAQRVAGLIAAGNARRVYGVE

SEQ ID NO: 13846 - protein, 256 aa, Streptomyces avermitilis
VRMTDDATARLLDRFLADLRALAPVAVWAHGSLAGGDYQEGRSDLDLIAVLEGPVPLGTVREVARLHRRLRADEALAEKLHCSYLTPDTVAGAERSHLTWAHDRLMKRPVTPVTRRELHAFGLVLHGEPPKDLLPPTPDRELDAFVVRDQKEFWRPAVRKARLWKQSVWVDLGMVTFARATVTLREGRLISKKEALAALPGLGAPADVVEDIGRRRYADPAPPTEEWTARRAELTRAYLGPAIDGLVATYEPLTRA

SEQ ID NO: 13847 - protein, 351 aa, Streptomyces avermitilis
VAERTLVKPCTSVPPTMVRVPNVTRADALAAARNPLALIAERWTPAPRTVRRAALAALVMAVVIVVTGGAVRLTGSGLGCPTWPKCTDDSLTTTSAMGFHGVIEFGNRMLTYVLCAAVGWAIIAARSQKPWRRSLTRLGWAQFWIVMSNAILGGIVVLVGLNPYTVAAHFLLSTALIAVATLMWQRACEGDGAPRPLVGKAVQQLVWFLVTASVLLIAVGTVVTGAGPHAGDSSDVERMPLDWETVSKLHAVLAWIVVTLTFALWFVLKAVDAPKGPLHRTRDLFLILLAQGVIGYVQYFTDLPEALVALHMLGSCLVWIGVLRVLLSLRERPEAVADLPGPSTESALTRA

SEQ ID NO: 13848 - protein, 256 aa, Streptomyces avermitilis
VTIAGTYTPKPGAAPLPRMIAAQAALETKMLLRNGEQLLLTVVIPTLLLVLFSSVDIVDTGKGRSVDFLAPGILALAVMSTAFTGQAIATGFERRYGVLKRLAASPLPRWGLMAAKTASVLVTELLQVILLTAIAFSLGWSPHGNPLAVLLLLILGTAAFSGLGLLMAGTLKAEATLAAANLVFLLLLVGGGVIVPLDKFPDAAQDVLGLLPISALSDGLRDVLQHGAGMPWGDLGILAVWGVVGLAAAGKFFRWE

SEQ ID NO: 13849 - protein, 310 aa, Streptomyces avermitilis
LALMQSDPVVQVQALVKRYGDKTAVNSLDLVAGAGVTAVLGPNGAGKTTTVETCEGYRRPDSGTVRVLGLDPVREASALRPRIGVMLQSGGVYSGARADEMLRHVAKLHARPLDVDALIERLGLGSCGRTAYRRLSGGQQQRLALAMAVVGRPELVFLDEPTAGLDPQARRATWDLVRDLRADGVSVVLTTHHMDEAEQLADDVAIIDGGRVVAQGSPEELCRGGAENTLRFMGRPGLDVGSLLKALPADCTAAELTPGAYRVGGKVDPQLLATVTSWCAQHGVMPEKISVERHTLEDVFLELTGKELRS

SEQ ID NO: 13850 - protein, 63 aa, Streptomyces avermitilis
MSAPPPTGPLVTRNTVATQLDGHAPDCRLGERSPSAGLAKLGARVLLLGAGYDTCASFHLAGP

SEQ ID NO: 13851 - protein, 249 aa, Streptomyces avermitilis
VKNVGEARETPTGAPQEELATGERSTRNRVVRSILDHGPSTVAELAGRLGLTQAAVRRHLDALVTDDIVQPREQRVYGARTRGRPAKVFALTDCGRDAFDQSYDKLAADALRWIAEREGGEEAVAAFARARIAAQAAAYRAAVEAAAPEERTEALAKALSADGYAATARSAPVGEQLCQHHCPVAHVAEQFPQLCEAETEIFSQLLGTHVQRLATIAHGDGVCTTFIPKISKTDHGHNASASTAGRNPA

SEQ ID NO: 13852 - protein, 474 aa, Streptomyces avermitilis
MTLPIEETAHPELEGLGTYEYGWADSDVAGASAKRGINEDVVRDISAKKNEPEWMTKLRLKGLRLFEKKPMPNWGSDLSGIDFDNIKYFVRSTEKQAESWEDLPEDIKNTYDKLGIPEAEKQRLVAGVAAQYESEVVYHQIREDLEEQGVIFLDTDTALKEHPELFKEYFGTVIPVGDNKFASLNTAVWSGGSFIYVPKGVHVEIPLQAYFRINTENMGQFERTLIIVDEDAYVHYVEGCTAPIYKSDSLHSAVVEIIVKKGARCRYTTIQNWSNNVYNLVTKRAVAYEGATMEWIDGNIGSKVTMKYPAVYLMGEHAKGETLSIAFAGEGQHQDAGSKMVHMAPNTSSNIVSKSVARGGGRTSYRGLVEIGEGAAGSKSNVLCDALLVDTISRSDTYPYVDVREDDVSMGHEATVSKVSDDQLFYLMSRGMTEFEAMAMIVRGFVEPIAKELPMEYALELNRLIELQMEGAVG

SEQ ID NO: 13853 - protein, 393 aa, Streptomyces avermitilis
MAEAQNIPVGSTTAGQIAVAAESTVATRMSAPPSFDVADFPVPHGREEEWRFTPLERLRGLHDGTAVATGDGVKVDVSAPEGVTVETVGRDDARIGRAGTPVDRVAAQAYSAFEKAGVVTVPKETVLTEPIRIAVHGEGGVAYGHQVIELGAFAEAVVVIDHTGDAVLAANVDYILGDGAKLTVVSVQDWDDKAVHVGQHNALIGRDATFKSFVVTFGGDLVRLHPRVAYAGTGGEAELFGLYFTDAGQHQEHRLLVDHNTPHCKSNVAYKGALQGDGAHAVWIGDVLIEAKAEGTDTYEMNRNLVLTDGARVDSVPNLEIETGEIVGAGHASATGRFDDEQLFYLMARGIPADEARRLVVRGFFAELVQQIGVADIQERLLVRIDEELEASV

SEQ ID NO: 13854 - protein, 106 aa, Streptomyces avermitilis
MTTFVRACGLSELEEDTPKRVELDGTPVSVVKTEGEVFAINDICSHANVSLSEGEVEDCQIECWLHGSAFDLRTGKPSGLPATRPVPVYPVKIEGDDVLVSLTQES

SEQ ID NO: 13855 - protein, 260 aa, Streptomyces avermitilis
MATLEIHDLHVTVEADNATKEILKGVDLTVKQGETHAIMGPNGSGKSTLAYSLAGHPKYTITGGTVTLDGEDVLEMSVDERARAGLFLAMQYPVEVPGVSVSNFLRTSATAIRGEAPKLRTWVKEVKEAMERLNMDPAFAERNVNEGFSGGEKKRHEILQLELLKPKIAILDETDSGLDVDALRIVSEGVNRVRETGEVGTLLITHYTRILRYIKPDFVHVFSGGRIVESGGAELADKLENEGYEAYAKHEVDTKGGVSA

SEQ ID NO: 13856 - protein, 418 aa, Streptomyces avermitilis
VTQLPGLLDTEAIRKDFPILDRQVHDGKKLVYLDNAATSQKPRQVLDALSGYYERYNANVHRGVHVLAEEATALYEGARDKVAAFINAPSRDEVIFTKNASESLNLVANMLGWADEPYRVDHETEIVITEMEHHSNIVPWQLLAQRTGAKLKWFGLTDDGRLDLSNIDEIITEKTKIVSFVLVSNILGTVNPVEAIVRRAQEVGALVCIDASQAAPHMPMDVQALQADFVAFTGHKMCGPTGIGVLWGRQELLEDLPPFLGGGEMIETVSMHSSTYAPAPHKFEAGTPPIAQAVGLGAAIDYLDSIGMDKILAHEHALTEYAVKRLMEVPDLRIIGPTTAEDRGAAISFTLGDIHPHDVGQVLDEQGIAVRVGHHCARPVCLRYGIPATTRASFYLYSTPTEIDALVDGLEHVRNFFG

SEQ ID NO: 13857 - protein, 155 aa, Streptomyces avermitilis
VKLDSMYQEVILDHYKHPHGRGLRDGDAEVHHVNPTCGDEITLRVKYDGETISDISYEGQGCSISQASASVLNELLVGKELAEAQKVQETFLELMQSKGRIEPDDAMEEVLEDAVAFAGVSKYPARVKCALLSWMAWKDATAQALGEADAERKTA

SEQ ID NO: 13858 - protein, 110 aa, Streptomyces avermitilis
MSETIETKPASEEEVREALYDVVDPELGIDVVNLGLIYGIHVDDANIATIDMTLTSAACPLTDVIEDQAKSATDGIVNELRINWVWMPPWGPDKITDDGRDQLRALGFNV

SEQ ID NO: 13859 - protein, 316 aa, Streptomyces avermitilis
MPERQSEPTPDESAPRPWSPFASSPASEPSHPGHLPLPTEEPPTPWQPGGTPDTSRVPGTRRLWLAGALALATVVACVTALTTTDHAADTSAAKEADTKLDSADPGLLTFASPSAGPSTYPGAKSGRSSERAAQTTPDGSASADPARHGSASKPAAERSKPASSTGTSSGSKPSAVWKSVRSVNYPDRYWHLGGDTGRLDPVSSGSSATTRQDATFKLVKGLADASCYSFATADGTYLRHSRFRLRADRNDGTALFKKDATFCPRTSSYSGAVMLESVNYPGRYLRHKDFLLRLDPYENTGQYRADSAFQLVKGWD

SEQ ID NO: 13860 - protein, 55 aa, Streptomyces avermitilis
VEPVLDGLSLADGHEAQSRQRVFVGADGDFDLAPACTRVRPSPPLVTGHPLRTLA

SEQ ID NO: 13861 - protein, 87 aa, Streptomyces avermitilis
MKYSDGFSRLWPSLLTALGYLVAFALLAQTLKTVSVGTAYAIWAGAGTAAIAAIGMVFLGEGMNPAKLAGIALIICGVVVLNMGGAH

SEQ ID NO: 13862 - protein, 446 aa, Streptomyces avermitilis
MAVVAATSAVMAPASRTYPMRTSVHSDAYGRTHHGPPSCAAHVLPPCAAPRTSVRRTPARRSPGTGYRSRSQWGRGVLGLPEHRSAEAMSNTAGWGPSGPYGGSPGGWGWAPPPPPPKPGVIPLAPLGVESILGGAFATMRRYAAPLFGLAALAYAVLGALVAGAAVIAYAAVRDRLEALIDHHRDVHWADVQPLVFAFLAVWVFAMLALMVASALVQASCVATVHDAVLGRRATFRSVWRRAWPRTPSVIGVALLQGLVAVVPMLLVAAVFVSLTLLALSSWSALPAGIAFLLLLGAAPVAVWLYTLFSFAPAAAVLEAAAPVTALRRSARLVRGAWWRVFGITLLASLMAAAMSYMVRLPLMFFTPTMQPYDTSSGQPESARAVFEQMLPDLGVSLAISAAGTLLVQLFAAVFVPLITSLLYIDQRIRREGLADTLLRAASAQQ

SEQ ID NO: 13863 - protein, 178 aa, Streptomyces avermitilis
MPRRYDPDRRQRIIDAAIRVVGDKGIAGLSHRSVAAEADVPLGSTTYHFKTLDDLMVAALRQANEGFAKVVAARGHLEDPRADLAGDIAALIGDWLAGDRTGVELEYELYLAALRRPALRPVAAECIDGFAEAVARRTDPVTARALVALVDGICLQVLLTGAPYDEAYARELLARLIP

SEQ ID NO: 13864 - protein, 197 aa, Streptomyces avermitilis
VSGPPPSTARVDDDAEVVAQSLEQPELFARLYDRYAPDIHRYAARRLGDGAADDITADTFLTAFRIRSRYDLTRTNARPWLYGIAGNLIGKQRRAEVRALKALARTGHDPVAASWVEDTESRIAAQGPLAGALAALPAGDRHVLLLVAWADLTYQEVAQALDIPVGTVRSRLNRARRKVRTALGADPAFVSDAAEVA

SEQ ID NO: 13865 - protein, 330 aa, Streptomyces avermitilis
MDEMTRVRELRADAPTPDRGRLAPGRMRLVEAARTGERRRAVWARREFVIAGVVAAVTAVAVTASVLADGGDQGRKASPAVSPNLNLKGLSARELLERAATVLETQPPVTVPKAKQWIYTKSMSEGQDPKLLKEMGEEAFVQESWIRYDGSASAHQLPGRHSELQITKMHLENGGEGDDRSPREMYRFLSTLPTDGEGALKTLREKNAIADGKESQAAADRTEIFVLLSADVMPPKGLAGLYRALATLPGGKVTDHLVKNAAGRRVIALHYGGDGIGSDGQDWLLDPQTFQVVGQRLYAPKGGADGGKGEVAGGNSLITKAVVDKAGRRG

SEQ ID NO: 13866 - protein, 329 aa, Streptomyces avermitilis
MTDTTAPRTTGAAAAGLATLAADGTVLDTWFPAPELTAEPGPAGTERLSAERAVELLGEGAAKALGPDARRGVEVVAVRTVIASLDEKPIDAHDVYLRLHLLSHRLVQPHGQSLDGMFGFLANVAWTSLGPVAVDDVEKVRLNARAEGLHLQVTSIDKFPRMTDYVAPKGVRIADADRVRLGAHLAEGTTVMHEGFVNFNAGTLGTSMVEGRISAGVVVGDGSDIGGGASTMGTLSGGGNVRITIGERCLVGAEAGVGIALGDECVVEAGLYVTAGTRVTMPDGQIVKARELSGASNILFRRNSVTGAVEARPNNAVWGGLNEILHSHN

SEQ ID NO: 13867 - protein, 206 aa, Streptomyces avermitilis
VHASQGAQGPGTESAGEEKVTMDAAGQESFREFVANRSSALLKTAVLLSGGDRHAAEDLLQNALIKAADRWSRIDEPEAYVRQVLYRQQVSRWRLKWRRRELSVAEPPEASTGPDAASAAELRLVMRGALARLTARQRTVLVLRYFEDLPEADVARILGCSVGTVRSTTHRSLARLRTLAPELAALGPADAEQEPSRDYSPVEVRP

SEQ ID NO: 13868 - protein, 193 aa, Streptomyces avermitilis
VHRPAAMPLTRRNSPRPRPLLAYVGEVSRPLLYLDVDGPLNPYAAQPERRPDGYTTIRVALTPGRPLRVWLHPDHGRALLALDYELCWATTWMDAANRWIGPVIGLPDLPYVDFGTGLFSQRPDGVHWKTEALVAHAGERPFAWVDDEHSPADEAYVAAHHPGPALLRHVSPRLGLREPDFTVLAEFAATIRR

SEQ ID NO: 13869 - protein, 406 aa, Streptomyces avermitilis
VNVDELVRDAFREQAADHMPAPPYFAERVLAVRRRRRTRRLASVAVATAAAVAVGVAVPLLGGGGDDVRPASEINQSDIIGHPDQSPPKGMIAAGDTVLAAFYVYKNVKQPNGDSVTTRVYGLLDQNTGTYRKTKWAFLDVAPGTRTAAVLEGELPAKRIGLLDMITGKVDRWIPMDRGVGGVSFSPDGKKLVATTYSKNPDRNFADHKQNVNGKEVPGPVQSRTGFAVVDVASGKSDWHKASDKPDEMGWFGNSREDFDWSHDGTLVYANRAMKPYREYYGLDGAEAKWPADEKYLTYVEAGLSPDGKLAAGDFAGDGKEIAAAIDDPKTGKRVAKVPGQQLLAWADNKRLIAWGCDPKKCSGKGEFRNQLLLVTIGTDKVVPLSDFRKASDDYPGRWTPLFSSR

SEQ ID NO: 13870 - protein, 315 aa, Streptomyces avermitilis
VELHGRAAETDRMTTQGTAQGTAPFGRALCAMITPFTAAGTLDLDGARRLADRLVSEGCDGLVLSGTTGESPTTTDAEKSALVRAVREAVGDRASIVAGVGTADTRHTVELALEAEKAGADGLLVVTPYYSRPPQEAVEAHFRDIADASGLPLVLYDIPGRTGTRIEPATMIRLAEHPRIVAVKDCAYDLLGTQKVLARTELAYYTGCDEYVLALYASGGAGYVSTVANVAPGHFRSILDAFDAGDPALAARLQQRAVPLIESMMAAGLPGTVTSKALLGRLGLPSGPVRAPLRPAGRETADGLLALYEELVSVS

SEQ ID NO: 13871 - protein, 286 aa, Streptomyces avermitilis
VPNGTSWVTMAGTVTNSGRRHEVGQGSRDRGRPGAAGRARRGDGTPSRRSRRGVGGIRSRRGPGRAMRLRLPEERPTEPPTGYKIAHPVLSQDGTRVGFTGVSLGGALPYGVLDEARCVYGLRHRAPHRRCDCGFHCVHDRTEAEALLCTAEHRAAVLLEVSVLGAYIRFERGFRYARQRVRTATLGPCGCGAVAAALADAGWGRPGWRALTAACAGCVRGRTSLSPAAFARLAGEGLRVRAGSGVAEQPAGLGVSELVAEAALLQARLDWFQTQLAQLDERGSQG

SEQ ID NO: 13872 - protein, 136 aa, Streptomyces avermitilis
MDTRPPVSGEHHSVGELVGQAAEQLSLLVRQEVSLAKEELAEKGRRAGRGGGLLGAAGAVAYVGVMALAATGVAALSLTLPVWAAALIVTAVLFAVASVLAAVGRGQLRRAAPPTPEQTLDSVRADVDEIKERAHR

SEQ ID NO: 13873 - protein, 248 aa, Streptomyces avermitilis
MTDDSTGAETAKATGAETTPGAGAAGVAGEKAANAKKAGAGAAQTGTSAGAAKVPGAAAAGEKAVGRKKAAAGDAGAAAAEKAADTVSGAGAARAGAGPGAGDGADAARAAGAEGPQELRRQIAETRSQLGDTVEELAAKADVKGRARARAADLRDRAGALTVQLRSTAAHAGHIAQDRAVRAGHTVQGTAGRAGGAVRDTVPGPVKTAATAVVQAGLRHRRPVLIAGAGAGALVAAGLLRRRQGGRH

SEQ ID NO: 13874 - protein, 608 aa, Streptomyces avermitilis
LPSKSSARLAALTVAAVCSTVSAVVLTSPAQADSVHIHDIQGTTRLSPLAGQKVTDVAGIVTGVRTYGSSKGFWIQDPAPDADPATSEGVLVFTSSAPKVAVGDSVTVSGTVSEYVPGGAASGNQSLTEITKPTVTVLSGGNTVPAPAVVDAGSVPSRYTAAGDTAAGGSINGLTLEPAKYALDYYESLEGMNVQVADARVVTATDPYSELWVTVKPREHANRRGGTVYGSYESQNTGRLQIQSLGSTADFPTANVGDELKGTTAGPLDFNQYGGYTLVANQLGTLEKGGLARETTRKQSRGELAVATYNVENLDPSDATFADHAAAIVNNLQSPDIVSLEEIQDNNGATDDGTVAADQTVRKLIDAIVAAGGPAYEWRSIDPVNDKDGGEPGGNIRQVFLFNPDRVSFTDRAGGDSTTAVGVTKVRGKAQLTVSPGRIDPSDAAWNSSRKPLAGEFVFRGRTVFVIANHFASKGGDQGLAAQYQPPARSSETQRHLQATAVNAFVKDVLDTQKNADVIALGDMNDFEFSDTAKILEGDGELWSAIKSLPKSERYTYDYQGNSQVLDQILVSPSIRRGCDVDYDSVHLNSEFSDQVSDHDPQVLRFRP

SEQ ID NO: 13875 - protein, 481 aa, Streptomyces avermitilis
MSDSSSLPPVRLHSEAELARDALATPLFSRAARLARWAGPDTRVGVGGELEEEQLPGAAEALGLAGDDAAALASEAWRVAVDTGLVVIVDEEEGTVAAAPDLALLTSGSPHDVLGLWLGALETVLADASVPDLDDLGDAMDEDGTIDFSELDWDLEAEAEFLDGVLGNLYLLTVGEEGPGDHPVPLPALAASMIVPDDMGEPTNDVLEQVSDAMMRLDDQFRLLEPIGLVEFRPVDEALMADAEDGEDAADEPAAPVDDTDVSRYGMVRLTPLGLYGLRARLLEAGISAPAVGDLVDKGADALLDGTSTFPPMAAQAETEQWLARREPLTAARELLAAARGGDTGAPLRRLRCQQALSLVGTEAEPALREVLDDAELGGLARVWLAERGAADVPAPPESMVFWLTIDTVAAQLAAEGNSTELQALVEGLAQQHSGFFATAWRVDHPATPDVLEAMGRLHPDKKVAKAARKAAFKARSQQGG

SEQ ID NO: 13876 - protein, 489 aa, Streptomyces avermitilis
MSLTRRDFARRSALTGAGVALAGSVGALATAPNALASTDTESAGEESADRHGSVGYGPLIPDPKGILALPAGFSYRVITYSGKTKLESGEFTPSNHDGTATFDGPRGATLLVNNHELKGPRANWKYPVPLTEGLVYDPAAAGGCTVVEVRRDKVAEWVGIAGTSTNCAGGSTPWGTWLTGEETEDRAGQNGMTKDHGYIFEVDPEDRRRNRDPKPVKALGRYAHEAVVVDPKRGRLYLTEDASTPNGLLYRWTPPQGFEHGHGRLRTLADDAGALQAFKCFDSGGRFVDDLSRATRIGTVYGVDWVDVPDRDAKTVSVRKQFAAGEVTRARKLEGMWWGDGGVYIVSSYAREESPVQHDGQVWFYDPKRRTLTLKVLLGVNRDPSADGAFDGPDNITVSPYGGLVIAEDGEGVQHLFGATDSGRTYPIARNDLALTPAAAAAGGTEAEPSYSEFTGVTFSPDGRTLFANIQDPGIMLAITGPWKRQKRG

SEQ ID NO: 13877 - protein, 527 aa, Streptomyces avermitilis
MARFNKKTAKAQPTSRVTSTGQVLRTHQGGRGQERDVRSELFLLALANFVSQQTFYETGAARDDRFAALVRELAVADPSWTAALLGWLRGEGNLRTASLVGAAEYVKARLDAGVTDGPSNREVVASVLRRPDEPGELLGYWTSQYGRAVPKPVKRGIADAVRRLYHAKSLLKYDTASKGYRFGDVLNLVHAAPDPDKPWQGDLFQYALDRRHHPDTAVVPKTLPVLVAHRDLMELRPAKRRKVVTGAHGAQRLADAGMTWEALAGWLQGPMDKAAWEAVIPSMGAMALVRNLRNFDEAGVSDEVAAQVAAKISDPAEVARSRQFPFRYLAAYQHAPSLRWSYPLEQALAHSLGNVPALPGRTLVLVDRSGSMFYSRLSDRSELNRADAAAIFGTALALRAADADLVEFGTSSNAVKFRKGESVLKVLDRFGDLGGTNTSEAVRRHYRKHDRVLIVTDEQAAYSHHGDPTEQVPADVPVYTWNLAGHRAGHGPSGTANRHTFGGLSDAAFRMVPLLEGARDADWPWAA

SEQ ID NO: 13878 - protein, 484 aa, Streptomyces avermitilis
MSTPSTPPASTTGPPRADPHPARLGAVLFVIVTAYLMVGVDSTVVNVALPDIQRDLRFSPTGLSWVLNAYTLAFGGLLLLGGRIGDIAGRRRTLTCGVLLFALSSLLGGLAGESGWLLAARALQGIGAALTAPSTLALITTNFPDGPRRHHALGVYTSMASIGASIGLILGGMLTSWASWRWALLINVPIGIGVALALPRFVAETPRHAGRFDAAGALTGTAGTTSLVYAFIRVSERGWSDTRALLGFTTAAALLAGFARVESRAGQPIMPLRLFRDRNRAGGYAGVLLLPAGMFGAFYFLTLFTQQVLGYGPLRAGFAFLPMTLALFATVRFVPRLLQRHGAKPLLLIGTTLLVAAAGWLWRLEPGDGYVTGLLGPLILMGMGVGMSFMPLNATILAGIEPRDAGAASGLLQTLQWLGGTLGLSVLVTVYGTATRHATGSPSAILTEGASRAFGVGSLVAVTALLVVAVVITGRRPKDQHGAR

SEQ ID NO: 13879 - protein, 201 aa, Streptomyces avermitilis
MAQVKPMRADARRNYERLIEEAAVAFAEHGEGASLDDIAKRAGVGSGTLYRHFPNRQALLEAVYVDAIEAIAMRADEIAARLPPGEALVEWLNELSERMIQVRGLKTLLGSAVTDGSSAVLTACGSSVKGAATRLVEAAQREGTVRPDVEPIEILRLAHGVATASELANGEGKHIRRYLSLLTEGLRPERRRADGGPGPEN

SEQ ID NO: 13880 - protein, 402 aa, Streptomyces avermitilis
MTAMTPGSNIPLPVTRVTVDVAAPVRLDVSGLLLTADGKVRSDDDFIFYNQPTGPGVTYRSGGGTSPDAITVDTTAVPPGIEKIVVTASPDAAGQTFQGIEPTATLRNADDNSVLATFTPPQLGTETALVVVEIYQRNGAWKARAVGQGYANGLAGIATDFGVTVEEPAAAPAPAVQPPVTAPAPPLDPRVSAPPVPAAPPAPPAPAPGAGKINLDKGRVSLQKNQTVSLVKGGRPLLTQVKMGLGWEPAYRGKDIDLDASVIAYGPQRNHIDSCYFGKLSIVNGAIKHSGDNLTGEGGGDDEVIVVDLGRLPQEVTGLVFTVNSFSGQKFTEVAKAYCRLVDAATDEELVRFDLTSAEPQTGVMMAKLIKQFSGEWEMTALGDFVKSRTVRGMVKPSAQAL

SEQ ID NO: 13881 - protein, 329 aa, Streptomyces avermitilis
MKAAVIESVGKAVVAEVPDPTPGPREVVVEVAACGLCGTDLHILQGEFAPKLPIVPGHEFAGEVVGLGTQVTEVSVGDRVAVDPSLYCYECRYCRTGHNNLCERWAAIGVTTAGGAARYAVAPVANCVKLPEHVRTQDAALIEPLSCAVRGYDVLRSRLGAHVLVYGSGTMGLMMLELAKRTGAASVDVVDVNPARLTTARQLGVSGSAANADELDRPQGWDVVVDATGNAAAIQDGLGRVAKAGTFLQFGVADYATRVTIDPYRIYNQEITITGSMAVLHSFERAAELFAGGVLDPDVFISDRIPLARYPQALEQFASGVGRKIVVVP

SEQ ID NO: 13882 - protein, 289 aa, Streptomyces avermitilis
MSATAPRVRPVRPVRTRLTRGAGLGLVAWLLGLLFFLPIAWMALTSFHSESDAATNPPSFGAALTLDGYRDFFGTGGGASPWPALVNSLVASLVSTLCVLLLAFPAAYALSIRPVKKWTDVLFFFLSTKMLPVVAGLLPIYLFAKNTGMLDNIWLLVILYTSMNLPIAVWMMQSFLAEVPVAVIEAAQIDGAKLPTILARVVAPIALPGIAATALICFIFSWNELLFARVLTGVVAETAPVFLTGFITSQGLFLAKVCAASLVISLPVLAAGFAAQDKLVQGLSLGAVK

SEQ ID NO: 13883 - protein, 312 aa, Streptomyces avermitilis
MTATTTAPVAAAPVRTTRQPSTRLRAWATRAPLLPALIFMIAVTQLPFVATLVISFFDWNALYPKARHFTGVDNYHQVLADPDLRHSVWTTILLTVTVVLACLVLGLGLALLLDRRFRGRGVVRTLLIAPFLVVPVAAALLWKHVLYNPEYGLLNGLLHYVGGPQPDWISNTPLLAVEASLVWQWTPFMMLILLAGLQSRDQQQIEAARVDGASDWQIFRHLTLPHLRRYLELGALLGSIYIVQNFDAVFTITSGGLGTANLPYTVYQSFYQAHENGLASAAGVLVVIGSIIIATFALRVVSSLFREEVSRA

SEQ ID NO: 13884 - protein, 456 aa, Streptomyces avermitilis
MRTQSRRRPRATLAMAAAGTLLAPLLSGCWVGAGGSGSGGDSINVLMVNNPQMVELQKLTATNFTKKTGIRVNFTVLPENDVRDKISQDFANQAGQYDVATLSNYEIPIYARNGWLHSMDGYVRGDTAFDQQDILKPMRQSLTGDDGRLYGQPFYGESSFLMYRKDVFAEKGLKMPAHPTWEQVNKLATDVDGAQSGMKGICLRGLPGWGEVMAPLTTVVNTFGGTWFDKNWKARLDSPEFEKATRFYVDLVRAHGESGAAQSGFAECLNNMTQGKVAMWYDATSAAGSLESAKSPVKGKIGYVPAPVEKTRSSGWLYTWAWGMQKASRNPDKAWKFVSWASSKEYEQLVGDTVGWSDVPAGKRASTYTNPDYRKEAGAFQEMTREAIEGARPTDPGVQPRPAPGIQFVGIPEFTDLGTKVSQEISAAIAGRQSVDSALKKSQKLAEQISKEYEGR

SEQ ID NO: 13885 - protein, 262 aa, Streptomyces avermitilis
VAAMAAKTTRTAEERQREIVRAARVTGSVDVTALAAELGVAKETVRRDLRALEDHGLLRRTHGGAYPVESAGFETTLAFRATSHVPEKRRIAAAAAELLGDAETVFVDEGFTPQLIAEALPRDRPLTVVTASLATAGALAEAENTSVLLLGGRVRPGTLATVDHWTTKMLAGFVIDLAYIGANGISREHGLTTPDPAVSEVKAQAIRASRRTVFAGVHTKFGAVSFCRFAEVGDLEAIVTSTLLPTSEAHRYSLRGPQVIRV

SEQ ID NO: 13886 - protein, 269 aa, Streptomyces avermitilis
MPAPRTVLLTGAAGGLGTLMRGLLPRYGYELRLLDLLPIEGEPDAITADLGDKEALREAVRGVDAVIHLAGISLESSFDKILKANIEGTYNLYEAAREEGVRRIVFASSNHAIGFTPRPRGDDPLIPVDTPRRPDTFYGLSKSFGEDLAQFYWDKHGLETVSVRIGSCFAEPTSVRMLSVWMSPEDGARLFHAALTAEDVRHTVVHGSSANTRLWWDLSTARALGYQPQDDSEPYAEKLIAEQGELDPDNPAHDHLGGHFTTDPPVWPY

SEQ ID NO: 13887 - protein, 313 aa, Streptomyces avermitilis
VTSAPLAARLSIPSGPLFFPVTAYRPDGALNLDVYREHVRRGVEAGAAAVFACCGTGEFHALAPEEFERCVGAAVEETAGRVPVVAGAGYGTALAVRFARLAQDAGADGLLAMPPYLVVAGQEGLLRHYRELAAATSLETIVYQRDNAVFTPEAVVELARTDGIIGFKDGLGDLDLMQRVVSAVRTEVPGDFLYFNGLPTAELTGLAYRGIGITLYSSAVFCFAPEIALAFHKALNSGDDATVNRLLDGFYRPFVDLRAQGRGYAVSLVKAGVRLRGLDVGEVRPPLHEPTEDHVKQLAQLVDRGYALLQEGM

SEQ ID NO: 13888 - protein, 410 aa, Streptomyces avermitilis
VKASAFVYPWDVNGDPAAAERIAGLGVPQVTLASAYHSTRALTPRHPRHRIVTAEHAAVLYPPGKRWKGRTLRPYAAGDWALGDAYGEAAEALAGAGLDVHTWVVLAHNSRLGEEFPCTNVVNAYGDRYPWAPCIAQPTTRAYLVDLAAEAAVRPGARGTELESLGWYGLAHLHAHDKIGGTGLGDAGQYLMSLCFCSACRQGYAGRELDAGALAVAVRAALEPVWRGAPSDGGWTTVEKLLGSELATATRAWREETARTLQEAAVTAVRAAAPDGFQVLLHADPVAYHCGANAGVDPAHILSVADGVVVPCTGGAALLTPFAEQGTGAVLAANLTVVSGMGGSPGTLAEDADRAARLGATELRLYHAGLASDADLATVQEALARLGRAPARSGTDAVASRARPSSTNSV

SEQ ID NO: 13889 - protein, 400 aa, Streptomyces avermitilis
MTWTMTRVLRDRNAGLYLAGVVVSGFGSSAMWLASGIWVKDLTGSNGLAALCVFALWAPTLVGPVLGTLADRTRRRPLLIGTNLGVAALLLALFTVDSPGSLWLLFAVLLVYGAAGVVHDAAESALVAAAVDSSLLGDFNGLRMTANEGMKLVAPLAGAGLYAAYGGAMVALLDAVTFVLAAGLYALLRVREDGPEPPPDGLRARVAEGVRHLWGRGELRPLVLAGGATMLFAGVNGALIYAVVDGLGRSPAYVGLLYVVQGAGSVTTGLAAGPLLRRLGERRFASSGIALTAAALALRAVPSDAAALTSAAAVGAGLPCVLIAAFTAVQRETPGALLGRVTATAHTLMFAPNAVGLAVGAGLVGLVDRQTLLVLLGLALLATASVPLRAGARPSRASAS

SEQ ID NO: 13890 - protein, 196 aa, Streptomyces avermitilis
MTDHTTLDLGPQARIVARLAEAVREEQLTAVTPCPGYAVHHMLGHLLGLTVAFRDAGRKDLGATTDTSPEAAVPDIGPGWREELPKVLDELAETWRDPAAWTGETRAGGVTLPGAVAGAVVADELVIHGWDLARATGQEYTPDQGALRAAYGFLVAAAEDPSRGGGIFGPVVPVPRDAPLLDRAIGLSGRDPGWKP

SEQ ID NO: 13891 - protein, 250 aa, Streptomyces avermitilis
MPLALTVLGTASPHPAPGRPSSGYLLRGGGAEVWVDAGFGTFAELQRHTDPARLTAIWISHLHADHSADLLAAVYGLAYGGLTPPAPIPLYAPRACGQRLAGFFGRPNERFLSGVFDFRPLYDGHTVRHWNLRLTARAVAHDIEAYGLRAECQGRVLAYSGDSGPCGTLTELARGADVFLCEADIDRHREGEQVHLTPEDAGAAAREARVGELLVTHVGPTLTPEAAAGRAAAVFGRPAVTAREGTTTIV

SEQ ID NO: 13892 - protein, 218 aa, Streptomyces avermitilis
MTSVPTPIPSRTQYVLEGIKHRILTGQLTPGQALVETELAAQFGVSKTPVREALKTLAGTGLVVMNQYKGVTVRMVDADMAREVYDVRLLLEPEALRRAVRRGASLAAARDALTRSDRAADTAERSLANREFHRALYVCCGNPLLGRMLDEVRDQAALVSAVAWAADPSWEREADEHREILRLALDGDADGAASALHAHIASFVQRAFPEAQGEDGQE

SEQ ID NO: 13893 - protein, 302 aa, Streptomyces avermitilis
MTATYEAQRTALAEVVAIPVTPFAEDGSVDRDTHRALLRRLLDGGVKTLTPNGNTGEFYALTPEERQLVTELTIEETGDRGAVLVGVGHDVPTAVASARHARAHGAQMVMIHQPVHPYVSDAGWVDYHRAVAEAVPELGVVPYLRNPLLPGARLAELADHCPNVVGVKYAVPDAARFAAFARDAGLERFVWVAGLAEPYAPSYFSAGATGFTSGLVNVAPSVSLNMIEALRSGDYQAAMKVWEQIRRFEELRAAGGSANNVSVVKEALASLGLCRRDVRAPSKPLPEDERAEVAAIAAGWSL

SEQ ID NO: 13894 - protein, 579 aa, Streptomyces avermitilis
VVPVKRPEEFRSHQWYGSGVSSGLRSFSHRARTRQLGYLPEEHLGKPVIAILNTWSDINPCHVHLRDRAQAVKRGVWQAGGFPLEFPVSTLSETFQKPTPMLYRNLLAMETEELLRSYPVDGAVLMGGCDKSTPALLMGAASVDLPAVFVPAGPMLPGHWRNEVLGSGTDMWKYWDDKRAGLIGDCEMSELESGLARSPGHCMTMGTASTLTAAAEALGVTVPGASSIPAVDSGHDRMAAAAGLRIVELVRGDRKLSDILTEEAFADAVTTVLGLGGSTNAVIHLIAMAGRAGVSLTLDDFDRIARTVPVLANVRPGGGPYLMEDFHFAGGLPGFLSRITDLLHLDRPTVSYDTLREQLASAQVHDDDVIRTRANPVADEGGVAVLRGNLCPDGAVIKHIAAEPRLLKHTGPAVVFDDYRTMQRTINDPGLGITADSVLVLRGAGPKGGPGMPEYGMLPIPDHLLKQGVRDMVRISDARMSGTSYGTCVLHVAPESYVGGPLALVRTGDTITLDVEARSLRLHVDDAELERRGARWTPPPERYERGYGALYNEQITQADTGCDFAFLARPGKVQDPYAG

SEQ ID NO: 13895 - protein, 314 aa, Streptomyces avermitilis
MAQAAAVAKQPAPPRRRRGSATPRTLPYLPYLLIAPAGLLMLGFIAYPVLSVFYYSLRNFNPTKPWRNGYAGFDNFVQIFTKDTQFWDTLTFSAKWVVVEVGLQLLFGLALALIVNQTFVGRALGRALVFSPWAVSGVLTSAIWVLLYNSQTGITRYLADMGVGEYGTSWLSDTSTVFPAAVIADLWRGVPFFAILILADLQSVSKDLYEAAEVDGAGRLRQFFHITLPHLKDAIVLSTLLRAVWEFNNVDLLYTLTGGGPAGETTTLPLYIANTSVDAHNFGYASALTTVAFTILLFFSIVYLRLSKFGGGDK

SEQ ID NO: 13896 - protein, 300 aa, Streptomyces avermitilis
VITKDAEISAPVVPAPEPAAPQQWPRKTRRAWDEAPRWQIYLPLGSYLLFTLIPFYWILLFALRPAGSTSLVPWPMTFEHFEKVWTERSFGTYFQNSVLIGVATLVMTTVIALAGGYALARFDFRVKRGFLLALLCSQFVPGALLLVPLFQIFAKLQMINSLGSVVIAETVFQLPLSMILISGFIRNVPYSLEEAAWVDGCNRFTAFRIVVLPLLRPGLIAVGSFAFVHAWNHFLFALMFLSNQDKQTIPVGLNTLMSADSVDLGALAAGGIIAAVPVVVVFAFIQKWLITGFSAGAVKG

SEQ ID NO: 13897 - protein, 394 aa, Streptomyces avermitilis
MTASVTASVTAPETAPVPIVLAGARGHGRWHLDNIRRLQDRGLVRLAGICELTPLAEEELDGLGVPEQSADFGSLLDATGAAIAVICTPIPTHTDLALTAAERGVHLLLEKPPAPSFAEFRRMADGVAAAGVVCQIGFQSLGSGAVPGIRKLIAEGALGTVAGIGAAGAWARDEAYYRRAPWAGKRRLNGVDVIDGVLTNPLAHAVATALALDGSTRAEDVTDIETELLRANDIESDDTSCVRVTTKSGGRITVAATLCAEEPDEPYVLVHGDRGRITFWYKQDRVLVQRSGHGPQEIEYDRTDLLENLVGHLTHGAELLVTPESTGAFMKVVEAIRQAPDPVALPGDAWELIPGENRRVVRGVDGLVAAAADTLALYSELGASWALPNEVSSR

SEQ ID NO: 13898 - protein, 288 aa, Streptomyces avermitilis
MTPLTNRTNSGDCPVLRIAGRPVGRYITRPELPGRMSPRPYLHPVTTLAGTAVTERGPADHTHHLGVGVAVPDVEGFNFWGGRTFVRDQGPTELDNHGAQRHAGFQLRDPDGFVEELRWVAAGNELLRERRTVAATALTDSAWALDFTFSLTNITPGPLSIGSPATNGRPGAAYGGFFWRARKEAGAPRVFTAAAEGEEEIHGTRADWLALAGATWTLVFAGATERTRRDPWFVRAAEYPGVGSSLAHEERLPVAAGETVVRRIVTVVADGSLGRGEAAALARTAVSP

SEQ ID NO: 13899 - protein, 436 aa, Streptomyces avermitilis
VILTSDLGDGTYRTPVLNADWSDPDLLRVGDDFYLTASSFGRAPGLPLPHSRDLVNWRLVGHALPRLEPAHEFRTPRHDCGVWAPSLRHHYGWLWISAPAGGVQTGWQGAFRSPGFFGPYEERIVLEQGDTDVDGPHQGGWVRTPAGEDWFAHFQARGAYGRVVHLQLMRRGSDGWPVIGNEGVPVAVHRKPDLPRQPPSAPATDDDFPGGRFGRQWQWTANPLPSSRLRSSRGDPHDGWATQLSGDGLRLTCVRTADAHDLRKLPNVLTQRLPGAPATVEVELRLDSEEPGARAGLAVLGDAFSWIGLQRGRDGSVQLVHRFDESVAMGAPPTPSGQWGKERDAAHARLAPGGRARLWIEIGRGARCRFSYDTGDGRRPSGPVFAATPWRWVGALIGLVALAPVGAGHAGAATFTRFRGTAAGSASLSAPASTSA

SEQ ID NO: 13900 - protein, 445 aa, Streptomyces avermitilis
MKISIHRSRRAATAVALGSVLALTATACGDDGSGAAGDKGTEGSGKGEITFWDNNGGVRTDIWKQIIADFEKKYPDIKVNYVGIPAASAQSKYDTAIQGGGLPDVGGVGTAMLAEVAVQGALEPLDSRLKKSSLNGELSQNLLDSSRAAGGGDTLYQVPTSANNGTLWYRTDLFKSAGLDAPTTWSTFYEAADKLTDKGKNKFGFTIRGGEGSIAPALDAVYGQTGITEFWNGEKTTVNDPKNVAALEKYIALYKKDTPSADVNNDFTKMVAQWDSGTIGMLSHNLGSYQDHLKALGAGKFKGIPNPTRDDGTRVQISNPVDGMSVFKSSKNKAAAWKFIEFAVSSAENSKFNESAGQVPANTEAAKDTWVQQAEPTKLAAEALNGADTKIVQLPYYLPDWNTISKADNEPNFQKLLLGKMSAKEFLDTLADQLNKAQADWKANH

SEQ ID NO: 13901 - protein, 266 aa, Streptomyces avermitilis
VSLTRRQVASVALAALPVAVVATGPASAHTNRRARTLYIAGDSTAAQKYADAAPETGWGMALPFFLREDLTVSNHAVNGRSSKSFIDEGRLDAILEVIAPGDFLLIQFGHNDEKSADPTRYTEPWTTYQDCLRQYVDGARARGARPVLATPVERRKFDADGNAVPTHGDYPAAMRALAEDELVALLDIQALSIALWQKLGVEETKKYFNWTATEQDNTHFDPPGAIAVARLVAAGLLHRRVLAPRDVRRLDAEVPESWITWPQATA

SEQ ID NO: 13902 - protein, 443 aa, Streptomyces avermitilis
MNAQTWHGHVTTTVLVGCTALALAVTGTTATATAQAQAQPRDLGRQTLAAGDGWASDGTGTTGGAAADAAHVYTVTTWAGFKAALKDGGTAPKIIKVKGTIDANAEGCDSFAAAGYDFDAYLRKYSPENWGYGANLDAEPDDSPEGLRRVSADTQAKAIKASVPANTTIVGLGKNAGFEGASLQITAVDNVIIRNVAFESPLDCFPQWDPTDTSVGNWNSEYDSAVVYGATHIWLDHNTFTDGEHPDSSLPTYFGRIYQQHDGELDIVKGADHVTASWNVFTDHDKTILIGNSDSASTAAVDRGHLRVTFHHNLFSGLVERAPRVRFGQVDSYNNHFVAGSAYSYSFGIGMESQLVAEHNAFTLPEGISAATVLKKWKEAPVTAADNYVNGAPTDLIAVHNAEIPAETLQSGAGWTPTLRTKVDPPRAVPGIVDHRAGAGKVC

SEQ ID NO: 13903 - protein, 379 aa, Streptomyces avermitilis
MAGLPLSRRAFVAACTGAALAPVLAAPAHATTRAPFGRYGSPAARLTEQTLYVHPGGLGDHTTVQAAVTAAGGTSQAFSTGGGSGRTLVLAPGIYRETVAVGVARTEMTWIGASGDPRDVVVVYDNAAGTPRPGGGTYGTTGSATTTVQADGFTARSITFANDFLRADHPEITGTQAVAIKVQGDRSAFLGCRFLGHQDTLYADSIALGTFARQYYRDCYVEGDVDFVFGRATAVYERCHFHTLNRTDLAGAPYGFVFAPSTAAADPRGYLVTRGRVTSGAPDAYYKLARPWVPSSDPTARPMLTVRDTRLAAGIDAVAPYTNMSDSYPWQSQRFAEYRNSGPGAEVTVPGNRPQLTRGEAGSATREAYLGDWTPWRGC

SEQ ID NO: 13904 - protein, 351 aa, Streptomyces avermitilis
VTGRHGGGVEMRRRAFLASAAGAAGALTALGSTPAPASSCRTLHVRPGDSVQAAVDAVTGPGRTIVVHPGTYREVVTIPADKAGLTLRGATRDPRDTVIVHDNANGTVKPDGTTYGTAGSATFTSAAPGLTVHGLTLANDWLRADHPEITGTQAVAAYVTGDRSSFSRVRLLAHQDTLFADTTALTAFDRHHYRDCYIEGDVDFVFGRATAVFERCHFHTLDRDVAFKPEGMVFAPSTARANPHGFLAVRSRVTSGAEDGAYKIARPWVPTYETTAWPSLVVRETELGPGIDAVAPYTDMREAYPWQSMRFREYRNTGPGAEITAPENRPQLTDAEAASHTRAAYLGDWRP

SEQ ID NO: 13905 - protein, 370 aa, Streptomyces avermitilis
MSRRTALALGATLALGAGLAVLPTQAQAATVVVSTTADLTSAIKNATAGTVIQVRGGTYYPTATLQSTANGTSSSPVTLQAYGSETVKIDGSSLPAGDWIFKLTADYWNVSNITFQNSPDSAVVCQSCTGTNWNNIKTINGGDSGFTLTGDGTVNNTVRNIDSYGHYDAATHGENADGVAVKFGSGTGNLITGARLYNNSDDGIDFWSFSSTVTIEHTWSFGNGKNRWGDSAFAGDGNGYKLGGDGEVVAHVVNNSAAWDDAGSGFTENSNTGAIVINRTTAYANGKYGYYFATSSAKLGKNLAVSNGSAAVSKGSSVTSSGNNWDSGIATPSFISTDATTTYNSRQSNGALPTTTFLTTGSTTIGATMN

SEQ ID NO: 13906 - protein, 123 aa, Streptomyces avermitilis
LHRRGDDLGDGMVLHEGNGKLTEGLHLAAGSNGPSPVVLAVFLSGGLVAFWCGVSWAFDVRGITTRRAERIRRRNEESWAAMGRLGGSPTVFATPGYLRFLGALMAFAGVILCVVAYALWHLG

SEQ ID NO: 13907 - protein, 264 aa, Streptomyces avermitilis
MRKSLRAAAIGAACAVAGAALYGTGVATAGQSTANSTHEPYNIGLLVKDIDTYYGATLDSNGVYQASKDSQYAKDLARLESGAKRYIDKAAHKAKRHGDKPAVVFDIDDTLLLSLDYEKKTNYTYNSTTWADYVAKADRPAVFGTPELVAYAKSKGVEVFYNSGLKESQRVSAVANLKKVGADINLDADHMFLKDAANPPAYLSACATAAAWNCTTVQYKSGTRKHIESLGYDIVANFGDQYSDLEGGYADKTYKLPNPTYFVS

SEQ ID NO: 13908 - protein, 735 aa, Streptomyces avermitilis
MRRTARTLLVPLLALLLGLLAAPPSPAAQSGAPHVNAAKYAGYLFAYFTGEGTADGEQIRYALSRGNDPLHWRELNAGKPVLTSDLGEKGLRDPFVIRSPKGDKFFLIATDLKMYRNSSGSWDQVQRHGSRSIMIWESTDLVHWTDQRLVRVAPGNAGNTWAPEAYWDDTLGAYVVFWASKLYADDDPDHTGSTYNKMLYATTKDFRTFSEPKVWDDPGYSVIDSTVIKHKGSYYRYTKDERDPSSSSPCSKFITGEKSTSLTDPTYDFVSDCIGSGSIDRGEGPTVFKSNTENKWYLFIDEYGGRGYVPFETTDLDSGEWTMSTDYQLPASPRHGTVMPVTRAEYDRLLAAYPVSGTSVVDATAKGQKGYAVVSEDTAKVVLPMKPDADLRRLAPALAVGAGATLSPRSGTRRDFRRPQTYTVTAADGTRRTWTVEAVPTRSPVLPGLYADPDIQYLDGRYWIYPTTDGFPGWSGTRFKAFSSKDLVHWKDHGVILDLGPDVTWADKNAWAPAIAERDGKYYFYFCAEQQIGVAVADSPAGPFKDALGKPLVAKGKLAGQMIDPAVFTDDDGTSYLYWGNGHGYVVPLNDDMVSYDATKVKDITQPDFREGSFVVERQGTYYFMWSEDDTGSENYHVSYATGPSPLGPWTKRGTILSKRPEYGIKGTGHHSVVNVPGTDDWYIVYHRFALSGPGKAGGDGTHRETTIDRMTFAADGTIEPVTPTLESVRPVRAN

SEQ ID NO: 13909 - protein, 385 aa, Streptomyces avermitilis
VRQSTGRHRRTRTLSIAAAVAVAAGAGGVCLGLSDNGSAQAASTTVTVSTTAQLQSAVANAAAGTVIQVRAGTYYPTATLKSTADGTSSARITLQAYGSEKVKIDGSKLPAGSWLAGVYGDYWTVQNITWQNSPAQGFVVTSSAGGVFKNLVTANNGDSGFTLRGDGTTNNLVQNLDSYGNYDAAGHGQNADGIAIKFGSGTGNKVTGARLYNNSDDGLDLWQFSSPVTIEHSWSYGNGKNRWSDSAFEGNGNGFKLGGGGVTVAHVVNNNAAWDNTLNGFTENSNTGAVLLNRNTAYANTEVGFYFATGKARLAKNLAVSNKGGLDKLGSSTVSAGNNWDSGVSTPSLKSTDASTAYGARSSSGSLPSTTFLTTGSTTIGSTMN

SEQ ID NO: 13910 - protein, 276 aa, Streptomyces avermitilis
MTAPSEQRVRHRRRVTKRRAVIGSAAALGLTAGALVTTSLLSSAGAATSWPEATGSKAVSSTIEVSGTYDGKLKKFSGSGDLGTADQSEDQGPLFELEDGAVLKNVIIGTPAADGVHCLGSCTLQNVWWLDVGEDAASFKSKSSSATYKVIGGGAKSASDKVLQFNGAGTLTVTGFQVENFGKLVRSCGNCKTQYKRTVVLSDIDATAPGKALVGINSNYGDTATLSRIRIHGDTKKKIKPCVRFKGNNTGKEPTELGSGPDGTSCKFKTSDVSYE

SEQ ID NO: 13911 - protein, 288 aa, Streptomyces avermitilis
MRKGQDVHDELRAGLREAAEAHEPDRARILARVERGMAGAGERRPAPRAARPPLLGWARVVGATAAVAGVLAVGGYAVASAVKDDTPPQQTVAVSPTPDPTPDATSRAPLAPDPTHRSGTSKPSGKPSSPPSGTPTSESSAATDRPPAKGDTDGPVWSDGSVDPHSNDFWAQSNVTLKTSEQLTSLTVRLKIRQSGGVTDAGAWRSLPEDDFTTTVVEKGGFLVYTWVLKPDHTVWPGEWVFAGQYDHDRGGRDAKDDSYSATATAKDGGRSAVRGDFAARVTDDGDS

SEQ ID NO: 13912 - protein, 188 aa, Streptomyces avermitilis
VGTVVDDAASVEFHAFFERHYAELARLAALLTGEPDAADDLAADALLALWHRWDRVRAADHPVAYARGVVANLARTRIRSAVRERRRITLFWSQREDKTENPDIPGTVDVQEALRRLPFRKRACVVLRHAFDLSEKDTALALGVSVGTVKSQTSKGMAELKRLLGTDEAPIRVHAGVLPTGGAGGRDR

SEQ ID NO: 13913 - protein, 483 aa, Streptomyces avermitilis
MSETQQVTDLPSAVPPGGNGIDRFFKISARGSTFGREIRGGFATFFTMAYILVLNPIILGSAKDKFGHQLDHVQLTTATALVAAVMTVVMGVGGNLPLALAAGLGLNAVVAFQIAPLMSWDDAMGLVVLEGLLICVLVVTGLREAVMHAIPQPLKQAISVGIGLFIAFIGFVDAGFVSRVPDVAGTTVPVQLGGTGTLTGWPVLVFCLGVLLTIGLLARRVRGAILISIVTMTIVAIVINSVADVKNWGLTVPKVPDDVVASPDFGLLGHFSLFGAFGETGAITVVLLVFTLVLSDFFDTMGTVVGISAEAGLLDEEGKVPDLGRVLLIDGAAAVAGGAASASSATSYIESAAGVGEGSRTGFSNLVTGGLFAFALFLTPLLTIVPMQAAAPALVAVGFLMMTQVKHIDWDRYEIAIPAFLTIAVMPFTYSITNGIGAGFLAYVLIKAVLGKAKEIHWLLWATSALFLVYFAIDPVEQILGVK

SEQ ID NO: 13914 - protein, 483 aa, Streptomyces avermitilis
MNKTIRRAAVFTLLLVLALLVRATWVQFYDGKALADNKDNRRNAIELYANPLGNIIVAGDAITGSARTKGSDLAYKRTYTDGSLYAAVTGYSSQVFGATQLEGIYQNLLDGTDNQLKNPLDTITNKRADPGDVVTTIDPDVQKAAYRALGDNKGAAVAIDPKTGKILAAVSTPSYDPSTFSAGNSAAWKKLTEDADKPMTNRALRQPLPPGSTFKLVVAAAALEDGLYSSVDKDTDSPNPYTLPGTTQVLANENASAPCENASIRVALQYSCNNVFAKMAVDLGQDKVRAMAEKFGFNDTSQDVPVRAYPSVYPSDMDKAQTGLSGIGQFDVTATPLQMAMVSAAIANDGKLVSPHMVSQTSDADGTVLKDYDDSTETKEIVGSSTAEQLRSAMQTVVEEGTGTNARIPGATVGGKTGTAQHGENNSKTPYAWFTSYAKSDSSSKEVAVAVMVEQSGAARSEVSGNGLAAPVAKAMMRAALKN

SEQ ID NO: 13915 - protein, 257 aa, Streptomyces avermitilis
MSAGETGGGAQVKSAVRTVELLEYFAGRPGMHSLAAVQEAVGYPKSSLYMLLRTLVELGWVETDATGTRYGIGVRALLVGTSYIDGDEVVAAARPTLDRLSDDTTETIHLARLDGTNVVYLATRQSQHYLRPFTRVGRRLPAHSTSLGKALLATHTDEQVRKMLPETLPALTEHTITDREKLIEELRQVRDQGFAVDREENTLGLRCFGVAIPYRTPARDAISCSVPVARLTPAHEQMVKDALFDARDRLTLATRRL

SEQ ID NO: 13916 - protein, 509 aa, Streptomyces avermitilis
VAAAPVWSVDPRTGKQREQVAVEATAQEVDQVVRAAHAARPSLADRTVRAAFLRTAADQLEAAKDQLVEAADAETALGPVRLTGELARTCYQLRAFADIVDEGAFLDIVINHPDDTATPPIPDLRRYKVPLGVVAVYAASNFPFAFSVPGGDTASALAAGCPVVVKAHPDHPGLSELVASVLRRAAAEHGIPAGVLGLLHGFEAGVELVKHPLVAAAGFTGSVRGGRALFDAAAARPTPIPFHGELGSLNPVVITEAAAAERAEAIGAGLAGSMTLGVGQFCVKPGLVLAPAGAAGDRLVKSLTDAVSDTDAGVLLDHRMRDNFIAGVAERAGLPGVEAPVTPGSGGEHSVSPGFLTVPAEKLAAPGAHDLLLEECFGPLTVVVRYEDDAEAGAVLSRLPGNLTATVHLSEEESAGEGRGAEILAELTPLAGRVLVNGWPTGVAVAPAQHHGGPYPATTSTSTSVGGTAIERWLRPVAYQGVPEALLPVELRDGNQLGLPRRIDGRPER

SEQ ID NO: 13917 - protein, 202 aa, Streptomyces avermitilis
MDVELPELPFPLRTYGPDGNWSYEDGVLTGWAGARQDRFVPPTGEALDPAADAPRLLGAPEGDFQLIARVTVGFAASFDAGVLYVHVGERAWAKLCLEYSPDVPTVCTVVTRGHSDDANSFTVEGSSVWLRISRTGRAFAFHASRDGEHWTFVRLFTLADEGPASAALVGFMAQSPVGEGCVVTFDHLAYRDSWPQGLRDGS

SEQ ID NO: 13918 - protein, 467 aa, Streptomyces avermitilis
MEGMATNPTTETPPTDPRLTSATSELEHHTSPSLTLAAALLGFALITLDASVVNVALPSIGSAFGGGMSGLQWVVDAYTLAFAALMLSTGAFADRAGASRAYGIGIAVFTLASAACGLAPGLPVLIGARVAQGVAAAVVLPASLALVRQAYPDAARRARAVALWAAGGSVAVALGPVAGGALTTAWDWRGIFFINLPLGALALVLLLRAPRSERRPAPLDLPGQLTAVVALTALTFAVIEGGAGGLIALAVAVTAAVLFVRIEARQAYPVVPLGLFRSRTVSVAVAAGAACSVAFYGVVFLFSLFFQQAQGRSALSAGLMFLPMTGLIAVTNIAAGKLSGRYGARLPMLLGQSLAAAGLLVLLFVDASTPPALVAVLLVPMALGCALTIPPLTATMMDAVPADRAGLAAGVLNSARQVAGGLAIAAFGSLVSGGFGSGLRVSLALAAALLALTATATFRLRGSAAVS

SEQ ID NO: 13919 - protein, 335 aa, Streptomyces avermitilis
MARSTSPARGVRRIAVVAASPVSMFNLAIPELLFEKVEIDGAPGYEVTICAPEPGPVPTTGGLDLYVRHGLDAVRDADTVLVAGTGLRYTPDPRTVDAVREAAADGKRIASICSGAFALAEAGLLAGRRATTYWGQAEELRKRYPSVDLKGDVLYVQDGPIMTSSGYAAGIDLCLHIIRTDYGAAAANRVARLALVAPVRPGGQTQFTQTPLPPERGTACADTRGWAMRHLDSPLTLTDLARHAGVSVRTLTRRFHAESGVSPLQWLLHQRIERAKELLETTTLPMDQVARASGLGTADSLRGHLVRRTGLTPSAYRTQFSRLGSGPGPGMEQAA

SEQ ID NO: 13920 - protein, 238 aa, Streptomyces avermitilis
MRVEIWSDIACPWCYVGKARFEKALEAFPHRDDVEVVHRSFELDPNRAKGDIQPVLTMLTKKYGMSEAQAQAGEDNLGAQAAAEGLDYRTRDRDHGNTFDMHRLLHFAKEQGRQDELIGLLYRANFAEERSVFDDDERLVELAVAAGLDAEAARTVLADPAAYADEVRADEREAAELGASGVPFFVLDRAYGVSGAQPAEVFAQALKQAWGDRPPLTLIQDSGDAQACGPDGCAVPQG

SEQ ID NO: 13921 - protein, 368 aa, Streptomyces avermitilis
MDGGFAGPQSGPMETFEPLVRAEFAPKNTYLNTASTGLVPARTVAAMRVAVESAAAGQPTDMFADVEAARASFARLTGVPVRRVAAGASVAVYSGLIAASLPEGAEVLTAEADFSSVVNPFHIRRDLKVRAVPLEGLAESVRPGTALVAVSAAQSADGRVADLPAVRAAARAHGARTYIDASQATGWLQIDADAYDYVSSVAFKWLVCPRGVAFLVVPEDLGGLTPLFAGWVAGQAPWDSCYGPVEELAHSARRFDESPALFSYAGARHSLALIEELGVENVRAHDLALADRFRTGLASLGHEPVPAPHAPIVSVPGLGDRQPALSRAGVEVSDRAGNLRAAFHLYNTPADVDRLLDVLSGLSGRPLA

SEQ ID NO: 13922 - protein, 280 aa, Streptomyces avermitilis
VSVPRQDPVLWGTPDTPGPITAADLQSYEHDGFLAVPQLIGDDEVALYHAELERLIHDPAVRADERSIVEPQSQEIRSVFEVHKISEIFAQLVRDERVVGRARQILGSDVYVHQSRINVKPGFGASGFYWHSDFETWHAEDGLPNMRTVSVSIALTENYDTNGGLMIMPGSHKTFLGCAGATPKDNYKKSLQMQDAGTPSDEALTKFADRHGIRLFTGRAGSATWFDCNCLHGSGDNITPFPRSNVFIVFNSVENTAVEPFSAPVRRPEFIGARDFTPVR

SEQ ID NO: 13923 - protein, 134 aa, Streptomyces avermitilis
VIVRSFKDIEGTDRHVKAASGTWESKRIVLAKEKVGFSLHETVLYAGTETSMWYANHIEAVLCVEGEAELTDDETGEKHWITPGTMYLLDGHERHTMRPKTDFRCVCVFNPPVTGREDHDENGVYPLLTEPEEV

SEQ ID NO: 13924 - protein, 423 aa, Streptomyces avermitilis
VTITQPDLSVFETVESEVRSYCRGWPTVFDRAQGSRMYDEDGHAYLDFFAGAGSLNYGHNNPVLKRALIDYLERDGVTHGLDMSTAAKRAFLESFQNLILRPRDLPYKVMFPGPTGTNAVESALKLARKVKGREAIVSFTNAFHGMSLGSLAVTGNAFKRAGAGIPLVHGTPMPFDNYFDGKVPDFLWFERLLEDQGSGLNKPAAVIVETVQGEGGINVARPEWLRALAELCKRQDMLLIVDDIQMGCGRTGAFFSFEEAGVTPDIVTVSKSISGYGLPMSLCLFKPELDIWEPGEHNGTFRGNNPAFVTAAAALQTYWADGSAMEKQTLARGEQVEQALISITEENLADVKEYRGRGLVWGIEFKDKDRAGRIAQRAFELGLLIETSGPESEVVKLLPALTITPEELDEGLRTLARAVRETA

SEQ ID NO: 13925 - protein, 179 aa, Streptomyces avermitilis
MTAAHADLQAEFLEMPEGLRIDRPDVADGSALWRIAKDSKTLDLNSSYSYLLWCRDFAGTTAVARAADGTPVGFITAYVRPERPHTLLVWQVAVDAAYRGRGLAARMLDGLTARVTDEYGVTGIETTISPGNTASERLFTSYAQRHGADLEREVLFEAGLFPDAPHDPEVLYRIGPLSH

SEQ ID NO: 13926 - protein, 376 aa, Streptomyces avermitilis
MEPVSEESIAVTHPFLDLAPLSAAHFASIEDRVARLLATEQDVVIMQGEALLPLEGAIRAAAGPGTTALNVITGPYGQTFGNWLRDCGATVIDLAVPFHTAVTAARIREAFAAHPEIDFVSLVHAEAATGNTNPVAEIGAAVREHGALFYLDAVASIGAEPVLPDAWGVDLCVIGAQKAMGGPAGVSAVSVSERAWARMAANPAAPRRSYLSLLDWKERWVDGGRKALLHAPAQLEMLALEACVERIEAEGLEAVMARHASAAAATRAGAVALGGGLEPYVHEAADAAPVATTLRTPAGIDASELVAKALASDPVLPLVAGGGALAREMVRVNHYGPGATRGVVQSCLGALGAALAEFGVPVDLEGARRAVAEAWA

SEQ ID NO: 13927 - protein, 282 aa, Streptomyces avermitilis
VKTVLGRRSRILAATTATAGLLLVAGCSSDNGGGKTTVKGVPLVKAGQITTCTHLPYPPFQSEIDGKVQGFDVSLIDLVAKDLGVKQAIVDTPFENFKTGAFLNSGQCDVAAAGMTITEERKKNVDFSDPYFEATQAVLVDKKSGVDSLADVKAKGKKLGAQAQTTGEEYAKSKGFDAVSFESSDAVLNGLRTGQVQAVIIDYPVVQGWLKDKANADAFKVVDNLNTGEEYGFTVKKGNTKLLAEINKTIKQAKADGTYKKIYEKWIGPYTASAATASPSAS

SEQ ID NO: 13928 - protein, 277 aa, Streptomyces avermitilis
MSDADAQLQPRRSGLSRRQKRAVSRGVQYVVFVAAVIAFAVLADWGQLKNQFAQWDLVKQMFPDVITLALKNTVLYTMSGFVVGLVLGMVIALMRLSSVGPYRWLAGIYIEIFRGLPALLIFVFVGVAVPLAFPGTEIPGGTYGKVALALGLVSAAYMAETIRAGIQAVPKGQMEAARSLGFSHARAMVSIIIPQAFRIVIPPLTNELVLLFKDSSLVLFLGVTLEERELTKFGRDLASQTANSTPILVAGLCYLLVTVPLGFVVRRLEAKAGEATK

SEQ ID NO: 13929 - protein, 267 aa, Streptomyces avermitilis
VSTPEIDVRGLHKSFGDNEVLRGIDLEIGSGEVVCVIGPSGSGKSTLLRCVNLLEEPTKGQVFVAGAEVTDPDVDIDAVRRRIGMVFQQFNLFPHLSVTDNLTLPQRRVLGRDKAQAAEVAADNLRRVGLSEKAEAYPASLSGGQQQRVAIARALAMGPQVMLFDEPTSALDPELVGDVLAVMRRLADEGMTMMVVTHEMTFAREVADRVVFMDGGVIVEDGTPEQVIGNPRHERTRHFLSRLLDPAMADVEEEISDQVGKSEQPPN

SEQ ID NO: 13930 - protein, 363 aa, Streptomyces avermitilis
MSDHAVLHVKGRVLVGPDDVRDELWVVGGRIAYAPPAGARDIRTVEGWALPGLVDAHCHVGLDRHGPVPDDVSEKQALADREAGTLLVRDAGSPSDTRWIDGRDDLPKIIRAGRHIARTRRYIRNYAHEIEPEDLVAYVAQEARRGDGWVKLVGDWIDRGTGDLSACWPPDAVRAAIAEAHRLGARVTAHCFAEDSLRDLVEAGIDCVEHATGLTEDTIPLFAERGVAIVPTLVNIALFPQFAADGEAKFPRWSAHMRRLHERRYDTVRAAYDAGVPVYVGTDAGGSLAHGLVAGEVAELVTAGIPPLDALSATTWGARRWLGRPGLDEGAPADLVVYEGDPRADVRVLAAPRRVVLNGRVIG

SEQ ID NO: 13931 - protein, 326 aa, Streptomyces avermitilis
VNVRADTPPAWLRERIAESLGGLAAYPDGRAARAAVAQRHALPVERVLLTAGAAEAFVLLARALKVRRPVVVHPQFTEPEAALRDAGHTVDRVLLREEDGFRLDAGAVPEDADLVVIGNPTNPTSVLHPAASIAELARPGRTLVVDEAFMDAVPGEREALSGRTDVPGLVVLRSLTKTWGLAGLRIGYVLAAPETVAELERAQPLWPVSTPALAAAEVCVSPRALAEAAHAAHRIAADRAHLVAGLREFASDGLCVAEPAEGPFVLVRLPRAAAVRGHLRGLGFAVRRGDTFPGLGEEWLRLAVRDRATVNRFLQALDRAVTLADR

SEQ ID NO: 13932 - protein, 312 aa, Streptomyces avermitilis
VTTPAPALLIAGHGTRDEAGAEAFRDFVRELGRRHPELPVAGGFIELSPPPLTEAVGELVERGVRRFAAVPLMLVSAGHAKGDIPAALAREKERHPGISYTYGRPLGPHPSLLNVLERRLDDALGGGPRTPQDRADVTVLLVGRGSTDPDANAEVHKAARLLWEGRGYAGVETAFVSLAAPDVPSGLDRCVKLGARRIVVLPYFLFTGILPDRVRQQTEGWAAAHPEVEVRSADVIGPEPELLDLVMERYREAVQGDLRMNCDSCVYRIALPGFEDKVGLPQQPHFHPDDDGHHHHGPHGHGHHGHAPSHAH

SEQ ID NO: 13933 - protein, 204 aa, Streptomyces avermitilis
VNRAFVPEDRVVHPIEQESFRRLRARLDTSHFPPLTRAVVERVIHSAADLDYAEDLVMDEGTLERAHAALHAGAPVVVDVEMVAAGITRRGTVCRLKDARSGPGLTRSAHAVRLAYEEVGPGALWVIGCAPTALEELLTLDASPALVIGLPVGFVGAAESKAALRESGLPAVSNVSMKGGSAVAAAALNALLYHLAAPASKEKS

SEQ ID NO: 13934 - protein, 533 aa, Streptomyces avermitilis
VYDGPVGEAVRRAFAECEQLVCFLATGAVVRLVAPLLGDKTSDPGVVCVDEAGRFAVSLVGGHGGGANELAREVGELLGAEPVVTTATDAVGLPGLDTLGFPVEGDVSGVSRALLDGEAVALDAEVSWPLPPLPVAAEGRYAIRLTDRLVEPGEREVVLRPPSLVVGVGASRNAPVEEVLGLVQGALRDAGLSVKSLAELATVDAKADEPGIVEAAARLGVPLVTYSAGELAAVEVPNPSDAPLAAVGTPSVAEAAALVRGGELLVPKRKSAAQPAMATCAVVRRPARGRLAVVGLGPGARDLLTPRARDELRRASVLVGLDQYVDQIRDLLRPGTRVLESGLGAEEERARTAVAEARRGHAVALIGSGDAGVYAMASPALAEASDDIDVVGVPGVTAALAAGAILGAPLGHDHVSISLSDLHTPWEVIERRVRAAAEADIVVTFYNPRSRGRGWQLPEALAILAGHREPTTPVGVVRNASRTDESSRLTTLAGLDPATVDMMTVVTVGNTATREIAGRMVTPRGYRWQEESE

SEQ ID NO: 13935 - protein, 416 aa, Streptomyces avermitilis
VITVVGTGTGAPLSADAARALAGAGLVVGGRRHLAAAALPDGAERIVLGPLAPALDAIEAALEKQRRVVVLASGDPGFFGIVRALAERFGAERLDVRPGVSSVATAFARLGLPWDDAVVVSAHGRDLRTALNVCRSRPKVAVLTGPGAGPAELGAALAHGFGARVLVVASALGDPEHERVERVTPAEAAARDWGTAVSVVLCLDASRALAPVRTVAGPPAGPARWALEEGDFAHRDSMITKFEVRALALARLGPRLGDLVWDVGAGSGSVAVECARLGAAVTAVEKTLDGVERIHANARAHGVDVHVVHGAAPDALTALPDPDAVFIGGGGRELPALVTACARRARRTVVVAMAALDRVPAVREALTGAGFGCDGVLLQSSRLAPLPGDVTRLAATNPVFLLWGARPPARTEGALQ

SEQ ID NO: 13936 - protein, 274 aa, Streptomyces avermitilis
MADAPTGKVTFVGAGPGAADLLTFRAARAIAEADVVIWAASLVQAEVLDHARAGADILDSATMSLEDVVAVYRRAHAEGLKVARIHSGDPALWGGTQEQADRCAEIGIETEIVPGVSSFSAVAALAGRELTIPEVAQSVILTRLGGGKTPMPPGEEVREFARHGTTMALFLSAARSGQLVRELLEGGYPTSTPVVVAYQATWPEELIVTCTIETLEETVKEHKLWKHTLFLVGPALGAHGTRSHLYHPGHFHGFRKADPQARAELRAARKGSPS

SEQ ID NO: 13937 - protein, 242 aa, Streptomyces avermitilis
MAVFVALGAFLMTLAGGWTAQRVTDRRHLVLGLAGGLMLGVVGMDLLPEALDAAGGKVFGVPAALLLFVAGFLLAHLVERLLAHRQAAHGGAESNGRAPEVGLTAAAAMVGHSAMDGVAIGAAFQVGGGMGLAVAVAVIAHDFADGFNTYTLTALYGNARRKAVIMLVADAVAPVLGAASTLAFTIPERLLGGYLALFGGALLYLAAAEILPEAHHEHPARSTLLCTVAGVGFIWLVVGLAG

SEQ ID NO: 13938 - protein, 249 aa, Streptomyces avermitilis
MSSKLIGVGVGPGDPELVTVKGVNALRAADVVVVPVMAAPDGTDGGERGRAEATVLHYVPEEKVLRVVFALNERADRGRREAAWDAAGGRVAELLTAHGTVAFATIGDPNVYSTFTYLAHTIQDLVPGTVVETVPGITAMQDLAARSGAVLTEGTEPLTLVPVTAGAAVLKEALNGPGTVVAYKFGRQAHEVAEALRETGRIDDAVWGSALGLAEESIRPAADLDGGPLPYLSTLIAPARREGGRGGKL

SEQ ID NO: 13939 - protein, 454 aa, Streptomyces avermitilis
VVMSSVPRLVIAAPSSGSGKTTVATGLMAAFTARGLAVSPHKVGPDYIDPGYHALATGRVGRNLDAYLCGAELIAPLFAHGARGCDLAVVEGVMGMFDGAAGEGELASTAHVAKLLRAPVVLVVDASSQSRSVAALVHGFASWDPRVRVGGVILNKVASDRHEELLREALDSAGVPVLGVLRRAEQVDTPSRHLGLVPVAERLAAAVAAVAAMAAQVREGCDLDALFALARGAGALSDDPWEPPVLSATERPTERPVVAVAGGPAFTFSYAEHAELLAAAGAEVVTFDPLRDERLPDGSAGLVIGGGFPEVYAPELSANEPLRKAVAELALAGAPVAAECAGLLYLCRELDGQPMCGVLDAEARMSGRLTLGYRDAVAVGDSVLAAAGTRMRGHEFHRTVVEPGAGAAPAWGVRAPVRRVEGFVQHGVHASYLHTHWAAAPGVAHRFVERCRTS

SEQ ID NO: 13940 - protein, 199 aa, Streptomyces avermitilis
MPQGQPSVVPDDGLTTRQRRNRPLVIVHTGIGKGKSTAAFGLALRAWNQGWPIGVFQFVKSAKWKVGEENALRVLGASGEGGSVDWHKMGEGWSWVQRDAQMDNEEKAREGWEQVKRDLAAETYKLYVLDEFAYPMHWGWVDTDEVVSVLRERPGTQHVVITGRNAPEKLVGLADLVTDMSKVKHPMDAGQKGQRGIEW

SEQ ID NO: 13941 - protein, 689 aa, Streptomyces avermitilis
VSTPFPFTAVVGQDDLRLALLLNAVSPAVGGVLVRGEKGTAKSTAVRALSALMPEVDVVAGCRFSCAPGSPDPACPDGPHEVGPGVRRPARMVELPVGASEDRLVGALDIERALAEGVKAFEPGLLADAHRGILYVDEVNLLHDHLVDLLLDAAAMGASYVEREGVSVRHAARFLLVGTMNPEEGELRPQLLDRFGLTVEVAASREPDQRVEVVRRRLAYDDDPEAFAARWADEESAVRARIVAARELLPSVRLGDGALRQIAATCAAFEVDGMRADIVMARTATALAAWDGRSDVLAEDVRQAALLALPHRRRRNPFDAPGLDENKLDETLEEFGGQNEDEGDDDPDPDGPGGGGQPPENGPEGGPQDGPQDGSQEGPQDGADSSEPGGDEAARPQAGESGQPGASGAGEQQAVRAGEPFRTKVLSVPGLGEGAAGRRSRARTEHGRTTGARRPRGTLTKLHLAATVQAAAPHQRARGRSGRGLVVRRDDLRQATREGREGNLVLFVVDASGSMAARQRMSAVKGAVLSLLLDAYQRRDKVGLVTFRGSAAEVALPPTSSVDAAAVRLESLPTGGRTPLATGLLKAHDVLRVERLRDAARRPLVVVVTDGRATGGPEPVALAGRAARLFAADGVASVVVDCESGPVRLGLAGQLAGELGGTPVTLDELRADSIAGLVRDVQSSNRRAA

SEQ ID NO: 13942 - protein, 1217 aa, Streptomyces avermitilis
MSTVLLLSTADTDLLAARASGAPYRIGNPTRVDVSEELPALVAGSDIAVVRLLGGKRAWEDGLAALKASGIPTVLLGGETVPDAELMAESSVPAGVVAEALRYLVEGGSANLVELARFLSDTVLLTGEGFVEPQQMPEYGVHGERPYTQGRPTVGVLFYRAHELSGNTAFVDTLCDAVEARGANALPVYCGSLRGADTGLYEILGKADALVATVLAAGGTHASQASAGGDEEAWDIGALTDLDIPVLQGLCLTSSHAAWEGSDAALSPMDAAMQVAIPEFDGRLITVPFSFKEQGPDDVPVYVADPERAARVAGIALRHALLKHKPNAEKKLGIVFTAYPTKHSRVGNAVGLDTPASAVRVLDALRDAGYGLTEYPDNGDELIHRLIAAGGHDVEWLTEEQLAAAPARVPLADYRAWFETLDPALREGMLEAWGEPPGSLYVDGDDIVLACLQFGNVVVMIQPPRGFGENPIAIYHDPDMPPSHHYMAAYRWLENSFGADAVVHMGKHGTMEWLPGKGLGLSGGCAPDAVLGELPLVYPFIVNDPGEGTQAKRRGHATVVDHLVPPMARADTYGDLAKLEQLLDEYALVSDLDPTKAPAVRAQIWTLVKAAELHHDLHVDDQPDDDAFDEFVMHIDGYLCEIKDVQIRDGLHILGGGPEAEPRVNLVLAVLRASQVWGGQANALPGLRAALAAHFGLVEKELLGEPGAPVKVPAELSDLVEGPSRSAADAIDLLEQLCRRAAEGMEERGWDVAAVPALVREVLGSELPDAVAVLEFACREVVPRLARTTDEIDHILRALNGGYVPAGPSGSPTRGLVNVLPTGRNFYSVDPKAIPSRLSWEVGQSLADSLIQRYLQDTGEYPKSVGLTVWGTSAMRTQGDDIAEILALLGCRPVWDDASRRVTGFEVVPLDELGRPRIDVTVRISGFFRDAFPHVVGLIDDAVRAVAELDEPVDLNYVRKHADEDTAEHGDRRRATARVFGSKPGAYGAGLLPLIDARNWRSDADLAEVYAVWGGYAYGRGLDGRAARGDMETAFKRIAVAAKNVDTREHDLVDADDYFQYHGGMVAMVRHLTGASPEAYVGDSAVPDQVKTRTLGEETHRVFRARVVNPRWMAAMRRHGYKGAFEMAATVDYLFGYDATAGVVDDWMYEKLSAEYVFDAENRDFMKKSNPWALRGITERLLEAAERGLWAEPDAQTLERLRATYLELEGDLEGDDQ

SEQ ID NO: 13943 - protein, 502 aa, Streptomyces avermitilis
MSGGLLIAGTTSDAGKSVVTAGICRWLVRQGVKVAPFKAQNMSLNSFVTREGAEIGRAQAMQAQAARVEPTALMNPVLLKPGSDRSSQVVLMGRPVGEMSARGYHGGRQEALLGTVLDCLAELRGTYDAVICEGAGSPAEINLRRTDIVNMGIARNARLPVLVVGDIDRGGVFASFFGTVALLSREDQELVAGFLVNKFRGDVSLLEPGLDMLRNLTGRPSYGVLPFQHGLGIDEEDGLRVSLRGSVRESAVSSPVGEDILRVAVCAIPLMSNFTDVDALAAEPGVVVRFVDRPEELADADLVVIPGTRGTVKALEWLRERGLAEALRRRAAAGRPVLGICGGFQVLGEHIEDDVESRRGHVEGLGLLPVRVRFAREKTLTRPVGEALGEHVEGYEIHHGVADVTGGDPFLDGCRVGAVWGTHWHGSLESDGFRRAFLREVAAAAGRRFVPAAGTSFAGLREEQLDRLGDLIEEHADTDALWRLIESGAPSGLPFIPPGAPA

SEQ ID NO: 13944 - protein, 313 aa, Streptomyces avermitilis
MRADRVFAYGAAAGLIGDLLLGDPRRGHPVAAFGRAAGVVERVLWRDHRGWGALHTVVCAGGAVGLAAVAARSVRTSRTASVALTAAATWAVVGGTSLGREARAIGQALDAGDIEGARERLPHLCGRDPGALDADGIARAVVESVAENTSDAVVGALVWGAVGGVPGLVGFRAVNTLDAMVGHRSPRYLRYGWASARLDDVMGWPGARLTAVLAALAGHDPRGALRAWRSDAARHPSPNAGPVEASFAGALGVRLGGTLSYGGRVEHRPVLNGGGRAVDSKDIERAVRLSRRVGWLALGVAAAGRLWKRGGTS

SEQ ID NO: 13945 - protein, 71 aa, Streptomyces avermitilis
MSIDWAALGSVFGVSLVVTVGLVGLFTLGIVGLTKKESAEGGSAALATTGAYACFAACAAAVAYGIYLIVA

SEQ ID NO: 13946 - protein, 417 aa, Streptomyces avermitilis
MEHITLLLGIVIVTALVFDFTNGFHDTANAMATTISTGALKPKTAVAMSAVLNLVGAFLSVEVAKTISGGIINEEGIRVEVIFAALVGAILWNLLTWLLGLPSSSSHALFGGLIGAAVMSAGWSSVNGPTIVTKILIPAVAAPVVAGIAAMLATRLTYRIGARADEKATKKGYRAGQIASAGLVSLAHGTNDAQKTMGIITLALVTGGVVAPGSNPPMWVIVSAGTAIALGTYLGGWRIIRTMGKGLTDLAPPQGFAAQTSAATAILASSHIGFSLSTTQVCSGSVLGAGIGRKGGVVRWSTATRMFAAWGLTLPAAGLVGAGAELLTKQGTWGTIATGVLLVAGAGAIWALSRRQPVTVDNVNDIAAEPAGVVTTAIAAVTPPPAGPVSVVDATADLKTTIPAPSPGAEPTRPATV

SEQ ID NO: 13947 - protein, 247 aa, Streptomyces avermitilis
MARDHKPSRRRARVLAASAAVFAIGGTVFAGLPASAAGKPLGHDVSSHQKDVNWSGAQAKGARFVYIKATESTDYRNPFFGRQYNGSRNAGLLRGAYHFALPDKSSGAAQAAYFVRNGGGWRADGWTLPPALDIEYNPYSKKKCYGLSKARMVGWIQSFSDEVKRQTGRRPVIYTTTHWWNKCTGGSAAFAADHALWLARYDSANAGALPAGWSFWTFWQYDNSGSLPGDQNLFNGSMTGLKRFAKG

SEQ ID NO: 13948 - protein, 241 aa, Streptomyces avermitilis
MAEQRRDGRDAGGVREHPQERREEGQRDEVARAWDDLVATARRTVSDGLVVGTSGNVSVRVGDTVLVTPTGVPYERLTPADVVGVGLDGRQVLGSLVPTSELPMHLAVYRTTDARAVVHTHAVHATAVSTLVPELPLIHYMAGALGGPVRVAPYATYGTPQLAENMRRALEDRTACLLQNHGTIAYGATLPQAYDRTAQLEWMCRVWLTASSIPGLTPTLLTEEQVAEAGERLRGYGQPGR

SEQ ID NO: 13949 - protein, 375 aa, Streptomyces avermitilis
VRTVKATAAAVTVAIAAGAAGVAAGRFASDAALKAPPGRPLPTEPRLTVHSTAAGQITLTRALASQRPGTYGISGDGSHAVVGPVLAAAPHSADTVVRRLERVTHGTLEPGDKVWLTPNVHIGNPSSALGLEHADVDIPGELGPLPAWFVPGVRDTWVITVHGLGATREHPMNVMGFLNRHHFPVLDLAYRGDLGAPRPQDGLNHLGETEWRDLDAAIRYAVRYGAERVVLHGWSTGATMALRAAAHSGLRERISGLMLDSPVLSWETTVRTLAAARRTPGALLPLAVRAAQGRTGLHGDRIQVAADPQHLQAPVLIFHGPGDTVAPWGLSRRLADSRPNLVTLHTVTNAPHGAMWNADPGVYEEAMRRFLTPLM

SEQ ID NO: 13950 - protein, 455 aa, Streptomyces avermitilis
VTQRRTRRPAPRPPEGTPPPAELARMARTGLADAARVARWADAALRPGHGVGPSDGRGTLSDTTAERAAADLGLTPAQVRADWDTARLAGLVEVHGDSARPGWRLRAWNRDDSAVLRGWVALFDAWSLAYPEPEEHEHAAVAEVVSAMPQVLSFLQLSAGPVPFEQLLDLLDQRVTELRTERCEVPYGPQAEPVEVPAGRSGGVFGIPGERLAEDTPLSPLLDWALHALASVGALTCADGQATLTPLGSWAVWVKLEQICVAAQSPAGNIEQNAEDMLRGCAQLRPNAARAEYRAWLAARTVGSAVTELLDAARGDDALLRGLAFEALRVVGAPAEPDVRAVAEATPLRPYALLWLAEHDGHDPEDAHEVLTREESTWLWVDTAAAVADHGEAPLLVRHLESAVQPTVPALLDEVRAVGHPRTVQVLVALAAAHPDPALARAVRRAAFQVHTGGS

SEQ ID NO: 13951 - protein, 140 aa, Streptomyces avermitilis
VIGMAGMDSGRPSICPSLLYADAKAAIKQLTEAFGFTELSVYEGEDGSVMHAELVQGNGAVMLGSKGRGGRFDEAMKNAGPCGVYVVVDDVDAHHRRAVDHGAEILMPPTDQDYGSRDYMARDAEGNIWSFGTYAPEIQG

SEQ ID NO: 13952 - protein, 393 aa, Streptomyces avermitilis
VWHRALTTRPRAKDRRTEGPKGRRTERPNGGRTRARPPCHGSRPPYPRLRSAWSVGSALRGRGGRFADRDDGGGPRRPALRGPHRRPARSVPRRQPAHRPHRPRAHAGPARPANPQAEHPATRTAERPANTEAAWTVNASPRPRLPTDPLPPPHFRRLHRLLPTALALLLGASLLAAVHHARPAPYGDRLTVHARVAPAVEPRLRMRGAAVEAYGGRGGSVHWTYARAGRRPLAVLPARGDAIALWDDGLVTATDATGVRWHRALPAAADWLAAHGGAGVLRMLDPGTRMLAVVTPHRIAAYRLADGDLRWVLPARQGCAFAPARAVHRGGAILIAQPCLAADSWSGEIVAVDDLGPIAPRRTPLGNEWQGERRGEHHSAEHPHTGNLVARPR

SEQ ID NO: 13953 - protein, 532 aa, Streptomyces avermitilis
VISASGIELRAGARILIESATFRIAKGDRIGLVGRNGAGKTTLTKVLAGEGVPAGGNVTRSGEVGYLPQDPRTGDLDVLARDRILSARGLDTLIRKMRENEQRIANGSGATREKALRQYERQETEFLTKGGYSAEAEAATIAAALNLPDRVLGQPLHTLSGGQRRRVELARILFSDADTLLLDEPTNHLDADSIVWLRDYLKTYRGGFIVISHDVDLVETVVNKVFYLDANRSQIDVYNMGWKLYQQQREADEKRRKRERQNAEKKAAALHSQADKMRAKATKTVAAQNMARRADKLLAGLEAVRQQDKVAKLRFPEPSPCGKTPLTAEGLSKSYGSLEIFTDVDLAIDKGSRVVILGLNGAGKTTLLRLLGGVETPDTGEVVEGHGLKLGYYAQEHETLDPERTVLENMRSAAPDLDLVEVRKTLGSFLFSGDDVDKPAGVLSGGEKTRLALATLVVSSANVLLLDEPTNNLDPASREEILGALRTYKGAVVLVTHDEGAVEALQPERIILLPDGVEDLWGADYADLVALA

SEQ ID NO: 13954 - protein, 73 aa, Streptomyces avermitilis
VAETLKKGSRVTGAARDKLAADLKKKYDSGASIRALAEETGRSYGFVHRMLSESGVTLRGRGGATRGKKATTA

SEQ ID NO: 13955 - protein, 277 aa, Streptomyces avermitilis
MASHEHETDVDKDPGKVLDPVLDKDGVRLTVDEAVATVTLTNPAKRNAQSPALWRALAEAGRVLPGSVRVVVLRAEGPSFSAGLDRQAFTPEGFDGEPSFIELARSSDAELDGTIAEYQEGFTWWRRSDIVSIAAVQGHAVGAGFQLALACDLRVVADDVQFAMRETSLGLVPDLTGTHPLVSLVGYARALEICATGRFVLAEEAERTGLANLAVPAEQLDGAVRDLAGALLAAPRDAVIETKALLRGAQERTYEDQRAAERAAQARRLRDLAGVGD

SEQ ID NO: 13956 - protein, 246 aa, Streptomyces avermitilis
MTADRWTQEVRHLLRLGRLLPLGLPHDGSWITESAAGSVLRRAADPVREVRLGTLRISLADPEQQVHEPVVPPPPSALPPGPLRIIAEFTVSADPTAPGVDPLPTTADRLRLALAAAAEERLGLTVTEVDLLVTELSNGADEAPVAVRPDDERPTAQPTGADELRAASAALSVPGVARLTDALGRPVHIEDVGGKTTLPHRHVRVELAVTAERRTADVARAVRSAVTEALPDHPSVAVVVTAVGRP

SEQ ID NO: 13957 - protein, 160 aa, Streptomyces avermitilis
MTDMTERNRPETPEGAVESPQARRATKRGGGDPATRGRTTIADGVVEKIAGLAARDVLGVNAMGSGLSRSFGAMRDRVPGGTKSVARGVKAEVGELQTALDLEIVVDYGVSITDVARAVRENVIAAVERMTGLEVVEVNIAVSDVKLPDEEEEEPETRLQ

SEQ ID NO: 13958 - protein, 61 aa, Streptomyces avermitilis
MSLAVIGMIAGMALGFAGYFGGFGAFLLVAALGAVGLVVGRVIEGDLEFGDFFRPRDDRRR

SEQ ID NO: 13959 - protein, 133 aa, Streptomyces avermitilis
VPGQAGELEQRYGPQAVRRPPTAVAPAERGATRIADRVVAKIAAQAAREAVLPLTRGAESPHATVVVHHGTARVRISLELDYPSDIGGRCRAVRRQVAERVGALTGMEVHEVAVQVERLHRAPAPGAAHGRTQ

SEQ ID NO: 13960 - protein, 228 aa, Streptomyces avermitilis
VSEPQGHEGHESTQRLPVIEKTDDTDPGRSASPEAYEPGPVPAADEGARDGRFWSARRVPAGLLALIVLLGAGLLLYDVVAVRAHRPAMHWRRFLARQLAERPLDDTWVLVGAGLAAALGVWLLVLATTPGLRGFLPMRRAHPDVRAGLHRKAAALALRDRAMEVSGVQSVRVRVRRRKADVRAVSHFRELDDVRADLDATLADGVRGLGLVRPPALSVRVGRPRRKG

SEQ ID NO: 13961 - protein, 195 aa, Streptomyces avermitilis
VRTVLRTVNRVLLGLAGLILVALGGSVLAVGLGVRPPSWWIHDGRRDVLLSYAERTRWRDEGWWWPTVIAVLAVLVLLALWWLSAVLRRRRLAEVLVDTGDGEGAMLRGRALEDVLAADAEQLDGVGRAHVLLTGRRAAPEARVRLLLEPHVDPGTALHGLTTRSLAHARDSAALAALPAEVRLRAVKHRAERVS

SEQ ID NO: 13962 - protein, 251 aa, Streptomyces avermitilis
MDLGLEDRVYVVTGATRGLGNAAARELVADGAKVVVTGRDDKSVADAASALGPNAVGVAVDNADPEAPARLVAAARAHFGGFDGILISVGGPPPGFVADNTDEQWTAAFESVFLGAVRLARAAAAELAEGGVIGFVLSGSVHEPIPGLTISNGLRPGLAGFAKSLADELGPRGIRVVGLLPSRIDTDRVRELDGLSADPEATRVANESRIPLRRYGTPEEFGRAAAFLLSPAASYLTGIMLPVDGGMRHGF

SEQ ID NO: 13963 - protein, 603 aa, Streptomyces avermitilis
VHKSVESPAFSASIEDYALIGDQQSAALVARDGSIDWLCLPRFDSPACFAALLGDEHNGKWRIAPKGAGPCTRRAYRTDSLVLDSEWDTPEGTLRVTDLMPQRDSAPDLVRIVEGLRGRVTVRSAIRLRFDYGSIVPWMRRAEGHRVAVAGPDAVWLRSEPAVHTWGEDFCTHSEFTVGEGEKVAFVLTWHPSHQPRPPLVDPYESLHGSLAQWREWVSQCRYDGPFRDAVVRSLITLKALTYAPTGGIVAAPTTSLPEQLGGIRNWDYRYCWLRDSTLTLDALLSAGYHEEAADWRDWLLRAVAGDPADLQIMYGLSGERRLPEFELPWLPGFGDSVPVRIGNDAAKQLQLDVYGEVIDSLSLARCSGLPAKPHMWQVQRALMDFLCSAWRQPDEGLWEVRGGRRHFVYSKVMAWVAADRAVRTLENEPQLGGDLAGWRAMRDEVHREVCERGYDAERNTFTQFYGSRGLDASLLLIPRVGFLPPDDPRVIGTVDAVREELGRDGFVRRYSTDVAEVDGLPGDEGTFLVCSFWLADALHRLGRTEEARALFERLVGLCNDVGLLAEEYDPASDRFLGNYPQAFSHLGLVSTALALFGDQEAG

SEQ ID NO: 13964 - protein, 265 aa, Streptomyces avermitilis
VYRFLLSRQWVILTLVTLALIPTMIELGFWQLHRHEHRVALNTVIGNSLAATPVPAESLTSPGATVKHDDLYHRVTAKGTFDTAHEVVARRRTNVDGEVGFHVLTPFVLDDGKVILVNRGWIPANGVQTEFPKIPAPANGEITVTGRLMPDETTAESGIKNVQGLPARQIMLISSGQQAKALGKQVLGGYVELTSPRPKGDSPELIPAPDHSDIGPHMAYAVQWWLFAAGVPVGWVVLARRERRDRAEAAAAKETETKETAPAAV

SEQ ID NO: 13965 - protein, 77 aa, Streptomyces avermitilis
MARCEVCGNDYGMTFEVHAQGAVHVFDCFSCAIHRMAPICEHCRVQIIGQGVEVGGRWFCGAHCSRAEGRAGIVDKV

SEQ ID NO: 13966 - protein, 325 aa, Streptomyces avermitilis
MLEDRTTAATPAPWPAAYPQGYAVVDVETTGLARDDRIISAAVYRLDARGEVEDHWYTMVNPERDPGPVWIHGLTSDVLEGAPLFEDIAAEFASRLADRVLVAHNAVFDWSMIAREYARAKSQAPVRQRLCTIALSKELGLPLPNHKLESLAAHFGVVQQRAHHALDDARVLAEAFRPSLHAAARDGVRLPLLECLPLTEWNATPRIGRQPSGGYPSGSWRPSRKRPVCPYPNPGRYEEGKPLKQGMRVAFSGDTSVDRELLEDRAVEAGLHVATSLSRLTSLLVTNDPGSGTSKTAKARQYGTPVIDEAAFGQLLRDVEPASQG

SEQ ID NO: 13967 - protein, 230 aa, Streptomyces avermitilis
VPGKYVCTNMDGGGMARPALTRDEVLDSAADLVKRHGPAALTMRGLAAELGTAVTSIYWHVGNRESLLDALVERTVADLGEIRPVGRTPARRIASVARALRRQLRDHPHLVAMVHERGLTERMFLPAQQALVREAHAAGLRGARAAEVVRAVQFLVVGHVLVERNRERAPAQRPGEQELWGARTADGDPALARTLAWPVDPEKVFTASVKALVAGLLEAAPETARGPGPS

SEQ ID NO: 13968 - protein, 265 aa, Streptomyces avermitilis
MARVRYGARTDAEIAAARSASSRLPDIWSTGVVAVWETDPDAVAAVLPPPLKPTGRPLARVNISKVDLPGYRLGAGSFAVAAAHDGVEGWYPLVMPMTHERALIGGREVFGEPKKLGEVTVERDGLVVRAALARHGIAFVEVRGAVSGDLPLPEPVRKTDFYFKFLPSVDGPGFDTAPVLVHCLRNEKVRRLERITGDVVLRESMYDPVADLPVRRLVEITIGEKTTDQKGKVVEQVSAQALLPYIHQRYDDPQQLLDGPPQGSV

SEQ ID NO: 13969 - protein, 294 aa, Streptomyces avermitilis
MDLRAGQVAVVTGAASGIGLAMARRFAAEGLKVVLADVEEGALEKAASALREDGAEVHARVVDVGERDQVEALAAGTWERFGAVHVLCNNAGVGSGAEGRMWEHDPNDWKWAFAVNVWGVFHGVQAFVPRMIAGGEPGHVVNTSSGDGGIAPLPTASVYAVTKAAVVTMTESLYAHLRAEHARVGASVLFPGPHMLRTGLWESHRNRPSRYAKHKPRKTPYRSLDQWEAAMREAGREVRFTPVEEVAELVVDGIRADRFWLLPESEHSDRQIRARSRSMLERTDPSYLESFILD

SEQ ID NO: 13970 - protein, 438 aa, Streptomyces avermitilis
VVTDKDATGRDVTDQDPYLIISSDCHAGLPTEEYRPYLDSRFHRDFDEFLAGRDRRREEMTRLGIRNEAFADKWFQDNEEGLRGGWDTAQRLKELDGDGVAAEVVFPDADAVDSRTAAPFGVGLGLSGDQDPELGMAGAQAHNRWLADFVSGHPERHCGVALLPVTAEPGRVVAEVYRAKESGLGALMIPSMWVDKEPYHDRRYDPVWTAAAECGMPVLTHSGAAPRHEYGDHLGIYVSEVTWWPARPLWFLLWSGVFERHPGLRFGVAESGCWWLPNLLWFMDRLYLGAHGGKKLSPFAELTRPPHAYLDRQVFICATNTKRRELAQRYEIGVDNILWGSDFPHPEGTWPDTRAWLSKTFHDIPVGETRRMLGLAAAEVFGFDVEKLAPLARRIGPTPADLGQSDDRAAVEASWARSREVGRHWLTGHDFPALGTTP

SEQ ID NO: 13971 - protein, 409 aa, Streptomyces avermitilis
MTDDRYTVISADCHAGADLLDYRPYLAKRHHDAFDAWAATYVNPYEDLLADTADRNWNSERRLAELAADGIVAEVVFPNTIPPFFPSASLMAPAPTAAEFEQRWAGLRAHNRWLADFCAAAPGRRAGVFQILLNDVEEAVKEISWAAGAGLRGGLLLPGTPPGSGLPELYSKAYDPIWAVCEELDVPVNHHAGSASPPLGDEPAARAVFMVETTWFSHRALWHLVFGGAFRRHPGLRLVLTEQGSGWIPGVLDMLDYYHGRLVAAGPKSATAEAKFGAGLDRAMGKGPSEVWRDNCFVGASFMRPHEVPLRDRIGLDKIMWGSDYPHDEGTYPYSREGLRIAYAGLPRTEIAAMAGGNAARVYGFDLSLLDPIAAKVGPTVAELARPLEEPPADATSPVFARGGSVRVW

SEQ ID NO: 13972 - protein, 236 aa, Streptomyces avermitilis
VTEPTHDEAHGGALGSRLNWLRAAVLGANDGIVSTAGLVVGVAGATGARSALLTAGLAGLLAGSMSMAAGEYVSVSTQRDSEKAALALEKRELTEQPEAELEELTELLEERGLSRDVAREAAQQLTERDALRAHARVELGIDPDELANPWHAAWASFLAFTVGALLPLLAIVLPPADWRLPVTVLSVLAALVVTGWVSARLGAARPGRAVLRNVGGGALAMGVTYAAGALLGAAGV

SEQ ID NO: 13973 - protein, 289 aa, Streptomyces avermitilis
MPNLPDVVLWSIPAFVLLTVIEIVSVRIHPEEDAEGYETKDAATSVGMGLGSLVFDLLWKIPIVAVYTAIYELTPLRVPVLWWTVPLMLLAQDFFYYWSHRGHHVIRILWACHVVHHSSRKFNLTTALRQPWTSLTVWPFYVPLIALGVHPAALAFCSSVNLVYQFWIHTERIDKLPRAFEFVFNTPSHHRVHHASQGGYLDRNFGGILIVWDRIFGSFVPETERPVYGLTKNIATYNPLRVATHEYVAIAKDLRAARGWRERAGRVFRGPGWQPVRPAAEQPVTEPVA

SEQ ID NO: 13974 - protein, 225 aa, Streptomyces avermitilis
VRPAAARVLLGAFAFAVVADLASQALGSDTGHLLAKPLLMPLLAAYAAVRGGPRLLVVALLLGWAGDVLLLSDADPAFLAGMSSFAAGHVCYLVLFARHGRTRARGALLAGGYGLVLVTTVALLWPGLPAGLRVPVVGYSLLLTAMAYGATRLGPVAGLGGALFLLSDTLIATGVADWPQLPRPDFWIMLTYAAGQYLLVRGVTDTLGAPTAPAAAYGEVRSTTP

SEQ ID NO: 13975 - protein, 347 aa, Streptomyces avermitilis
MRATTIHAPYDMRVEDVPEPVVRQPTDAVVRVLRACICGSDLWAYRGEAARQPGQRIGHEFLGIVEETGSEVTGVRRGDLVVAPFMWSDGVCDYCREGLTTSCEHGGFWGSVGHDGGQGEAVRVPYADGTLVQLPKDAASDEHLLSALLTLSDVMGTGHHAALGAGARPGATVAVVGDGAVGLCAVLAAKRLGAERIIALGRHEVRTDIARRFGATDVVAERGEAAVEAVRELTRGQGAHCVVEAVGTEQSMRTAVDITRDGGAIGFVGVPHGSGTGLDLGVMFDRNIALRGGVAPVRAYIPELLPDILAGRIDPSPVFDRTVDLEGVPEGYKAMDERTALKVLVTN

SEQ ID NO: 13976 - protein, 350 aa, Streptomyces avermitilis
VSLIRPPAGPNGGDAAPSPVPAAAPARRLSPGRAVAVLALVAVAALIPLLGPAAALHGTGEAAAPGAGGIALLRTVLFAAVCMPAGEWFAGRLARRVPGAPLADASDAPRGWAPGSRPAPVSVAAPGAPPRSWPPGNSYRIRLAEIDVGGLYRTRDGALALLEVNAFAVAGLCALSRRPAGRVWPSAAVVVAEALRVHPTTEHSPSVGSGLTLVHLTCAVLWAGGLPHVLRTVRRWRAPGPGAALLGLYARVAAVLLAAITATGVWSSLRRMPAGTIPHQLTATAYGRTLVAKVFLVAAVAVLALWARRRLRRADDPLGACVPARAEVVALGVVVAVSALLTALPLPIRW

SEQ ID NO: 13977 - protein, 503 aa, Streptomyces avermitilis
VPCGAVSPPLVHMLIQYTLHSAVMTAVNTEFAWAALGGDPALTERVSTVVRDGALKARLPVRELARACVATCALAAAELGARRAGRADVPGVRVDDGAVATAFVSERQLRVDGRAPVTFAPLSRFWRTADGWVRTHANYPHHRERLLSALKLPEDPASVAAALAERSSREIEDAVYGAGGLAVALRTPEEWARHEQAVEVAARPLVERRRPGGGRARRPAALFGSPLLPAAGLRVLDLTRVIAGPVATRTLALLGADVLRVDSPQLPELVDQHADTGFGKRSAKVGLGTDRRTFEELLAAADVVVTGYRPGALDRFGLSPEALAERRPGLVVAQLSAWGAYGPWAERRGFDSLVQVATGIAAVEGSGRQEPGALPAQALDHGTGYLLAAAVLRSLTEQLTDGGARFVRLALARTAGWLLEGRAAGEAGNAVHAGAGAAAYAEAGAAYAGAGAAAYDGPDAWLAERDSELGRLRYALPPVSFAGGPVDWARPPSPWGTDGARWA

SEQ ID NO: 13978 - protein, 507 aa, Streptomyces avermitilis
MTAPRKRSRRAVAIPLGMATVTALAFLPNVSASAAETAAPGTVTADATSLSYVVNVRPGHGTSSVVKKAIAQAGGTIVTSYDQIGVIVVHSSNADFAKTVRRVRGVDSAGATRNAPLPAQSTTDVGTPKALTSEEVASAQAVDGQDPLEPLQWDLPAIQADKAHEKTLGSSKVTVAVIDTGVDDTHPDIAPNFDRDASVNCVTGKPDTTDGAWRPSAAESPHGTHVAGEIAGAKNGVGITGVAPGVKVAGIKVSTTGGYFYTESVVCGFVWAAEHHVDITNNSYYTDPWYFNCADDPDQKALVDAITRASRYAEKKGTVNVAAAGNESYDLAADSITDPVSPNDGTPSDRVIDPSKCYDIPTQLPGVVTVASTGAKGIKSSFSNYGLGVIDVAAPGGDSTRYQTPAPPATSGLILGPLPGGTWGYMAGTSMATPHVAGVAALIKSTHPHAPAALVKALLYAEADATPCTDPYDIDSDGKIDAVCEGTKNRNGFYGWGTVNALAAVTK

SEQ ID NO: 13979 - protein, 511 aa, Streptomyces avermitilis
MAHLRSRRRLALAVPVALSLTASLGFLPGAAAAAPLSTPASASASPADGTELAYVVNTKTDRHTIESVKRAIARADGTVVVTYDKIGVIVAHSANPDFGKQLRAVRGVQSAGATRTAPLTAAGTTDEGAAQYLTKTQAAKIAARSTASGEEPLEADQWDLRAIGADKAAKINPGSRNVTVAVIDTGVDDTHPDLAPNFSAAQSANCVGGKADTSYGAWRPANADHYHGTHVAGEIAAARNGIGVAGVAPNVKVAGIKVADPVSELFYPESVVCAFVFAADHGVEVTNNSYYVDPWLYNCMDDPDQRAIVDAVNRAQLYAQHKGTLNLASAGNSNDDLDSHALVDDSSPDDSTAVPRTVDPHKCFDVPTQLPGVVTVSATGVASTKSYYSSYGDGVIDIAAPGGDKFQLPDTPSKNGRILSTMPNNEYAFLQGTSMASPHAAGVAALLKSAHPSATPAKLQALLKAQADNPGCPTDPYDGDGDGVVDATCVGGKRVNGFYGFGIVNALRAVK

SEQ ID NO: 13980 - protein, 118 aa, Streptomyces avermitilis
VATDAPPPSKVHPRYPSTEEFVAEQESAEFGELRRSYRSFAFPLTIAFIAWYLLYVLLSNYAGGFMGTKLFGNVNVALVLGLAQFLTTFLIAWWYSRHAAAELDPKAEAIKSRMEGGA

SEQ ID NO: 13981 - protein, 549 aa, Streptomyces avermitilis
MSPAITLAADAAGPRLLAAGEASEHRPLIITLFAVFVAATLVITVWAGRQTKDAADFYAGGRQFTAFQNGLAVSGDYMSAASFLGIAGAIALFGYDGFLYSIGFLVAWLVALLLVAEPLRNSGRYTMGDVLAFRMRQRPVRTAAGTSTIVVSIFYLLAQMAGAGVLVSLLLGITSDGGKIGIVALVGVLMIVYVTIGGMKGTTWVQMVKAVLLIAGALLLTFLVLLKFNFNISDLLGKAASNSGKGSAFLEPGLKYGATSTTKLDFISLGIALVLGTAGLPHILIRFYTVPTAKAARKSVNWAIGLIGGFYLMTLALGFGAAALIKPDEIIASNKAGNTAAPLLALHLGGVDSNWGAILLATISAVAFATILAVVAGLTLASSSSFAHDIYANVIKKGQASEKDEVRAARYATIAIGVVSIGLGALARDLNVAGLVALAFAVAASANLPTILYSLFWKRFTTPGALWSIYGGLITAVGLVLFSPVVSGKPTSMFPGVDFHWFPLENPGIVSIPVGFLLGWLGTILSKEEPDTAKYAELEVRSLSGTGAH

SEQ ID NO: 13982 - protein, 343 aa, Streptomyces avermitilis
VSEECDPHRGEGARVLIDTYGRVATDLRVSLTDRCNLRCTYCMPEEGLQWLAKPDLLTDDEIVRLIDIAVTRLGITEVRFTGGEPLLRPGLVGIVERVAALASRPQTSLTTNGIGLSRTATALKAAGLDRVNVSLDTLRPDVFKTLTRRDRHKDVIAGLEAARDAGLTPVKVNTVLMPGLNADEAPDLLAWAVAHDYELRFIEQMPLDAQHGWKREGMVTAGDILASLRTRFELSEEGADERGSAPAERWLVDGGPHRVGVIASVTRPFCAACDRTRLTADGQIRTCLFATEETDLRAALRSDAPDEEIARIWRLAMWGKKAGSGLDDPSFLQPERPMSAIGG

SEQ ID NO: 13983 - protein, 80 aa, Streptomyces avermitilis
VIFNAPGAGSDPSSPMCSAKGCRAEAVWVLAWNNPKLHTPERRKTWLACEEHREHLSQFLGVRGFLKDVVRLEDWEAAQN

SEQ ID NO: 13984 - protein, 159 aa, Streptomyces avermitilis
MCSGLVPDRVRAGYGAGASPIQGGWWNVMRKQGNGGNAEVFRITGARQGLADDVRGRQRRYVISMAVRTVSVILAATLWNVERHVAVVALVLGALLPYIAVVIANAGRENAPSLPSTFVTTPMRPMIAPPRADDSAEPDPEGVSAEPGAQVRSEPHERA

SEQ ID NO: 13985 - protein, 91 aa, Streptomyces avermitilis
MGWLWAIIVGFVLGLLAKLILPGKQHSPLWLTTIMGIIGAIVGNAIAQGLGIAETKGIDWGRHGLQLAAAVVLVFLGDMLYMAMRGSKQRA

SEQ ID NO: 13986 - protein, 422 aa, Streptomyces avermitilis
VTDIVDELKWRGLVALSTDEDALRKAFADGPVTFYCGFDPTAPSLHLGNLVQILTMRRIQQAGNRPLGLVGGATGLIGDPKPNSERTLNSREVVAEWVERLRAQIAPLLDFEGPNAAIMVNNLDWTQGLSAIEFLRDVGKYFRVNKMIAKEAVSRRLNSDAGISYTEFSYQILQGMDFLELYRRYGCTLQTGGSDQWGNLTSGTDLIHRAEPDAVVHALGTPLITKADGTKFGKTESGTIWLDPEMTTPYAFYQFWLNADDRDVSKFLRIFSFKSHEEIEELEKQTEERPQARAAQRALAEELTTLVHGADQTAAVIAASKALFGQGELTELDEATLAAALSELPHVKVAEPAPVVDLFAEVALVASKSAARRTIKEGGAYVNNVKVAAEDAVPAKEDLLHGRWLVLRRGKKNLAAVEVTGG

SEQ ID NO: 13987 - protein, 464 aa, Streptomyces avermitilis
MTARTNKPHEIVERALELSRADGCVVIADEHSTANLRWAGNALTTNGVTRGRTLTVIATVDGREGTASGVVSRSAVTAQELEPLVRAAEAAARGAAPAEDAQPLVTGVPQAPDFTDAPAETSSAVFTDFAPALGESFARARAGGRELYGFANHELVSSYLGTSTGLRLRHDQPNGTLELNAKSPDRTRSAWAGRSTRDFKDVDPAALDAELAQRLAWAERRIELPAGRYETLLPPTAVADLLIYQMWSAAARDAAEGRTVFSKPGGGTRIGDKLSELPLTLRSDPNEPGLESAPFVLAHSSGDDASVFDNGLPLKATEWVSEGELRHLTTTRHSAALTGLPVAPAIGNLILEGGEDRSLEEMVAATERGLLLTCLWYIREVDPATLLLTGLTRDGVYLVENGAVVGEVNNFRFNESPVGLLGRATEAGRTEKTLPREWSDWFTRAAMPALRIPDFNMSSVSQGV

SEQ ID NO: 13988 - protein, 507 aa, Streptomyces avermitilis
VPHSIDEAFTALPLRALADAALARARALGAEHADFRFERVRSAAWRLRDAKPAGSSDTTDLGYAVRVVHGGTWGFASGVDLTMDAAARVASQAVAMAKLSAQVIKAAGSDERVELADEPVHAERTWISSYEIDPFTVPDEEKSGLLADWSGRLLAADGVSHVDASLLTVHENKFYADTAGTVTTQQRVRLHPQLTAVAVDESTGEFDSMRTIAPPAGRGWEYLTGTGWDWESELGQIPELLAEKMRAPSVEAGIYDLVVDPSNLWLTIHESIGHATELDRALGYEAAYAGTSFATFDQLGKLKYGSELMNVTGDRTAEHGLATIGYDDEGVEGQSWDLVKDGTLVGYQLDRRIAKLTGFERSNGCAYADSPGHVPVQRMANVSLQPDPAGLSTEGLIGGVDRGIYVVGDRSWSIDMQRYNFQFTGQRFFKIENGRITGQLRDVAYQATTTDFWGSMAAVGGPQTYVLGGAFNCGKAQPGQVAAVSHGCPSALFKGVNILNTTQEAGR

SEQ ID NO: 13989 - protein, 239 aa, Streptomyces avermitilis
LSRSVLVTGGNRGIGLAIARAFAEAGDKVAITYRSGEPPATLTDLGCLAVKCDITDTEQVEQAYKEIEDQHGPVEVLVANAGVTKDQLLMRMSEEDFTSVLDTNLTGTFRVVKRANRGMLRAKKGRVVLISSVVGLLGSAGQANYAASKAGLVGFARSLARELGSRNITFNVVAPGFVDTDMTKVLTEEQRKGIVGQVPLGRYAQPEEIAAAVRFLASDDASYITGAVIPVDGGLGMGH

SEQ ID NO: 13990 - protein, 255 aa, Streptomyces avermitilis
MSGILEGKRVLITGVLMESSIAFHTAKLAQEQGAEIILTAFPRPTLTERIARKLPKPTKVIELDVTNDEHLGRLADIVGEELGGLDGVVHSIGFAPQDALGGNFLNTPFESVATAMHVSAFSLKSLTMACLPLMQSGGSVVGLTFDAQYAWPQYDWMGPAKAALEATNRYLARDLGKQNVRSNLISAGPIGSMAAKSIPGFSELAAVWDSRAPLEWDLKDPEPAGRGVVALLSDWFPKTTGEIIHVDGGLHAIGA

SEQ ID NO: 13991 - protein, 175 aa, Streptomyces avermitilis
LRNRLRATARSLSYEADAPFPAPRGAGRRPFGPTGRAAGTGQHARWDYAPPRSRTAEEVPLVRLSRRFAPVILAVTLVMVLPSDAMPHARVADRKPADPQPFGAECRTSVTGSHAVAYCHNPYVDTDRVRLHIECDRWWDLDTDSAPVDTGPAMTVRLSGRCWEEIRSVWVSHEK

SEQ ID NO: 13992 - protein, 231 aa, Streptomyces avermitilis
MPLSHPRRSALSEQVIAELRNQITSGEWPVGSRIPTEPELVEQLGVARNTVREAVRALAHNGLLDIRQGSGTYVAATSELAGVMHRRFADADPRHIAELRSTLESGAAKLAARRRTERDLKQLDTLLVRREEAWESGNAEAFVTADATFHMAVVAASHNDVMTAMYADLGEVLRDWLREDVGEELTPETYMDHARLVDAIRTGDAEAAATEAAGYPFLCRPGRRKSAPADG

SEQ ID NO: 13993 - protein, 446 aa, Streptomyces avermitilis
MASEEIRTATSTPIRSSAGTGADSETPSTRAWRTRLVVVGIVLTALNLRPAITSLGALLEEVRDGLGMSGSVAGLLTSVPPLCFAVFGVMAPRLARRFGAAAVVGAGMVAITAGLVIRPYAGGTAGFLAASALALMGIAVSNVLMPVIVKRWFPDRVGSMTGLYSMALALGTSAAAAVTVPLTDALGGSWQSGLAVWAGLAAAAVLPWIPLVRARGGAGGSHGFGSSEAAGGSHGLGSSEAAAAAAPQEADGLRITRSRTAWALAVFFGLQATAAYITMGWMAQIFRDAGVAAGTAGLLLAVTMVMGVPLAFVIPRLATRLPHQGPIAVVLGACGLAGYAGLYFAPAAGAWAWALLLGVSNCAFPLALTMVGMRARTGAGVAKLSAFAQSTGYLISIPGPLLVGVLYQHSGGWGLPIALMAGLMIPQIVVGIVAGRNRTVEEEAAR

SEQ ID NO: 13994 - protein, 66 aa, Streptomyces avermitilis
VPRVPPCHDAAGRDPGGVRAGDGCETGRMPVLDPNPQNGQKKMLLVFGAFLAIFVIIGIIASIASP

SEQ ID NO: 13995 - protein, 70 aa, Streptomyces avermitilis
MSACTPTRPHPATSGGVDIRLPWWALALPALAFVALLALIINPSDASAAAGEPAITHLLERVRTVLGQAL

SEQ ID NO: 13996 - protein, 172 aa, Streptomyces avermitilis
MSVAEPRRIVLFRHAKADWPQVSDHERPLADRGRTDAAVAGRKLADTGIPVDLALCSTATRTRETWKLAVHELPHRPKTVYEERLYEASPGEIIAVLNETPDDVQNVVLIGHNPGVQGLADILAGSAEGDTRTRMADRDFPTAAFAVLSFDGPWKSLEPGVATLLDYWAPTE

SEQ ID NO: 13997 - protein, 404 aa, Streptomyces avermitilis
MSASQTSDARTLLVKIFGKDRPGLTAGLFDTLAAFSVDVVDIEQVVTRGRMVLCALVTEPPAGLEGDLRSTVHSWAESMKMQAEIISGLGDNRPRGLGRSLVTVLGHPLTAESTAAIAARITSTGGNIDRIFRLAKYPVTAVEFAVSGTETETLRTALATEAAALGVDVAVVAAGLHRRAQRLVVMDVDSTLIQDEVIELFAAHAGCEEQVAEVTAAAMRGELDFEQSLHARVALLKGLDASVIDKVRSEVRLTPGARTLIRTLKRLGFQVGVVSGGFTQVTDDLKERLGLDFAQANTLEIVDGKLTGKVTGEIVDRAGKARLLRRFAAEAGVPLAQTVAIGDGANDLDMLNAAGLGVAFNAKPVVREAAHTAVNFPFLDTVLYLLGVTREEVEAADTHDDDAG

SEQ ID NO: 13998 - protein, 671 aa, Streptomyces avermitilis
MSIETADHGRRVPWGDVLLSAIASVSWALIGMAGTAALGLHLLDADAEGSLGPMTAAVVALGAGGSVTPSGDVSAFGLKGAEATTAIQITPLGVGLVGALLLCWFFLRSLRAAGVVVAPSELLARAAAVVVLFVAMLGGLAWAGHDVITIDGERLGLGRLPGGGGSGKIDIPGLGDIGGLLPDRIGDLVKAKAAVGFSVDTVPTLLGGAVWAVGVLVIALLASRRTPLPRGWEAVHRVVRPAVSALVTVLLVAVVAGLSAAAYAAIGDDHPRRIAGAALLGAPNGVWLGIPVGLFVPWDGKASGALATLLPHPLDELLSVRSDQPVTLGRLAELDGRVWLLGVAAALMMLFAGVLTAARTPFVRGPGAASRPRKGRADVRGGSAASGPVPGTAAVRGGGALGFAGHCALRLGVVTALALPLLVWLTDVSVDASLSVLGFDAFGAGIRLHGHLGMALVLGAVWGAGAGAAGALLAYVSGAAGRRAAPLALGDVGAPGPVGPQRTDVSLGTDVPQRTDVPQRTESPKHAGPYAPSRPYRPANPDTNPYLRVPEELRAAEGRRAPEDGRAPEARRPAGGAAPGDRDVRPGDRDVRRPEGAAPSQGVRPPDDVYGAPTVIGPITPPPRSPGRRSRPAAPGASPEEGPPPPPPPPPPPPPPPPGRPQGGGGRGGRG

SEQ ID NO: 13999 - protein, 843 aa, Streptomyces avermitilis
VPELVLELNGRTWTLDASRPYTLGRDPQGDITLDDARVSWRHATISWNGRSWVIEDHGSTNGTFVQGQRIHQMEIGPGSAVHLGNATDGPRLNLSGAAAAVAAPQQAQPQQQPYVAKGASPGWAQQAPPQQQAPQQQAPQQGWQQPQQSAAVPQQQGPGGGAGAPPVYGDRSPTTFHQFSLGRVMRIGRALENELVVSDLQVSRNHAEFHATPDGRFEIRDLGSHNGTYVNGMPIAKGGSALLGPNDIVGVGHSTFRLIGDRLEEFVDTGEVSFSARHLTVTVDGGKQILKDVSFGVPEKSLIAVIGPSGSGKSTLLKALTGYRPANQGDVLYDNRNLYKQFAELRQRIGLVPQDDILHKELTVKKALKYAAKLRFPADTTGQEREARIDEVLRELKLDIHKEKKVTSLSGGQRKRVSVALELLTKPSLIFLDEPTSGLDPGMDRDVMQLLRGLADDGRTVLVVTHSVAELAICDKLLVMAPGGSVAYFGPPEEALNFFGYDTWADVFSAFENYRDYDWAGRWKGSQHYQMYAADIDAVAPQSVHMPPPQQMRPPKPQGWGSQLMTLIRRYVSVIVSDKGFLALTVILPAVLGAVSLLIDSDKGLLVNPANPKTGVHIPNGTATTVLLILAVGACFAGAANSVRELIKERVIYERERATGLSRSAYLMSKVIVLGTITVLQGAMVGAIGFSSREIPDKGLVLGNAVLLELSIPIMALGFTSMMFGLIISSLVKTAEKTMPLLVMFAIIQVVFTGCLFTLHGAVGVNEFSYLMPSRWAVAAAGTTLDFNNIAPNTDDPTSTDPLWDHAAGAWTMDMAALIVLGVICGFFVARFLRRHEPEVMRK

SEQ ID NO: 14000 - protein, 247 aa, Streptomyces avermitilis
MPKNINTPGHRPKLTKTHKLSVAGVAALGAAALAFSAVPSSAQTPTQETAAVSSAPVVYSQEQIKDVKASITDQLAGATVKAEAIAAKKQAADAAAAKKLAAVAAAKKQAVAKAAQVRKAKAAASRSAQRVEVKPVAAKTYANNLDGWIHESLDIMAKHKIPGSYNGLYRNIMRESSGNPKAINGWDVNAINGIPSKGLLQVIPPTFNAYHVPGTSWNIYDPVANITAAANYAADKYGSMDNVNSAY

SEQ ID NO: 14001 - protein, 410 aa, Streptomyces avermitilis
MGVPPVGRGRAWGKVPEELSARVPAEQRGPGLDRDSVRLLVSRGTEVSHHDFVELPRQLRAGDLLVVNTSPTLAAAVDGRIGHARVVVHFSTRGEDGRWAVELRDPDGRGTTRARTGGPAGTEVRLPDGVRLVLEEPLAGRSERLWWARVSAPGDADVTVLLRGHGRPIRYSYTERDQPLSVYQTVFALPSADGAGSAEMPSAARPFTARLVAELVSRGVQFAPITLHTGVASAEAHEPPYPERFAVPEASARLINAARAHRTPREASSSRGGDGSREGGRVIAVGTTAVRAVESATGTDGVVRPAEGWTDLVVTPERGVRAVDGLLTGLHEPEASHLLMLEALAGRTAIDRSYEEALAGLYLWHEFGDLHLILPDGESSHSALLPQPNVRLPLGRCDPAHRAHITYEEG

SEQ ID NO: 14002 - protein, 234 aa, Streptomyces avermitilis
MPVAIITGASKGLGRALGAALAERGWDLVLDARTGEVLEETAAALSAYGTRVRALPGDVTDAGHRAGLVTAARELGGLDLLVNNASALGAEPLVRLEALTLEGLRHALEVNVVAALGLIQEALPLLRASRAGTVIDISSDAAAEAYETWGGYGASKAALDHLSAVLGEEEPGLRVWAVDPGDMGTDLYTAAVPDDDDPRPAPASVVPAFIGLLDERPASGRYGASALSALPAGR

SEQ ID NO: 14003 - protein, 381 aa, Streptomyces avermitilis
MSHGPRSGLSAVSSALLAMSRHLEVRDVLKTIVASARELLDAEYAALGVPDDHGGFAQFVVDGVSDAQWKAIGPLPRQHGILAAMLHEAKPERLADVREDPRFEGWPAAHPDMSDFLGLPIRDGDEIIGALFLANKRCPKPEGGCGFTPEDEELLTILAQHAAIALTNARLYERSRELTIAEERSRLAHELHDAVSQKLFSLRLTAQAAAALVDRDPSRAKGELQQVAALAAEAADELRAAVVELRPAALDEDGLVATLRTHIQVLDRAHTARVTFDSRGVRALPAAQEEAMLRVAQEALHNALRHSGGSRVDVTLVKRGPGVVLRVTDDGSGFDPASTRRAGRHLGLVSMRDRTSGVGGTLTVDSAPGKGTTIDMEVPGG

SEQ ID NO: 14004 - protein, 213 aa, Streptomyces avermitilis
VADAIKVLLVDDHQVVRRGLRTFLEVQDDIEVVGEASDGAEGVARAEELKPDVVLMDVKMPGMDGIDALRRLRELANPARVLIVTSFTEQRTVVPALRAGAAGYVYKDVDPDALAGAIRSVHAGHILLQPEVAGALLSQEEANSGQGRGGSLTEREREVLGLIADGRSNREIARALVLSEKTVKTHVSNILMKLDLADRTQAALWAVRHGAAG

SEQ ID NO: 14005 - protein, 81 aa, Streptomyces avermitilis
VKNLKKVAAVTMVAGGLVAAGAGMASATDGAWAGGKAVGSPGVGSGNVVQAPVHIPVNAVGNTVNVIGALNPAFGNLGVNH

SEQ ID NO: 14006 - protein, 262 aa, Streptomyces avermitilis
MLSEPRSGRLAAWGNALLAGFVSPDDAVLAIVGEDAVHRVEGLPGESGPVGLTLALGRMRALGVTGLRVALPAPGHPLGLSGPPEFNARALDAEEAAICFGAALGLVPEVYEAGPDGDVHVEVVWHCLAVREAPPADVPSLGEAERELAEALREATEVLSRLDVAGSGPVAEAAVDAYRARAERGREVLAPGYPPRAVRVLELAQRVGLLISVAYENGHGGAVSASEIAARSLALRPVERTARRAQVAAYNAFVEERERGVR

SEQ ID NO: 14007 - protein, 263 aa, Streptomyces avermitilis
MSDVLELEDVSVVREGRALVDQVSWSVKEGERWVILGPNGAGKTTLLNLASSYLFPSSGTATILGETLGQVDVFELRPRIGVAGIAMAEKLPKRQTVLQTVLTAAYGMTAGWQEEYEDIDEQRARAFLDRLGMSDYLDRRFGTLSEGERKRTLIARALMTDPELLLLDEPAAGLDLGGREDLVRRLGRLARDPVAPSMIMVTHHVEEIAPGFTHVLMIRQGKVLAAGPLELELTSRNLSLCFGLPLVVEQIGDRWTAQGLPLS

SEQ ID NO: 14008 - protein, 143 aa, Streptomyces avermitilis
VNDIEAWVWWLVGAVALGIPLVVTAMPEFGMLALGAAAAAVTAGVGGGVVLQVLVFAVVSVALLAVVRPIAARHRAQRPQLATGIDALKGKQAVVLERVDGAGGRIKLAGEVWSARSLDSGRAYEVGQEVDVVDIEGATAIVI

SEQ ID NO: 14009 - protein, 316 aa, Streptomyces avermitilis
MEPIIIVLIILVVLVFIALIKTIQVIPQASAAIVERFGRYTRTLNAGLNIVVPFIDSIRNRIDLREQVVPFPPQPVITQDNLVVNIDTVIYYQVTDARAATYEVASYIQAIEQLTVTTLRNIIGGMDLERTLTSREEINAALRGVLDEATGKWGIRVNRVELKAIEPPTSIQDSMEKQMRADRDKRAAILTAEGTRQAAILTAEGEKQSQILRAEGEAKAAALRAEGEAQAIRTVFESIHAGDADQKLLAYQYLQMLPKIAEGDANKLWIVPSEIGDALKGLSGAMGNFGPMGGGSGSGNSGGSGSERREKPPITD

SEQ ID NO: 14010 - protein, 168 aa, Streptomyces avermitilis
MRDTLVLNASFEPLSTVTLNRAVILVLQDKAVVEQAHPELRMRGAALDIPVPRVIRLCRYVRVPFRRQAPWSRRGVLVRDRHRCAYCGRRATTVDHVVPRAQGGQDSWLNTVASCAEDNHRKAARTPEQAGMPLLRQPFEPTPADAMLLALGQDDFESLPEWLAQPAA

SEQ ID NO: 14011 - protein, 179 aa, Streptomyces avermitilis
VTELKRPPLPHDFHPPVPSFTVTSEDVEPGATLKDAQVYAAGNTSPQLRWEGFPPETKSFAVTCYDPDAPTGSGFWHWVAFDIPASVTELPTGAGSGKFEGLPDSAIQVRNDYGSKDFGGAAPPPGDGPHRYVFTVYAVDQEKLGPDADASPAVVGFNLRFHALARAQLIGEYEVPAED

SEQ ID NO: 14012 - protein, 261 aa, Streptomyces avermitilis
MGFKRLLASLGAGGASVETVLTEVNVVPGGVVQGEVRIQGGSVNQAIEGLSVGLQAKVEVEGHDDQEYKQDIEFAKLSLGGAFELQAGAVHAVPFGLEIPWETPITMIDGQALRGMNIGVTTELEIARAVDSGDLDPVNVHPLPAQKAILDAFVQLGFRFKNADMERGHIRGTRQRLPFYQEIEFFPPSQYRGLNQVELSFVADDREMDVILEMDKKPGLFSEGSDSYRSFQVGLNDFQGTDWTAYLHQWLSEVGSKRSWF

SEQ ID NO: 14013 - protein, 213 aa, Streptomyces avermitilis
MIAAPDRTPLTREFFARPVLDVAPDLLGRVLVRTTPDGPIELRVTEVEAYDGPSDPGSHAYRGRTARNGVMFGPPGHVYVYFTYGMWHCMNLVCGPEGRASAVLLRAGEIIEGAELARTRRLSARNDKELAKGPARLATALEVDRALDGTDACAPEGGPLTLLSGTPVPPDQVRNGPRTGVSGDGGVHPWRFWIDNDPTVSPYRAHTPRRRRT

SEQ ID NO: 14014 - protein, 463 aa, Streptomyces avermitilis
MSDRSATSAAGTVVTAAATAGARAGTTTALAPATAVVTAGVTTAVMVTGAEIAVVTAAETGVVSAVTIAAMTVVGMTAAADPAASGAGTTGAMTGVTTAVATVAETVVASVATTTVVAAASAEGTTATVVDARRSAATTAPPDRAAMTGVLDRVATTALLDRVATTALLDRAATTATVIVGSAATVIAPRSVAMTTVVASVAMTDVMATVAASPVAMTVVGMTVAADPAASGAGTTGAMTGVTTAVATEAETVVASVATTTVVVATGTVDSVATVTVRPSVAMTTVAASAVTIVVATTVAIVAASAAMTGVTTVAATVVASVAMTAVTTVAETVVASVATTTAVAIAVVTVVGSVVMTGVMTAAATVAETVVGSGVMTGVMTVAAIVGASVGVMTAVRVARVVMTVAAAPAASGAGTTGRATTGAVAAGSATSGTATVSRSSGCRSRTTSRARRSTRTYGRSC

SEQ ID NO: 14015 - protein, 258 aa, Streptomyces avermitilis
MVARLIDEDPESAYGYSKVALRLASRVAAVREAAGFAAYANQKYSEALGEFRAARRMTGGVELWPVMADCERGLGRPEKALEMAGAPEVHKLDKADQVEMRLVAAGARRDMGQLDAAIVTLQSPELASNSVQPWTARLRYAYADALLAAGRESEAREWFAKAAESDKDGSTDASDRLAEMDGVEFVDALVEDEESDEGTRGETEAPVAAAEGDADADVDEEQVDVVREVVEAGVEDGDGHGDDKSDNNDNNDGDGDKS

SEQ ID NO: 14016 - protein, 430 aa, Streptomyces avermitilis
MNYAGPAEETPARSGLDLTPFRGLRYDPDRVGSLAAVTSPPYDVVVRPDGLLHLESADPYNIVRLILPQAVTPTARNEQAADTLEHWLTKGVLTTDSEPGLYVYEQSDGSMLQRGIIGALRLSEPSDGVVLPHEDVMPHVIADRAALMRATSANLEPLLLTYRGNGSEAGTTAVIERTVESTPLLSTTTEDGFSHRLWAVTDPAELAEIQTDLGSHQALIADGHHRWATYLRLRAEHPSPSPWDYGLVLLVDTARYPLRVRAIHRLLHRLPVADALAALTGLFRVRRLDLPLADALAALADSACAGNAFLLAGDGAFHLVDHPSPDLLARTIPADHPEAWRTLDATVLHATLLDHVWNIPEDSPTDIAYIHDTAATVEKAERDGGTAVLLHPVREEVVRDLARQGVTMPRKSTSFGPKPASGLVLRALTV

SEQ ID NO: 14017 - protein, 342 aa, Streptomyces avermitilis
MSQTVRTRPEGSTQALSEAYDTALLDLDGVVYAGGNAIAHAVESLGTARAGGMHLAYVTNNALRTPDAVADHLTELGIPTGPSDVITSAQAVARLISEQVPAGARVLVIGGEGLRVALRERGLEPVDSAEDDPAAVVQGYGGPELPWGRFAEASYAIARGVPWFASNTDLTIPSARGIAPGNGAAVEVVRIATGAEPQVAGKPLPPMHRETILRTGAERPLVVGDRLDTDIEGAFNGEVDSLLVLTGVTDGAQLLAAPPRHRPTYVDADLRGLLTGQPEVVEAGDGFRCGGWTATAGSERLELAGEGEAMDGLRALCAAAWTAAGEGSCELDGGKALARLGL

SEQ ID NO: 14018 - protein, 347 aa, Streptomyces avermitilis
VLVDSPPEQRAETAPAPPTRRAIRAVGLLVSVVILVLVALASIAIGAKELPLDQVWHGLFHDSGTYADVVVGERRSRTVLGLLVGAALGLSGAVLQALTRNPLADPGLLGINAGASAAVVTAITYFGVTTLSGYVWFAFFGAAAVGALVWFLGGSRGATPVRLALAGTAISAALYGYLQAVMIMDDAALGKMRFWTVGSLASATDSMIMQVLPFLVIGTVLALALARPLNAMAMGDDTARALGANLNRTRALSMAAATVLCGAATAACGPIVFVGLMVPHVVRSFTGPDLRWILPYATVLSPVLLLGADVVGRIVARPAELQVGIVTAIIGGPVFIYLVRRRRTAQL

SEQ ID NO: 14019 - protein, 352 aa, Streptomyces avermitilis
VKTTRKPALPTRTVRTPGGLSLRLDVRAVTVVVLLLVAALAASVVLIGTGDFPIPAADVLRTLVGNGNAGQEFIVNELRLPRVLVGLLVGASLGLGGALFQSISRNPLGSPDVLGVGQGSTAGALVMIVLFSGSAAQVALGALVGGLATGLAIYLLAWKRGVHGYRLVLVGIGISAMVTAVNGYLMTKADIVDAARAVVWMTGSLNGRGWEQVWPLVWLCAVLVPLVLANARGLRMTEMGDDVSYALGVRVERVRLLLLLSAVLLTAGATAAAGPVGFVALTAPQLARRLTRSPGPNLIPSMCMGATLLIVADWASQRAFGADQLPVGVVTGVLGGVYLLWLLVTERKAGRI

SEQ ID NO: 14020 - protein, 295 aa, Streptomyces avermitilis
MSGRANKNTRRSTVNRLSADNVTLAYDQRVIAEQLSVEIPDNSFTVIVGPNACGKSTLLRALSRMLKPAEGRVLLDGQVIQSMPAKKVARTLGLLPQSSIAPDGITVGDLVGRGRYPHQGLLRQWSSEDERVVRESMESTGVAELADRYVDELSGGQRQRVWIAMALAQQTPLLLLDEPTTYLDIQHQIDVLDLCAELHEEQGRTLVAVLHDLNHAARYATHLIALRDGRAVAEGAPNDIVTAELVEEVFGLRCQVIDDPETGTPLVVPAARRARVAAAAAGPAAEAATVATGGS

SEQ ID NO: 14021 - protein, 115 aa, Streptomyces avermitilis
MATIEECRAALDKLSDNMAASEGEVRGAAALDRSLSCRITDLDITFAGRLKDGRIEVVDTYEGPPREKAQIRLTMTGDDLVAMVDGELNFAKAWGSGRVKLEAGLRDLLRLRSLL

SEQ ID NO: 14022 - protein, 101 aa, Streptomyces avermitilis
MSDSVSEAEVPPQASATEPAREAAAPEDDPAAPAPLYVARTSTGNAEVDAQLDRLADADHLATDGHVEVYEDVHRGLRDALTALDARPGPPAPPTSYDRRS

SEQ ID NO: 14023 - protein, 271 aa, Streptomyces avermitilis
VAGVARRRLDAELVRRKLARSREHAGQLIAAGRVTVGKTLATKSATQVETAAAILVTQDDSDPDYVSRGGHKLAGALAAFVPQGLTVEGRRALDAGASTGGFTDVLLRAGVAHVVAVDVGYGQLAWSLQSDERVTVKDRTNVRELTLEAIDGEPVDLVVGDLSFIPLGLVLPALVRCTAPGADLVMMVKPQFEVGKERLGSGGVVRSPELRAEAVRGVAGRAWELGLGVKGVTASPLPGPSGNVEYFLWLRAGAAELDPADVDRAVAEGPR

SEQ ID NO: 14024 - protein, 301 aa, Streptomyces avermitilis
LTQTRARTVFLLAHTGRPAAIRSAELVVQGLLRSGLGVRVLEAEAADLPLPDEVELVKEATPQCLDGCELLIVLGGDGTLLRGAEFARASGVPMLGVNLGRVGFLAEAERDDLDKVVDRVVTKAYEVEERMTVDVVVHKNGDIVHTDWALNEAAVQKVSAERLLEVVLEIDGRPVTGFGCDGIVCATPTGSTAYAFSAGGPVVWPEVEALLMVPISAHALFAKPLVTSPNSVLAVEVQPDTPHGVLWCDGRRTVELPQGARVEVRRGAVPVRLARLHHASFTDRLVAKFALPVAGWRGAPH

SEQ ID NO: 14025 - protein, 507 aa, Streptomyces avermitilis
VRRRRWREHDPEPCHPRGWPAERPRRWGFPQPGAGAAPLSALGRSPWRKIHSSRQPGPMTTGLARAALRAHRPAFAGTAVAALFASTVVSAATSVLLATSADGLPARARAQLAESEVGGMAAVLLIGSIYMSIFVIASTMGTAVAQQYRELAMVRAIGARPRQVRRAVAGQALAASVPAALLGCLLGGFLARAWCAGMKEHGLLPREVVFHPAWLALPVCLGVAVVTSTLAALLSSLRFSLLRPARALAEAAAGRRHLGVLRAPLGLTALAGACALSVLLSHQPAEKAGQGAFLVLILCCAGVGLLGPRIVGPAARLVSALVGRLGPSARLAMLNVRSQPRRFSAAVVPLVLVVGFGLTKIALHTTAEHRTGSPGSPGEVWLDYAGTALYAGFAAIAAANTLCMISFERRRDIALLRVIGTQTRQIRAMAAWEAVVVAGTALLLGAAIALGTLAPILDTAFGSPVPYVPWTVLAGIGAGTLLLTLSATGLPVRAVMRRRAITVVGAA

SEQ ID NO: 14026 - protein, 578 aa, Streptomyces avermitilis
VSVLEEMRIRSLGVIDDAVVELSPGFTAVTGETGAGKTMVVTSLGLLLGGRADPALVRIGAKNAVVEGRITVPTGGSAVVRAEEAGAELDDGALLISRTVSAEGRSRAHLGGRSVPVGVLAELADELVAVHGQTDQQGLLKLSRQRQALDRYAGDAVAAPLAKYAGAYRRLRAISAELEEITTRARERAQEADMLRFGLDEIAAVEPRAGEDVELAAEAERLGHAEALASAATAAHAALAGNPEDPEGIDAATLVAGAHRALDAVRSHDAALGALAGRIGEIGILLGDVAGELAGYADDLDADPLRLAAVEERRAALTQLTRKYGQDIDGVLDWAEQSAARLTELDGDDERIGELTAERDALRTELGGLAQALTDARTEAAERFAAAVTAELASLAMPHARVSFDIRQTEDPEGAEVGGRTVAYGPAGVDEVELLLAPHPGAPPRPIAKGASGGELSRVMLAVEVVFAGTDPVPTYLFDEVDAGVGGKAAVEIGRRLARLAKSAQVVVVTHLPQVAAFADRQLLVEKTNDGTVTRSGVKVLEGEDRIRELSRMLAGQEDSQTARAHAEELLATARADG

SEQ ID NO: 14027 - protein, 299 aa, Streptomyces avermitilis
VTAGADGYRAACQLGRTGERSARRLGRRTGGGPREGPRISVPRVVHMITRRGGSFGLAAAATRAGIAALRANAPGGRGRWERQNYAGRTVELYAGPAAVAGAALGAGRVRPAAGFVVLAAGACGAYDDVAGAGDPRRGFREHLAALRKGEVTSGAVKLFGISAAGLVAGALLEERLPDKALAGVVIAGTAHFVNLVDVRPGRAAGAVLALGAPGLLRQGAAGELAAAAMGAAAAVLPDDLGERAMIGDSGAHALGAALGAAIVAGNGRAGLLAHAAALVAATVYGERVSELARSIGARK

SEQ ID NO: 14028 - protein, 390 aa, Streptomyces avermitilis
VTVRRRTRSPGHVSLVSSHSPHGQSPLRTVQVLGGGSAGSSAHVRSLASGLVARGVRVTVCAPAEADRTYDFAGVGAEHVPVPRSGDPASVAALRAACADADLVHAHGLHASLRAALALSGRRTPLVVTWHTRAEAEGTRAHLLRLLERRVAKAAAVVLGTSSDLVDRARSRGARDARLAAVALPVLRKPVDRDDPDRLRPKARAELGATGRPLLMSVGSLDRQRGYEVLLDAARAWRRLEPVPLLVIAGEGPLRTVLQRRIEDEELPVRLVGRRDDVGELLAAADLALLTSSWESRSVLAQEALHARVPLVATAVGGIPELVGDAAELVPYGDAEALAVAVVRLLDDPGRRELLGEKGVRQAAGWPTEDETVTQVLSVYDELTQPTPLP

SEQ ID NO: 14029 - protein, 549 aa, Streptomyces avermitilis
MDSRSDSRFDSQNTQGAGITVQRALELPGLRSGLPEVLAGADRLHRTVRWVHAGEVPNIASLLKGGELLLTTGYGLGTRPADQRAFVRTLAERGIAALVVELGPRFTRLPAALVETARTAGLPLVQLHREVPFVTVTEEVHTEIVNGHYALLQRAEEVHRRCTEALLGGGGVPQVLRILADFSGNPVFLETADGRLLYAAGAGPADTDPLQVWEGLRGQHKDAPPAGTTIVDVPGGGPGAGSVRARLVLLPVGNPVAPVHRIAAERAAGSLAVVLMQARQEEELAARGRGDFLTDLAEGRIDAADAPAQARVLGFKPGAGPLLPVVMRLADGLSPGGGWAVLARAVAEELASIGVPVLLGVRPVEGRVPLLLGLRSESERSAVADRVAAALRAGVERAGMQRPGAQPPVVVVGVAGGWAAASAGLRHAAQTATAAQGLSDRPWYDARRLDIDLLLWRLRDDPDLAAFVDRAIGPLRDHDNRSKPPLLPTLQTYLAHAGRKAETARELHLNRQTLYNRLARIGELLGTDLDDPQTVLALSLALRARRHVP

SEQ ID NO: 14030 - protein, 608 aa, Streptomyces avermitilis
VAVRLELHVAGRIEDYALIGDMQIAALVCQDGTVDWLCLPRFDSHAVFAGLLGTEEHGFWRLGPAHASDAEPPRASRRTYRGDSLILESEWDTPRGTVRVTDFMPPRDGAPQLIRIVEGVTGRVPMRSALRMRFSYGRVVPWVHRHEGRTVAVAGPDSVWFDTACETYGKGLTTYADFTVAPGDRIAFAISWEPSHKQPPALPEPEQALEATEEFWREWVEHCTYHGPYREAVVRSLITLKALTYAPTGGIVAAPTTSLPEHVGGVRNWDYRYTWLRDAAITLSSLLRTGYREEARAWREWLLRAVAGDPENLQIMYGIAGERELGEAELDWLPGYESSAPVRVGNGAAHQLQLDVYGEVIEALHLAHMTGLARNDYASLLQLKLIRYLEKHWDEPDEGIWEVRGPRRHFVHSKVMAWVAVDRTIKLIESGDADGPLEKWRELRDDIHRDVCERGYDKERNTFTQSYGSKELDASLLLIPQMGFLPPDDKRVIGTIEAIQRELSTPDGFILRYPTSGEEEGVDGLPGDEGAFLACSFWMADDLAMIGRVDEARKLFEKLLALRNDLGLLAEEWDPTLQRQVGNFPQAFSHVPLIDTALRLTASGAYGG

SEQ ID NO: 14031 - protein, 549 aa, Streptomyces avermitilis
MPPKSTTTKHIFVTGGVASSLGKGLTASSLGMLLKARGLRVVMQKLDPYLNVDPGTMNPFQHGEVFVTNDGAETDLDIGHYERFLDRDLDGSANVTTGQVYSTVIAKERRGEYLGDTVQVIPHITNEIKHRIRRMATDEVDVVITEVGGTVGDIESLPFLETVRQVRHEVGRDNVFVVHISLLPYIGPSGELKTKPTQHSVAALRNIGIQPDAIVLRCDREVPTAIKRKISLMCDVDEAAVVACPDARSIYDIPKTVHGEGLDAYVVRKLDLPFRDVDWTTWDDLLDRVHKPDHEINLALVGKYIDLPDAYLSVTEALRAGGFANRARVKIKWVTSDDCKTPAGAAGQLGDVDAICIPGGFGDRGVSGKVGAIQYAREHRIPLLGLCLGLQCIVIEAARNLADIPDANSTEFDSATGHPVISTMAEQLDIVAGEGDMGGTMRLGMYPAKLAEGSIVREVYDGKEYVEERHRHRYEVNNAYRAELEKKAGLQFSGTSPDGKLVEYVEYPREVHPYLVATQAHPELRSRPTRPHPLFAGLVKAAVERKTGK

SEQ ID NO: 14032 - protein, 231 aa, Streptomyces avermitilis
LPGCVSFGTRAPAFVRAWEEQGDMTIKDTPEEWEVRATETPFKGNKTSVRTDDVVMPDGSVARRDYQVHPGSVAVVAVDDEGRVLVIRQYRHPVRHKLWEIPAGLLDIPGENPLHAAQRELYEEAHVKAEDWRVLVDLYTTPGGCDEAVRIFLARDLSEAEGRRFEVEDEEADMELSRVPVDELLRGVLAGDLHNNCLVTGVLSLIAAQNGEGLDALRPADAPWPARPFEA

SEQ ID NO: 14033 - protein, 693 aa, Streptomyces avermitilis
VTDQAVDTGGSQLPGNEQRPAAAPAPTVSQFLGRTRELKELRADIERAGLDTLSGRKAPRARVLLIAGRPGSGRTALAEELVRQVADRYRDGVLRARLTEPDGTPVPTERTARELLAALEVATPPGAAEDDLTEALREALADRRTLLLLDDVAAAEQVDALLPGTPDCLVVAVSEGPLTGIADVRPCTLGGLDTKSALELLGRLTGAVRITVDPRAAEGLVEECAGQPLALVLAGSWLAARPQAAVADLAKQLRSEGDEGPPTARLFRLAYAGLPATAQRILRLLSLAPAGLVDPHTASALAGCSVSAAHTTLDDFAALGLVRLLESPLPQYEVPGSLLPLLRALAESRERPAELQLARARMLERTVRLLQSCRAITETDSIEAREKLLGMPRTLRFPNPRAAADWLRVRQPALLAAARSAVADGELDTLARRLMSQLVRAMVAHFGTQASAPELYGIHRLVLDVAERRNLPREQAAALLNLADLDTRTGRTTEALARYRAALDAGREANDPYATGRAMESVGGAHQELGDYDRAADWYGRALAQRLARDERVDAARLYGRIATAHTYAGRYGEALRNWRSAVAGHRKNGDVAAQARALSELARVQEYAGRPEESLRTCQEAVEWARRADDVRLQAALQLRLADTLEHLGDPAAAKLHRGAAERMLGEELLESDSGAEQAPNACEIRSASSKD

SEQ ID NO: 14034 - protein, 371 aa, Streptomyces avermitilis
VKVGIPREVKNNEFRVAITPAGVHELVRYGHQVFIEQNAGVGSSITDDEYVSAGAQILPTADEVWAIADLLLKVKEPIAEEYHRLRKDQTLFTYLHLAASQECTDALLESGTTAIAYETVELPSRALPLLAPMSEVAGRLAPQVGAYHLMRANGGRGVLPGGVPGVLPAKAVVIGGGVSGWNAAQIAIGMGFQVTLLDRDINKLKEADKIFGTKIQTVVSNAFELEKACLEADLVIGAVLIPGAKAPKLVTNELVSRMKPGSVLVDIAIDQGGCFEDSRPTTHAEPTFRVHNSVFYCVANMPGAVPNTSTYALTNATLPYILELANRGWAEALRRDPALAKGLNTHDGKVVYREVAESLGLEYVEIESLLG

SEQ ID NO: 14035 - protein, 346 aa, Streptomyces avermitilis
MTQTAHPSMDGHHVNAMAGNGSGENRTHFADYDELPEGHFYDPDAEYEPDPEYAATLAPDAARQRRERVGPTGRPLPYFPIPGPLTDHGPAKIIAMCNQKGGVGKTTSTINLGAALAEYGRRVLLVDFDPQGALSVGLGVNPMELDLTVYNLLMERGMAADEVLLKTAVPNMDLLPSNIDLSAAEVQLVSEVARESTLQRALKPLMADYDYIVIDCQPSLGLLTVNALTAAHKVIVPLECEFFALRGVALLTETIEKVQERLNPELELDGILATMYDSRTVHSREVLARVVEAFDDHVYHTVIGRTVRFPETTVAGEPITTYASNSVGAAAYRQLAREVLARCHAE

SEQ ID NO: 14036 - protein, 194 aa, Streptomyces avermitilis
VSRRVSLPGADELFRTTGGMGLQASTPRRQANGEARVPAPAGESDAAAAAENTPVSVPVQGGDGEGDEHVAADTAEAEAGESRTRSGGAERSGRRQPPQEGSASPSSQPQAQPRKRGRSGGRRPSGRERHDEKITVYVSAEELMDLEHARLVLRGEHGLAVDRGRIVREAVAVVLADLESRGDASILVRRLRGR

SEQ ID NO: 14037 - protein, 263 aa, Streptomyces avermitilis
VRLANFEGPFDLLLQLISKHKLDVTEVALSKVTDEFMAHIRAMGPDWDLDQTTEFLVVAATLLDLKAARLLPTAEVEDEADLALLEARDLLFARLLQYRAYKQIADIFNRRVEEEARRYPRTVGLEPHHAELLPEVVISIGAEGFAKLAVKAMQPKPRPQVYVDHIHAPLVSVQEQAGIVVARLRELGEASFRTLVEDTDDTLTVVARFLALLELYREKAVALDQETALGDLMVRWTGGEDGEQPKVTDEFDRPPQEAKEDQA

SEQ ID NO: 14038 - protein, 216 aa, Streptomyces avermitilis
VSEEITEVAADLDSVAGLDLKPALEAVLMVVDEPATVEHLAKILERPKRQIADALRELADEYTGQGRGFELRLIAGGWRFYTRPKYATAVERFVLDGQQARLTQAALETLAVVAYRQPVSRSRVSAVRGVNCDGVMRTLLQRGLVEEAGAEPETGAILYRTTNYFLERMGLRGLDELPELAPFLPEADAIEAETQEGVPSFDPDAPETDDPTTTEL

SEQ ID NO: 14039 - protein, 356 aa, Streptomyces avermitilis
MRSSGSGKSGGRGNYRGAGNDRDQKQGQGQGRPSKPRPEERRYDVGPGATQDGPKAGRGNAARGGAKGGPKQSRQRGGRTEPARSREYETRAEERNRDRYAGKPEVKTPKTFPGAEQEGERLQKVLARAGYGSRRSCEELIEQARVEVNGEIVLEQGLRVDPEKDEIKVDGLTVATQSYQFFSLNKPAGVVSTMEDTEGRQCLGDYVTNRETRLFHVGRLDTETEGVILLTNHGELAHRLTHPKYGVKKVYLAHIVGPIPRDLGKRLKDGIQLEDGYAKADHFRVVEQTGKNYLVEVTLHEGRKHIVRRMLAEAGFPVDKLVRVAFGPITLGDQKSGWLRRLSNTEVGMLMGEVDL

SEQ ID NO: 14040 - protein, 253 aa, Streptomyces avermitilis
MCASENTPRAPGGRAPEGYDKHAFEPFAVTVDLAVLTIRAGVLQVLLVERGQEPYAGRWALPGGFVLPHESAEAAARRELAEETGLADLTGLHLEQLRTYSEPDRDPRMRVVSVAYTALLPDPPEPHGGGDAAQAQWLRYNALGPLAFDHDRILADAHERVGAKLEYTCLATSFCPPEFTLGELQQVYETVWGTALDRPNFRRKVLATPGFVEQIPGAARLTGGRGKPAALYRAGGATTLHPPLLRPTSEGRP

SEQ ID NO: 14041 - protein, 340 aa, Streptomyces avermitilis
MTTTTLTKRAATGSLLGLALGDALGFPTEFNDVPSILAKCGPWREMELPSPAIVTDDTQMTLALGRGLRSAMDRGLLEPQRMERPVREEFVAWYESPENNRAPGRTCLVACNLLKTEGRPWQLASQIGSKGCGANMRVAPVGLVRGLSDEQRAGAAQLQAALTHGHPTALAASDLTAHAVRLLVQGVEPTGLVGLLRSYAYENRTRYHRRWLGDLWTFSQDPTPEHFIARGWDECLEILGRLQQAVCTVSPEVDPCLATGEGWIAEEALATGLLCFLLFPEEPLTALRRAACTSGDSDSIACLTGAFAGAHLGVDAWPTEWADRIEYRGDLQTLGALWDA

SEQ ID NO: 14042 - protein, 249 aa, Streptomyces avermitilis
MLDALDIDLAPVVAAQPDPVLFATVSGAHLYGFPSRDSDIDLRGAHLLPAAELVGLREPTETRSRMWDRDGVEMDLVTHDLRKFVRLMLRRNGYVLEQLLSPLVVHTSDAHRELAELAPGVLTRHHAHHYRGFATTQWRLFKKTGELKPLLYTFRVLLTGIHLMRSGEVQAHLPTLVGQVDAPGWLPELIAAKAEREHGAADVDQARVRLDVERLHGLLDEAEGASRLPDAPTAYDALHDLVVRVRLEG

SEQ ID NO: 14043 - protein, 253 aa, Streptomyces avermitilis
MPETDPDLGARLVRHHTIYSCVMGSRAFGLATDGSDTDRRGVFLAPTPLFWSFAKPPSHVEGPAEEQFSWELERFCELALRANPNILECLHSPLVEQADATGRELLALREAFLSRQTHETFARYALSQRKKLEADVRAHGAPRWKHAMHLLRLLTSCRDLLRTGSLTIDVGDRREPLLAVKRGEVPWPEVESRMTRLAAETDEAARHTPLPAEPDRRRVEDFLIRTRHASALQAHPDDEVVQGVVRGRGVGQP

SEQ ID NO: 14044 - protein, 154 aa, Streptomyces avermitilis
MTIRPTRRTLLGTGGAVALLAGCSKYGDSNNSSSQSTSGTPSGSPSGTASATASGGAAAGPELAKTSDIPVGGGTIFKDEKVVVTQPEQGEFKAFSAVCTHQGCTVSTVSDGTINCPCHGSKFRITDASVAAGPAPRPLPAEKITVEGNSIRLT

SEQ ID NO: 14045 - protein, 194 aa, Streptomyces avermitilis
MPVDPNAATQSFPPSQPAHRGPGAARFLVPALVAAVVAVGLGAYGKVHDPAGTAFNLAGFSSTGAVKSWLATTAFFFALVQLVSALMMYGKLPGPSWAPVLHRWSGRVAFLVAVPVAVHCLYALGYQTYEPRVLWHSLLGCFFFGAFSAKMLLLRAERLPGWLLPIVGGLVFAVLTGIWLTSALWFFRTFGVTT

SEQ ID NO: 14046 - protein, 231 aa, Streptomyces avermitilis
MAGNSPRGRPVMKRSGPLFTLLAGLLLAVFMLSLNAMTGTKSTSSYQEEPPAATVSPSPRPERSTPPPSPSPSTSPLPNADYAGRTDDNSSAVAVSLRDGKAIAYFCDGRNKESWLKGDVKDDGTMKLTGKQGAELNGKLKEGKRIRGTVDLGGTRYGFTADKALKPSGLYRATASVRGAKIDGGWIVLPGGKQVGILNRDGKPQAAPRIDPETGAVTVDGQQLTARPVTP

SEQ ID NO: 14047 - protein, 120 aa, Streptomyces avermitilis
VAVRAVRGAVQLERDAADHMDEQVSELLTAILERNGLTADDLISIWFTATPDLHSDFPAAAARKLGIVDVPLICAQELDIKGAMPRVVRVLAHIESDKPRAEIAHVYLGAAGALRKDIAQ

SEQ ID NO: 14048 - protein, 364 aa, Streptomyces avermitilis
VRTALVIGTGLIGTSAALALAGRGVVVHLADHDPEQARTAAALGAGTDEAPEKPVDLVIVAAPPAHVAATLADAMRRGLGRGYLDVASVKGGPRRELEALGLDRSVMSTYIGSHPMSGREKSGPLAATGDLFEGRPWVLTPTRDTDTEVLNLALELVSHCRAVPVVMDADAHDRAVALVSHMPHLVSSMVAARLENAEETAVRLCGQGIRDVTRIAASDPRMWIDILSANPGPVADLLTDVSADLDETVRALRSLQSSDEAKRRAGATGIEDVLRRGNAGQVRVPGKHGSAPRTYETVAVLIDDQPGQLARIFADAGLAGVNIEDVRIEHATGQQAGLVQLMVEPKEAPVLSAALRERGWALRQ

SEQ ID NO: 14049 - protein, 231 aa, Streptomyces avermitilis
VENGAARTVPAVIVAIDGPSGTGKSSTSKAVAAKLGLSYLDTGAQYRAITWWMVSNGIDITDPTAIAAVAGKPEIISGTDPSAPTITVDGTDVAAPIRTQEVTSKVSAVSAVPEVRTRITELQRSLATSAENGIVVEGRDIGTTVLPDADLKIFLTASPEARAARRSGELKGADVNSTREALLKRDAADSSRKTSPLAKADDAVEVDTSDLTLQQVIECVVTLVEEKRAAK

SEQ ID NO: 14050 - protein, 238 aa, Streptomyces avermitilis
VRRHPRRGEAGREVTEAPSVRGAEVGRRIGVGLMYGLFKPRVLGAWKVPATGPVILAVNHSHNIDGPMVMGVAPRPTHFLIKKEAFVGPLDPFLLGIGQLKVDRETTDRSAVTRAVGVLDNGGVLGIFPEGTRGEGDFASLRAGLAYFAVRGGAPIVPVAVLGSTERRGRLIKALPPLRSRVDVVFGDPFEAGDGSGRRTRKALDEATVRIQKQLSAHLENARRLTGRRENAGRPTGH

SEQ ID NO: 14051 - protein, 491 aa, Streptomyces avermitilis
MNDHIQPEGSAEHEHGALGDAEYAEFMELAAEEGFDIEDVEGAIDEAGHGPLPVLAVVGRPNVGKSTLVNRIIGRREAVVEDKPGVTRDRVTYEAEWAGRRFKLVDTGGWEQDVLGIDASVAAQAEYAIEAADAVVFVVDAKVGATDTDEAVVRLLRKAGKPVVLCANKVDGQSGEADASYLWALGLGEPHPVSALHGRGTGDMLDAVLEALPEAPAQSFGAAIGGPRRIALIGRPNVGKSSLLNKVAGEDRVVVNEIAGTTRDPVDELIELGGVTWKFVDTAGIRKRVHLQQGADYYASLRTAAAVEKAEVAVILIDASESISVQDQRIVTMAVDAGRAIVLAFNKWDTLDEERRYYLEREIETELLQVAWAPRVNVSARTGRHMEKLVPAIETALDGWETRVPTGRLNAFLGELVAAHPHPVRGGKQPRILFGTQAGTKPPRFVLFASGFIEHGYRRFIERRLREEFGFEGTPIHISVRVREKRGNKKK

SEQ ID NO: 14052 - protein, 129 aa, Streptomyces avermitilis
VHAYDPPRRPSFQPVPAARPAQDLANGSSATPIYDALYAEYVRSFRSLPGDRSGEEDLGFTAFANTPRGTGSYTTGSYGAVGYGARHGTPQHATGHLATTAIWQPGTRQHATGMHHVPAALPPAPRRGM

SEQ ID NO: 14053 - protein, 275 aa, Streptomyces avermitilis
VSREPPGIATHRIPREPPVPRMLDVSDDVRAEIGDEEADRLLAGENAPGSYDCTSCRTPGDSEQEHTSTVLFIGDETAVLAFAHATCLPSQVVQVTEEQLQGAVRSIAAEEGPGTPVPEQAVLGVTSGLVLISGELHPALVVEPTGPIVRPGSTAAGDDFLPLLIEQGFMPLTRIESVPSVLHGWSVLLAMGQLHAVLQPGTGGGSPVAWWQAHQALQVAENWRAAANKHQQVIMFAAPVGSIGRQPREDLLRDALDKAAAGGKLVAAALPLAGT

SEQ ID NO: 14054 - protein, 224 aa, Streptomyces avermitilis
MSECADSTRKVRTTRTTAVLAGAALLAPLGLLAATGEAAAADSGVWDRIAQCESGGNWHINTGNGYYGGLQFSAGTWRAYGGTAYAATADQASRGQQIAVATKVQRAQGWGAWPTCSARAGAGGSAPAASGTGASGGSSSAGSATTESAASAKQAPSKQSKAPTRAPEHTNRNSSRGDYTVRDGDTLSGIASRHGTTWQKLYAANKTVLGGDPDLIMPGQRLAL

SEQ ID NO: 14055 - protein, 196 aa, Streptomyces avermitilis
MRPVSRRRDRDRLSVRVRARVGFPYLVVAALAVVLAPAGAVAAPPPPLPGPQAAPVSYECAKDEWPWDCLADCESSGRWDANTGNDFYGGLQFRQPTWEEFGGLTYAPRADLATRKQQIAVAERVLATQGWQAWPACAKRYGLEGRAHVVKAGETLASIARAYDVKGGWTALYQANKEVVGARPDRLKTGTVLLIP

SEQ ID NO: 14056 - protein, 216 aa, Streptomyces avermitilis
MSIALRHARVRYGPLEALHGVSLVAPGPGLTVLLGRNGSGRTTVLRALAGGVPLSGGAVVWDGADVTRLPAYERARRGLCLVPERRAVFASLTVRENLELTAGDLAPALDAYPQLEPLLPHRAGTLSGGEQRMLALSRALAAPARVVLVDEPAQGMSPEVAARTYRLLSGLDACVIVAEQRLPHGLAGPAGRTVLVHELRRGAVAFSGEAAELARP

SEQ ID NO: 14057 - protein, 269 aa, Streptomyces avermitilis
VSRPAAGQGPGASHGPRSRSRNAPRAAAPRPSPVAPHTLRARRLHAAYGDCTALDGVDLELPPGRVTAVVGPNGAGKSTLFHCLAGTLRPARGQVLFGDRDVTRLAAHARTRLGIARTFQQLAVFPSLTVAENVRIGAEQGRLPDPAAVARSLRLLGLDGPVRALPTAGLPTGTLRRVELARALAGSPRVLLLDEPAAGLDTAEVTALARVLRALAADGTALLVVEHDLDLVADLADIVHVMTAGRIVASGPADRVLDGGAEGGGGGGA

SEQ ID NO: 14058 - protein, 160 aa, Streptomyces avermitilis
MRTRRLRTAHLVLWAGWAALAAGAVFCVLGWYGVSGERYAERQLPYLASCTVPGAALIIAGAVLLTHGGPASAAARVEELYGLLVAAEPAGVAEPGQAAAAPVATSGELLRVPGGTLWHRADCPLVAGKSEAVPADSRLWASGELGPCPICEPPPPGPVG

SEQ ID NO: 14059 - protein, 189 aa, Streptomyces avermitilis
MVLGSDLRRADTQRGRGPGRATAWAAVAVLLLGPALAACSDESGGENTTPPTPSVEKPTGAQPSPTAPADPAAAKKEIKKNWEKFFDPAVPTKDKQAVLENGDRMTAVLRSFNGDKRGGQVAAHVEKVAFTSPTEADVTYSLTLKGQTVLPGAAGTAVEQHGTWKVSVNTLCALVQLSGDASASPAQGC

SEQ ID NO: 14060 - protein, 429 aa, Streptomyces avermitilis
MRRRARLRAAETAAAVLLLLVGAGCGSRLPESDFAHRSAPPASRRTEPVRVGILTSATSPVGGSAFTGPRDGARAYFDRLNARGGIDGRKVDVRTCDDGGSGVGNNECVHRLIDEDKVVALVATTALTYAGASRVSAAGVPDIGGQPIGAAYDTYPHLYGIYGSLAPRTGTPGWGGKVYGGTEVYRYFKREHGARTAAVVSYNQSASAAYASLVARGLKAEGYKVVTEQVDFALPNFRAAAADLKDQGADLVFDAIDTHGNAQLCRAMDEVGADVIAKVTNVQNWTSSVPEDYKDSPRCRNVLWATGSSRNADDTADPAVQEFRAATRGLKTHSQWQLEGWAAAMWFTDAARSCATDLTRACVDRFMSRGTPYTADGLLIPVGYERLAEPPRTRRTCLSVARWKDAEGWVAQGDMNATCFVVPQLPYQP

SEQ ID NO: 14061 - protein, 420 aa, Streptomyces avermitilis
MHISFLIHNAYGIGGTIRTTYNLANTLAEQHDVEIVSVFRHREQPVFAPDPRVRVRHLVDLREGAPDAGHPDLGRPARVFPRAEGRYQQYSALSDRRIAGHLASVEADVVVGTRPGLNVHLARETRRGPLRVGQEHLTLDSHSRALRATLRGAYPRLDALTTTTEADAHAYRGTMRLPGVQVHAVPNPVPAPGIEPADGTGKWVVAAGRLAPVKRYDLLIKAFARVRAQRPDWRLRIYGGGKQKDTLRALIDELGLYNHVYLMGPANPIEPEWAKGSIAAVTSSLESFGMTIVEAMRCGLPVVSTDCPHGPGEIIDNGVDGRLVEVGNVEAIAEGLLELINDDALRQRMSVAALKDSERFDPSRIAERYESLFTGLAPRGGATLGGKVRGSLHRTRGALLGGAYAVRDVGRTALKKGRAA

SEQ ID NO: 14062 - protein, 278 aa, Streptomyces avermitilis
VMTLAERTTGRHPDEETAPPPRADCIADSAGGLTFDIGGSDEAGLAHLVLRRREDDAEVRLPLTPSAEGRLRAALPSSVELPEGRWDAYAQTADGEPQRLVPGVSDLRSLVDRGPGAAGHVAVRIPYATKHGNLTVRSWLRAPHAEAGELRIGDGGLQVSGRVHGAALAPGAHAELCRRGEPASVLTAEVAPRQGEFRFTVDYGAMAEGVWDLWLRPAGEDGPRVRIARLLDDIADKKPIFTYPKLTLETKHGPVQAGPYYTADNELSVTVTSAPPPQ

SEQ ID NO: 14063 - protein, 344 aa, Streptomyces avermitilis
LETSARLLRLLSLLQAHREWSGAGLAERLGVTPRTVRRDVDRLRELGYPVNASPGTGGGYQLGAGAELPPLLLDDDEAIAVAVGLRTAAGQGIEGIGESSVRALAKLEQVLPNRLRRRVSALNAFTVPMLRGPQPSAVDPAVLTELAHLCRDAERLRFRYRGNDGASTRRTVEPHRLVCSERRWYLVAWDVDRDDWRTFRVDRITPRPPHGPRFAPRTPPADDLAAYVSRGVSTRAYAAQAVVRLLVPIEEAAARVSPSAGTLEAETPGSCVLRTGAASLDVMVIHVMMMGFEFEVLEPAELTEAVRTARDRLARASARAAEPPRRAPDGAGRTPGTPSGPGAA

SEQ ID NO: 14064 - protein, 563 aa, Streptomyces avermitilis
MGTDTAQATARPVRTQQPGRLIVDWLTTTDHKKIGHLYLITSFAFFLIGGVMALVMRAELARPGMQIVDNNQFNQLFTLHGTIMLLLFATPTFAGFANEIMPLQIGSPDVAFPRLNMLSYWLFLFGGLIVLGSLAVPSGPAAFGWFAYAPLNSLERSPGIGADMWIMGLALAGFGTILGSVNFLTTIIGMRAPGMTMFRMPIFTWNTLFTSILVLMAFPVLAAALLVLEADRRFGSQVFDAANGGALLWQHLFWFFGHPEVYIIALPFFGIITEIIPVFSRKPIFGYLTLIGATAAITGLSVVVWAHHMFATGAVLLPFFSFMSFLIAVPTGVKFFNWTGTMLKGSLSFETPMLWATGFLVSFLFGGLTGVILASPPLDFHVTDSYFVVAHFHYVVFGTVVFATFGGFYFWWPKFTGKMLDERLGKIHFWTLFVGFHTTFLVQHWLGAEGMPRRYADYLAADGFTALNTLSTIGAFLLGMSTLPFLYNVWKTARYGRKVEVDDPWGFGRSLEWTTSCPPPRHNFVTLPRVRSESPAFDLHHPAHAGEAPQPEPKHEQADREPS

SEQ ID NO: 14065 - protein, 71 aa, Streptomyces avermitilis
MAPTPAPPAEPEDSPQAYVGLPARRAEQLAGERGWSSVRSLPPGAIITMEYRVGRLNFEVADGTVVRCWKG

SEQ ID NO: 14066 - protein, 338 aa, Streptomyces avermitilis
VRTELKLTRLDRVFARLDREPERPAHIDVPRMSRHRVVLFSATLAFYLAIVWAVVVTSWLVRLDWQVMFFRPYQQWPEIHAFLDYYVVLGQRGPTAVMVASWLGWRSWRQHTLRPLLTLGAALLLLNITVGAAKYGMGRLGPHYAVTIGSNEMWGGGDIFPSGHTANAVVTWGILAYLASTPRARRWLSALSAVTSLGVGLTTVYLGTHWLSDVVLGWAAGLLILLALPWFEPLIALAEAGIFRLRDSLRSRPGRTAPAPAPVGAPVPIARSAPDEETPVREPAGPARTSRPPLYLAPGPHTARSERTPVTPVGSRRPPHSDRVARTTTTSARPVAGG

SEQ ID NO: 14067 - protein, 388 aa, Streptomyces avermitilis
VTDLETRPAPPHAGALRRAAPALLGFAAVRALGLVALALWSAARGSSAHTLLTARWDALWYTRVAGLGYGYEVRLPNGDVHSNLAFFPLLPWLERLGAAVTPLSYADAGLVVATLASLAAAWGIFAVTEHVHGRRAGVCAVLVWAVLPVGIVQSMAYSESLFTALAAWSLYAVLTGRWVTAGALASLAGLTRPVGAAVVAAVWVAAIASFVHDRRAPAADGASAWRRALGMLLAPLGAAGYVLWVGHRTGKGPLGYLDVQAGWRNGFDGGYAFARFVGDKFTSFPSALAGVGLIVGVALVVWLYVVCVRQGQPLPLLVYAGVVTALALCASSYFGSKPRLLLPAFPLLLPLARALARLRTPRSAAVLGGVAVASAVYGAFWLNGSGPP

SEQ ID NO: 14068 - protein, 535 aa, Streptomyces avermitilis
MSGTTTAAARCRRETGPGANRWVVLVVLCVSLLLVALDATVLHVAVPAVTEDLKPGAIELLWIVDIYPLVCASLLILFGTLGDRVGRRRILLLGYGLFGVASGIAALADSAQVLIGARALLGVGGAMIMPATLSILRQVFPDRRERALAIGIWSAVAAVGAAVGPLLGGFLLEHFWWGSVFLINIPLMLISLPVGRLLLPESKGDRDGPWDVVGALMAAAGLFGAVLGVKRLGGGEPPLSPFTVVPLVVGAALLVAFVRRQRRRAHPLVDLRMFARPAFSTSVGCIVLAMLALVGLELIAAQYLQLVLGLSPLETGLRLLPLTIAAMAAGLVGSNMLHRFGPRRMVVFGFCLTAGSVVTLTAMGAEDNTGLLLFGFLLLGFGLETTLFGAYESMLSEAPQEQAGGAAAIGETSYQLGAGIGIALLGSVMNAAYAPGLSSVPGVPASASGAAGHSLGEAYEVAARLGGAPGAALRHAARDSFVHGLHVTLLVSAGLLMLGAVMALRLPRVMECEEPATGFAEVPAPREAAESRVSA

SEQ ID NO: 14069 - protein, 391 aa, Streptomyces avermitilis
MTAFDPADFLGIDDLLDAEDLAIRDTVRTWAAQRVLPYVAEWYENGELPGIRDLARELGAIGALGMSLTGYGCAGASAVQYGLACLELEAADSGIRSLVSVQGSLAMYALHRFGSEEQKQEWLPRMASGDVIGCFGLTEPDHGSDPASMRTYAKRESGGDWVLNGRKMWITNGSVAGVAVVWAQSDDGIRGFVVPTDAPGFSAPEIKHKWSLRASVTSELVLDDVRLPAAAVLPEVTGLKGPLSCLSHARYGIVWGAMGAARASFEAAVEYAKTREQFGRPIGGFQLTQAKLADMAVELHKGILLAHHLGRRMDAGRLRPEQVSFGKLNNVREAIEICRTARTILGANGISLEYPVMRHATNLESVLTYEGTVEMHQLVLGKALTGLDAFR

SEQ ID NO: 14070 - protein, 145 aa, Streptomyces avermitilis
MGSVRKASAWLGLVDDNDDERYYDDDYAEGQESGEAWVTDPRVKVASETAEEKGRRIGTVTPDSFRDARGIGELFRDGVPVIINLTAMEPTDAKRVVDFAAGLTFGLRGTIERVATRVFLLTPANTEIVSGEAAGRPTDGFFNQS

SEQ ID NO: 14071 - protein, 382 aa, Streptomyces avermitilis
MAHLCGLCLALRKDHGQFARLVTNYDGLLISVLTEAQAERTTGGRRTAGPCPLRGMRTASVAQGEGARLAAAVSLVLAAAKVRDHMADGDGLLARRPVALAARRVAASWGRAGARSGSGVGFDTAVLVDAVDRQVGLEALAGPGTPILTVTEPTETATAAAFAHTAILAGRPGNAEPLAEAGRLFGRLAHLLDAVEDRETDAASGAWNPLTATGTPLAEARRLADDALHGIRLALREADFVDAGLTHVLLAHELRNSVDRAFGGTACSHRPELHGPSASGPYAPGPGPYAPGGPGGPGGPPLPPEPPRGNRRGLLAGCAVWAGLACTCQLCCGTYDDPWTRERKDGLCHDCDCGDCGECCDCCQCCGSCCDGCDGCDCGCDC

SEQ ID NO: 14072 - protein, 318 aa, Streptomyces avermitilis
MSTSSRPRRRIFIPFALITSAAVLLTACGSGDSEGAGKSDAQAAAKTGGIPTADVVSAVRKNEAAAKLLPSGTRSLTVAISVGGTPPGTSYLDDGKTLAGQDVDFANAVGKVLGIKLKTESASFEAILPALDSGKYDFGASNFGVTDERRKTIDFVTYINDGQGFATREDSKLQKITDLKQLCGLNVATGAGTTFEATLEENKKVCTDAGKKAYEVQTYNESGAIWSSLQQGRSDIVMSTINGLRYAVAQQQGLKFLNEFHRLDVGFAFKKGTKLAPAFQAAVNELIADGTYEKILKKWGTTGSAIEKSQVSPPELKD

SEQ ID NO: 14073 - protein, 281 aa, Streptomyces avermitilis
MSSDTLAKPAAAAEAAPVRIVAQRRLGQWTAAAVVLVLLGLAVNSVVRNDAFQWDVVADYFTSASVLRGLWLTLWLTAVVMVLGFALGTLLAAGRLSANPVLRSVSWGYVWLFRSMPILVQLLLWFNIGALYPQILGVKTVNLLGPVTVAIVGLTLHEAAYAAEVVRGGILSVDRGQIEAAQALGLSRWRRWWRIVLPQAMRSIVPPAGNMLIGTLKGTSIVSVIAVQDLLYSVQLVYHRTYQVIPLLMVATVWYVVVTSVLSVGQYYVEKYYARGSERTR

SEQ ID NO: 14074 - protein, 586 aa, Streptomyces avermitilis
MTPTLVIVGAGPRGTGLLERIAANAPELYAGSELDVHLVDPYPPGGGRIWREAQSPLLWMNSEAQDVTMFTDETVAMAGPVRKGPTLHEWAALDGRAFTGRRRQGAYLRWVYESTVAALPPGIRVHHHARRALRVSGPPEGRQQVWLEGRPEPLLADLVVLTLGHLDAELDDEQRRLAAHARAHGLVHLPPDFTADTDLAALAPGEPVLVRGFGLAFVDLMVLLTEGRGGRYEGAEYVPSGREPVLHVGSRRGVPYHSKIGYDWTGDRPPLPRFFGPAEVDELLARPEGIDFRRDVWPLVEKELGFAHYHRLFTAHPERTTVAWADFEEKYAAGVGPELRALAASAVPDPADRLDLDALDRPLEGVSHTSYEELQDGLRAYIQDDLTRRHDPSFSPDSAVFFGLLSVYGQLVRLGDIGSWWHGFFSYLASGPPGPRLRQMLALSRAGVLKFLGADMTVSAGDGVFRAASATVPGTFVEARALVEARLPHPTVERTRDALLRGLYADGAAATPEGLLAVDPADGRVLDGSGTPHPRRFALGPHTDARGSGAFTRPRTGGPAFRQNDATARAALTFLHAHHHAEGAVR

SEQ ID NO: 14075 - protein, 262 aa, Streptomyces avermitilis
MSTTTPATPAPAMVDIRSVHKSFGPLDVLKGIDLEVRAGEVTVVLGPSGSGKSTLLRTINHLEKVDQGTISVDGRLVGYRRSGDKLYELPEREILKQRTRIGFVFQNFNLFPHLTVLDNLVEAPVSVLKRPRKAAVESARRLLGRVGLADKADAYPGQLSGGQQQRVAIARALALEPALLLFDEPTSALDPELVGEVLDVIRDLAHQGTTMIVVTHEIGFAREVADTVVFMDDGRIVEQGTPGEVLDRPRHERTRAFLSKVL

SEQ ID NO: 14076 - protein, 372 aa, Streptomyces avermitilis
MTSSTGRGLLHLAAAVDQPTVFDAGSYVELVRLAERGVLDFVTLGDTFARPGPDALAVLSRVAPATRRIGLVPTVTTTHTEPFHVQAAVATLDWVSRGRAGWHLDVSTTEGEARLFGRRHAAPADTLWQEAGEVADVAARLWDSWEDGAEIRDVATGRFVDRDKLHHTDFEGAAFSVKGPSIVPRPPQGHPVRVVDATEGQARRTAARYADVALLRVTSPAQAAAVRTELRGTAEEFGRDPDTLRILACLVVDLGDGEHAAEPGWGSPLFGRRRELGGGGGGPLGTAQGPRYRGGPVDLADLIAVWHQAGAVDGFHLTPVEPRRDLERLVNGTVALLQHRGLFRTFYPGSTLREHLGLGRPANQYAVTGGTS

SEQ ID NO: 14077 - protein, 461 aa, Streptomyces avermitilis
MTVRKPAVKQIHLAALPHSHSHSRSRSSGESPVPGVDNTTVWADPRAKSQIEFASFEHLARTAERGLFDFFLLAGGLRLREHKGRIHDLDVVGHPEAITVLNALAAVTERLGLAATVDATFNEPYETARRLATLDHLSGGRAAWNVVTSADAFTGANFRRGGFLDRADRHARTAEFVAAARELWDSWTPEGVSRPFAHRGRHFDIAGEFTVPRSPQGHPVVIQAGDSAEAREFAASSADVVFARHGTLEAGRAFYADVKRRLAAYGREPEDLKIMPGVTFVLGDTAAEAQERAAEIRWQQISPQNAILTLEQIWGVDLSDHDPDGPLPAFDPDPDPHPDPEPGLMQGGVEVADPRAIAEKWRALSHEKGLSIRQTVIEATGRQSFVGTPEAVAAELEEFVRTDAADGFILAPHLTPGGLDEFVDRVVPLLQERGAYRTHYPGTTLRSHLGLADPPTEALIP

SEQ ID NO: 14078 - protein, 90 aa, Streptomyces avermitilis
VTAAPVAHGERRLVVLVREGVWGVRDFDPASAARRAFKGIEASSYDPRWSVPGRFTSYGENRTVRVENADGRERGLVSAANSSSPWPDRS

SEQ ID NO: 14079 - protein, 365 aa, Streptomyces avermitilis
LLRGPQVERCTAERRPCALRSRGRILPHSACQGHGLSGNRTTGSWLRLTGPIPHVGPPTSPGRERKVRIKRTNPRSGVARRTRLIAVATGFLAAAAFAVPTANASDAQTFSATQLTTVAKSVLKSDVAGTAWAVDPKTNRVVVTVDSTVSKAEIAQIKKDAGSNAGALTVKHTPGTFKKLITGGDAIYGGGYRCSLGFNVHSGSTYYFLTAGHCGEVASTWYSNSGQTTTLGTNVSYSFPTNDFALVRYTNTSVAHPSAVGSQTISSAATPSVGTTVYRRGSTTGTHSGRVTALNATVNYGSGDVVYGMIQTTVCAEGGDSGGPLYGGSVAYGLTSGGSGNCTSGGTTFFQPVTEALSYYGVSVG

SEQ ID NO: 14080 - protein, 388 aa, Streptomyces avermitilis
VRRLRARTPSGRRGPHNLVDRPPTGGRKLKHRRISRRRAAVAGAGIAALVAAGVTFQTANASEAPKTEAPHTLSLSAAGKLASTLGKDLGTDAAGTYYDAKAKHLVVNVLDETAAKTVEAAGAKARVVRNSLAELTSARTTLKQDATIPGTSWATDPETNKVVVTADRTVSKAEWATLTKVVDGLGQRAELQRTKGEYKPFIAGGDAITGGGGRCSLGFNVVKGGQPYFITAGHCTESISTWSDSSGSQIGTNEQSSFPGNDFGLVKYTSNADHPSEVDLYNGSTQPITKAGDATVGQKVTRSGSTTQVHSGTVTGLDATVNYGNGDIVNGLIQTDVCAEPGDSGGSLFAADTAIGLTSGGSGDCTSGGETFFQPVTEALSTFGAQIG

SEQ ID NO: 14081 - protein, 176 aa, Streptomyces avermitilis
MTGTSHSSAWISSDPPDYGEEPAIPYGDGGTFEIELTVDAKDEYTDCFKATCVLATRADHTLSGDRSQDVKVPVSFVGQDPVDTDDGTGGTGGGTGGTGGTGDSGSASASGGSGTSTNTAGTSAGSLASTGVAALTLSFLAALLTAAGWFAYRRGHQDNGHPRHFRTGGPADGPTD

SEQ ID NO: 14082 - protein, 1161 aa, Streptomyces avermitilis
VPGFTHLHTVSGFSPRYGASHPERLAERASERGMDALALTDRDTLAGTVRFAKACAAAGVRPLFGAELMVASAGEREHGGKRRAPVRGGAFIDESTPRVTFLAREGAAGWADLCRIVTASHTGEGQPLLPWPDNHAEGLTVLLGPASDVGRALAAGRPDRAARLLAPWREVYGDALRLEAVWHGRKGTGPGSLRLAARTVGFAAEQRVRPVLSNAVRYADPGMGPVADVLDAARRLVPVDPTKELDSGEAWLKDADAMLGAAERIVEAAGYRRDTAYRLLEQTQATAAECLVDPEDDLGIGTVHFPEPHLVGAGRRTAQRVLTSRAAAGMVRHGYADRRDYWERMHRELDIIAHHGFASYFLTVAQVVDDVRDMGIRVAARGSGAGSLVNHLLGIAHADPVEHGLLMERFLSKRRAVLPDIDIDVESARRIEVYRAIIGRFGTERVATVAMPETYRVRHAIRDVGAALSMDPADIDRIAKSFPHIRARDARAALAELPELRELAGEFRREGGRYGKLWELVEALDALPRGVAMHPCGVLLSDASLLARTPVVPTSGEGLPMSQFDKEDVEDLGLLKLDVLGVRMQSAMAHAVAEVERATGTSVDLDAVPPGDPATYRLIRSAETLGCFQIESPGQRDLVGRLQPATFHDLVVDISLFRPGPVAADMVRPFIEARHGRAPVRCPHPDLEGPLKETYGVVVFHEQIIDIVDIMTGCGRAEADRVRRGLSDPESQGRIRFWFAQHAAVRGYDAETIQRTWEIVEAFGSYGFCKAHAVAFAVPTYQSAWLKAHHPAAFYAGLLTHDPGMYPKRLLLADARRRGVPVLPLDVNRSAVAHRIELVSESGDPSGGSSGGPSGGSPGRWGVRLALSDVHGISEAEAARIADGQPYASLLDFWERARPSRPLAQRLAQVGALDAFGANRRDLQLHLTELHRGARGGGGGQLPLTGGRGTASAGLPDLSSAERLSAELGVLSMDASRHLMDDHREFLDELRVVSARRLREARHGETVLVAGAKAATQTPPVRSGKRVIFTTLDDGTGLVDLAFFDDSHDACAHTVFHSWLLLVRGVVQRRGPRSLSVVGAAAWNLAELVELRAEGGLDVVAARLAEPVPAAERSGDDDPAEGGKIRMPTGYEMHPWADLRPAGEGPAGGKKLWHQSPGSAG

SEQ ID NO: 14083 - protein, 324 aa, Streptomyces avermitilis
MTILCIRFQLPPMYEAALPGLLGLLEEFTPVVEALPPDGALVDLRGAERYFGRGTVEFASLIRVRALAHYGIDCAIGAGPGPMLARMALRDAVPGVTRVVPEEPDAVAEFLAERPVVALPGVGHATARTLCEYGLDTLGKVAAAPLSTLQRLTGARTGRELREKASGIDRGRVVPNAVSRSLTAERPFPRDEVDPSRHRRALLSVTEELGTRLRTLEQVCRTLTLTVRYADRSSTTRSRTLAEPTAHSAALTATAYRMYEALGLQRARVRAIALRAEGLSPAEDAAHQLTFDPVDEKVRRIEEVADRARAKFGPRAIVPGALAA

SEQ ID NO: 14084 - protein, 128 aa, Streptomyces avermitilis
MEVSMPVVRPSEAVVHEIHGARFVSYATPLSGSKELCAWRGEIPAGTKAPVHTVNREEIFHLLSGELVITLDGRTERITAGDTVIINPGATLGVENPTDRTAVSWVTTSIGLEAELADGSRIVPPWAN

SEQ ID NO: 14085 - protein, 148 aa, Streptomyces avermitilis
VQNSEAMAFSAALLAAAGELTQRIHDGVVARGFEGLRPAHGFAFSRLAPGGATVTDLAAHLGVTKQAASQLVDEMVRKGYVERRPHPGDARARLVVLTERGWACTRAAEEAAAEAVRPWVELLGEGEVGLLRARLSRIAPSGPIRPTW

SEQ ID NO: 14086 - protein, 286 aa, Streptomyces avermitilis
MLPWKRVLRPLTALLLTVAVALVPAATAHADSAPSSGWNDYSCKPSAAHPRPVVLVHGTLGNSVDNWLGLAPYLEHRGYCVFSLDYGQLSGVPFFHGLGPIDKSAEQLQVFVDKVLTATGATKADLVGHSQGGMMPRYYLKFLGGAGKVNALVGIAPNNHGTTLSGLTNLLPYFPGAEDLLSTATPGLADQVVGSAFMAKLNAGGDTVAGVHYTVIATQYDEVVTPYRTAFLSGSDVHNVLLQDLCPLDLSEHVAIGLIDRIAFHEVTNALDPAHATRTTCASVFS

SEQ ID NO: 14087 - protein, 343 aa, Streptomyces avermitilis
MSARRKAAAVAAAGAAPLALTALAAAPASAHGSMGDPVSRVSQCYAEGPESPGSAACGAAVAAGGTQALYDWNGIRIGDANGRHQRLIPDGRLCSADNDEFKGLDLPRADWPATGVSGGSYTFKYRVTAPHKGTFKVYITKAGYDPSKPLAWDDLDLGHPVATATDPAASGGFYTFSGTLPQRSGKQLLYAVWQRSDSPEAFYSCSDVTYGASNGGGDRGSGGTASGSSPAPTASAPSDRQIENGADKSTVEHHGHGDSDASTSAKPTAAGGAARTTGSAAKSPAKSADEPAAAGAAENLAETGGDGSAPYLAIGGAAALAFGAAALFASVRRRATSGGRHHR

SEQ ID NO: 14088 - protein, 156 aa, Streptomyces avermitilis
VSAMTDAWNDAETRPAVAADVDAVKAVTDAAYHHYVERIGRVPQPMEADHAANVAAGRVFVLGEPVTGLVVIEAFEDHLFLDSIAVRPDAHGQGVGRRLLAFVDARARALGLDEVRLYTNAKMWENQKIYPKYGYEFVERRVDGPYDRIHYRKRLA

SEQ ID NO: 14089 - protein, 57 aa, Streptomyces avermitilis
VNIAEPGRHKEAAMRRVTLQKPLRKSVSRRVREEAEERPAERPEVRKDIARTWWPDG

SEQ ID NO: 14090 - protein, 215 aa, Streptomyces avermitilis
VAGATLGGMTINGGPETSAISADVDWDAESATFDDEPDHGLRDAVVREAWAARLRDWLPGKACDVLDLGCGTGSLSLLAAERGHRVTGVDLSPAMVGLARAKTAGRDAAFLVGDAAAPPVGEQRFDVVLVRHVLWTLPDPGRALRRWCGLLRPGGRLVLVEGVWGTVSPVGLSADRLTGLLAPLAKSVRVERLSDDSRLWGKEVADERYAVVATP

SEQ ID NO: 14091 - protein, 172 aa, Streptomyces avermitilis
VRRRCAMSANSAEAVGQVEVVLVKSGRTKIRYPAELLHDDGTRVAVRAPWAGDGVRDFGFVRFEPGDVFTEYYWRDRWYAVKEVRDGRGTLKGWYCDITRPATLVGTELVVEDLDLDLWRSADGTAVLRLDEDEFAASGLAVSDPRAAAAAENALDTLERLAREGDFEALLA

SEQ ID NO: 14092 - protein, 128 aa, Streptomyces avermitilis
VRDNHSVTLKIVIEAGGAPYEQVRAQIAEQARSGELPVGYRLPTVRGLAESLGLAANTVAKAYRALESDGVIETRGRNGTFVAAAGSAAEREAASAAQAYAERVRRLGLSEGDASAAVRDALRAAYGD

SEQ ID NO: 14093 - protein, 342 aa, Streptomyces avermitilis
VIVPHRPPGAERSSRAPGKSEAPARGPRVACEPMTLIVRELRQDSRPDAEGFAHIRRLALPFFIVTPESIAYDRRHTHPDAHYQPLLAEADGELVGTAQVGLVHDSPEPGQAYLNVYVHPERLGGGAGSLLVRTAEERLRALGATKLFAWVLDEPANRAFAERRGYRASRSGHFLRLDLAHGTLPPLQSPPPGVELRTAADFADDPRPLFELDAETSGDEPGDVDHEFTDYEAWLEETWRHPLLSHELTSVALVDGRPAAFSAARTDGATRYHTGMTGTARAFRGRGLAKLAKNDSLHRARAAGFTEAFTGNDAGNEPMLAINKWFGYEICATEVRYVRELG

SEQ ID NO: 14094 - protein, 254 aa, Streptomyces avermitilis
MTLFVGTSGWQYKDWLGALYPPGCPTRLWLEEYATRFATVEINNAFYRLPSRGTFETWRERTPPDFVVAVKASRYLTHIKRLRDPEEPVHRLMTHAAGLGDRLGPVLVQLPPTLRADPGLLDACLACFPSGTRIAVEPRHDSWWAPAVREVLEARGAALCWADVLSRPATPLWRTADWGYVRFHEGRARRWPRYGRQALVTWARRIAETWPDDHEVYAYFNNDPHAAAVEDAAVFARVAKATGLTVTRTPGGDE

SEQ ID NO: 14095 - protein, 364 aa, Streptomyces avermitilis
MSANPHDALPIRLNVDDSDSPSDVVDALFLGRFATGEQPHSHAANIDRVRTGATLLPPGARVLRSARDDDRSATLAEGDGWTLLVSRWNRGADVTVTATSAELAEKVLGQATDGAADEPEPQPENVTMGFWYVSPRRGPHRTTRQISAGTWEEVRPNYTTPVADAMDRLMKTTPEDIAGRLLLLHGPPGTGKTSALRTLARSWRDWCQVDCVLDPERLFSDVGYLMDIAIGEEDGTGKGRWRLLLLEDCDELIRGEAKHTAGQALSRLLNLTDGLLGQGRNVLVGVTTNEDLERLHPAVVRPGRCLARIEVGPLTRREAVNWLGTEEGVGREGATLAELYALRRGTSPTSLPEPREGADAGLYL

SEQ ID NO: 14096 - protein, 421 aa, Streptomyces avermitilis
VHGTPAVPPKNTGPEVGWGFTHTQFSADEGSGDATQRVEGLLAQRAVPQIQHIMGWGAGNPEPVKGRYDFAEMDRRIDFIRESGGTPVVTLCCAPDWMKGGKSGADNTDWSRSALETAPDPDHYKDFAALAVTVAKRYPDVRHFIVWNEFKGFWNDSRARWDYEGYTELYNLVYKALKKVDEKNMVGGPYLVMDSVDPRQQENASTAVKGPWGAMDQRVLDAFDYWNRNKAGADFVVVDGSSYTKDDDLLPNEFAATDKLTAVGEWVRARTRGLPLWWAEYYVEPADGNDDRTGWSETRRVAVQATGMIAMARGGASSGFYWNPEEERGSDCAGCLWTPTSGGDGGTKLPMYDLVSRFGKEFPPGTTYETVPVAKDDVPNVRVLADDKAVLVVNTLDRAISAKVDGKRFELPAYGVKWLRR

SEQ ID NO: 14097 - protein, 1230 aa, Streptomyces avermitilis
MLNTGISAVLGLGFWLAAARYYDESAVGQGSAAIAAMKLLAGLTAVTLTGALARFIPVSGRATGRLIFRTYAGSSVVVALAAVVFLLTLNAWGPSYRFLHGPLNGLGFIVAVVAWSLLTLQDGVLTGLRSALWVPVGNTVFSAVKLALLVAFAVAIPASGVFVSWVAAIATSVVPLGWLVFRRLVPRHVKATKDHTRPPTLKEVGRFLAGDYTGSLFSLAVVYLVPVIVASQVSSENNAYFYITTTIGGTVNLLAINMGASLTVEGSHDPARLAANTRAALRRMARLMLPVCGILFVGAPFILRVFGEGYAHAATPLLRWFAVGALLRVVMETYFAVLRAQSRTSGLAYLQGLLCVLVLGLTLILLPRMGLTGAGVAEISSLAVIVAIAAPKLFKIVRTAPSPAVPEDAAPDGDLADLGAREAAGAGSGPSWARKLDADTLALGLHVDFDHLERRPDVRPGPGTPPTGSPAVRPDRRPTWALRVQSAREPEPHVGLPVEEREPGSEASLGPAEVPEVDAPFTGEAVQARASVGESGAVREPEAPSPGAPPDTPLSLRDRLRPSRPGVVLGCLLVSALLLYWVPALGLDEAALDRMGGLGLISVLPMPTLVGAALLVVVFASLLWRTREHQGLLLFTLLATVVSLHALPAVIETEPRFATAWQHLGFLDYIDRTGSAVPDLDARWSWPGFFAVAAFVAKACGVTDLTEVIRWWPMTVQLLYLAPLFLLVRSLRAGWRAKWTGIWIFVLSGWVGQDYFSPQGFTYLLYLAFVAILLVWFRAPRVLWSTRRPGEAEVEPAGRRQQAVLLMVLIGLFAATVPAHQLTPFVMLGVLAVLVLVGRSELRGLPILFAVVVAVWIGFMAEPYWSGHFDDLFGGVGGVGSNVSTSVSGRIQGGSSTHKLVLYTRVLLAGGVLALACWGWWRRRDHKYRERSLLVLTFVPFLGFGMQSYGGEMALRVFMFALPGAALLAGLALFPRTGVTAEERDKDRVSLAPVAALLAGLLLMGGFLVARWGNEPFERIRPGEVAAMNYVYEHDKPSVRLLWLSNDTVDNVTPAMPWGARDMEKVEYVPTLAPSDPVLVSGLVKSLKDAGPNSYLMINRSQVTYLQLDVGYSTTWESRLVRNLDDRQELKKVLVNDDVTMYTLRKQPAGKVPKPDPGPIGPQVTWTPWSVVGGLAAVALVLMLTAREVVRVAVRPGVRQLQWLQSSFWFSLPLLAVLLASLVQRFMTMK

SEQ ID NO: 14098 - protein, 266 aa, Streptomyces avermitilis
MREPAVPILMYHSIATAPNDATRALSVAPEAFAEQMALLGDLKITPVSTAQLAESWRSGGPLPERPVLITFDDGYEGVHRHALPVLAEHGFASTLFVSTGWIRGAYDTGGGLDTMLDWDQVRELADAQVEIGGHSHTHPQLDEIDDDALRFELLRCKEIVADELGARPVSFAYPYGYSSRRVREAVREAGFAQSLAVGNALARRRQGPYALRRVTVRRSTGVEEFTRLVEGRAIALDFARDRALTKGYAMVRRARQVRRKAIRSRV

SEQ ID NO: 14099 - protein, 323 aa, Streptomyces avermitilis
VICVYTEDRWADILAAVASVRAQSRPARETLLVVDHHQTLLERLSREYKEVPEVRVLANAGPRGLSAGRNTGIAASHGEIIAFLDDDAVAERDWLRHFAEGYEDPRVMAVGGRTMPIWASGRRPAWFPEEFDWVVGCTYKGLPPGRVRVRNVLGGNASFRRTAFDAAGGFATGIGRDGDKRPLGCEETELCIRLTRARPDAILLIDDRAVIHHRVPEPREHFAYFRTRTYAEGLSKALVARSVGAGKGLESERRYTTRVLPAGVARGLRDAALARPGGAGRAGAIVAGVLTAAGGYVLGSVRARRGGATFSVVEPPDSEGEAA

SEQ ID NO: 14100 - protein, 272 aa, Streptomyces avermitilis
VSSFLRPAVSGQDPFTTGNYRAISSHLAITPPVSVVIPAMNEAENLPYVFKSLPDWIHEVVLVDGNSTDGTVEVARELWPDVKVVEQRGKGKGDALITGFEACTGDIIVMVDADGSADGQEIVSYVSALVSGADFAKGSRFANGGGTSDMTPIRKLGNRVLCAAVNAKFGARYTDLCYGYNAFWRHCLDQIDLDCTGFEVETLMNIRVVKAGLKVQEIPSHEYLRIHGASNLRAVRDGLRVLKVILKERSNRRALRSRPHAMQLNSGQGEVS

SEQ ID NO: 14101 - protein, 364 aa, Streptomyces avermitilis
VDISVYRPGELSAADRAAWTALQSKAHLDGSPELANPFLSPEFTLAVGRCRRGVRIAVAREDGEPAAFFPFQRTATGVGRAVGLGVSDCQGLVHRAGFTWDAQELLQACGLALWEFDHLVAGQAPFEAGAAGTFPSPVMEVDQGYEAYLRGLRARSPKFTRTTLAKERKLGRDTGGVRYVHDERDPAALRTLMTWKSAQYRRTGRSDRFAHAWITHLVQQLFHSRSEPFAGILSVLYADDRPVAAHFGLRSERVLACWFPAYDPAYAKYSPGLILHLRMAEAAAADGIAHLDLGRGQKDYKDSLKTREIAVSEGWVTRRHPIAFGHRAHRAPVRALRNAVLSRPELFESADRILKRMGKIRSSR

SEQ ID NO: 14102 - protein, 163 aa, Streptomyces avermitilis
LTAPRPLRDIEARHPALRGAKSPMQTIRIKTPSTDSAQRSGQGPGRDLSPLLAGAATAIGGVGAVLALADVDSPLRGPFTLFFLLAAPSVAIGAVLRGLEPFGRVLVSVAGAVAVDMLVAQGMLAVHRWSVHGGIAAVTAISSLVLLLVLVRRLRGRTARRRA

SEQ ID NO: 14103 - protein, 363 aa, Streptomyces avermitilis
VLAAGSPTAIKGSYIVTLKKGTGFKAASSKGKGLINEYGGTVKKTFGAALNGYTANLSATEARRLAADPAVATVEQNQTVHLTDTTQSSAPWGLDRVDQTSLPLSTTYTYPDTAGSGVTAYVIDTGVRITHAQISGRASYGYDAVDGDTTASDGNGHGTHVATTIAGSTYGVAKKAKIVAVRVLDDAGSGTTAGVIAGIDWVTNNHSGPSVANLSLGGGASTSLDTAVSNSIASGVTYAVAAGNSSANASSYSPARVAAAITVGATTSTDAKASYSNYGSVLDIFAPGSSITAGWNTSDTATNTISGTSMATPHVAGAAAVYLAGHTSATPAQVASALTGGATTGKVTSAGTGSPNRLLKIVP

SEQ ID NO: 14104 - protein, 269 aa, Streptomyces avermitilis
MRRSRITAYVTSLLLAVGCALTGAATAQASPAAAATGYVALGDSYSSGVGAGSYLSSSGDCKRSSKAYPYLWQAAHSPSSFSFMACSGARTGDVLANQLGTLNSSTGLVSLTIGGNDAGFSDVMTTCVLQSDSACLSRINTAKAYVDSTLPGQLDSVYTAISTKAPSAHVAVLGYPRFYKLGGSCLAGLSETKRSAINDAADYLNSAIAKRAADHGFTFGDVKSTFTGHEICSSSTWLHSLDLLNIGQSYHPTAAGQSGGYLPVMNSVA

SEQ ID NO: 14105 - protein, 550 aa, Streptomyces avermitilis
VEQSRGCDGGTPVSEEPGSERVIAGRYRLLSPLGEGGMGTVWRAHDEVLHREVAVKEVRAPAGLPAAEIERMYTRLEREAWAAARVANRNVVTVYDVAHEDGRPWIVMELIRGIALSDLLDAEGPLSPQRAAHIGAEVLAALRAAHTAGVLHRDVKPGNVLMANDGRVVLTDFGIATVEGSSALTMTGEVIGSPEFLAPERALGRTPGPESDLWSLGVLLYAAVEGNSPFRHDTPLSTLRAVVDEELPPPFRAGPLAPVIEGLLRKDPADRVPAEQAEQDLRLIGAGGTPRTGTSAYSPTVTAFPGPSDTPPRPVPASAATRPSAARAEAASPEPARNRRAAVAVIAGLAALALALAGLTYALLTRDNGGGTAGTTSSSSNGSAGGGSSKTPEDDNADGGGDHSSGSTPGGGGGGGGTTTPPAQSVKVTVTGVHTDYSGACPPPTAQAPTFTATFTVGRVPVEVEYRWVTKKGEVPDPGWKTLSFPASGGKTQQKQVFVTTYDTSGTISNEIAVEVRDPVRTTSNSVPFSVTCATETPTDGASASGSPSP

SEQ ID NO: 14106 - protein, 574 aa, Streptomyces avermitilis
VNPRRAFASCAAVLTAACALVLVPSGPASAHPLGNFTVNRYDGLVAAPGQLRVDHVEDLAEIPATQAKPEIKKLGMTDWARQRCETAAHDSKVTVGGRQVALSAGTSHARVRPGQAGLNTLRVECRLTAPLPKGDSVTLGFHSAGATSGPGWREITARGDRMTLTASDVPKKSVSQELTSYPKQLLSSPADTAAASLRVRPGGPALVEEQRDAPAASVLPRGADRWTRALDGLVARHDLTAGFAALALLIAVGLGALHALAPGHGKTLMAATAAARGGRATLRDVLPLAASVTVTHTLGVVALGLLVTAGSAAAPSVIAWLGIASGVLVTTAGMTLVRRAWRNRVPAHGHDHGHKHDHSHDHDHSHDHGDHVHHDHADHREHAHERPLVLAHAHGETHAHDAPHTHPHDQNHNHSNSHKHNENHGHGHGHKHDHDHDHKHPHSPTLEHTHGGFTHTHEIAPTLRGTILLGFAGGLVPSPSAVVVLVGAAALGKAWFGLLLVVAYGVGLALTLTAAGFAVVKLGSGMTRVLNRRPRWTDGPMAALVRRTVPLGSAFVVVALGAGLVLKGAASALG

SEQ ID NO: 14107 - protein, 670 aa, Streptomyces avermitilis
VRAAPLIRHNDRFPQGHRGEGMSPRTNDSAPESDGGEQPPAGPEAGTAETGTPASATGTAGAMPEESAGGATTEEPSVGATTEKPSAGATTEDPSAGATTEESPADAVAQQSAAAAPAEESAAAATAKESPADARAEEPAAGAAVKEPPTGAAPEKPAGATAKKSPADTTAEEPAAGTTAKELQAGAVAQEAPAQEAVAPKALAQAPGSGADGVRDERVAAVRRLSVSGRRWRAAQLGFCAAALAVALTAGAVVLGAVRDGGTANAAAAPVAVSPQLLASGDLDASITSLQAHLRAQPKDFGGWATLGLAYIEQARTKGDPSRYPQAQRALDRSLRLRPDNDPALAGRAALAAARHDFHGALTYADRALKQNPYSERALSSRIDALVELGRYDDASKAADVADQRRPGVPVFTRYAYVRELRGDVKTARRVLEQALSTATSRGDISYVASALGQLAWNQGEYKAALTYYARALAADDSYLPALEGRARAQAAQGDSAAAIRGMEQVVERFPLPQPLVELGELYEARGKKGNPQKARDQYALVDAWVALARANGVNADLDTALAAADHGDAKAALKAARAEWARRHTVHTADALAWALHVNGRDKDALPYARRATATGYHNASFLYHRGIIERAAGDAKDARASLKSALDLNPGFSPLGAREARTALGAAK

SEQ ID NO: 14108 - protein, 506 aa, Streptomyces avermitilis
MTPISRSGAGRRSLATLISGALAAGGLAAAGVTALEPGAASASSHREAPLISGTPQYDNTDVYAFVSPDKPDTTTVIANWIPFEDPAGGPNFYTFAEDAQYDIHIDNNGDAQGELIYRYTFKTHRKNGDTFLYNTGPVDSLDDPDLNITQTYDIDLLRLHDQKLVSRTKVADDIPVAPSNVGKASMPDYTKLRNQAVYKLAGDSTTFAGQADDPFFLDLRVFDLLYGGDLSEVGRDTLKGYNVNSIALQLPTDMITESKDQPIVGIWSTTQRKDARGHYTQVSRLGNPLVNEVVNPQKDKDKFNASSPWEDAQFLKNVTNPELPKLIEAIYKIKAPAEPRNDLVDVFLKGVKGLNQPPHVTPAEELRLNTSIEPTAKPKRLGVLDGDNAGFPNGRRLTDDVIDEALQVVEGELVGSKNDLGDAVNKNDKKFEHSFPYVAEPTAGSRGKTAGGTGNSVRNQLGDGLIANATDGSNTTLIAASAAAGAAGFLLIATGLAWWRRRNRAY

SEQ ID NO: 14109 - protein, 182 aa, Streptomyces avermitilis
VLVHADELLVLVAEGDQRAFEELYGLVSGPVFGLVRRVVRDPAQSEEVAQEVLLELWRSAARFDPGRGSALSWILTLAHRRAVDRVRSARAAGEREQREALRAHHPAFDQVAEEVEAGLEREWVRRCLDRLTALQRQSVTLAYYDGYTYREVAERLSLPLGTVKTRMRDGLTRLRNCLGGAA

SEQ ID NO: 14110 - protein, 271 aa, Streptomyces avermitilis
MSALDRLLRRDLHSLAAPYALDALEPDERRRFERHLKGCDRCAAEVRDLYEDAVRLAWSTAAPPPAALRDRVLSAVRSTPQEAPQGASRAREPHLPAHVWGTAPPPARARARRTRPLFVPLATATAAAALVVASLFAVQAGRTQDQLAEQQAQAREIAHVLAAPDARATSDRDAKGRGIGVIASASEGRAVVTLSGFRAPSGGRVHQLWLMRPNGQPRSLGLFDGDAPLVASGLNTKATSLAVTVEPDGGSAQPTSQPVVQLALESVGFGE

SEQ ID NO: 14111 - protein, 89 aa, Streptomyces avermitilis
MEQITVRSRARVPAITCGSSATSSRLDRHLAVLGGPAIPQRETAEATSLMRELTARDTAHDRSGRGARVRRVSLFAPLRRLRRSLFGGR

SEQ ID NO: 14112 - protein, 395 aa, Streptomyces avermitilis
MPSVTHDDAPLLADLMPWSVAPLRLGRGWPMAPDVASLKARWDALLKAEGPDREALFEPTRARTLHSAVAQLPGQSSGTGRLARATGPCPEPVRVLGDPFDEQWLIPDHRLLDAARPELWRVADEGQVFVAEQTVAPGSTGPLLLASPLLPVKSPAVRSGPVRPLYRRPGRLEPNLAPGLVEHLAGRLGRPVSPVDALAWILAAARPGPEGIEVPLTADPGLWSRGTESGHRTLWLMCRTGERPKLPGGRRPYVRAPLPARPLELLYDRAEEALHIGEGRISPVPGGAWDFHVGGVRVLEAWFARRTEPAEPGTLEAVRPAAWPQAWTSELLELITVLALLGEIGPRHGESAAGAPVTAAELYRAGVLPVPDAARRPASVLDHHEEGPEGQFALI

SEQ ID NO: 14113 - protein, 249 aa, Streptomyces avermitilis
VTSFAPDSIVLNRKLPLWYQVSQSLRASILGRSPQDPLRLPTEEQLAGHYGVSVLTMRQALKELEDEGLITRHRRRGTFIEPGVQRGAPVRLLGSVDAIVAQQSGMVAELLEHGRSPVSGELAEYFPDVDEVATYHRLRADERTGEPTNHARNYVRPELAERIGLDDLARWPMTKVLRDVVGVRIGRITDTVEARLADPETARLLQVPLLSPILHYTGVTYDEDGQVLDVAVIHYRGDRFSFTVTLDAD

SEQ ID NO: 14114 - protein, 438 aa, Streptomyces avermitilis
MSGDARKTAEGLAHLTGFGNEHASEAVPGALPEGRNSPQRAPLGLYAEQLSGSAFTEPRAHNRRSWLYRIRPSAAHPPFTRADNGAIRTAPFTETAPDPNRLRWNPLPEPPAGTDFVGGLWTLGGNGDATQRTGMAVHLYHANSSMDRVFSDADGELLIVPERGGLLLRTEFGLLHAEPGQVALVPRGVRFRVDLLDESARGYVCENYGAPFQLPDLGPIGANGLAAARDFKAPVAAYEDVEGPVEVVNKFCGNLWTATYDHSPLDVVAWHGNHVPYTYDLRRFNVLGTISYDHPDPSIFTVLTSPSDTPGLAGVDFVVFAPRWLVGEDTFRPPYFHRNVMSEYMGLIEGAYDAKAAGFVPGGGSLHNMMSAHGPDRETFDRASAAELRPQKIDDGLAFMFETRWPVTATAQAARAEHLQPAYDDVWQGLQRHFRPSD

SEQ ID NO: 14115 - protein, 221 aa, Streptomyces avermitilis
MSWTRGPLAALAVCALLGGAAGCGADGAHGRRGGATASPVGKLLDDTDERGRHYREVDEKGAPEVSVEVQPDSDDSWDVLLTVHNFRFSPPGARAVPVAGRGVALLSLDGRALARLRTPDHHLPGKLVPRGTHHVTVRLYADDGTVWAVDGRPVQSTADITASGTGPTRPHSTPSGAGGGAEGASGTPTQGTGDSAAGMSVGRTHLRTDGRGSPDSRGKAS

SEQ ID NO: 14116 - protein, 206 aa, Streptomyces avermitilis
MKPVPQATSLRRAPVQRRSAERLTRILDACADLLDEVGYDALSTRAVALRAGVPIGSVYRFFGNKRAMADALAERNFERYTDRVTHRLEQSDGEGDWRAAMDAVLDEYLDMKRTAPGFSLVDFGNQIPVGARYAEPNHRVADRLTELLSAYLGRTPDDDLRRTFLIAVETADTLVHLAFRMSPEGDEDIIAETRALLRAYLGRVLD

SEQ ID NO: 14117 - protein, 743 aa, Streptomyces avermitilis
VSRTALRICPLCEATCGLTLTIEGTRVTKARGDRDDVFSKGFICPKGASFGAADGDPDRLRTPLVREDGELREATWEEAFDAVAAGLRPVVEEHGPHAVGVVLGNPNVHTMAGALYPPVLLAGLRTHSLFTASTVDQMPKHVSSGLLYGDAVAIPVPDLDRTDHLLLLGANPLESNGSLCTAPDFPGKLKALKARGGTLTVVDPRRTRTAKLADRHVAIRPGTDALLLAAMAYVLFEERLVDLGELAPHVQGVDELADALRDFTPEAASPSCDVPADVIRELARELAAAPTAAVYGRIGSCTVPHGTLASWLVDVLNILTGNLDRPGGALFPLSATDKAPRPAGPGRGFALGRWHSRVSGHPEAKGELPLSALAEEIDTATGEGSPVRALIAVATNPVLSAPDGDRLDKALGSLDFMVSVDPYLNETSRHAHVVLPPPPPSQAPHFDFAFNAFAVHNQVRYTRAAVPLEPGRMAETEILARLVLAATGMHGAAPDAVDALVIDQTLGKAVTDPHAPVHGRDPGELAAVLTGDSGPERRLDMMLRLGPYGDGFGARPDGLTLEKVLAHPHGIDLGPLTPRLPQPLKTRSGKVELLPGPIAGDLPRLREALRERSEGLVLIGRRHLRSNNSWLHNVPALTGGTNRCTLHIHPEDAERLGLTDGAPVRVRGAGGAVTAPVEVTDGIRRGVVSLPHGWGHDRPGTRMSHAALDPGVNVNQLLDGSLLDPLSGNAVLNGVPVELTRTS

SEQ ID NO: 14118 - protein, 468 aa, Streptomyces avermitilis
MLTILGFTMIATFLVLIMLKKMSPIAALVLIPALFCVFVGKGAKLGDYVIDGVTSLAPTAAMLMFAIVYFGVMIDVGLFDPIVRGILRFCKADPLRIVVGTALLAAIVSLDGDGSTTFMITVSAMYPLYKRLKMSLVVMTGVAAMANGVMNTLPWGGPTARAATALKLDASDIFVPMIPALAVGLLGVFALAYVLGRRERTRLGVLTLDEALEPQEAETVLVGAGGSEEKSPRATGGSGSGTDADAPESATADDGFQGLDPHRATLRPKLYWFNALLTVTLLTAMIMEWLPIPVLFLLGAALALTVNFPHMPDQKARLGAHAENVLNVSGMVFAAAVFTGVLQGTGMVDHMAEWLVSNIPDGMGPHMAFVTGVLSIPLTYFMSNDGFYFGILPVLAEAGQAHGVSSLEIARASLVGQPLHMSSPLVPAVYVLVGMAKVEFGDHTRFVVKWAALTSLVVLGAGILFGII

SEQ ID NO: 14119 - protein, 386 aa, Streptomyces avermitilis
MARPAVSYRALALGADERAVGVIAGVYALLPLFAAVPLGRRTDHGRCAPLLPLGVVLIAGGCALSGAADSLAAMAAWSGVMGLGHLCFVIGAQSIVARQSAPHEQDRNFGHFTIGASLGQLIGPVVAGALIGGPDRAGSSALALLVAGAVAAVSCASLWRIEHRTTANSRTERGDRIPVHRILRTRGVPAGIFVSLAVLSATDILTAYLPVVGEHRGIAPSVVGLLLSLRAAATIACRLVMTPMLRWLGRAALLTVTCLAAALLCAGIALPVPVWALAVMLAALGFCLGVGQPLSMTTVVQAAPDDARSTALALRLTGNRLGQVAAPAAAGLIAGVAGVAAPFVMLGALLLISSGIALRAPGKQVVRQRTGGPRRSGAPLGRTRDS

SEQ ID NO: 14120 - protein, 253 aa, Streptomyces avermitilis
MTTSPLSRRAGAARTGAAAALAVLATATTASIGAPVAFAAPGDEGELRIHRVGAPLGVPKDDSKVCRFYLDATNFDGATTVTYTIEAQPPLPNTATLTGAIILAAGVGRTEPLALPDGQYKLTWPVPPSATAPQKEKIFRVDCREENEHGEKEYNGASGPQGGGYQGGDSQGGAGQGGDSSSQGGGHESQGGGNSSSQGGEDGPKGGVHAGGGGLADMTEAVSPVAATAAVGLVVAGGVTYFRLIRRRPHGAA

SEQ ID NO: 14121 - protein, 243 aa, Streptomyces avermitilis
MAPRRRLRRPWYRTRAYRLTRTAALVAVLVTVGNRCGQDDEPGGPAVLAGPERPAVAADAAGPGTDARGPGTGAERTGRSARSAPPPTPLPRSRATVLRIPHLGIEAPVIGLRLDRDRQLATPPVDKPKLVGWYEGGPAPGEKGTAVVVGHRDTRTGPAVFAALGQLPPGRLVEARRADGRTAVYTVDRVQTYEKSHFPDKEVYGTRKRPELRLITCGGTYDRKKGYASNIVVFAHLTATRKG

SEQ ID NO: 14122 - protein, 462 aa, Streptomyces avermitilis
MKAQDGMYIDGAWRPAAGPDMIEVVNPADEQVIGRVPAGTPEDVDAAVRAARAALTAWAATPPAERAARISALRDVLVARQDEIAETVTAELGSPLSFSQSVQVGLPILVAGSYAELAATYAFEERVGNSTVHHEPVGVVGAITPWNYPLHQIVAKVAPALAAGCTIVLKPAEDTPLTAQLFAEAVHEAGVPAGVFNLVTGLGPVAGQALAEHEDVDLVSFTGSTAVGRQIGATAGAAVKRVALELGGKSANVILPSADLAKAVNVGVANVMANSGQTCSAWTRMLVHAERYEEAVELAAAAAVKYADRIGPLVNAKQRARVRGYIDKGVAEGARLVAGGPESTEPQGYFVSPTVFADVTPEMTIAKEEIFGPVLSVIRYEDEEEALRIANGTVYGLAGAVWAGDEAEAVAFARRLDTGQVDINGGRFNPLAPFGGYKQSGVGRELGAHGLAEYLQTKSLQF

SEQ ID NO: 14123 - protein, 359 aa, Streptomyces avermitilis
MVRAAVLPAVGAPLEITGIELPEPGPGQVRVRLAAAGVCHSDLSLSDGTMRVPVPAVLGHEGAGTVVSVGEGVTQVSPGAGVVLNWAPSCGRCHACSLGEVWLCADALTGAGTVYARRTDGSDLYPGLNVAAFAEETVVPAACVLPVPDGVPLTDAALLGCAVLTGYGAVHHSAKVQPGETVAVFGVGGVGLATLQAARIAGASKIVAVDVSPEKESLARRAGATDYLVASENTAREIRGLTDKQGVDVAVECVGRAVTIRTAWDSTRRGGRTTVVGIGGKDQQVVFNALEIFHWGRTLSGCVYGNSDPAKDLPVLAEHVRAGRLDLGALVTERIALDGIPAAFDNMLAGKGGRALVVF

SEQ ID NO: 14124 - protein, 336 aa, Streptomyces avermitilis
MSTPPFTPAPRRRAELLAAGAAAVTVVLWASAFVSIRSAGAAYSPGALALGRLLAGVLALGVICLVRGEGLPPRAAWPGIVMSGLLWFGCYMVVLNWGEQQVDAGTAALVVNIGPILIALLGARLLGDALSPRLLAGMAVSFAGAVAVGLSLSGEGGSSVLGVVLCLLAAAGYAGGVVAQKPALGSASALQATTFGCLVGAVGCLPFAGQLVHEAAAAPVSATLNMLYLGVFPTALAFTTWAYALARTTASRMGATTYAVPALVVLMSWLVLDEVPGPLTLAGGLLCLAGVAVSRSRPRGRTTAPVPEDTAPAPAPEPAPRPAPDPVPRPAPEPRA

SEQ ID NO: 14125 - protein, 251 aa, Streptomyces avermitilis
VPKCPYRMLERMTSRHRSRDAQAPRLARLAGLIADETRAAFLLALLDGRAWTAGELARHAGVAASTASEHLGKLVAGGLLAEERQGRHRYVRLADGRTAQLVEDLAAQVAPGALEQPRTLRESSAGTAMARGRTCYDHLAGRLGIALTDALTGRGLLRQDTGFALTDDGLKWFADAGIGLEPTGRRPLARACLDWTERRPHLAGVAGAALCRHALDAGWCVRIGSERAVKVTDQGERALAALLGIATGALR

SEQ ID NO: 14126 - protein, 213 aa, Streptomyces avermitilis
MARPRKPLLSTDRIVDAARALVDAEGLAAVSTRRLAAELGVSGPSLYNHFRTKDQILEAVADSVSAQVDLSMFEDGRNWRTALHDWAFSYRAALRDHPNIVPVLARGPGRRPAGLRLADAVFGAMVRAGWPPAQATSIGALMRYFIMGSALGSFAGGFVDDETAYDPADYPHLGQAHLLAEQQEKIDERAFETGLTALLDGLAQQYEQVRRAL

SEQ ID NO: 14127 - protein, 383 aa, Streptomyces avermitilis
MNLELSEEQTAVRQLAKDFVDREVAPNVIAWDRAEEVDRSLVKKLGEVGFLGLTVDEEYGGSGGDHLAYCLVTEELGRGDSSVRGIVSVSLGLVAKTIAYWGSEEQKRQWLPGLTSGAYVGCFGLTEPGTGSDAGNLTTRAVRDGDDYVVNGTKMFITNGTWADVVLLFARSTDAPGHKGVSAFLVPTDTPGLTRRPIHGKLGLRGQATAELVLEDVRVPASAMLAPEGKGFSVAMSALAKGRMSVAAGCVGIAQAALDVAVKYATEREQFGKTIAHHQLVQELISDIAVDVDAARLLTWRVADLVDRGQPFATASSQAKLFASEAAVRAANNALQVFGGYGYIDEYPAGKLLRDARVMTLYEGTSQIQKLLIGRALTGVSAF

SEQ ID NO: 14128 - protein, 96 aa, Streptomyces avermitilis
MWFRPWPPTLVRMSETPVKQQNTAAFYGQAVASFSVAMAATAIGIFKLHADAWVRGFLAIAVLYLVTSAFTLAKVIRDRQEGAHPAGRAYGPFEKL

SEQ ID NO: 14129 - protein, 209 aa, Streptomyces avermitilis
VMSTAEETAGGEIQPWAEVTPDAARRLLVAAVEAFAERGYHATTTRDIAGRAGMSPAALYIHYKTKEELLHRISRIGHEKALEILRPAVEGEGSAAERLSEAVRSFVRWHAGQHTTARVVQYELEALGPDARAEIIALRRQTDAAVRGIIQDGVAAGDFDVPDVPGTTVAVLSLCIDVARWFNVNGPRTPDEVGALYADLVLRMVRAKV

SEQ ID NO: 14130 - protein, 153 aa, Streptomyces avermitilis
MAEPRIFTSADELKAAVGEQLGYSDWLEVDQKRIDLFADATGDHQWIHVDPEKAAAGPFGTTIAHGYLTLSLLPALVPQVMRVEGMKMGVNYGSNKVRFPAPVPVGSRLRATAVLQEVTEAGEGVQVTAAVTVEREGGDKPVCVAESVSRYYF

SEQ ID NO: 14131 - protein, 169 aa, Streptomyces avermitilis
VPQIPEKIHELTVGQLSARSGAAVSALHFYESKGLISSRRTAGNQRRYHRDALRRVAFVRAAQRVGIPLATIREALAELPEERTPTHEDWARLSEAWRAELDERITQLGRLRDHLTDCIGCGCLSLETCVLSNPDDVFGERRTGSRLMVDRAASRPRRTPGQQQPEDCC

SEQ ID NO: 14132 - protein, 355 aa, Streptomyces avermitilis
MSTLRVTAEVLTIHPHPNADALELAQVGLYRAVVAKGAYRTGETAVYIPEQSVLPAGLIEELGLTGRLAGSGSDRVKAVRLRGELSQGIVCRPKALADVDLARTVADGTDFAELLGITKWVPPIPPTMSGEIESVPDLLRWVDIENIQRYPDIFTPGEPVVLTEKLHGTACLVTYLADEDRVHVSSKGFGAKSLALKEDPRNLYWRAVHGHGVAQAAARLAERLGARRVGIFGEVYGAGVQDLTYGADGRRDTLGYAVFDVSADIDGEVRWLDAADRLDGELPLVPRLYEGPYDIERVLETASGRETVSGHGLHLREGVVIRSATERRSPVTGGRAIAKAVSPAYLTRKGGTEYE

SEQ ID NO: 14133 - protein, 173 aa, Streptomyces avermitilis
MSVVISSLKYEAAHSGAQKITYDNDGYHLVRFPYEVSEESYDPWKMHDPARGGGQASTYPDTRSGLIWPSHDGWAVLSAMVFWEADARALEYRARFVRDPLGVSTGYDSTATNDTTLTRGGQYRTYLWQMFVHPGTPVGLKISARGVGDAKIAVPITLAEFKLAIHTDVKTPS

SEQ ID NO: 14134 - protein, 200 aa, Streptomyces avermitilis
MAGFRSLARQVRDPRCDLALRRYSLRKCLERFAPYGHRATWDHLCSRAGFGPEDRSPDPARLVAALDELEEARSVWLAYEVEFAQRRKKEKHDGLRRPGSVDDWHRLTWGGFGVAWCDDPRVHPHEALAEVLRRLIAALEREPGEACPVCAGERLTWKYDLAHEPSSGPVCTGCGIVVPRPVLTPEALVEARRGRLLVSA

SEQ ID NO: 14135 - protein, 929 aa, Streptomyces avermitilis
MSRRTPRIALDRLRTPRRIPKFLKAASICVLVAGLLSPVTQVAAADTSAAAAGDYCGGQCSDILPPGENGNATLAQILLNQAFGTQPDHAEDQLAPYGNLPSGYSALTDAKINNFFNDASFGVASDQVASTTKPGGRSDVTIVRDKKTGVPHITGTTRYGTEYGAGYAAAQDRLWLMDVFRHVGRGQLTSFAGGAPSNQGLEQEFWRNAPYTEADLQAQIDSAIANNGARGQQALADANAYIEGINAYIDASDSGRYFPGEYVLTGHKDSITNAGTIDHFKLTDLVALASVIGALFGSGGGGEVNNALSLIAAQSKYGVTEGTKVWESFRERNDPEAVLTVHNGESFPYASKPDSPQGAALPDAGSVTQEPLVYDRTGSAATAGATGASATAAATTLTSAKRGMSNALVVSGKHTASGHPIAVFGPQTGYFAPQLLMLQEIQGPGLSARGASFAGLSMYVELGRGQDYSWSATTSGQDIIDTYAVELCQDDYHYLYHGTCTAMDKVERTNSWKPTTADSTAAGSYRMQVYRTKYGPVEYRATAGGKKVAYTTLRSSFLHEADSIIGFQMLNDPDYVKSPQTFQSAVQHINYTFNWFYADSTHTAYYNSGDNPVRATGVDAEFPVWAQAAYEWRNWNPATNTADYTAASAHPNSVDQDYYISWNNKQAKDYTTASWGDGSVHRGNLLEDRVKKLVAAGGVTRASLVKAMADAALADLRAEDVLPKLLRVINSSTVTDTTAAAAVGKLSAWVTAGAKRTETSAGSKAYANADAIRILDAWWPLLVKAEFEPGLGSDLFTAFTSNLPTDEPPSSAHGPTGAHAGSSFQYGWWSYVDKDIRAVLGEPVQGGLEKSYCGSGSLSACRDTLISTLKEAAGKTAAQVYPGDDQCSAGDQWCADSIVQRTLGGIKHGKITWQNRPTYQQVVEYTSHR

SEQ ID NO: 14136 - protein, 453 aa, Streptomyces avermitilis
MAERAMSVTPYWELTFDADGDVDGRERDRLLAQVAQRKVHDLVVFAHGWNNERSGATRLYSRFFQPVPALAPRARLGYVGVVWPSMIFPDEPIPDFPASVPAEVTAVARPALAKGARQALVEVFPDRATLVEQIARLLERHPDEEASLETFGQLVRLLVEARPQDPQDACAADTLATGGPVSGPEMLSGDTALVCRDFARALDRVASLHGTSAASGAVDFSFTPAGLWDGAHELLRQATYYAMKRRAGTVGERGLGRVLGRLAQAAPDVRVHLVGHSFGGRLVSFALRGLPAGVRTVKSVTLLQGAFSHYAFAARLPHDTHASGALHGLQSRIDGPLVCCYSHFDSALGTMYPLASRMAGDARSAAGELGADFDIGRTLGPRWGAMGHDGVQAVDGTRAFTLAEALRAELPASGCVNVDAAAVVKRGGPPTGAHSDIVHRELAQVVLAAGRIR

SEQ ID NO: 14137 - protein, 445 aa, Streptomyces avermitilis
NMPTPDTALVYAGTCLFEGTNLSEGRGTTRPFELLGADGIDGRWAREAERLGLPGVRFREAYFAPTFSKFQGKTVGGVQIHVHDRAAYDPVRTGVALLVTAKKVWSGFTWRSDNWIDKLTGSARVRTMIDAGATADEVVAAWQDELAAFRRVRKEYLVYRSGDRTRHFGSVAPDRTHLANLPRRQDDTPTSWDHRGQGGLSWRNGQVLPTGSRSTRTGTWTAGNGIGCSRRWRSARSMTWSSSPTAGTTNARGPPGSTAASSSRSRRSHRGRVSGTWVWCGPRSSRTSRSPTSRRPCRPRSRRSRARPSPRGPGRRWWRCSPTGPRSSSRSRGCWSGIRTRRPRWRRSDSSYGCWSRRGRRIRRTRAPRTPWRRAGRAAPRCSRGTRRWCAATSRGRSTGSRRYTVRARRPARSTSPSRRRGCGTGRTSCCGRPRTTRSGARGRS

SEQ ID NO: 14138 - protein, 439 aa, Streptomyces avermitilis
VRTSVRGHDSSVDHGGHRMKLSRRGLLAATTAAVSLTAPPAAADGGRLRTGFERLAADGYGLLDGQRVGIVTNPTGVTSGGPSRSSEAESGGVRHIVDVMHADDRVHLTAVFGPEHGFRGTAQAGGSEGRYDDPATGLPVYDTYLKSGRPLADVFTASGVDTVVFDIQDVGARFYTYIWTLYDCMEAAGLAGKRFVVLDRPNPVTGRTAQGPVLHKEFATFVGRQPIAQAHGMTAAELARLFNGEFLTTPVPLDTVLVSGWKRSEFYDASGLPWVPPSPNMPTPDTALVYAGTCLFEGTNLSEGRGTTRPFELLGADGIDGRWAREAERLGLPGVRFREAYFAPTFSKFQGKTVGGVQIHVHDRAAYDPVRTGVALLVTAKKVWSGFTWRSDNWIDKLTGSARVRTMIDAGATADEVVAAWQDELAAFRRVRKEYLVYR

SEQ ID NO: 14139 - protein, 254 aa, Streptomyces avermitilis
MVEAVQDAGVVVTGAGGGIGAALARRFAAEGARVVVNDLDAVRAKAVADEIGGIAVPGDASAIVAEARDALGGTVDVYCANAGLASGGTEAADEKVWALAWDVNVMAHVRAAQELLPGWLERGSGRFVSTVSAAGLLTMIGAAPYSVTKHGAYAFAEWLSLTYRHRGVQVHAICPQGVRTDMLTASGSAGDLVLAPTAIEPDDVADALFKGIEEDRFLILPHPEVAEYYQARATTPDRWLANMNHIQQKWEAAR

SEQ ID NO: 14140 - protein, 555 aa, Streptomyces avermitilis
MTGSPYAAKPWTALLNDAQGAPVAPVASLVHAVRRAAADTPERTALAYFDGRITYRALDELSDSVAGHLAARGLERGDRVAILLQNSPHFVLALLGAWKAGAIVVPVNPMYKSGEVTHVLKDGEVAALVCSDRAWDSYLRETAAGTPVRIVLTACELDLQTRNDARVLNFERLPQAADADDLIAVARRGHKAPADRAAVPSDIALISYTSGTSGAPKGATNTHGNIMYNAERQRTGLALPGTPVYFAMAPLFHITGMVAQLAGCLNSAGTLVLAYRFEAGVVLDAFAEHRPVYTVGPSTAFMALAAHPDVTRDHFSSFRMISSGGAPLPPALVEKFRAGFGPYIHNGYGLTECTAPCASVPPGLEAPVDPVSGTLAVGAPGPDTVVRIVDDQGEEVPFGEQGEILVRGPQVVPGYWRLPEATAETFPEGELRTGDIGFMDPQGWLYVVDRKKDMINASGFKVWPREVEDVLYTHPAVREAAVVGVPDGYRGETVKAYISLRPGADEDPAAFAAYCKERLAAYKYPRQVEILPDLPKTASGKILRRELRSRSGETQ

SEQ ID NO: 14141 - protein, 200 aa, Streptomyces avermitilis
VAAVPRTTDGDGTPVPQRLLAAATRLFADRGYDRTSVQEIVEAAGVTKGALYHYFGSKDDLLHEVYARVLRVQQERLDAFADADAPIEERLRAAAADVVVTTIDNLDDAMIFFRSMHHLSPEKNKQVRAERRRYHERFRALIEEGQKEGVFSTRTPADLVVDYHFGSVHHLSTWYRPGGPLTPQQVADQLADLLLRALRP

SEQ ID NO: 14142 - protein, 407 aa, Streptomyces avermitilis
MDFAFDARTEELRQKLLAFMDEHVYPAEAVAHEQRERLASPWDTPVIVEELKAEARRQGLWNLFLPDSEYGAGLTNLQYAPLAEITGRSPQLAPTALNCAAPDTGNMEVLAQFGDERQRKQWLEPLLAGEIRSAFAMTEPEVASSDATNITTLIERASDGTDEYVITGRKWYISGAMNPDCKIFIVMGKTDPGGADIRRQQSMILVPRDTPGVQVKRAMQVYGYEDHSHGGHAEVIFDHARVPVSNLIGEEGGGFAIAQARLGPGRIHHCMRLIGMAERAIELMCRRAVSRTAFGKPLAQQGVVHNWIADARVAVEQLRLLVLKTAWMMDTVGNKGAHAEIQAIKIATPRTVVDIIDKAVQLHGAGGVSQDFPLAELWASARTLKLADGPDEVHQRSLARRELKKYV

SEQ ID NO: 14143 - protein, 340 aa, Streptomyces avermitilis
MSPDHPPGLDLDRLRGLLDAERPGLVTGPLTGRLIEGGRSNLTYVVTDGTGKWVVRRPPLGHVLATAHDMKREHRVISALHPTAVPVPRPVLLCEDDSVLGSPFYVMDFVEGTPYRTAEQLAPLGPERTRGALLGLVDTLVELHAVDPAEVGLVDFGRPEGFLDRQLRRWGKQLDASRNRELAGIDELHAALGRELPHSPAPTVVHGDYRLDNVLLGADDRITAILDWEMSTLGDPLTDLGLVAMYSVPLALPDSPISTTAAAAGHPDPAELIERYAARSGRDVSAVSWYTAFAWFKLAVILEGIHYRYTLGQTVGGGFDRIGELVPVFIEHGLTTLQEG

SEQ ID NO: 14144 - protein, 303 aa, Streptomyces avermitilis
MTAAEPYTVELAADVHAYVQPDGGWCLNNAGFVSDGTTTLLVDTAATERRTRALSAAIAAAGVPAPRFVVNTHHHGDHTYGNSHFAPTATIVSHAECRRETLANGRQLHLLWPENDFGDIRIQAADLTYTGHTTVHVGAVDAEVIHPGVAHTVSDSVVWLPHRRVLFTGDLVFEGGTPFILMGSLSGSLRALDVLRQLGAETVVPGHGPVTDPSAFDRTERYLRFVADIAHKSHAAGRTPLEAARETDLGEFAALPESERFVANLHRAYAELDGAPEGAPLDVPAAVRDIAAMNGGRMVACHA

SEQ ID NO: 14145 - protein, 107 aa, Streptomyces avermitilis
MTAPAQERDPGLQPERTRLAWRRTTLSGTVAAVLAVKTTLHSGTAAGLIVCALCCALWVGFLAVAHHRIRDLSTAGAHRPPALAPRHAAAAAFCTVALALCAAALVL

SEQ ID NO: 14146 - protein, 130 aa, Streptomyces avermitilis
VIEFARNVRLWFAPQEVRKVGGTPDYRFSLANERTFLAWLRTALALIGGGFAVDQFLPDLRWGWRVGLALALLAAGVLCSLRAVNHWVRCEQAMRRGEDLPVSRFPALLSIAVAVVAIAMVLVVLVGWEG

SEQ ID NO: 14147 - protein, 200 aa, Streptomyces avermitilis
LDGPMSEPVSEAVTEAAVSGATSGPTGGPVDPADELLDIVDENDRVVGQSARGEAYARGLRHRCVFILARDGEGRIFVHRRTPTKLVFPSLYDMFVGGVVGAGETYDDAALREAEEELGVCGLPRPAPLFKFLYDNGAGQTWWSSVYEVRCDLPVSPQVEEVAWHDFLPQDEVERRLADWEWVPDGLAAYERLKAHRATG

SEQ ID NO: 14148 - protein, 307 aa, Streptomyces avermitilis
VAPLSFEVRSVSVLVLVLAVSAAFCLGIGFVLQQNAAQHAPLSDFLSPRLLLDLMHVRRWLGGIGFMVVGMVLGAVALAHGELSLVEPLLATNLLFALGLSRRQTKQPLGRQGWAGLALLAGGVTAFIVAGQPTGGDAVTNPLRHWVIIGVMVGFALLLTTYAKQSRLSAAPVLLSLAAGLLYGVQDALTRVSGQRFSEGGWPELVTGWQPYAVLALGVTGLVLVQSAFETAPLRMSLPALTAAQPLAGIVCGVGFLGDQLRTDTGALAWEAAGLAAVVLGIVLLGLHPAMPRGSAEAERQRDLQPH

SEQ ID NO: 14149 - protein, 551 aa, Streptomyces avermitilis
MAHDADVIVIGAGLAGLAATAELVDAGRKVILLDQEPEQSMGGQAFWSFGGLFFVDSPEQRRLRIKDSHALALQDWMGTAGFDRPEDHWPRKWAEAYVDFAAGEKRAWLHRQGVRFFPVVGWAERGGYDANGHGNSVPRFHITWGTGPGLIEPFVRRVRAGVARGLVELRFRHRVTGLSRSAGAVDTVTGEVLEASDIQRGRASSREVTGAFELTAQAVIVTSGGIGGNHDLVRANWPERLGRAPEKMISGVPAHVDGRMLAIAEGAGARLINRDRMWHYTEGIQNWNPIWHNHGIRVLPGPSSLWFDARGNRLPVPLFPGFDTLGTLEHIMKTGYDYTWFVLDQKIIGKEFALSGSEQNPDLTGKSIKDVIGRARAEVPGPVKAFMDHGVDFVVEKDLGALVRGMNALTKEPLIDEAALRREIVARDREIANPFTKDLQVTAMRGARRFLGDKLIRTAAPHRILDPKAGPLIAVRLNILTRKTLGGLETDLSSRVLTEGGAPLEGVYAAGEAAGFGGGGVHGYRSLEGTFLGGWLFSGRTVGRAAAQAVG

SEQ ID NO: 14150 - protein, 316 aa, Streptomyces avermitilis
VPPPPPPLGRGRKRAAHAFDAALDDAELVASRASLTQGRWAPVRALLAATRDDWDRRGHRVTVLAQESAALPWAREWQLAEPESPCAAVLLACATVHRALNGKERPQTAREACHAAAALAPDDPTPWLGLLILERSLGTDEDVVRLFDEVRHRCPDHHHAHQLIVARLAERRADAGRDPLHEVYDFANWAAEQAPADSPLAILPVVAHAERYRVLAAAGAEPADPVASGHWVGRRARQVMKAAFDWWLEWERDDHPRRFVDLNFLAHAKFCEGRGAEAAALFHRIGEHATPAPWSYPDRDPYQAFSAARASALGAP

SEQ ID NO: 14151 - protein, 520 aa, Streptomyces avermitilis
MTTGSSSTSESRPANRSAVADDISTFKGQERALRADRLGTAGLLLSVLAATAPLMVVAGVMPTTFGVMGIVGQPLLFVVLGAVLALFSLGYAEMSRHVHNAGAFYAYISRGLGGTAGAGAAAVALVAYSALQFAIYGIFGFEVSGLCATYLELQVAWWIPALAAVLAVGALGLLKIDVNARVLGVLLLIEVVLVVVFDIAAVADPAKEGLSLHAFNPDTLTGAGVGTALCFCVAAFLGFEQAPVYAEETSRPDVLVPRVMFLAIGFVAVFFAVSCWAFTVAAGPSTIVAAAQKQSAGLLFQLTESRLGGTFTDVLHVLFVTGMFAAMLSFHNVVARYAFAMGREGLLPAAFGRTTGASGAPGTGSLLQTAVSAVIVIAFAMADDKPAGDPTAPVLHLFTWFGSVGALGVTLLMVAASLSVIVFFARRGAARAQAWRLATSAVSGAALLVIVGYTVKDFGVLVGTGPDSALGWVLPAIIGVALVLGLAQGLVLRSRKPQAHARIGLDNEAFQLDKAAESAT

SEQ ID NO: 14152 - protein, 203 aa, Streptomyces avermitilis
MESVLAGAAEKDPTGLTGLLPNGGGFRYYSVTSSVPHKGEANYRLTIDGLVDHPTSFTLADLRALPQTRLVRDVQCVTGWRVPGTPFEGVRLSRLLDAAGVRSSARAVRFTCFDGAYTESLTLAQARRADVLVALRMQDKPLGHNHGGPVRLYVAPMYFYKSAKWLSGITVTEDVRPGYWEDRGYDVDAWVGKSNGRDDDPTS

SEQ ID NO: 14153 - protein, 218 aa, Streptomyces avermitilis
MTLRADAPAPAVSSRVRRFTRAERWVHRVTAALMGVCVVTAACLYIPVFAELVGRRDLVVRVHEWAGLLLPAPVLAGLASRAFRSDLGHLNRWGPHDRVWLRAVLRRDARPSSRPAAKFNAGQKTYAAWIAGASLVMVGTGLLMWFTHLTPLMWRTSATFVHDWLALTIGVVLAGHIGMALADPEARRGLRTGSVSREWASQEHPLWREGPPGGDRRG

SEQ ID NO: 14154 - protein, 341 aa, Streptomyces avermitilis
MLGCVIHGRGDLRVDELPEPAAGPGQALVAVRYGGVCGSDLHYWRHGGVGDFRLREPMVLGHEVVGTVLSYGPGAAGPAPGTAVAVHPATPCGVCPECADGRANVCRDTRYLGSAARMPHVQGGFAARVVVPAAQVRALPEGLDLRRAALAEPLSVALHAVRRAGPVAGRPVLVTGAGPIGCLVVAAAKAAGAGRVTVTDLLPRALSYAAGVGADDVVRADDPADAGWPDSVDVAVEASGVAAGLDTCLRLVRRGGVVVQLGMLPPGQTPFAGNLVVSREIELRGAFRFADEFDEALTLLAREPAFDSLISAVVPLEEAESAFALAADRGEACKVLLDFGV

SEQ ID NO: 14155 - protein, 252 aa, Streptomyces avermitilis
MSHPLFDIAGRTALVTGSSRGIGRALARGLLEAGCTVVLNGRDGDRLTAAAAELPGDVRTAAFDVTDGPSVAAGIAEVEERVGPLDILVNNAGIQLRAPLLEFTDSDWHRILNTNLTSAFLVGREAARRMTERGHGKIVNICSLQSEVVRPGIAPYAATKGALKMLTKGMCADWGPYGVQVNGLGPGYIETELTRPLVEDEEFSAWVRHRTPAGRWGRTEDLVGGVLFLASPAADFVSGQVLYVDGGMTSVL

SEQ ID NO: 14156 - protein, 465 aa, Streptomyces avermitilis
VTRLSVEKLAADTVEPITSAGHAQLGIAVLAGIAVIVLLITKFKLHAFLALTIGSLALGAFAGAPLDKTIVSFTAGLGSTVAGVGVLIALGAILGKLLADSGGADQIVDTILAKAGGRAMPWAMVLIASVIGLPLFFEVGIVLLIPVVLMVAKRGNYSLMRIGIPALAGLSVMHGLIPPHPGPLVAIDAVKANLGLTLALGVLVAIPTVIIAGPVFSKYAARWVDVPAPDRMIPTRASEDLDKRPGFGATLATMLLPVVLMLAKALVDIIVDDPTHQVQRVFDVIGAPLIALLAAVIVGMFTLGRAAGFTKERLSTTVEKSLAPIAGILLIVGAGGGFKQTLIDSGVGQMILEISKDWSIPALLLAWLIAVAIRLATGSATVATISAAGLVAPLAADMSTAHTSLLVLAIGAGSLFFSHVNDAGFWLVKEYFGLSVGQTVKTWSIMETIISVVAGGLVLLLSLVI

SEQ ID NO: 14157 - protein, 178 aa, Streptomyces avermitilis
MEQVHTPHVVVVMGVAGTGKTTIGPLLAARLGVPYAEGDDFHPPANIAKMSAGVPLDDVDRLPWLDAIGAWAHSRAGLGGVVSSSALKRSYRDRLRAAAPGVVFVHLTGDRELIEDRMSHRQGHFMPTALLDSQFATLQPLAADEAGVAVDVTGGPEEISERAVTALRALEPASQPAK

SEQ ID NO: 14158 - protein, 233 aa, Streptomyces avermitilis
MTTPGRGLHGHVLETLGPAIAAGTYPPGSVLRTDELAQRFEVSRSVMREAVRVLESMHLVESRRRVGVTVRPKAEWNVYDPQVIRWRLAGADRPHQLRSLTVLRSAVEPAAAGLAARHATADQCADLTECALGMVATSRGHQLEAYLVHDVAFHRVILNASGNEMFARLGDVVAEVLAGRTHHEVMFEDPDPAAVTLHVQVAEAVREGDALRAEQLTREITVGALQELDILAP

SEQ ID NO: 14159 - protein, 140 aa, Streptomyces avermitilis
MSKSRRTRSTSRPTSRPQPASCPCGLPEVYEACCGRFHSGAADAPTAALLMRSRYCAFVRRDEAYLLRTWHPRTRPAEVDFDPRMRWTGLEILGTTEGSAFHSAGTVTFRASYRGGALQERSRFERIGGAWVYVDGEFFE

SEQ ID NO: 14160 - protein, 483 aa, Streptomyces avermitilis
VTRSGPKDGAPARRTSPAQGADAAVSPRQKAEADPYFPTNGDARYRVHRYELTLDYRPGPNRLAGTARLNAIAGRAPLAEFQLNLADFRIGRVRVDGKAPHYTHRGGRLRIRPPKPVRAGAAFTVEVHWSGNPQPVNSAWGGLGWEELEDGALVASQPVGAPSWYPCNDRPADKAAYQLSVTTPSAYSVVAGGRLLTRTTKASTTTWVYEQPAPTSSYLVGLSIGKYQTVLLGDPGLGGVPQTGHIPAHLLTEFSRDFARQPAMTELFEELFGPYPFGEYAVVVTEEELDVPVEAQGLSLFGANHVDGKRGSERLVAHELAHQWFGNSVTIADWRHIWLNEGFAKYAEWLWSERSGGRTAQQLATLAHRKLSSLPQDLRLADPGRKLMFDDRLYERGGLVLHAVRCALGDEAFFRMLRGWAGVHRGGVVTTAAFTTHAARFSAQPLDELFTAWLEETALPSLPVLAAPVPARPPYPPHITGSA

SEQ ID NO: 14161 - protein, 1291 aa, Streptomyces avermitilis
MAALQQGPALALSDDEVRAEFGDRARFSAGSPASPRTLVDILDASVRAYPDEPALDDGRRCLTYRALAVEIEALRRRLAAAGVGLGDRVGVRVPSGTNDLYIAVLAVLAAGAAYVPVDAEDPDERAELVFGEAEVRAVVGAGHHLTVDGTAGVPAARPGTGHDAWIIFTSGSTGRPKGVAVSHRSAAAFVDAEADLFLTEEPIGPGDRVMAGLSVAFDASCEEMWLAWRYGACLVPVPRSQVRGGADLGPWLVEQEITVVSTVPTLAALWEPEALSDVRLLIFGGEACPPELAERLVTEGREVWNTYGPTEATVVACASLLTGNEPIRIGLPLGGWELAVVDEAGEPVPMGGSGQLVIGGVGLARYLDAEKDAEKYAPLASLGWARAYRSGDLVRAEPEGLVFLGRADEQIKLGGRRIELGEVDAALQALPGVAGAAAAVRTARSGNQLLVGYVVTQDGWDQAAAVEKLRAELPAALVPLLAPVADLPTRTSGKVDRTALPWPLEGVEAPTAELYGTEAWLAEQWTEVLGIPVGGAGDDFFAIGGGSLAAAQLTTRLRTRYPGAAVLDVYQQPVLRKLARRLERSTRDDGAARVIAPVPPRAKALQLLLLIPLFTLLGLRWTVALAALGNVLHRFGPYPWAPSASWWVVTAGAVLFFSPPGRLAIAAGGARLLLRGLRPGRYPRGGSVHLRLWTAERLAEFSGATSLTGSWLERYARALGAKVGADVDLHSLPPVTGMLKLGRGAAVESEVDLSGHWLDGDRLEIGPVRVGAHAVVGTRSILFPGARVGKRAEVAPGSAVAGQIPTGQRWAGAPAGKLGKAKRAWPEERPRRGTYWRAMYGAAGFALSALPVLAGLAALLVAGVFVAPDAGLGAALRGAAIALVPATLAFGCAYALLLLLAVRLLSLGLREGTHPTHSRTGWQAWTVTQLMDRSRETLFPLYAGLITPVWLRLLGMRIGRGAEVSTVLALPSLTTVGEGAFLADDTLTAPYELGGGWMRIGRAQIGRRAFLGNSGMTAPGRSVPDGGLVGVLSATPKKAKKGSSYLGLPPVKLPRSTRDGDQSRTYDPPARLLWGRALVELCRIVPVFCSAALVVLTVAALSALGGWAPLLAGLVFLGAGVLACLTSVVAKWLLVGRHRAGEHPLWSGFVWRNELADTFVEVVAVPWLAGSVPGTPLMTAWLRGLGARIGKGAWIESYWLPETDLVTLEDATTVNRGCVLQTHLFHDRILRTDTVVLREGATLGPGGIVLPGSTVGARSTLGPASLVMAAESVPDDTRWLGNPIEAWRPRA

SEQ ID NO: 14162 - protein, 441 aa, Streptomyces avermitilis
VSESNTARGISGEDEVVDLCRELIRIDTSNYGDHSGPGERKAAEYVAEKLAEVGLEPQIFESHQGRASTVARIEGEDPSRPALLIHGHTDVVPANAADWTHHPFSGEIADGCVWGRGAVDMKDMDAMTLAVVRDRLRTGRRPPRDIVLAFLADEEAGGTYGAKYLVQKHPDLFEGVTEAIGEVGGFSFTVNEKLRLYLVETAQKGMHWMRLTVDGTAGHGSMTNDDNAITELCEAVGRLGRHTWPVRVTKTVRSFLDELSDALGTELDPENMDETLAKLGGIAKMVGATLRNSAAPTMLGAGYKVNVIPGQATAHVDGRFLPGHEEEFLADLDRILGPRVKREDVHGDKALETDFDGRLVDAMQSALSAEDPIAKAVPYMLSGGTDAKSFDDLGIRCFGFAPLKLPPELDFAGMFHGIDERVPVDGLKFGVRVLDRFIDAS

SEQ ID NO: 14163 - protein, 77 aa, Streptomyces avermitilis
MIKKVVAAAAATGGLVLAGAGLAVADSGAQGAAVHSPGVVSGNVIQVPVHVPVNVCGNTVSVIGLLNPAFGNTCINK

SEQ ID NO: 14164 - protein, 303 aa, Streptomyces avermitilis
MRQVTRKGLMTVAAATGVLAATGGYAHADSGAYGSASHSPGVLSGNSVQVPVHVPVNVCGNTVNVVGLFNPAVGNQCANGGGGGHHDGGGHHGGGGHHGGGYGDSPSGGGGHHGGGGHQGGGYGDGPSGGGGGGGGSQAGGHTGDSPGVGSGNHVQVPVDVPVNVCGNNVTVGGLGNAAGGDACADTPGGGHATTPPGGGGGTTPPGGGGGGTTPPGGGGGGTTPPGGGGGTTPPGTPGHPGQPGGDSSAHPNHPGGQSVTQPEGTAQLAHTGSDMPLGLLVPAGAGALLGGALLYRRARSAA

SEQ ID NO: 14165 - protein, 62 aa, Streptomyces avermitilis
MPEYEFVDVYVPRGVSRKEATRLLTDHAEYGHWELDRLSLHRDGSRRVRLRRRIIRQVRATW

SEQ ID NO: 14166 - protein, 236 aa, Streptomyces avermitilis
MSDAAQSTAAEVRAAAEAVKTALDRHLAAVERRSGEDDPAVYEAFNELAAAAEEYDELLYDRYDEVTPFEIPGTDDSLPPYTGPEEPSAVSVLIRRDYAVVEPQRLLAQAQRVEAAEEPADEVAGTVHGALGVLFEEYEPDEIASRHKEFGLEEGDSTLWVTAEEERPEPGEWLEAPFEQIDPQHIVCRFDASAVYDEESDGEESDGEVPEDDLGPDSELDGELDEDDLEPLDADR

SEQ ID NO: 14167 - protein, 734 aa, Streptomyces avermitilis
VDGVPETEGTPGSGAAGDAESSAEGTAGSEAAGATESSEGTAGSEAAGTAEGSGDAAKPTEAEAELAAQRVERERIERRKAEKQAPIEAGTKLSGTAADLLAAVRVVESGAKPVASAFSEPPAPRRPAPEPERRPEPVAAPAGPAVPAAQAVAGVRAVLTEGGAPEALAPQLAALLGDGADLQLREDPWQLLRVSGVRPEQADGFARALLGAECGPDDERRGRAVTVWLLEQAALAGHTALEVAALTTALAQRAVPDPDTAVQSALAEGEVLVFQDALDAAAPAAEAEAEEEGAERPVRVLIGLERYALAEESLADALGRVMNSVPKEDGSAADWERAAASAGGSAAELIRAVAGHGLVLHTGGDASGAEAAALLSAARGLGLRTWAAAHSRIGCDRFTARLAPSDLPGGPQQGPGTGVSTVAGLLSGAEGPGRDADGALVLDLLVVLDAPQLDVETAAMLAESLPDGARLVLSGDPGVLWSAGPGRVFADLLAARVCPGIASRTPDPGPIGELISGIGVGELNQVEAPGKEVVIVPVRDAGEAVHRTVQLVADSVPRALGVPAEQTQVITPGHGGAAGTRALNAALKERLNPGPGRFGGFDPGDRIAYSPAPGRTLPGRVVKADADGLHLEIPGAPVVVPKERVEQCVRHGWALTAHQAVGSRWPAAVVVLPGDAAQSLTRPWVYTAFGLAERHLSVVHGVEQALPRAVAEVTAKPRTTRLPALLRPQVPAAD

SEQ ID NO: 14168 - protein, 327 aa, Streptomyces avermitilis
MEQRHLGRTGLRVSRIGLGTLTWGRDTDEHDAAELLKVFWEAGGTLVDTADVYGDGEAEYVLGQLIEGLVPRRDLVISTKAGSVADPDRRFDGSRGHLLSALDASLARLGTDYVDLWQVHAFDPHTPLEETLQALDLAVSTGRARYAGVSNFCGWQLAKAATWQLSAPGPRTRIASTQMEYSLLQRGVEREVLPAALDLGVGLLPSSPLGRGVLTGKYRGGTPAGSRGASEHLAPFVAPYLDDTASGIVDAVQTAADGLAVTPLQVALAWVRDRPGVAAPIVGARNAQQLTAALSVETLSLPDEICRALDDVSAPVHHYPDQDWSTL

SEQ ID NO: 14169 - protein, 351 aa, Streptomyces avermitilis
MQLGINLGYWGAGMDADNLAVAQEADRLGYGVCWAAEAYGSDAATVLTWVAAQTERIDVGSAIFQIPARQPAMTAMTAATLDSLSGGRFRLGLGVSGPQVSEGWYGVKFDKPLARTREYVEIVRKAMTRERLSYQGEHWTLPLPDGPGKPIKLTVHPEREYIPVYIAAIGPKNLEQTGEIADGALLIFPSADHLEDTAIKHLRAGREKAGKTMDGFDVCPTLPLALGDDKNVTALADTFRPYTALYVGGMGSRKQNFYNQLAQRMGYEKEAAEIQDKYLSGDKEGAAAAIPHELIDQTTLLGSVDRIADRMKAYAAAGVTTLTLAPAGFTLEERIAALRAGTDALERAGLA

SEQ ID NO: 14170 - protein, 262 aa, Streptomyces avermitilis
MLSVRSLFQEILDNDESFRLFCSIAASGESQGGWENGRIAALVPHSQRDLAPKITRHGADEDKHGRIFHALMKKRGLDPVAIPPDTDYTMLLERHGIGLAHEKLKGDEPLTVQDIVTYLAHSRVTEQRAAEQMELLRRHFADHPDIGRAVRMISHDEDNHLAYCHEELLRFAYTGHGRAIQRTLRQCALAEIRVYRDVSLAVMAHMGRLLGWPKARAAALAAGIHAVYAYERAVGWRRMVSLRMPERRDALGGPATTAAEYA

SEQ ID NO: 14171 - protein, 343 aa, Streptomyces avermitilis
VRTCPRDGRIRSVIVDCAIYRDGRRTEGPEDLSDALDEARAQGDSFLWIGLHEPTEKEFDLVTHEFGLHPLAVEDALKAHQRPKLEVYDDSLFVVLKPVTYEPYSDTVSSGEVMVFVGDSFVVTVRHGEGAPLSSIRHELERRPDMLRHGPTGVLHAIADSVVDHYLDVATELGTDLEELEAEVFSPSGGARNTASRIYSFKRQIQEFRRATVPLTPPLTRLAGLGPNLAAVPFVKEEARPFFRDVNDHLTRVNESVEGLDRLVSDILSAHLAQMSVRQNDDMRKISAWAAMAAIPTMIAGIYGMNFEHMPELHWTWSYPAVIAAMVVLEVLLYRLFKQRGWL

SEQ ID NO: 14172 - protein, 240 aa, Streptomyces avermitilis
VRTAGGPFRLGRMPTLILVRHGRSTANTAGLLAGWTPGVALDERGAAQAAALPGRLAEVPVSEIVTSPLQRCRETVQPLLDARPGLRAHTEERIGECHYGDWSGRKLAELKDEPLMEVVQSHPSAAAFPGGESMRAMQTRAAEAVREWNARVERDHGSDAVYLMCSHGDIIKSLVADALGLHLDLFQRISVEPCSITAIRYTRLRPFLVRLGDTGDFASLAPREEPSGGDAPVGGGAGAP

SEQ ID NO: 14173 - protein, 196 aa, Streptomyces avermitilis
VSRQVFLYDPPDRFVAGTVGLPGRRTFFLQASSGPRVTSVALEKTQVAALAERMDELLDEVVRRSGGSAPVPAMAPTEISDNAPLEAPVEEEFRVGTMALAWDGDEQRMIVEAQALVELDAESDEDLAEAEERLLQDEENGPPMLRVRLTGLQARAFAKRALDVVNAGRPPCPLCSLPLDPEGHVCPRQNGYRRGA

SEQ ID NO: 14174 - protein, 261 aa, Streptomyces avermitilis
VTTAELLAEGELKVRGRIREASNAALYCTVSHDGQEAFCIYKPVAGERPLWDFPDGTLAQREVAAYEVSEATGWGLVPTTVLRDGPYGEGMCQLWIEGQPDVELLALVDGEEPEAGWKAIGFADVGEGRTALLVHADDERLRRLAVLDAVINNADRKGGHLLPTDEGRLYGIDHGVTFNTENKLRTLLWGWAGEPLTADAAEALGTLKDGLTAGGALATRLAELITPAELDATRARVDAMLTSGKHPEPSGEWPAIPWPPV

SEQ ID NO: 14175 - protein, 409 aa, Streptomyces avermitilis
MHAWPASEVPALPGEGRDLRIHDTATGGVIPLHPGPVARIYVCGITPYDATHMGHAATYNAFDLVQRVWLDTKRQVHYVQNVTDVDDPLLERAERDGVDWVGLAEKETALFREDMTALRMLPPQHYIGAVEAIPGIVPLVERLRDAGAAYELDGDVYFSVEADPHFGKVSNLDAAAMRLLSAERGGDPDRPGKKNPLDPMLWMAAREGEPSWDGASLGRGRPGWHIECVAIALDHLGMGFDVQGGGSDLAFPHHEMGASHAQALTGEFPMAKAYVHAGMVALNGEKMSKSKGNLVFVSKLRRDGVDPAAIRLALLAHHYRSDWEWTDAVLEEALARLGTWRAAVSRPDGPPAEALVEEIRDALANDLDAPAALAAVDRWAALQHERGGTDEGAPGVVSRAVDALLGVAL

SEQ ID NO: 14176 - protein, 227 aa, Streptomyces avermitilis
LREGGTRMSTTPQLSSMGQQQDQQGRQGQQGPSTAPPQFGQQQPYGQQQPYGPQMQQPFGQQGMGQQGMGQQNIGQQGIGQQQPFGQHQQQIPQHLQQQLQHLGQQQPFQHLLQQLAQPQDIGGQQQQQQQQQQQQDVQHGQALVLPSAVSTAALSIGVAQHFQDVVTPLPGQPQVLYLFISNGWRRLINPNQVTHDAVQEAFAYGQPVYGIYDTATGVLQSVIVTK

SEQ ID NO: 14177 - protein, 652 aa, Streptomyces avermitilis
LHRFPHSTCFQTKLAKSGWTGRHGRARLCVEGAVPGRTTKAGRGAPEGGKSSAPSATWHPQHGPKGAAHAMTDQGQPAQGPGASGPGPDGAGFTYRGAEHELIVVARPEARLRARADGVRSAVGADVSALNMFLSDEQLALEPLFGSEERLQQSMTTGVENVPDLGLFYRVRGVRSRAQELRARIAALPEVDTAYVKPGAVPASTGSGRPTGESADDSRRLKEGTPVTPDFGSRQGYLRPAPEGIDAHWAWQRPGGSGQDVTVIDVEGAWQLGHEDLAAKLAGVVVGTPLTDLAWRNHGTAVIGVIGGDRNERGVTGIVPDAVTAAASFQGIGTAAAIHAAADRLGPGDVVLVELHRPGPRFDYEQRDDQRGYLALEWWPDDFAAIRYATAKGVIVVEAAGNGGESLDDAAYERRPDEFPTWWRNPFNPSHRSSGAVLVGAGAPPPGTHGRDHGPDRSRLAFSNYGARVDAQGWGREVTTTGGFWDRPGDLQGGAEEIVWYTDTFSGTSSASPMVVGALAALQGMLKAADQEPMSPERARVLLRATGSPQQDAPGRPASQRIGNRPDIKAAVTHLLPEAVGSAQAERYWDELLPYPRELPPRLRLFAAGAWRNLNNPSPEIRQAVHTAFAGGRPDIRVWFSDDEIIGLVVTG

SEQ ID NO: 14178 - protein, 334 aa, Streptomyces avermitilis
VIELEGVPELIDPVMVAAFEGWNDAGDAASTAVAHLDREWKGEVFAALDAEDYYDFQVNRPTVWLDGGVRKITWPTTRLSVVRVGGEKPRDLVLVRGIEPSMRWRSFCNELLAFAHELGVELVVVLGALLGDTPHTRPVPVSGVTSDPDLARTMDLEETKYEGPTGIVGILQEACTHAGVPAVSLWAAVPHYVSQPPNPKATLALLNRLEDLIDVRIPLGELPEDARAWQVGVDQLAAEDSEVAEYVQSLEEARDTAELPEASGEAIAREFERYLRRRDGGGPAAGGHATADGSDGTSYLRDAPGGRTRPPKPPKPEAEDDGPADEGSDDSSED

SEQ ID NO: 14179 - protein, 232 aa, Streptomyces avermitilis
MSERQGGPAMAVTDEAIEKIKGMIVSGALRPGDRLPKESELAAELGLSRNSLREAVRALSLIRILDVRQGDGTYVTSLDPQLLLEALSFVVDFHRDDTVLEFLAVRRILEPAATAMAASRISERQLDALTSQLDALGAAPSVEELVACDLEFHRGIVQSSGNSVLCSLLDGLSGPTTRARIWRGLTQEDAVSRTLHEHRAILTALRDRDAEAARSWATVHIASVEQWLRSTL

SEQ ID NO: 14180 - protein, 432 aa, Streptomyces avermitilis
MSETVDLLVHGGDVLTVDEAGTLVRDGAVAVRAGEILAVGPAQELRTRYAAAEDIDAEGCLVLPGLVNTHTHLAMTLLRGRADDVTLQRFLERMLKWEAELLSPKNVAAAVRVAVAESVRAGVTSALDMYWFHEAAERAARESGWRLHTGPTFMDVPDPADGIAYEDRLAWARRDLADRAHRPGTRPVLFAHSTYTLSPGQLLDIAALAREFGALLHLHAAENATEVATVEVRHGKRPVELLDSLGLLGPDVLLAHAVDLTGPEIAALARTGTSVAHCPVSNLKLGCGIAPVPRLLSAGVTVGLGTDGAVSSNTLDVLGALRQAALVHKAGGDPTAVGAEQAVRMATIEGARALGLGDHLGSLEAGKRADLIVLDLGRPHLCPPHDPWSLLAYAAHAPDVRDTVVDGRILMRGRTLTSLDEAAALAELGALA

SEQ ID NO: 14181 - protein, 262 aa, Streptomyces avermitilis
MTQDLLPVTRIPRTGLPPYAVVVGDPARAAAVAALLDGAEEVSYHREYRVFRGAWKGLPVTVASHGVGGPGAILLFQELADAGVRTFVRFGTAGAMKPGIGDGDLVIAEAAVRDDGVTQQLLPAAYPAVSAPEAVLALQRAARETGAPHHRGIVWTRAAFQPGLIPLDGYARAGLAAIEMELSALLVTASLRGLVAGGVLVVDGANADELVDEDALLTTGAYDPHRDVVAAGVERGAVVSLEALRLLAQGAAGTEGTEEYTA

SEQ ID NO: 14182 - protein, 288 aa, Streptomyces avermitilis
MFFDSDLLMSALRALTPILLAALGGALCERAGVFNIGLEGMMLMGCFTSVATSWFTGSPWLGVLAAALAAAGYSLILAVGAVTLRGDAVVLGIAMNLLAVGLTGFLLRTVFGVQGTFDDPSLAGLPLVGGFSPLAYLAWAAVGVAALMLSRHGWGLRLRGVGEAPDAAATLGVSPAKYQYAAVLVSGVLCGLAGAQLALGNVTLFSENMTAGRGWIAVVAVMLGRALPLGVLLAALLFGVAEAAGFRLQGLGLPQQATDAAPYVVTLGALFLTTARRRRRIRATGATS

SEQ ID NO: 14183 - protein, 353 aa, Streptomyces avermitilis
MNRITGALRSPVAFSILAGVVIGALFLVGTGADPVAAYGAVIGGSLGADGIGSTLSTGTSVLGMALALAIPLRAGLINLGGDGQLVLGGIAAAVTGLYAPLPAPLTVVLALFAGMAAGAGYAALAALCENHLGVPLLVSSLLLSYPAASFASYLARYPLKEPGSSLPQTRQLPDGVALPAFGGSTVTVGLVLVALAAAAYWFADRRTAIGYEVRMTGLNSRFAAYAGIERKGLTLRLMAVSGALAGLVGSIGVLSFPYRFVDGSLTAPGHTWTGLTAALLAGAAPLGTVVASFFFAVLQVGGLSMERTTEVPRELTQVLQAIVIVFLAARLRFPRFSRFRRGREKPSAQGEFA

SEQ ID NO: 14184 - protein, 509 aa, Streptomyces avermitilis
MTPPPSDAPPAAVELRGITKRFPGTLANDAVDLTVRRGEIHALMGENGAGKSTLMSVLYGMERPDAGSIRIDGREVSFADPGAAMAAGLGMVHQSFKLFDSLTVAENVVYAAEPRRFGLVDRSAARRRVRELAEVHGLAVDPDARVGELPVGLRQRVEILKLLHRGARTLILDEPTAVLTPAEADALFAVLKSLAAEGRTVILVTHKLREVLEGSDRVTVLRDGRVVARLRTAGTTADEIAAAMTGRAVELDRVHAPGTPADVVLGVRGLTTDAVREVELTVRAGEIVGIAGVAGNGQSELVEALAGLRPTAAGQVTLRGEDITHASATERRARGLAYVPEDRHAVGTAPAASVADNLAMGHHRTSLSSRGLLSAAAVRAHALGLVERFGIKAATPEVPASALSGGNLQKLLIGRELAHEAPLLLVEQPTRGVDIGAVQNIHDQLIAYRDAGHAVLLVSAELSEIRGLADRVLVMYEGRVTATYPKDEADERTLGLAMAGAAAPAEVGD

SEQ ID NO: 14185 - protein, 349 aa, Streptomyces avermitilis
MHRRSRRTLQLAAATTLLVTGLTACNAAAKNDASGTAKSGGKSFTLVTPDGVGQNEFLKLAVDGVKAAAEAHDGTQKVYQSTDTSSQQQNVQAAVDAEPDVIVLVGFEFADVVAQQAKAHPEQQFLIVDACTTKTYRNVSCAVFREHEGVYLAGAEAGLLSRSGKVGAVDVLDTPQFRRYSDPFAAGAKEVAAKTSASTRFVGGQSPFDDSARAKEQANSLLAKGYDQIMAAAAAGNYGVFEAAKAKGAYAYGVDVNQCVAAPGTVVDNVIKRTDVAVRKGIDQVLGGKAGTTVSYGLKEGGISLTGLEDGVATSKCVIAQHKDVLKKVTALRDRIVAGELKVDDPAAE

SEQ ID NO: 14186 - protein, 346 aa, Streptomyces avermitilis
VSVMSQKLRAVDWTGNSLALIDQTVLPHRTETIQVRDVDGLVDAIQRLVVRGAPAIGAAGAYGVALAVLEGEREGWDRTQVLAAVARIRAARPTAVNLMVCVDRVLTRFDEGLDAVLAEAAAVQREDVGANRAMGAYGADWLLKRVAADRPLRVLTHCNTGALATAGWGTALGVIRELHARGQLEVVYADETRPLLQGSRLTAWELVQEGIPHYVQADGAAAGTILRGEVDAAIVGADRIAANGDTANKVGTVGVALACAYAGIPFLVAAPTTTVDLSTATGDGIHIELRGEAEVLEWSGIRTAPAGSRGHNPAFDVTPGRLVTGLVTERGVLEVSAGELPGEHLR

SEQ ID NO: 14187 - protein, 202 aa, Streptomyces avermitilis
MTVDTSVPDLEGAGAVLAAESARFASFGWMRGTSGNLSVVLSRDPLRLAVTASGHDKGELTPADVVLVDGDGAAVAGGRPSAEAALHARVAALTGAGAVVHVHTVASVAMGRREPGGIAFRDLEMLKGVGLPAHDVEVTLPVIANSQDMKVLGDRLEEARDPRMPAVVVAGHGLYVWGENPRQARHHTEVVEWLLELELTQR

SEQ ID NO: 14188 - protein, 239 aa, Streptomyces avermitilis
MSSVFDIDSVVLDIEGTTSATGFVVDVLYPYSRSRFGALLTERSGDPEVARAVAQVRELLGEPDADAVRVEKALNEWLDDDRKATPLKTLQGLVWSEGFARGELVSHFYDDVVPALRAWHAAGVRLHVYSSGSVAAQRAWFRSSPEGDLLPLVEGLYDTENAGPKQEPESYRTIAAALGTGADRILFLSDRPGELDAARAAGWRTVGVRRPGEPYYEQGVGDHAQAGSFGGITIARSTA

SEQ ID NO: 14189 - protein, 197 aa, Streptomyces avermitilis
MTLLTTWPESGPETVVRRTSDPAEIAAALAPLGVRYEQWPVRADVPADADSDTVFAAYGPEIDRLNAEEGFTTVDVLGLHPSDDPEYPVKAKAARAKFLQEHTHDDDDEVRFFVSGSGIFYLHVNGEVHAVYCEKGDLLGVPRGTTHWFDMGTRPAFTAIRFFHEEDGWIGSFTGSTIASRFPDYDTIHAGHVGSAA

SEQ ID NO: 14190 - protein, 372 aa, Streptomyces avermitilis
VIPPLPLRTGTPSSSSSPRPGAPHVPYPPARRRALTKQALPWVRVAGPSWPMSPERADAEARAYEQVAGVAPDKIPAIHGYDGENHALVMEDMSDLEVLRTVLNEGAAYGPDTSRRIGEFVAQLSFATSGFGMPSAERKALIAACVSPELCKITEDVVLSEPYIEHEHNHWHPGLDDLAAAFRADPRLRTEVADLRHVFMTSAQAPLHGDLHTGSVMVGERDGAPVVRVFDPEFSFVGPIGFDLGLYWANTLVSQERARALGTLTDHGEQLRLSWEAFAAQFRRLWPTRVDTFFDDAYLDRFLDRVWAESLGFAGTEIVRRVIGFAHLTDLTTLPDPVPASRRALLLGRELIVRRAELTGPDDVRAVVASLS

SEQ ID NO: 14191 - protein, 538 aa, Streptomyces avermitilis
MTSQPTLQSVPALGTHPASGSNPSRAETREQLSKATYDLLVIGGGILGISTAWHAAQSGLRVALVDAGDFAGATSSASSKLLHGGLRYLQTGAVKLVAENHFERRAVSRQVAPHLANPLTFYLPVYKGGPHGAAKLGAGVFAYSALSAFGDGVGHLLGPSKAAQDVPELRTENLKAVAVYGDDQMNDSRMALMTVRAAVESGAVVLNHAEVTGLRFTRGRVTGAELKDRTNGEEFGVNARLVLNATGPWVDHLRRMENPDAAPSIRLSKGAHLVLKRTSPWKAALATPIDKYRITFALPWEDMLLLGTTDEEYEGEPGDVAVNEKDIAQILDEAAFSIRDQQLSRDLITYSFAGLRVLPGGPGDTSKAKRETVVTEGRGGMLSVAGGKWTTFRHIGRTVMKKLESLPGHPLGEDFEPINELPKKLPLPGVANPRAVAHRLLVDGPAPGPRMAADTAKHLATHYGSLAFDIARLANDNPELGERVHQDAPEIWAQVVYARDNEWAETADDVLRRRTTLTIRGLATDEVRGKVQDLLDKK

SEQ ID NO: 14192 - protein, 512 aa, Streptomyces avermitilis
VTDAHTAGPFIAAIDQGTTSSRCIVFDRDGRIVSVDQKEHEQIFPKPGWVEHNAAEIWTNVQEVVAGAVEKAGITRDDIKAIGITNQRETTLLWDKNTGEPVHNALVWQDTRTDALCKELGRNVGQDRFRRETGLPLASYFAGPKARWLLDNVEGLRERAEAGDILFGTMDTWVIWNLTGGVNGGKHVTDVTNASRTMLMNLHTMQWDDKIAESIGVPLAMLPEIRSSAEVYGEITGGKLGDLLGGIPVASALGDQQAALFGQTCFSEGEAKSTYGTGTFMLMNTGDKIINSYSGLLTTVGYQIGDQKPVYALEGSIAVTGSLVQWMRDQMGLIKSAAEIETLASSVEDNGGAYFVPAFSGLFAPYWRSDARGVIAGLTRYVTKAHIARAVLEATAWQTREITDAMTKDSGVELAALKVDGGMTSNNLLMQTLSDFLDAPVVRPMVAETTCLGAAYAAGLAVGFWTNTEDLRANWRRAAEWTPNMAAETRDREYKSWLKAVERTMGWIEDEE

SEQ ID NO: 14193 - protein, 264 aa, Streptomyces avermitilis
VSSSDIFIGETIGTAVLILLGGGVCAAVTLKASKARNAGWLAITFGWGFAVLTAVYISAPLSGAHLNPAVTLALAIKDNDWSNVPTYWAGQLLGAMIGAALVWVAYYGQFHAHLTDHEIVGGPGAQATKTKAVEAQETGAGPVLGVFSTGPEVRNVVQNLATEIIGTVVLVLAILTQGLNDNGNGLGTIGALITSLVVVSIGLSLGGPTGYAINPARDLGPRIVHALLPLPNKGGSDWSYAWIPVVGPLIGAAIAAGIYNVAFA

SEQ ID NO: 14194 - protein, 254 aa, Streptomyces avermitilis
MARNIQSLERAAAMLRLLAGGERRLGLSDIASSLGLAKGTAHGILRTLQQEGFVEQEAASGRYQLGAELLRLGTTYLDVHELRARALVWTDDLARSSGESVYLGVLHQQGVLIVHHVFRPDDSRQVLEVGAMQPLHSTALGKVLSAYDPVAHSEVLEAERKVFTPRTISELDQFEGVLDLTRARGYADDVEETWTGVASVSAPIHNRRRMPVGAVGITGAVERVCKDGQLRPDLIAAVRDCARAVSRDLGAGRF

SEQ ID NO: 14195 - protein, 1190 aa, Streptomyces avermitilis
MGSAKPTAVALQGASSMASLPNPSPSSASAASRSRTDALREALATRVVVADGAMGTMLQAQDPTLEDFENLEGCNEILNLTRPDIVRSVHEAYFAVGVDCVETNTFGANHSALAEYDIADRVFELSEAGARLAREVADEFGTGDGRQRWVLGSIGPGTKLPTLGHVGYGTLRDGFQANAEGLIAGGADALIVETTQDLLQTKTSVLGARRAMDATGVDLPLLVSMAFETTGTMLLGSEIGAALTALEPLGIDMIGLNCSTGPAEMSEHLRYLTRHSRIPLLCMPNAGLPVLTKDGAHFPLGPEGLADAQENFVRDYGLSLVGGCCGTTPEHLRQLVERVRGVEPTERRPQPEPGAASLYQTVPFRQDTAYMAIGERTNANGSKKFREAMLDARWDDCVEMARDQIREGAHMLDLCVDYVGRDGVADMEELAGRFATASTLPIVLDSTEVDVLRAGLEKLGGRAVINSVNYEDGDGPESRFAKVTRLAQEHGAALIALTIDEEGQARTVETKVAIAERLIEDLTTNWGIHESDILMDCLTFTICTGQEESRGDGIATIEAIRELKRRRPDVQTTLGLSNISFGLNPAARILLNSVFLDECVKAGLDSAIVHASKILPIARFDEEQVTTALDLIYDRRSEGYDPLQKLMALFEGATTKSLKAGKAEELAALPLDERLKRRIIDGEKNGLEADLDAALQDRPALDIVNETLLDGMKVVGELFGSGQMQLPFVLQSAEVMKTAVAHLEPHMEKSDAEGKGTIVLATVRGDVHDIGKNLVDIILSNNGYNVVNLGIKQPVSAILDAAEEHRADVIGMSGLLVKSTVIMKENLEELNQRGLSADYPVILGGAALTRAYVEQDLHEIYQGEVRYARDAFEGLRLMDALIGVKRGVPGAALPELKQRRVRAAAVEVEERPEEGAVRSDVATDNPVPAPPFRGTRVIKGIQLKEYASWLDEGALFKGQWGLKQARTGDGPTYEELVESEGRPRLRGLLDKLQTENLLEAAVVYGYFPCVSKDDDLIILDEQGNERTRFTFPRQRRGRRLCLADFFRPEESGERDVVGLQVVTVGSRIGTETAKLFEANSYRDYLELHGLSVQLAEALAEYWHARVRSELGFAGEDPDRMEDMFALQYRGARFSLGYGACPNLEDRAKIAALLEPERIGVHLSEEFQLHPEQSTDAIVIHHPEAKYFNAR

SEQ ID NO: 14196 - protein, 250 aa, Streptomyces avermitilis
LPKKGSRPDRPSRRCARMTSTVPALGTRSAEGSALQAVLLDMDGTLVDTEGFWWDVEAEVFAALGHPLDESWRHVVVGGPMARSAGFLIEATGADITLAELTVLLNDGFEARIGRTLPLMPGAARLLAELAAHEIPTALVSASHRRIIDRVLTSLGSQHFALTVAGDEVARTKPFPDPYLLAASGLGAEPARCAVIEDTATGVAAAEAAGCRVVAVPSVAPIAPAARRTVVTSLEEVDLPFLRGLMTEMR

SEQ ID NO: 14197 - protein, 534 aa, Streptomyces avermitilis
MNRKTLVLPAVVGLLAPVLAACGGSDSGSSGGGSVVVGTTDRFTASSDAPAPVDPAYAYDVGTWNILRQTVQTLMVQPRGDGEPEPEAAESCGFTDTGNERYACKLRKDLKFSSGKAVTAADVKFSIDRARSIKADSGVFALLSTVDTVETQGDREVIFHLKTADATFPFKLSTPVAGIVNPDDYEKDKLRDGFKIDGSGPYTMEAEEKDNELVKAVFTKNPNYKGALKVKNDEVEMRSFEDASAMGAALSKGDIDLMTRTMTPDQIQKLSTDSKGDVNLVEMPGLEIRYLAFNTDATTVKTKAVRQAVAQLVNRGELVSKVYGSTAEPLFSLVPATITGHSNSFFNKYGDASVAKAKSLLARASITTPVKLTLHYTTDHYGSATKTEFQQLQQQLNNSGLFDVRIKGEPWSTFRPAEQKGKYDVYGMGWFPDFPDADNYIAPFLDKDNFLGSPYANSEIIGNLIPQSRREADRLTASKSITDIQDIVANDVPVLPLWQGKQYIAAQDDITGAEWALNSSSTLQLWELGRGVSD

SEQ ID NO: 14198 - protein, 527 aa, Streptomyces avermitilis
VNMRNQWPVLSVATGLAAGLLTGCGSDTGDSGGTGSEVVMGMSDDVLATDPASGYDPGSWLLFNNVFQSLLSFPKGGTEPEPEAARECKFTDTETKVYSCTLRDGLKFSNGDALTSKDVKFSFDRMLKINDASGPAIMFPMLDRVETPDAKTVTFRLKTPDATFPSKIASGAGSIVDHNSYSATGLRKDGGAVGSGPYKLDSFDDDKAVFSVNDSYKGTAKVNNSGVTLTFFHGNQTALKNALLNNEIDAAYRGLAAADVADIDNDTSTGKGINVVEGTSAEVQHMVFNMDDPVAGKLGVRKAIAYLLDRDALVNKVYDNTATPLYSIIPAGIAGHDTSFFDTYGARPSKAKAAAALLAEGITGKVKLTLWSTPSRYGPATDEEFRTIAGQLNASGLFDATVKSVAYSQYEKDIAQGKYGVYVKGWVPDYPDPDNFTAPFFGKGNVLSNNYSNSTITGQLIPKTAAQSDRASTDAEYGRLQDIVAEDLPVIPVWQAKQYAVVRDNVYGLEYCLDASTVFRFWEISKG

SEQ ID NO: 14199 - protein, 223 aa, Streptomyces avermitilis
VAIRVLLVDDQPLLRTGFRMILEAEQDLAVVGEAGDGLQALDQVRALQPDVVLMDIRMPRMDGVEATRQITGPGRDGPAKVLVLTTFDLDEYVVEALRAGASGFLLKDAPANELVQAIRVVAAGEAMLAPSITRRLLDKYAGHLPSGDEPVPDTLHTLTEREVEVLKLVARGLSNAEIAADLFVSETTVKTHVGHVLTKLGLRDRVQAAVYAYESGLVRPGAQ

SEQ ID NO: 14200 - protein, 286 aa, Streptomyces avermitilis
VTVAVPPRSLSPSRASDFMQCPLLYRFRVIDKLPEKPSEAATRGTLVHAVLERLFDAPAAERTAPRARSLVPGQWDRLRESRPEVVELFADDPEGERLARWLGEAEQLVERWFSLEDPTRLEPAERELFVEAELDSGLRLRGIIDRVDVAPSGEVRIVDYKTGKAPRPEYAEGALFQMKFYALVVWRLKNVVPRRLQLVYLGSGDVLTYDPVVADLERVERKLHALWDAIQLATETGNWRPRPTKLCGWCDHQAVCPEFGGTPPPYPLQIGPPESGGREQGRMGPD

SEQ ID NO: 14201 - protein, 376 aa, Streptomyces avermitilis
MGRPFGVPVYVAPSWFLVAALITWVFGGQLDRVLPELGAARYLVSLFFAVAFYASVLIHELAHTVAALRFKLPVRRIQLQFFGGVSEIEKETETPGREFVLAFVGPLLSLILAGIFYLAMQTVDRGTVPGVLIAGLMISNLIVAAFNLLPGLPLDGGRMLRAVVWKITGKPMSGTIAAAWVGRALAVAVLIGLPLLTQTGALGSNAEDVGGMDTVTDALLAAILAAIIWTGAGNSLRMARLREHLPELRARNLTRRAVPVETDTPLSEALRRANDAGARALVVVDADGEPLSLVREAAIVGVPEHRRPWVDVSGLAQDLTDGMRISAELAGEDLLDVLRATPATEYLVVEESGEIYGVLSAADVERAFVKAMARPN

SEQ ID NO: 14202 - protein, 300 aa, Streptomyces avermitilis
MSEPTGAARRRGPFKVGDQVQLTDPKGRHYTFTLEAGKNFHTHKGSFPHDELIGSPEGSVVRTTGNVAYLALRPLLPDYVLSMPRGAAVVYPKDAGQILAFADIFPGARVVEAGVGSGSLSSFLLRAIGDQGMLHSYERREDFAEIAQQNVERYFGGPHPAWQLTVGDLQDNLSDTDVDRVILDMLAPWECLEAVSKALVPGGILCCYVATTTQLARTVESIREIGCFNEPTSWESMIRNWHVEGLAVRPDHRMIGHTGFLLTARRLADGVEPPMRRRRPAKGAYGEDYTGPNADGGAGR

SEQ ID NO: 14203 - protein, 191 aa, Streptomyces avermitilis
VQQSAVPELAHTTTRPIHWVATATALAGVVALSSVLQPGSATAAQPGPGTKAAKVATAPPDPAKADFPLDCGPTKLLVQKKASGDLDGDGQPETVAVVRCDASMGTPPDGVYVLTRAADAKKPRVVATLVDPKDRLTVTDFAVRDGAVTATFLGYSSSDVPSCCPDVKDRAKWQWKGGAFVRSTPSAAQSV

SEQ ID NO: 14204 - protein, 101 aa, Streptomyces avermitilis
MTVQQEAAVDGEALEVWIDQDLCTGDGICVQYAPEVFELDIDGLAYVKSADDELLQAKGATTPVPLTLLRDVADSAKECPGDCIHVRRVSDSVEVYGPDAE

SEQ ID NO: 14205 - protein, 588 aa, Streptomyces avermitilis
VAAHDDDMNRGIRPGRGSDDPAGQIAYLEQEIAVLRRKLADSPRHTRILEERIVELQTNLAGVSAQNERLANTLREARDQIVALKEEVDRLAQPPAGFGVFLTANEDGTADIFTGGRKLRVNVSPSVELEELRRGQELMLNEALNVVEAMEYESVGDIVTLKEILEDGERALVVGHTDEERVVRLAEPLLDVTIRPGDALLLEPRSGYVYEVVPKSEVEELVLEEVPDIGYEQIGGLGNQIEMIRDAVELPYLYPDLFKEHELRPPKGVLLYGPPGCGKTLIAKAVANSLAKKVAEVTGQATGKSFFLNIKGPELLNKYVGETERQIRLVFQRAREKASEGTPVIVFFDEMESLFRTRGSGVSSDVENTIVPQLLAEIDGVEGLQNVVVIGASNREDMIDPAILRPGRLDVKIKIERPDAEAAKDIFGKYLTERLPLHTEDVGEHGGDRSATVHGMIQTAVEQMYAESEENRFLEVTYANGDKEVLYFKDFNSGAMIENIVGRAKKMAIKDFLEHSQKGLRVSHLLQACVDEFKENEDLPNTTNPDDWARISGKKGERIVYIRTLITGKQGADTGRSIDTVANTGQYL

SEQ ID NO: 14206 - protein, 503 aa, Streptomyces avermitilis
MTVRRVMGIETEYGISVPGHPNANAMLTSSQIVNAYAAAMHRARRARWDFEEENPLRDARGFDLAREAADSSQLTDEDIGLANVILTNGARLYVDHAHPEYSAPEVTNPRDAVLWDKAGERIMAEAAERAAQLPGAQPIHLYKNNTDNKGASYGTHENYLMKRETPFSDIVRHLTPFFVSRQVVTGAGRVGIGQDGHEHGFQLSQRADYFEVEVGLETTLKRPIINTRDEPHADAEKYRRLHVIIGDANLSEISTYLKLGTTALVLSMIEDGFIAVDLAVDQPVRTLHQVSHDPTLKRLVTLRSGRTLTAVQLQMEYFELSRKYVEERFGADADEQTKDVLVRWEDTLNRLENDPMSLAGELDWVAKRELMEGYRRRDDLDWDAARLHLVDLQYADVRAEKGLYNRLAARGRMKRLLDENDVERARTKPPEDTRAYFRGRCLEQYADDVAAASWDSVIFDLPGRDSLQRVPTLEPLRGTRNHVKELLDRCRTAEDLVRVLSGA

SEQ ID NO: 14207 - protein, 72 aa, Streptomyces avermitilis
MATKDTGGGQQKATRNTEEVEEQAQDAQASEDLKERQEKLSDDVDSVLDEIDDVLEENAEDFVRSFVQKGGE

SEQ ID NO: 14208 - protein, 202 aa, Streptomyces avermitilis
MGASGLVNEEGVKRCVRCGECRPRAAFARRRSNLDGLQRHCRECASDYHRARQESLGKKVRPKVEVPEGHKLCLKCGEVKPWSAWHRNATASDGLSTRCKACRAVEGRAGHLKRHYGLTEAERDEMVASQMGICVICLKAPAAHVDHCHRTGSVRGVLCFNCNSAIGKLGDDPDAVRRAAAYLEGTPWKPTLVAPGVYRLPS

SEQ ID NO: 14209 - protein, 281 aa, Streptomyces avermitilis
VEANTRSTGRLPAAFLTPGSSSFMDFLSEHQPEILPGNRQLPPTQGVIEAPHGTTIVATTFPGGVVLAGDRRATMGNVIAQRDIEKVFPADEYSAVGIAGTAGLAVEMVKLFQLELEHFEKVEGATLSLEGKANRLSTMIRSNLAMAMQGLAVVPLFAGYDVDREKGRIFSYDVTGGRSEEHGYASTGSGSIFARGAMKKLYRDDLTEQQATTLVIQALYDAADDDSATGGPDVARRIYPIVTVITEDGFRRLTDEESSEIARAILERRLEQPDGPRAALL

SEQ ID NO: 14210 - protein, 253 aa, Streptomyces avermitilis
VSTPFYVSPQQAMADRAEYARKGIARGRSLVVLQFADGIVFVGENPSRALHKFSEIYDRIGFAAAGKYNEYENLRIGGVRYADLRGYTYDRDDVTARGLANVYAQTLGTIFSSAAEKPYEVELVVAEVGETPEGDQIYRLPHDGSIVDEHGSVAVGGNAEQISTYLDQRHQDGMTLAEALKLAVQSLSRDTNGSEREIPAERLEVAVLDRTRPQQRKFKRIVGRELSRLLEAAGASTAGEAGSAEDEGSDDEK

SEQ ID NO: 14211 - protein, 338 aa, Streptomyces avermitilis
VARASTHPTSRDVAQAAGVSQAAVSLVLGEKWRGRVSEATAERVREAARELGYRPNLAARNLRLGRTRTVLLVVPALTTEFFAGVYTGAARLAAEHGFGVVLYPSPEGIGPARDPFGSAQAALDGVIASSMAADALTAIRGDQLPLVMLDSDPEGSLGAATVNLDIADGVRQVAEHLLALGHRRFLHLAADIPSWTFEVRARELAARVGTIPGTEVRTTRAPISIEGAVAAAEAALAAPGPRPTALVCDDDKLAAGAYKAARRLGLRVPDDISVTGLDDLALATAIDPELTTVRLDAERFGERGMAALLAVLEGRTPEEGDIPVQLVIRGSTAPPRTS

SEQ ID NO: 14212 - protein, 419 aa, Streptomyces avermitilis
MAAGYLEILRARHAARLLTGTLVGRLPNATAAIAVVLFIRAEGGTYSLAGALAAVYGVANAVGQPLLGRLVDLYGQPRVQLPAALVSALAMTAFALSGTNPLPPAYVSMAVAGLFTPPLEGGLRALWPSVLRREDQVHTAYAMDAVAQEVMFTVGPLLVTLCVALWSAQAALVVLNVIGVLGALSVVVSPPSRAWRSAPREAHWLGALRSPGLLALLGAFLFVGLALGSITVAGVSYADDNGGDAVYGWLMAALGLGALVGGTVYGARQWGGAPERRLRGLVALLAVCYLPLVLVPGPVAMTALTALAGVFLAPCIACAFIIVDRHAPSGTVTEAFSWLVTTFTVGASVGTGLAGPVVEWGGTLWGFAVPGVAGAVSLLVLLATGRVLAAPAGGPVVAASSENDPNRAVEPRFSSGDRA

SEQ ID NO: 14213 - protein, 453 aa, Streptomyces avermitilis
MDRRIFGLENEYGVTCTFRGQRRLSPDEVARYLFRRVVSWGRSSNVFLRNGARLYLDVGSHPEYATPECDNVTELVTHDKAGERILEGLLVDAERRLHEEGIAGDVYLFKNNTDSAGNSYGCHENYLVARHGEFSRLADILIPFLVTRQLLCGAGKVLQTPRGAVYCVSQRAEHIWEGVSSATTRSRPIINTRDEPHADAERYRRLHVIVGDSNMSETTMLLKVGATDLVLRMIEAGTVMRDLTLENPIRAIREVSHDITGRRKVRLASGREASALEVQREYYEKAVDFCERRGIRTGTVEQVLELWGRTLDAIEAEDLDRIGTEIDWVMKYKLIERYRAKHNMTMSHPRVAQIDLAYHDIHRRRGLYYLLEKRGQATRICNDLKIFEGKSVPPQTTRARLRGDFIRRAQEQRRDFTVDWVHLKLNDQAQRTVLCKDPFRSVDDRVEKLIAGM

SEQ ID NO: 14214 - protein, 334 aa, Streptomyces avermitilis
VRRRSVLLAVPAGLVTLAGCGDEKSDTAKTKPSTSPSPSASASSAPPPKIVDGPLPAITAGTKFDEKPTVAKGSGDPSKDVAVKTVIAGSGKTVAENDYIQANYLGQVWDTAKVFDNSYDRKTPLVIQLAQGSIIDGWRYALAGKKAGSRVLMSVPPTWGYGKQGNSQAGIKGTDTLVFVVDIQNTFNAKSSAQGKDVAQGDAKLPKVGTNTDGKAPSIDVPKTAAPTKLVANYVIEGDGDVVKADSSVLVQYKGVLWDTGKEFDSTYSRSALTSFSLQQVVKGWSQGLTGKKVGSRVLIVVPPKLGYGDSPPSGSGIEKDSTLVFSVDILAKM

SEQ ID NO: 14215 - protein, 124 aa, Streptomyces avermitilis
VSIEKPEIDFPGGEPPADLEIKDIWEGDGPVAKAGNTVSVHYVGVAFSTGEEFDASWNRGTPLQFQLGAGQVIKGWDQGVQGMKVGGRRQLTIPAHLAYGDRGAGGGRIAPGETLIFVCDLVAV

SEQ ID NO: 14216 - protein, 325 aa, Streptomyces avermitilis
MAIAKAERLMNLALCLLGTRRPLSKRELRDSIEAYVEAFGPGKGAASSDDSFNRMFERDKDDLRELGLVIETVENLDGEVGYLARRDSNRLPAITLDAEEAAALGLAAKVWQQARLAGAASGALQKLRAAGLPEDVDPYEAHGALEPRIPVHEAAFEPLMLACRDRRPASFDYRKANAARPEPRTVEPWALECWRGHWYLAGWDRDRGAERVFRLSRITGKVRTRSGRYTAEVPDVVTVRETVASWAGETADRSALIRLRTGAGYPLRAKAVSVRELGDGWDELEIPYGHGLDAWLVEFGPDVVVLEPAELRADVVDRLRAVAKG

SEQ ID NO: 14217 - protein, 346 aa, Streptomyces avermitilis
VAGKPARPANAIDQTRRMLSLVTYLRERPGARVEDVARAFGITEDELISDLDVLPLCGTSFRGGDLLDIDTDGDRIWWHNPAALGADAAEPLRLAADEATALLVAARAVSTLPGLREGDRQALLRATAKVETAAGEAAGASSRLSVTFESEGGVFADVDRAISERRRLWIRYYSPARDELTEREIDPIRLVSVGHTYVEAWCRRSEARRTFRLDRVAEIRILDEPSAPPEVELRDLSEGLVQPAAEDPEVVVEVGPGGRWVAEYYPHDSADELPDGGLRITLRTPEPASLRRLALRLGRDGRIVSPQDLADSARRAAQEALAAYDDAPRGADGVQDGPYDRQEQGL

SEQ ID NO: 14218 - protein, 126 aa, Streptomyces avermitilis
VSTSSMSGAPEQSDTARRVVVPGPASGTADRAVVPVEAPEMSVGAAFAGMRRVAHVVFRAGCPDCRARFELGANALRLAIGATSRTTFYSFTCPECGVPVRKPAGERIVALLTGGGVRTLRLHSTV

SEQ ID NO: 14219 - protein, 64 aa, Streptomyces avermitilis
MFWPMLAIAVGFLGLAVLGVLAVRVFLAAERLGRQVTDSARRINRAADDLERATVAAARSADPV

SEQ ID NO: 14220 - protein, 94 aa, Streptomyces avermitilis
MFGRLGAPEIILILVVIILLFGAKKLPDMARSLGKSARILKSEAKAMKSEGQESTPAGPPNTDEQPPAQRTIQAAPGDVTSSRPVSEPTDTTKR

SEQ ID NO: 14221 - protein, 315 aa, Streptomyces avermitilis
LLKPARNKEKDPEGRMPLAEHLRELRNRLAKAMLAIVVVTAVAAFYYNDIINFFTKPVLESVGCPKTFAEVAKMPEGKQCAQITINGLLAPFTLALKVSLMAGVALASPVWLYQLWAFVAPGLHRSEKKYAYAFVGTGVPLFMGGAFFAYKVLPTTAKVLMEFTPNGVSNLLPLDDLLDLVTRMVVVFGLSFELPLLLVMLNLTGILTGKRMLGWWRGMIMGITVFAALATPSTDPLTMLALAGPIWILYFGAVAFSLVNDRRKRRREAEGPDDDEASELDLTPEDIGEIETVSANRALPEQSVTDRVNGYDDVT

SEQ ID NO: 14222 - protein, 296 aa, Streptomyces avermitilis
VTSEITLFVNPTAGRGRGAHAAQPAASALRAAGFSVRTILGENAEDALARAREAVAGGTGALVAVGGDGMAHLALQAVGGTRTPLGLVAVGTGNDFARALGLPVRDPAAAGRVIAEALKGARLRDVDLGRVDGTWFGTVLASGFDSRVNDRGNRMRWPTGRFKYDLAMLAELAAFTPVPYRMTLDDGAVREIEATLVAVGNGSSYGGGMKICADADLDDGLFDITVVGDCSRTTLLKVFPKVYKGTHLDHPKVTVHRAAKVELVAQGITGYADGEPLGPLPLTAECIPGAARVAVP

SEQ ID NO: 14223 - protein, 937 aa, Streptomyces avermitilis
MTEDLSPAERYAAARQRAAEQATALAPFREMYDFGLDPFQIEACQALEAGKGVLVAAPTGSGKTIVGEFAVHLALQQGKKCFYTTPIKALSNQKYADLARRYGADKVGLLTGDNSVNSDAPVVVMTTEVLRNMLYAGSQTLLGLGYVVMDEVHYLSDRFRGAVWEEVIIHLPESVTLVSLSATVSNAEEFGDWLDTVRGDTQVIVSEHRPVPLFQHVLAGRRMYDLFEEGEGHKKAVNPDLTRLARMEASRPSYQDRKRGRAMREADRERERRQRSRVWTPGRPEVIERLDAEGLLPAITFIFSRAACEAAVQQCLYAGLRLNDEAARDKVRALVEERTASIPTEDLHVLGYYEWLEGLERGIAAHHAGMLPTFKEVVEELFVRGLVKAVFATETLALGINMPARSVVLEKLVKWNGEQHADITPGEYTQLTGRAGRRGIDVEGHAVVLWQRGFSPEHLAGLAGTRTYPLRSSFKPSYNMAVNLVDQFGRHRSRELLETSFAQFQADKSVVGISRQVQRNEEGLEGYKESMTCHLGDFEEYARLRRELKDRETELAKQGAAQRRAEAAVALEKLKPGDVIHVPTGKYAGLALVLDPGLPAGRSNGHRGFEQHDGPRPLVLTAERQVKRLASMDFPVPVEALERMRIPKSFNPRSPQSRRDLASALRTKAGHIVPDRHRKGRSAAADDREIARLRAELRAHPCHGCNDREDHARWAERYYRLMRDTSQLERRIEGRTNTIARTFDRIVALLTELDYLRGDEVTAHGKRLARLYGELDLLASECLRAGVWEGLDPAELAACVSALVYESRVGDDAMAPKLPSGKAKAALGEMVRIWGRLDALEEDFRITQTEGVGQREPDLGFAWAAYMWASGKGLDEVLREAEMPAGDFVRWCKQVIDVLGQISAAAPVRGEGSTVAKNARKAVDELLRGVVAYSSVG

SEQ ID NO: 14224 - protein, 366 aa, Streptomyces avermitilis
MPVEFLGIAATNEGSEVTARSGPSFDKEYTLRLARAHEEYGWDRILFAYGSGSPDPSPAAAYIAARTEKIQILVAHRPNVSYPTFAAKTFATLDRISDGRLAVHFITGGNDHEQQREGDFLTKDERYARTREAIQIIKKAWTTHEPFDHEGTHYRFHDFVSDTFPVQQPHPPVSFGGSSAAAYAAGGAEADIYCLWGEPLAQTAEQIESVKAAAKAAGRTDIPRIQVAFRPIIAPTEELAWEKAHRTLARIKARTAGAPLSRRHPLKNPENSGSQRLLAVAARGDRHDRALWTPTAAETGGAGNSTALVGTPETVAEALLDYYDLGVDILSARGYDLLDDAIDFGRHVIPIVREEVAKRDAARVAA

SEQ ID NO: 14225 - protein, 550 aa, Streptomyces avermitilis
MSTLSRVRAAYARVAAVDRPEIWIDLRSRADVEAEAAVTDERVAAGQRLPLAGRLFAVKGNIDVHGLATTAGCPAYAYLPEADAPAVARLRAAGAIVLGTTNLDQFATGLVGTRSPYGAVRGAYDPARISGGSSAGSAVAVALGIVDFALGTDTAGSGRVPAAFNGIVGLKPTRGLVPTTGTVPACASLDCVTVFARTLPEAEQALAHLASPPGRDLPPLPQRAPGPWRVAVPPLPQLGELDEGWGEAYEAAVEHLVAAGVSVRTIDLSPFTEAAAMLYEGAFVAERYTAVGSFVDKLISEGGAGLDPTVAGIITRARDIPAHRLFADQERLATLRTRALAELGDADALLLPTTPGHPTLAEVAADPLGANARLGRFTNSTNLFDLAAVAAPAGLTPAQLPFGVMLIGPAFTDGRLARIAALLQPQLSVAVIGAHLSGQPLNPQLLALGARRERTTTTAPAYRLHALPTTPPKPGLVHVRQGGAAIETEVWRLPAEGLGRLLASLPRPMTLGQVELADGSRVPGFLCEPDALTDAADITEYGGWRAYLDR

SEQ ID NO: 14226 - protein, 1171 aa, Streptomyces avermitilis
MTFDTLLVANRGEIAVRVIRTARELGLRTVAVYSDPDRSAPHVRLADEAVRLGPAPAKESYLDADLVLKAAKDTGAGAIHPGYGFLSEDAAFARRCEDAGIVFVGPTPEQLELFGAKHTARAAAEAAGVPLAPGTGLLASLDEALDAASRIGYPVMLKATGGGGGIGMSACRSAAELAESWERVRRVTAASFSSAGIFLERLVEHARHVEVQVFGDGRGRVVTLGDRDCSLQRRNQKVVEEAPAPGLPSHVRDHLASAARDLCAAVGYRSAGTVEFVYDAAREEAYFLEVNTRLQVEHPVTEEIYGVDLVAWMLRLAGGDADVVRDPGPPRGHAVEARVYAEDPSREHRPSAGLLTRVEFPQGVRVDGWVETGTEVTTSYDPMLAKVVAYGSDRAHALARLDEALARTRVDGIETNLGLVRAALADHGLRTATHTTATLAKITDPTPRVEVVAAGTLTTVQDWPGRTGYWQVGVPPCGPMDDRSFRLGNRALGNEEGAPGLECTLRGPALRFTHATTVCVTGAPAPVTVDGTPVAQWEPVTVPAGALLEVGAPAEPGLRTYVLFAGGLDVPAFLGSAATFTLGRFGGHGGRALRTGDVLHGGSVTDRGAPVPAGDRPVFATEWHVGALEGPHAAPEFFTEDDIRDFYAAGWKVHFNSARTGVRLVGPKPRWARSDGGEAGLHPSNIHDTPYSVGAVDYTGDMPVLLGPDGPSLGGFVCPATVATAERWKLGQLRPGDTVRFTPLAEDGSTRPAIVDGGVLARDGDVTYRRSGDDNLLVEFGPMQLDLALRMRVHALMEAVAEAGLDGVTDLTPGIRSLQIRTDPRRLPLRELLAVVRETVSALPPTDQLVVPSRTVHLPLSWDDPATREAIERYMAGVRDDAPWCPWNIEFIRRVNGLESVADVYDTVFDAEYLVLGLGDVYLGAPVATPLDPRHRLVTTKYNPARTWTAENSVGIGGAYLCVYGMEGPGGYQFVGRTTQVWSGWQQRGAFEPGSPWLLRFFDRIKWYAVGPDELLDLRADIASGRFVPRVEEGEFSLAGYESFLAANAGSIAAFRARQGAAFAAERDAWEAAGEFARAEAATAPEAPPAEVTVPVGGALVEAEFAASVWQLNVGPGDAVTAGQPLLTLEAMKMESRVPAPMAGVVTEILARPGDQVAAGTALVVLAPATS

SEQ ID NO: 14227 - protein, 211 aa, Streptomyces avermitilis
MTRTAVTETVVPARAAWSAVVRAGETLTLTDLHGNQAVDFLVYDAHDTAVRYSAPDTIHAQGSVFLTTGSVLLSNEHTPLMTVVADEVGRHDTVGGACSKESNTLRYGHHTWSQHACVDNFLAEGAKYGLGKRDLVSNINWYMNVPVEKDGTLGIVDGISAPGLALTLRAERDVLVLVSNCPQINNPCNGFEPTAVRMTIGAAVQVQGDAS

SEQ ID NO: 14228 - protein, 274 aa, Streptomyces avermitilis
MATATTYGARAHARAQEGARTEAMPVVPASAWPAPPCAAGHLVWAETVAGGNYTHRVLARGTELRLTDLRGDACAHLLLYVADRPWERLNVADTVKVQWNAYLGEDRLLLSDQGRVLASVVADTSGRHDALCGTSTLVRNTERYGDGTPQSASPAGRELFKLAAAKNGLEPRDLPPSLSFFQGVEVRDDGTLDFTGSAGPGGSVTLRAEQDLTVLIANVPHPADPRTDYVSTPLEVLAWRADATRPGDPLWEATPEGRRALLNTAEFLAARGLA

SEQ ID NO: 14229 - protein, 207 aa, Streptomyces avermitilis
MGTSGRRVGRPRAAQRPDSGLSPRDELLTAAAELFTTRGYAATTTRAVAERAGMRQASMYHYVSGKEELLAALLESTVTPSLALARHLLAEDAAPAESRLWELCRTDVELLCGGPHNLGGLYLLPEVHTERFAGFHAVRAELKDTYRQLLAATAVGGALAKSELDLRTDLVFGLIEGVILVHRSDPERPVSAFAEATADAALRIVGV

SEQ ID NO: 14230 - protein, 527 aa, Streptomyces avermitilis
MVSVQSPPGGRELPYARVLLLPAILMAAATGAAVALVAEPARIAVGWCGAVATLLVIAAAAEAVRRGRTVRELRAEVARRTADLEERVAAHDAEFVRLGQEILPAALELVRVGESPSEVIRKTVDAEPEWRDLPPPQRSLLTTVVRVVDRQFALRDSSQRTFVNIARRVQAIVHQQNKELREMEEDHGRNPEVFDDLLRIDHGTALIGRLADSIAVLGGGRPGRQWPLPVPLYSVLRGAMSRILEYRRVELHSIAKVNVAGVSVEPLIHAAAELLDNATRYSPPQTKVHVTAIEVQTGVAIEIEDAGVSLSEEALARTEGMIERAKMSMDLQDIGETPRLGMAVVGRLSTMYNMQISLRQSAYGGVRAVLVVPRDMLTDDPAPGFAHGIGAASAPIMDTDAVEAPDRKAKKRRPTTGPRIPSQYADMEDDVPEVTEWTANGLPQRRRRVQMSLTERYAEQARIEAEAKATGVNIWEPEPAPEEPKEPEPEPGLWVEAFMNGLKGDPDPTAFTKNPALAEADDEGDLK

SEQ ID NO: 14231 - protein, 135 aa, Streptomyces avermitilis
VIQQRANFDWMLKELADGVPGVHQIVVLSADGLRIARYGGDPDAADRVAAACAGLQSLAGAVATEIPHSDGKMRMVIIEMDGAYFYMMAAGPNAYLAVLSDVTAEAGLMSNRMRDLVVRIGAHLTSPPRRNGQTV

SEQ ID NO: 14232 - protein, 141 aa, Streptomyces avermitilis
MTPPQRRRRSPEPQPPPRPPQPNDGNDGKDGDASNPERLFILTGLADGGERAALDLVTLIVAGADPPPTAPPEQSALLRLCQAPLSVAEISAYLRLPFSVVTVLLTELLAAELVTARAPISREALPDRSLLEAVMHGLQKL

SEQ ID NO: 14233 - protein, 206 aa, Streptomyces avermitilis
MDFKSSDAIRGPRTEDHLPHTAQAAVKIVIVGGFGVGKTTMVGSVSEIRPLTTEETMTQMGIGVDDNYGSESKTATTVAMDFGRISITEQLVLYLFGTPGQERFWFLWNGLFEGALGAVVLIDTRRLEVSFDVIGRLEERGVPFVIAVNDFPDAPRYPVEDLRGALDLTEDIPIVKCDARRRASSREVLMTLMHFLHSLAVSKTSV

SEQ ID NO: 14234 - protein, 486 aa, Streptomyces avermitilis
VTPEPHPSTGTDDPTFGPPPGCPAHDPGLGGVRRLYGPEAEDLGDLYEKLRAEHGAVAPVLLHNDVPMWVVLGHTENLHMVRSPSQYTRDSRVWTPVLDGTAGPDHPLMPHIAWQPICSHAEGDEHLRLRGAVSGAISTIDHRGIRRYINRSSQALVNRFCEEGRADLVGQFAEHLPMAVMCEILGMPDEYNDRMVQAARDMLKGTETAIASNAYVMDALMRLTARRRAHPEGDFTSHLINHPAQLSDDEVGQHLRLVLIAAYEATTNLLANVLRMVLTDPRFRAQLNGGQMTVPEAVEQSLWDEPPFSTVLGYFAKQETELGGQLIRKGDGLLLGIAPGNVDPHVRPDLSANMQGNRSHLAFGGGPHECPGQDVGRAIADVGVDALLMRLPDVQLDCAEDELRWTASISSRHLVELPVRFAPKEPQDVSQRPSLRPLPQPVPSRPVRTQQPQATTPPPAPPAPPAAAPERGPGAWQRFLRWWRGY

SEQ ID NO: 14235 - protein, 321 aa, Streptomyces avermitilis
VAPRTLIAMRRKPRIPPSPLPQREGVDPVRVKLPQGGAWGTVRDHLVARLAAGDGVVDGMLDAGLIVGADGRPVERDTAYVPGMFVWFHRELPDEERVPFALDVVYRDEHIVVADKPHFLATTPRGSHVAETVLARLRRDLGIPELGAAHRLDRLTAGLVLFTVRPGERGAYQSLFRDKLVHKEYEAVATYDPEVALPRTVRSRILKERGLLAAREVAGEPNAVSRIELTEHRDGRGRYRLLPRTGQTHQLRVHMNALGLPILGDPLYPVVTDPGPAGDFRRPLQLLARVLEFTDPVTGHEHRFLSERVLTAWSAYEDWVR

SEQ ID NO: 14236 - protein, 200 aa, Streptomyces avermitilis
MPYLTGPVLPAGTLARSEQPTIPTGDGLVLRPWTAEDAPAVHEAFQDPVMHQWHIRAADSTDEVAGWIEEWRTAWAGERNVQWAVADADTDRLRGRVALRDVLLGDGVAEVAYWTVAGARGQGVAARATSALASWALDEVGFHRLELSHATANEASCRVAAKAGFTLEGTRRSALLHQDGWHDMHLHARVQGDPSQGPTA

SEQ ID NO: 14237 - protein, 526 aa, Streptomyces avermitilis
VRKQVAAMTSTAPADVRPDPPRPESAADLAEFGYRQELHRSLGRYASFAAGFSFISVLTTVFQFFAFGYAFGGPVFFWAWPAVLVGQLLVAACFAELAARYPISGAIYQWSSRLSNLTFGWFAGWIMVIGQIVVVAAAALALQMVMPPIWSGFQLVGGDPAPTSASGAANAAVLGVILLVLTTFVNVIDNRVMSVINRVGVTAEIIGAVLIIVLLLTHSERSPGITFHTGGGAQAGLFGALAVGSFTAAYVMIGFDSAGEMSEETHNPRRVAPRTILTALGAAGLLGGLIVLGGLLAAPSLTDGRLGVDGLSYVLTSSLGDGVGRVLLADVVVAISVATLAIQTAACRMLFSMARDGRLPFARRLARVNPRTGMPSAPALVVGVLAAALLLLNFASPEAFLAIGTTCIVMLYLAYAMVTGPLLVRRLRGEFTTEGTDETGAPLFSLGRWGVPVNTLALLYGLLMTVDLAWPRAEVYDPAGGHWYFQWFTVLFLAVTLAAGAAYRAYRGRTSAPAPAPEATVQEATA

SEQ ID NO: 14238 - protein, 215 aa, Streptomyces avermitilis
MGTKRRKLGNPLALAVMVLLMEKPMHPYEIAQTLCRRGKDTTTKINYGSLYTVVQNLEKHGFVEVAEVQRQGNRPERTLYGITDAGREEATEWLSDLLAVPAREYPIFETALSLLGVLHPDEVTRLLEERLTQLEVQVASARGGLEKLYETLPRLFLVETEYQLHMVEAQAEWVRGFLRELHDGSLAGVEAWRRFHETGEIPPEFKDLEERHFEK

SEQ ID NO: 14239 - protein, 343 aa, Streptomyces avermitilis
MNTRAPAVEARQLIKTYPGDVTALSGMDITVEPGTVFGLLGPNGAGKSTTVKILTTLARPDSGTATVAGHDVLRHPDRVRRAIGVVAQSSGADPVATGRENLRLQGRLHGLKGAGLSRRVAELLDRFKLADAAGRQVKGYSGGMRRRLDVALGLVHRPEVLFLDEPTTGLDPEARTAMWDEIARLAGDEGLTILLTTHYLEEADRLAERIAIVDRGRVVVEGTPDGLKGELRGDAIHLELREAVGQAGRTLLKGSLGGVPGVHEVLFDDAQGRRVSVRADDGAAAMPALLGALERAGVGVAAATVARPSLDDVYLRHAGRRYSEAEAEGADSLALAGATGGTR

SEQ ID NO: 14240 - protein, 258 aa, Streptomyces avermitilis
MSTAVSQTWYMTQRQLMVFVRQPAYLLITLIQPVVWLFLFGNLFKKVVELGGFGTTSYLDYLVPGVVVMSALSSNMWAGMSTLDEIQRGTLDRFLTTPVSRAALMNGNVVNNGLVTALQSVIIVLLGLLGGADYPGGFGGVAVLIVASVLLGTVFGALSNALGMLVRERESIIGINTFLLLPLTFLSSAFMATSQMPGWMRRTADFNPLDWAMVAGRSAMSEHPDWGGVLGRGGALLALAVAAVWLSIRTFRSYQRSV

SEQ ID NO: 14241 - protein, 282 aa, Streptomyces avermitilis
MAERPERRTPKPHSARVIRTERLTPHMQRVVLGGDGLAEFTVGTRTDHYVKLLFGAEGVTYPEPFDMQRVREEFPRDQWPVTRTYTVRAWDPELRELTLDFVVHGDEGLAGPWATRVQSGELVRFMGPGGAYAPDTSADWHLLAGDESALPAIAAALESLPDGADVRAFIEVSGPEEEQKIASDVDVVWLHRGDRPVGEALVEAVRALEFPAGRVHAFVHGEAGFVKELRKLLRVEREIPREDLSISGYWRLGHNEDGWQAAKREWNAQVEAEQETAEPAAS

SEQ ID NO: 14242 - protein, 309 aa, Streptomyces avermitilis
VTQPTRRLMLLDTASLYFRAYFGVPDSVKAPDGTPVNAVRGLLEFIDRLVKDHRPDELVACMDADWRPQWRVDLIPSYKAHRVAEERESGPDEEEVPDTLSPQVPVIENVLDALGIARVGVEGYEADDVIGTFTARAKGPVDIVTGDRDLYQLVDDERGIRVLYPLKGVGLLQLTDEAWLREKYGVDGGGYADLALLRGDPSDGLPGVPGIGEKTAAKLLAEFGDLAGIMAAVDDPKAKLTPSQRKRLDESRPYLAVAPKVVRVAGDVPLPDVDITLPGAPRDPAALDELAARWGLGGSLHRLLSTLQA

SEQ ID NO: 14243 - protein, 359 aa, Streptomyces avermitilis
VSSRLQAESLYKVFGRRPGEAVERLRSGADREELRADGTTAAVIDASFTVEPGEIFVVMGLSGSGKSTLLRMLNGLLEPTAGHVRFDDQDLTALGDRALREVRSKKISMVFQHFALFPHRSVRENAAYGLEVQGVPRAERERRADEALALCGLGGWEKSWPDELSGGMQQRVGLARALATDAELLLMDESFSALDPLIRRDMQDQLLELQKTLKKTIVFITHDLNEAMRLGDRIAVMRDGRIVQVGTAEDILVRPADDYVASFTQDVDRSRVLTAGAVMDPDVRGDEADCACETATPDTPFNELCAISARLSHPVAVLDKKRKLLGVVPRQRLVGFLGDERGEPAACATPRAKAVTTDA

SEQ ID NO: 14244 - protein, 871 aa, Streptomyces avermitilis
MPRIPFGDWVNDTVDWLLNHMSWLFDFFKTVFLGAFDGIDAVLQAPQPLLLAGILAVIAFWLRGTSAGVLTFVGFAFIDSLELWEDAMVTLSLVLVATVIALVVSVPVGIWAARSDRVSSIVRPVLDFMQTLPAMIYLIPAILFFGTGAPAGIVATLIFALAPGVRMTELGIRQVDKELVEAADAFGTTPRNILLRVQLPLALPTVMAGVNQVIMLGLSMAAIAGMVGTGGLGGDVNEAIGQLNVGLGSEAGVAIVILAIYLDRMTSALGTQVSPLGRRAAAKLRAAQGLKIWSYRPRAAVAVVGVVVLALVAGGMGIFGGTTSSTAASDAENVGQGKKVTIGYIPWDEGVASTFLWQEVLEQRGFQVDTKQFDAGPLYTSLGQGDIDFQTDSWLPTTHAQYWKKYGKQLDDLGSWYGPTSLELSVPSYMKGVDSLADLKGQASKFGGKITGIESSAGMMGLLKTKVLKEYGLDKEYKVVDSSTPAMLAELKRAYAKKDPVVVTLWSPHWAYSDYDLKKLKDPKGAWGKGDGVHTLARKGFAQDNPVVGRWLKNFKMTEKQLTGLEAEINKAGKGKQQDAVRSWLKRNPGVVDKLAPVKSATSGAAGETKRPLDVAWFPWDEDVAVTYLWKNVLARRGYTLNLKQMDVGPVYTGLASGDLDLNFDAWLPYAQKNYWDQHKNDLRDLGTWYKPTSLEIAVPSYVKDVKSLADLKGKGGTFDGKIIGIEPGTGEMNLLKTKVLPGYGLDKEYKVVDGSTPAMLAELKRAYAKKEPVAVVLWSPHWAYSEYKLTKLADDKKLFGEGNTIRTISSKQFPERYPQLTKWIKDFRMSEAELGSLESEIKKRGQGHEQDAVAAWLKEHPDMVGRMTPQ

SEQ ID NO: 14245 - protein, 226 aa, Streptomyces avermitilis
VWRSPPLAACPRGARRPALGADGKCGSVLAYEKDPDNRIAVRGRAGPDAPPAGRVERGFEVPRTLSRGAEGTPDPVSVHDGTQVRSGPYRGACGSDRRLRLSGGTSGPGGPALTSGSTVPWRRAGPAATSVTARRSASARGRSSRKRGQGRCDDFGSRRTYAHDRATGGAERLAVRTHGGNRALAHPPATLLAGRDGRPALLVSRFVPREGSAPGETGGPFHWREL

SEQ ID NO: 14246 - protein, 191 aa, Streptomyces avermitilis
MGDHKEQPLRVGAAVRRRRRALELTLAVVAERSGLSVPFLSQVENERARPSRPSLERIADALGTTAVELLAAADPARSVDVVRADDTGLTPTRARVRPLVRGHHQLHAMEFTGDHDEGREFQHRNDELMYVADGAVEIEAEGRAHRLGRGDTLYLTGGVRHRWRATVPDTRVIVVAVADHIEAAEDPSGRR

SEQ ID NO: 14247 - protein, 265 aa, Streptomyces avermitilis
MPDTSGYAFDNTSERAGSRYDVLESTYDPVTFARLAELGVAPGMRCLEVGAGAGSVAAWLAERVGPDGSVLATDIEPRWLGELPAAGNVRVVRHDITQEDLPEGRFDLIHARLVLLHLPERQAALDRMVRALRPGGRLVLDEFDCGWVPVLSAPSPESAELFERMHDAVMGVLTRAGADIRWGLHAYGALRATGLAEVASATWAEAWVGGSRGIRLHQVNIRDVGGQLTGDGLTDDDLERCLRLLDDPSFAVNSYPLITTWGRRR

SEQ ID NO: 14248 - protein, 251 aa, Streptomyces avermitilis
VGQAHSGRVSVTRVVSLVPSLTEAVARSAPGVLVGATDWCSQPADLDVVRIGGTKNPDVERIVRLGPDLVIANEEENRAPDLAALREAGVEALVTEVREVPQAFRELERVLHACGVPGGRPRWLDEAEAAWSRLPAPGRRTTAVVPIWRRPWMVLGRDTFAGDLLARLGVDNVYAAHAERYPRVPVEELRAAAPEIVVLPDEPYRFTADDGPEAFAGTACALVSGRHLTWYGPSLREAPQVIVEAVRAARR

SEQ ID NO: 14249 - protein, 386 aa, Streptomyces avermitilis
MVTAAQPLAPPSVRTSRPRAAAFRHLGPNWYASVMGTAIVATAGAGLPSGSAAGLPGDLPGLRTACTAFWALSLIMLVTLLGARALHWIHHRDQARAHLLDPTTGPTTAPFYGCLAMALLAVGGATLTVGRDWLGTTAAVVLDAVLFTAGTAVGLAAAVAVPYLMVTRHRIEPGRATPVWLLPLVAPMVSAALGPLLVPHLPAGQPRETLLLACVAMFGLSLLGTLMMLPMIFARLITTGPLPLVLTPTLLLVLGPLGQSTTAVGKFADFAPGVVPAPYDQGFGVLAVLYGVPVMGFALLWLGLAVALVVRARRRGMGFALTWWAFTFPVGTCVTGAEALARHTGLAAFDGLAVALYAGLVAAWAVTAARTARGLVTGELLAPPRR

SEQ ID NO: 14250 - protein, 306 aa, Streptomyces avermitilis
MSEGVDGGLSAGLAHRVPELGALELLLAVARLGSLGRAARELGITQPAASSRIRSMERQLGVALVDRSPRGSRLTEAGALVTDWARRIVEAAEAFDAGAQALRGRRDSRLRVAASMTIAEYLLPGWLIALRAQRPDTAVSLLAGNSAVVAERLLADEADLGFVEGLSVPAGLDSTVIAHDRLIVVTAPGHPWARRRRPLSAAELAATPLILREEGSGTRQVLDAALGGLARPLIELSSTTAVKASAVSGAGPAVLSELALGEELSARRLVSIPVAEVRLGRALRAVWRSGHRPTGPARDLLGLTRG

SEQ ID NO: 14251 - protein, 261 aa, Streptomyces avermitilis
VRHAPRASSQGGLLCPGPPAKVWARAIGSKGGGHVTGRPLIGVSTYLESGARWGVWELEAALLPAGYPRLVQRAGGLAAMLPPDDPAHATAAVGRLDGLVIAGGPDVDPSHYGAARSPRTGPPAPERDAWELALIRAALASGTPLLGICRGMQLLNVALGGTLVQHIDGHVEQVGAFGHHPVKPVPGTRYGDLAPEETAVPTYHHQSVDRLGTDLLPCAHAADGTVEAIELPAPAWALGVQWHPEMGEDLRVMRALVAAAS

SEQ ID NO: 14252 - protein, 258 aa, Streptomyces avermitilis
LGRGHGQMPQADSDDDLGGLGGRGDRLAPVLRPVRAGNGFEEALEQILQVVRLGLVPGGERLPSERELAERLGISRVTLREVLKVLQDQGLVESRRGRYGGTFVLPRADAGGEDELRRRIEKVDMEDVLRFREVLEVGAAGLCAAHGLTAEQEDRLREALARTQDAPLADYRRLDTLLHLTLAELGGSPSLTAQYAAVRATVNDLLDCIPLLVRNLEHSQRQHAALVEAVLDGDADGAREMMREHCGGTAALLRGFLA

SEQ ID NO: 14253 - protein, 454 aa, Streptomyces avermitilis
VADRTPPLGVEELHALVAGGEIDTVVLAFPDMQGRLQGKRFAARFFLDEVLEHGTEGCNYLLAVDTDMNTVDGYDMSSWDRGYGDFAMHPDLSTLRQVPWNAGTALLIADLAWNDGSPVVAAPRQILRRQLDRLAALGYTAQVGTELEFIVFKDTYEQAWDAGYKGLTPANQYNIDYSVLGTGRIEPLLRRIRNEMQAAGLTVESAKGECNPGQHEIVFRYDEALVTCDQHAVYKTGAKEIAAQEGVSITFMAKYNEREGNSCHIHLSLADADGTNAMAGDGPGGMSDVMRHFLAGQLAALRDFSLLYAPNINSYKRFQPGSFAPTAVAWGYDNRTCALRVVGHGRSMRFENRLPGGDVNPHLAVAGLVAAGLYGIEHKLELPEACAGNAYAAEYEHVPTTLREAAELWENSPIAKAAFGDDVVAHYRNMARVELKAFDAAVTDWELRRSFERL

SEQ ID NO: 14254 - protein, 463 aa, Streptomyces avermitilis
VRPHVSHPHELVVLDPATEEVVATVPAATPQDVDAAVVRASKAQVRWAALAPGERARLLRRFAVVVDEHLEELARLEVREAGHVIGNARWEAGNVRDLLDYAAGGVERLTGRQIPVPGGLDITILEPLGVVGVIAPWNFPMPIAAWGTAPALAAGNAVILKPAETTPLTALRLAELALEAGLPEHLFQVLPGAGPVAGNALVEHPGVAKIVFTGSTAVGKQVWAKGSALLKRVTLELGGKSPNIVFADADVEAAAAAAPMAFLDNSGQDCCARTRILVQRSVYDRFLALLAPAVESVAVGDPLDERTAMGPLISKVQLERVRSYVPAGAPALRGKAPEGPGFWFPPTVLTDVDPHAPVAVEEVFGPVAVVLPFEDEADAVRLANATEYGLAGSIWTRDVGRALRVSGAVRAGNLSVNSHSSVRYWTPFGGFKQSGIGRELGPDALTAFTETKNVFISTEGPAQ

SEQ ID NO: 14255 - protein, 263 aa, Streptomyces avermitilis
VTEATEQTSCRRLVGRTAVITGAGSGIGLATARRLASEGAHVVCGDIDEVSGKAAADEVGGTFVQVDVTDAEQVEALFRTAYDTYGSVDIAFNNAGISPPDDDSILETGLEAWKRVQEVNLTSVYLCCKAAIPYMRRQGRGSIINTASFVARMGAATSQISYTASKGGVLAMSRELGVQFAREGIRVNALCPGPVNTPLLQELFAKDPERAARRLVHIPVGRFAEADEIAAAVAFLASDDSSFVNATDFLVDGGISGAYVTPL

SEQ ID NO: 14256 - protein, 404 aa, Streptomyces avermitilis
VAAPAASATTTGPRNCPRLSGSWYGDNRARLQQVIDERGTCAGHPGSHPVAAFDWDNTVTKNDVTDATLAWALQHDRIRRPARWKDTSKWLTDAADAALTEACGTAVPAGAPLPTSTNTRCTDEILEIRENAKTMSGAAAFTGDFDHRRTVPQYAWVPQLFAGHTVAELSSYASRAREEALAAPVGATRTLGTHTIAAYVRYYDQQRDLVHALQKAGFDVYIVSAGSEPVTEVWSRGIGIDARHTIAIRSVLDRHGRITTWNQGCGDVPVSQGEAIPYIDGKRCWINQEIYGVRGKAAWQRQNRPHRPAIAGGDADTDVTFVGDATGAHLVLNRNKSELMCRAYDDADGHWLINPMFIEPLPRRPAPYPCSTAAYNEPDGGKGPVRREDGSVVPDQEDTVFRIP

SEQ ID NO: 14257 - protein, 310 aa, Streptomyces avermitilis
MSSTPPPGWYRDPSYPLVERWWDGSAWTDHRRQPETPQEPLVGPRPAGRGPGRAKVIALTAAGAVLVAAVVTGVVVLARDAGGSGSGAEAKTTAGSSVTTTPSASASATWPSASASEPSADDPSVVEDELNGITMPLPDGWVRAENVAEDDVVMTTPGTYDCPGDPGLCRHGQVLSRTATASDASPKALARGDIADAMDTAFDRDGLGSRPFGGVTSHREVKAGTVAVGGRAGYFVRWRVTTAKGPGGYVQSLAFPSSVGSEAPVIVRFAFDAGADGPPLTDMDKITKGIRPIGDPATGGGVGSSIGASR

SEQ ID NO: 14258 - protein, 400 aa, Streptomyces avermitilis
MTARAADRARYDRATAQLDAPVAIVDLEAFDANADDLVRRAGGKPVRVASKSVRCRALLERVLARDGFAGIMSFTLAESLWLARSGFDDVLLAYPSADRKAFSELAGDPKLAAAVTVMVDDPAQLRLIDEARQGGTEVVRVCLELDTSLKLLGGRVRVGARRSPLHSAAQVADLARAVARTPGFRLVGIMAYEGHIAGVGDAVAGRPVRSRAVRLMQAAARKELAQRRADVVRAVRAVAPDLEFVNGGGTGSVQHTAAEDAVTEIAAGSGLYVPRLFDNYTSFSGRPAALFAQPVVRRPGVGVVTVLGGGYPASGAAGADRLPVPCLPEGLKYDPQEGPGEVQTPLLGSPADDLLIGDKVWFRHAKAGELCERFDVLHLVEGDEVTATVPTYRGEGHTFL

SEQ ID NO: 14259 - protein, 369 aa, Streptomyces avermitilis
MPSVLGGTAGLGGAAVGPRSAGAAEDLASRAGSAGDTGGASGNRAEATGGGGESGAEFRSRRRLGNRGDSAARRDDTADEGASGVTERGSTPELPLRTVGSAAEPDGTGALPCAGTDAEPDGTGALSCAGGRVGRGGGAVGGDAAEAACRPAVGGTVGPAPTAGGRCGAGGGAVGAPPVVGRPPGVDGGTFGMRLAKGRSYDGGIPGRGFRAAGRGTARRGTAEGGSCGTGGTAPSVSREVACPSREAGPVGGGVVGRGGTAGRGGMEARRASVLMHPPFRCGRAAPGPAGGVRPPVRSGLHAGYGKHLAGSPATGRHTRPAGPPSRAHPPGQGRSPRRVRVTLRVDTPVTGTSPHPRGICPERPPTLR

SEQ ID NO: 14260 - protein, 250 aa, Streptomyces avermitilis
VRPRVAAAAACVVLGLGLIGGAVTGSWLTGDDSAPSGSPSAFVAAGGLWHSVPVDKLFPATVDGTGAGPGGADRTWTRIAVAPDSGCKDAFDPLLRKALAPVGCLRLLRATYMDATRSHVTTVGLLFTKADTTAMSALKTRFKTEDLGRRTDLMPRPYAAKGTVAAGFGDDQRASWTLSVLTDAPVVVYAVSGFADGRSVTDPQPAAEAIQAGATTAPAQAGLGHEAQGLADRIERGLRKTVTSATEKPS

SEQ ID NO: 14261 - protein, 406 aa, Streptomyces avermitilis
MTRRPTDVRKPSKDRAPRRTGARLLTLLLAGSLALLPATTAHADGIRAKQWALDAMHTQQAWSTTKGKGITVAVLDTGVDDEHPDLAGNVLTGTDMVGFGARRGDRAWARHGTAMAGIIAGHGHGVGDADGVMGIAPEARILPVRVILEDGDNARAKARNTRGNALAEGIRWAADHGADVINLSLGDDSKSAHPEPAEDEAVQYALKKGAVVVASAGNGGEKGDHISYPAAYPGVIAATAVDRYGTRASFSTRRWYATVSAPGVDVVIADPDHKYYEGWGTSAASAFVSGAVALIRAADPGLTPAQIKQLLEDTARNAPTGGRDDSRGFGFIDPAAAIEAGARLKTEGLHSTAYGKRYFGSGPDTAEDSGDSPGWAGPLAGGLGAALLIAAVALWRGRNRRRPHGF

SEQ ID NO: 14262 - protein, 316 aa, Streptomyces avermitilis
MESHRAHRRARPPRRRPLLYTVLATAVIVGGTAAGTAYVKAQAHADAGTVSSSATPSASAPASEEASVEPAADPSVDRNALLAKAMKSVTVEDGADVSVAVLDPDSGDSASYGDGTFDTASIVKVDILATLLLQAQDANRQLTAREKTYATEMIENSDNTSASALWAAIGRADGLGSANQRFGLEGTEGGDGELWGLTQTTAADQLALLQQVFGDDSELSEASRTYLQGLMGEIATDQHWGVSAAADGTKWALKNGWLARSTTGLWDINSIGRVTVNGHAYLMAVLSNGNTTKAKGISLVEAAAQAALSAFEDSAG

SEQ ID NO: 14263 - protein, 243 aa, Streptomyces avermitilis
VANKNIPDSGFSDDDGSADPRLSAALAAWAEDRTAVGPVLDALKGARLLVPVVAVLGEVEEDENGLRREKTSDMAVPTLKAGNRTALPAFTSTESLARWDPQARPVAVPLHQALQAAVHEKADTIVLDLAGPVAYELTGPALLALAEGRTTTDPLADPAVVDAVRTAVAAVPAVRRAHLGPGQADGTLALVLDPAAAPAEAARAVAERLAADTTLRARLVRGLDLALLPAEATPPGEPLFVRS

SEQ ID NO: 14264 - protein, 118 aa, Streptomyces avermitilis
MSDTPPQTPDFDTMTRDIAEVPAVEVIVTVAVNLMSAAAVKLGLTEEGDEHKDLDEARKLVHALAGLLDASTTEISSFHAAPLRDGLKSLQLAFREASLVPDEPGQGPGEKYTGAVYG

SEQ ID NO: 14265 - protein, 241 aa, Streptomyces avermitilis
VWCYRGGSISTEPRINDRIRVPEVRLVGPSGEQVGIVPLAKALELAQEYDLDLVEVAASARPPVCKLMDYGKFKYESAMKAREARKNQAHTVIKEMKLRPKIDPHDYDTKKGHVVRFLKQGDKVKITIMFRGREQSRPELGYRLLQRLATDVEDLGFVESSPKQDGRNMIMVLGPHKKKTEAMAEAREAQAARKAEAKANPGRSQNAADEDIPEGELPEGEVPEAETTEAAEAPAEASTEA

SEQ ID NO: 14266 - protein, 64 aa, Streptomyces avermitilis
MPKNKSHSGASKRFKVTGSGKVLRERAGKRHLLEHKSSRLTRRLTGNAEMAPGDAKKIKKLLGK

SEQ ID NO: 14267 - protein, 127 aa, Streptomyces avermitilis
VARVKRAVNAHKKRRAILEAASGYRGQRSRLYRKAKEQVTHSLVYNYNDRKKRKGDFRQLWIQRINAAARANGMTYNRLIQGLKAANIEVDRKILAELAVNDAGAFAALVEVAQKALPSDVNAPKAA

SEQ ID NO: 14268 - protein, 308 aa, Streptomyces avermitilis
VCVPPPPRTADPHPHKPEGDVTPMSAAPELISPRSPRVSAARRLAKRNFRGKEQLFLAEGPQAVREAAAHRAADAATLVELFATAEAAERYADIIGEARDAGARVHLADEAVIADISTTVTPQGLVGICRFLDTPFEEILAARPRLVAVLAHVRDPGNAGTVLRCADAAGAEAVVLTDASVDLYNPKSVRASVGSLFHLPVAVGVPVDQAVAGLKDAGVRILAADGAGDDDLDDELDKGTMGGPTAWVFGNEAWGLPEETRALADAVVRVPIHGKAESLNLATAAAVCLYASARAQRASGGCRSVTDS

SEQ ID NO: 14269 - protein, 387 aa, Streptomyces avermitilis
MSVGTSGAQKAPRAQDVRGTPASRRGDLAELGIDPDELPDGLVVADEHGRVICFNAAAARITAVSAADALGQRLERALPLEDLEGRRWWQLTDPYGGLAIRVAQPERNLLLPGGREVLVSVRYVRTRPTGPVRRLVVSLRDTEARRRTERSHAELIATVAHELRSPLTSVKGFTATLLAKWERFTDDQKKLMLETVDADANRVTRLIAELLDISRIDSGRLEVRRQPVDIGAAVGRHIQAYVAAGQPADRFLLRIEQPLPALWADPDKIDQVLSNLLENAVRHGEGTVTIDVTPSASPRERTDDEGTAHAATSVTVSDEGPGIPEESMNRVFTRFWRGSKRGGTGLGLYIVKGIVEAHGGGITVGRAPGGGAEFRFTLPVATPAYLL

SEQ ID NO: 14270 - protein, 360 aa, Streptomyces avermitilis
LKPEEIERMRDEALAAFAAAGDLDALQEAKVAHTGGTSPLALANREIGALPPHAKAAAGKLVGQARGAVNKALGARQAELEAERDARVLVEEAVDVTLPYDRVPAGARHPLTTFMERVADVFVAMGYEIAEGPEVEAEWFNFDALNFTPDHPARQMQDTFFVEGPKGTEGDESGVVLRTHTSPVQARAMLDREPPVYIVCPGRVYRTDELDATHTPVFHQIELLAIDEGLTMADLKGTLDHMVQTLFGADMKTRLRPNYFPFTEPSAEMDMLCYVCKGESVGNPDRPCRTCSSEGWIELGGCGMVNPRVLTACGVDPEKYSGFAFGFGIERMLMFRHNVEDMRDMVEGDVRFTRPFGMEI

SEQ ID NO: 14271 - protein, 833 aa, Streptomyces avermitilis
MRVPLSWLREYVDLPATETGRDVQAKLVSAGLEVERVEQLGADLKGPLAVGQVLTIEELEGFKKPIRFCTVDVGQANGTGEPQEIVCGARNFSVGDKVVVVLPGAVLPGNFAIAARKTYGRTSHGMICSGDELGMGDDGSGGIIVLPPEYEVGTDAIELLELVDEVLDIAVTPDRGYCLSLRGIARETAIAYGLPLRDPALLDVPAPNAFGHPVKISEPLGCDRFTARTVTGLDPEARSPIWLQRRLQKAGMRSISLAVDITNYVMLELGQPLHAYDRSRIQGAIGVRRAEQGEKLTTLDGTQRTLDAEDLVITDDRGPIGLAGVMGGAHTEIDDTEGTTTEVVIEAAHFDPISVARTARRHKLASEASKRFERGVDPLAASAAAQRTVDLLVLLAGGSADAGVTEVITPSAPHTITIPANHPDRVAGVEYGRETVVRRLQEVGCDVYGQDELLVTVPSWRPDLTDPNDLAEEVIRLEGYENLPSTLPKPPAGRGLTERQRLHRRVGRALAGAGYVEAPNYPFIGEHVFDQFGLAADDPKRRVVKLVNPLSEEEPALRTTLLPGLLGALRRNDGRGSHDLALFETGLVFHPRAEQRIAVRLPVDRRPTDEEIASLTAALPEQPRHAAVVLAGAREQAGWWGKGRPADWADAVEAARTLAREAGTELLVRAGQYGPWHPGRCAELAVVLDGEEKVIGYAGELHPGVLKTLGLPARTSAMELNLDALEQASAGVVKGPRISTFPVATQDVALVVDKTVPHADVEAALREGAGELLESIRLFDVYESEQLGAGKKSLAYALRFRAADRTLTVEEASTARDAAVALAAERTGAALRS

SEQ ID NO: 14272 - protein, 384 aa, Streptomyces avermitilis
MIRIKAGVPCGPRPRARPGEGFRAVVARGIPRDRMLRRRSRRESRRFRRALSIALPTVWGTTAITYKLACPLAQQNGLGARIVTSAVFFAVGTGLILQVRHTLLRELRQARKVAGAAQSVLLRPLPSRIGGLNIAAAQLSADRGATVGGDLYEVIATEHGVRVVIGDVRGHGLAAIGTVAAVLGSFREAVHDEAELAGVLQRLERAMVRHLRERARAEPPSAGPDPDSLVAEEFVTVLLLEIRHDGEVYALNCGHPWPYLLSGSRVELLARAEPLPPLGPFPLPAELPSTSCGPLQPGEALFLHTDGAEDARDARGRFFPLAAVLGEVVRIPAVSPQAVLKAVFAGLLRHTGGRPSDDVALLVLHNDPHRTSTTANHPMAHHVQ

SEQ ID NO: 14273 - protein, 446 aa, Streptomyces avermitilis
MQPNTLLDAILDEAGISHAGLAAHVNQVGRARGVALRYEHTAVARWLKGQRPRGQVPDLICEVLAARLHRPVTLDDIGLGVPGEPSAPHASTLSGFVERATALWRSDEQQRPHILGAPAVTGTPAVMPVWEWENPPEDVDVSRGGRHRVRMADIEMLRAARAHYEQMYRKAGGIATRTRIVGFLNSETAPLLRGSYTDATGRQLHRATGGLVAIAGICAYDSDAHGLAQRYFHQALRLAKASGDRGLGAYVIALLVNQSLFMREHRQAVAFAEAALRAAGKHITPALASDLYAMQAKAYAHLGDGTSALSCIRRAEQAAERIRRGYEPDETGYVQPGLVNVQVAEALLSLGDLVAAGEHAAAAVDTPAHDRGRVHRLAMLSQIELRQGNADKAVATAVEMAEQARGMESQRLRDRLRAVREHLARSGCAGTAEAAELIDGALRVPL

SEQ ID NO: 14274 - protein, 181 aa, Streptomyces avermitilis
VQWTKQNEQTVYENRWFSVNLADVELPDGRHLDHFLIRLRPVAVATVVNEANEVLLLWRHRFITDSWGWELAAGVVEDGEDIAVAAARELEEETGWRPGPLRHLMSVEPSNGLTDARHHIFWADEGVYTGHPVDDFESDRREWVPLKLVPDMVARGEVPAANMAAALLLLHHLRLGQDALP

SEQ ID NO: 14275 - protein, 103 aa, Streptomyces avermitilis
LTFRAYTRDVTTTERSGHVTADPEHPVVHGEVAELRRRLDVAHARVEGGLALLSHRAEQTAKDVDDLSTRVVTLEHTRWPLPAVAAITAVGALAVAVWQALGH

SEQ ID NO: 14276 - protein, 293 aa, Streptomyces avermitilis
MISERDDVTDIERVGVVGCGQMGAGIAEVCARAGLDVKVAETTGEALEIGRTRLFNSLSKAAERGKISEEERDATQARLSFTTDLGEFADRDLVIEAVVENEQVKTEIFQVLDQVVTRPDAILASNTSSIPLVKLAVATSRPDQVIGIHFFNPAPVQKLVELIPALTTSEGTLSRAQGLVEKILGKHAIRAQDRSGFVVNALLIPYLLSAIRMFESGIASREDIDNGMELGCAHPMGPLKLSDLIGLDTVASVASSMYEEYKEPLYAAPPLLQRMVDAGRLGRKSGSGFYSYA

SEQ ID NO: 14277 - protein, 417 aa, Streptomyces avermitilis
VQMGRLSRRAFAMAALTTLGTAGDLAAAPRGGPAAPPGRRRAAGELRGMWLATVANRDWPSRTGLTPAEQRAELLAHLDTAVRRRLNAVFFQVRPTADALWPSPYEPWSQYLTGTQGKDPGWDPLGTAVAEAHARGLELHAWFNPYRIANHTDPARLVASHPARLHPDWAVPYGGKLYYNPGLPEVRAFVQDAMLDAVRRYRVDGVHFDDYFYPYPVAGQTFDDDAAYAAHGADFPDRASWRRHNIDRLVSETAALIRKVRPAARFGISPFGVWRNAATDPLGSDTRAGVQTYDDLYADTRTWVRECWIDYICPQVYWNIGFAAADYAKLVPWWAAVAKGTGVRLYVGEALYKAGDPAQPAAWQDPVELSRHLTLAKGYPQVRGHVFFSAKEVAADRIGALARVVADHYQQPAKPPR

SEQ ID NO: 14278 - protein, 66 aa, Streptomyces avermitilis
MHATEGDQLVQHGRVVGQHDKIAEIVEVMGAEGTPPYRVRFQDGHEAVCSPGPDSEIRHPKPLGSL

SEQ ID NO: 14279 - protein, 339 aa, Streptomyces avermitilis
MRAQDSATADTPIAVPTQPRSTAHTHPAALPRDTTGVDPASLPRDTTGAGPASLPHRSGTLQAALGVTAFSLTFPATAWGLEGFGPWSLVTVRSLLAAVIAGGCLLALRVPLPARRHWAGLAVVAAGVVLGFPLLTTLALETATTSHAAVVVGLLPLTTALFSALRTGARPSRTFWIAALSGAAAVIAFTVQQSGGALTSADAYLFGALLVCAAGYTEGGRLARVMPGWQVIGWALVLCLPLSVPGALVALAYEPVQLAAHSVAGLLWVAAGSQFLGLVVWYRGMAAIGIPKASQLQLAQPLLTLVWSVLLLGEHLTPAAPLTAAAVLVCIAVTQRARG

SEQ ID NO: 14280 - protein, 436 aa, Streptomyces avermitilis
VTVSRALAQLVAEGLVITRPGAGAFRAEPRRAPATVGDTAWQEVALSADAAAELVPRTVDASGVLVSLAAPPAGVVEFNGGYLHPSLQPERAMGAALSRAGRRPGVWARPPVEGLGDLREWFARGIGGAITAAEVLIAAGGQSALTTALRALAPPGAPVLVESPTYPGMLAIARAAGQRPVPVPVDADGVKPALLADAFRATGARVFVCQPLFQNPTGAVLAPERRGEVLRIARDAGAFVVEDDFVRHLVHEDAGPLPPPLAAEDPDGVVVHVRSLTKVTSPSFRVSALAARGPVLERLRAIQVVDTFFVPRPLQEAALELVGSPAWPRHLRSVGVELRNRRDTMTAALRLHLPELALPHIPSGGYHLWLRLPDGADEPSVVAGALRAGVAVTPGRPYFSAEPPAAHLRLSFAGVAGTGEITEGVRRLRTACDAVL

SEQ ID NO: 14281 - protein, 146 aa, Streptomyces avermitilis
MTDAQRLPGGYELSTDPARIDLDRVHGWLSADAYWAIGRPREKQERAVAGSLNFGVYAAASGEQVAYARVVTDRATFAWLCDVYVDPSVRGKGIGTALVGGVRAHLEPLGLRRVLLATEDAHGVYAKLGFKPLDTPGHWMALAFEQ

SEQ ID NO: 14282 - protein, 194 aa, Streptomyces avermitilis
MHLRVTFVATARSSSLLAERFEEDRPLDQAGWDAVQRAAAELVPLAAAELRYCSPSPGSRATGDALGYAPLAQLALRDCDMGRWRGLTLGEAMAREPSAVDAWLADPRSAPHGGEPLMSFVSRVGQWLDTRPADDGSQIVAVAEPSVVRAALVHALRAHPSTYWNIDVRPLSTVTLIGANGRWNLRLEAGLQRV

SEQ ID NO: 14283 - protein, 156 aa, Streptomyces avermitilis
MGEFWPVADALGYLTGSWRVERTVRDLAGGAEGHFTGTTVFSPLEDGGGGLLHQESGTFVWQGAARPAERTLWFLPGETLGMSDVRFGDGRPFHVLDLTTGHHVADHPCAADLYRGEFTVYAEDRWRTVWRVGGPAKDLILTTDYAREEPTGRATV

SEQ ID NO: 14284 - protein, 710 aa, Streptomyces avermitilis
MSPTRTRWRLGLTAAALLVASVGVPAPAHAEDITDYAIAVDPKGSGAKIDDTMYGVFFEDINRAADGGLYAELVQNRSFEYATADNTSYTPLTSWNTSGTADVVSDDGRLNARNRSYLALGGDSSVTNSGYNTGIAVESGKVYDFSVWARADQADPLSVTLHDTDGDLARARRVTVRGGWAKYTARFTAGRTSTTGRLTVAAAGAVALDMVSLIPHDTYMGHGLRKDLAEKIAALHPGFVRFPGGCLVNTGSMRGYDEASGYERKRSYQWKDTIGPVEQRATNANFWGYNQSYGLGYYEYFQFAEDTGAMPLPVVPALVTGCGQNKAVDDDALLERHIQDTLDLIEFANGPVTSEWGRKRARMGHPEPFHLTHLEVGNEENLPDEFFARFTRFRAAIEAKYPDVTVISNAGPDDSGPTFDTAWKLNRDADVDMVDEHYYNSPQWFLQNNDRYDAYDRNGPKVFLGEYASGGNTFKNALAEAAYMTGLERNADVVKLASYAPLLANEDYVQWRPDMIWFDNHASWGSADYEVQKLFMTNTGDRVVPSTASGTPALSGPISGAVGLSTWATTAAYDDVRVTGEDGTTLLGDDFSGDASRWTHTGGGSWSVEDGQYVQSDVAAENTMVSAGDPAWHDYDLRVKATKKSGKEGFLVAFGVKDTGTYTLVAAPDAVNSRTATPVAPVTSVLEGVADRFTYTFPANSVTFLRIRQR

SEQ ID NO: 14285 - protein, 145 aa, Streptomyces avermitilis
MSDATTREERFEHGLRVLKQVDGEAGERVVAALGDINPELGHQIVSWAFGDIYDRPGLAPRDRQLVTLGMLTALGGCEVQLEVHVNAALNVGLSPDEIVEALLHSAVYCGIPKAMNASLVAKKVFAERGLPPAGQQPTAAAATSA

SEQ ID NO: 14286 - protein, 139 aa, Streptomyces avermitilis
MTSGQPLPLHREPTLTIAQVVERTGLSHDTLRYYEKAGLIERVGRTTGNQRRYEAADLAWLEFLLRLRETGMSIADMQRFALLRSRGDATVPDRLVMLREHRAELAERIRALRRNAAALDDKIDHYERLLGQPEPGEPT

SEQ ID NO: 14287 - protein, 212 aa, Streptomyces avermitilis
MGTPITGINTAGFTQREADLWTDERGLVLSLHFFPLVPDLPAPLHEPDRLRRGLAEGAARAGAGLIEAVTGDVAGVPAVRQLIKVRRPDGHGQVFLGSWTIPKAGCSTVVKVQAGEGATTGMREAVVLNQVGPAAYFRPHPYAYDLQGALPYHVADHEEWDAHFPDHPLTLVRDALRRITPTVTFDPRFTSLPPFGAQPAWAPPMPPAPPAL

SEQ ID NO: 14288 - protein, 399 aa, Streptomyces avermitilis
VTQDLADFTAPHAERPPVPLAVDWAAVEKWLGLRLPGEYKRLIDRHGPMDFGEYVWIHGPCAEEGRFDYGDWLREKHRAARIELRDLPEDERYAVHPAPGGLLAWGCSRGSDVFFWDTSSSDDPDRWTVVVRHSGSVPGSGLRNWHPYDLTLGAYLRHTVRDTWELPSPPGPLIGPLPGSVARTAFLPTAAPWTPPARTAPRLTETQRRVALETGAGLAALRLLCPPPATPYLGGGRWASLFAELGTRLPREYVTLMDEYGAGCWSEWLRFLTPLRTGERRFRTHIEQTTGGYRKHRESYPEQYPLPAWPEPGGFLPFACSIDGDYLGWLAEGPDPDTWPLIVWPRHAPQGPRLESGLVDTLVAWQRGLLTAPGLAGLDEDDDPVEFARFESWDDRAYW

SEQ ID NO: 14289 - protein, 147 aa, Streptomyces avermitilis
MSSRRAPGKPLAKQNRQMPEHGADQGCLLDNRHAEAGIRFDALSELFDPVTFRHVDQLGIGAGMRCRKIGAGGPSVPLGPAERFGPSDGDRHRHSMPTDSPRRTAASQRDSAAELVAGCGNDGRTLRTRAGGTIVVRPARSPPEDHP

SEQ ID NO: 14290 - protein, 267 aa, Streptomyces avermitilis
VRRDDERAQALRATGAEVVIGDLTRAGDVADALAGCARMYFGMSVSAQYLEAAVTAAAVARAYGRLEVFVNMSQLTVSEMDLTSTSESVQQRQQWLAEQVLDWSGLPVVQVRPTVFMENPLFRVGFSSIAKYGTIRLPFGRAKSSPVAAGDVAAVVEEILADPAPHIGRIYELTGPRSEDIAAMAAEVSTVLGRPVRYADIPLQEWIDDDLRPLGLPDHVFQHISTMARLHAENRYDRKAEGVEQVTGRPPSGVADYVRDNLSLFSP

SEQ ID NO: 14291 - protein, 342 aa, Streptomyces avermitilis
MAVRVAVAGASGYAGGEALRLLLAHPEVEIGALTGNSNAGQKLGALQPHLLPLADRVLQETSPDVLAGHDVVFLALPHGQSAAVAEQLGPDVLVVDMGADFRLRNPADWEKFYGSPHAGTWPYGLPELPGGRAALEGSKRIAVPGCYPTAVSLALFPAYAAALAEPEAVIVAASGTSGAGKAAKPHLLGSEVMGSMSPYGVGGVHRHTPEMIQNLGAAAGEPVSVSFTPTLAPMPRGILATCTAKARAGVTAESVRAAYEKAFADEPFVHLLPEGQWPATASVYGSNAVQVQVAYDAAAQRIIAISAIDNLTKGTAGGALQSMNIALGLPEELGLSTIGVAP

SEQ ID NO: 14292 - protein, 383 aa, Streptomyces avermitilis
VSVTAAQGFTASGIAAGIKENGNPDLALVVNNGPRLAAAGVFTSNRVKAAPVLWSEQVLKGGVVSAVVLNSGGANACTGPKGFQDTHATAEKVAETLDLNAGEVAVASTGLIGVLLPMDKLLPGVERAVAGLSEHGGEKAAIAIKTTDTVHKTSVVTKDGWTVGGMAKGAGMLAPGLATMLVVLTTDADLDRDALDRALRAATRTTFDRVDSDGCMSTNDTVLLLASGASEVTPKQEEFAEAVRAVCDDLGQQLIQDAEGASKDIKVEVVGAATEDDAVEVGRSIARNNLLKCAIHGEDPNWGRVLSAIGTTRAAFEPDQLNVAINGVWVCKKGGVGEDRDLVDMRYREVHIVADLAAGTETATIWTNDLTADYVHENSAYSS

SEQ ID NO: 14293 - protein, 304 aa, Streptomyces avermitilis
MSHGPTRKHTALPKAQILIEALPWLTRHNGKTVVVKFGGNAMIDEELKAAFAQDIVFLHHAGLKPVVVHGGGPQISAALDRHGIVSEFKAGLRVTTEDAMDVVRMVLAGQVQRELVGLLNQHGPLAVGLTGEDAHTITATKHQPEIDGELVDIGRVGEITEIDTGAIEALLADGRIPVVSSIARSQDDGHVYNVNADTAAAALAAALGAETLMVLTDVEGLYEDWPDSDEVISRLTASELEKLLPELASGMVPKMEGCLHAVRNGVTTARVIDGRVQHSILLEIFTDEGIGTMVVPDEEEGDAV

SEQ ID NO: 14294 - protein, 403 aa, Streptomyces avermitilis
MTGTATNAELTERWQGALMNNYGTPRLPLVRGAGTRLWDADGKEYLDFVGGIAVNALGHAHPAIVEAVSTQIASLGHVSNLFVAEPPVALAERLLQLFGRDGRVYFCNSGAEANEAAFKIGRLTGRSHMVATQGGFHGRTMGALALTGQPGKQEPFLPLPGDVTHVPYGDAQALAAAVTEETALVVIEPIQGENGVVVPPAGYLKAARAITAATGSLLVLDEVQTGIGRTGHWFEYQAHEGVLPDVVTLAKGLGGGLPLGATVAFGRAAELLQPGHHGTTFGGNPIACAAGLAVLETIQAEGLLENVKSASEKLRDGIESLGHPLIAHVRGSGLLLGIVLTEPLAPQAQQAAQDAGFLVNAPAPDVVRLMPPLNLGDDEVDAFLRALPGVLDAVTNGDGRAKE

SEQ ID NO: 14295 - protein, 178 aa, Streptomyces avermitilis
MSQAQENEHAGPAVPQTRTARHRRIVDILNRQPVRSQSQLAKLLADDGLSVTQATLSRDLDELNAVKIRNNDGDLIYAVPSEGGFRTPRVPLGESAKEERMRRLSAELLISAEASANLVVLRTPPGAAQFLASAIDQAELHDILGTIAGDDTLLLISREPTGGQALADHLLRLAQNHH

SEQ ID NO: 14296 - protein, 245 aa, Streptomyces avermitilis
MGTVVSFDVRGGDPQAVGTALEEAVAGLHRVDEVFSTYREQSQISRLARGELTVEECDPEVAEVLGLGAEAERVSEGWFSTRYEGRLDPTGIVKGWAVERAARHLVAAGASGVSVNGGGDVQLYGVPGPHRPWRVGVSDPLRPGALAAVVSAAGVPELAVATSGTAERGAHIVDPRTGRSAVTDLVAVTVVGPRLTWADSWATAAFAMGSREALAWLESLPDVEALLITAGDEVRCTGGLAQRLG

SEQ ID NO: 14297 - protein, 262 aa, Streptomyces avermitilis
MKKSHPIRRVMLATAATVSGIVLLLSLKPASDPASASAAGGAAPQQTAAAQESAQGGAAAAQSGTVTGDVVKTQYGPVQVRLTMSGGKISKAEAVQAPSGGTSSQKTELAVPRLNQEAVAAGSADIDAVSGATYTSDGYKQSLQSALDKAKATGGGASSASPSPTGGGSSTQAKTVTGSVVKTQYGPVQVRVTVSGGKISKAEAVQAPSGGTSSQKTELAVPRLNQEAVAAGSADIDTVSGATYTSDGYKQSLQSALDKAGG

SEQ ID NO: 14298 - protein, 459 aa, Streptomyces avermitilis
VSTIAGGRAARRQTMRRIRPRRSPAVPLLLAVWAGAAGVIWLWWSNTPSIADDNSKILNAGRITGLLAGYLMALVVLQMARVPALERRVGSDRVARWHAMSGRYTLCLVLAHLVLTMWGYALQAGKTFNDIVQQTIDSINQLPDMGQAAIGTGLLVFIGLISIGGIRRRMPYDAWYHIHLLTYAAVFLTFWHQLSTGNDFAVQPAAKTAWYALYGSVTALVIWYRILAPIRLNLRHRMRVEAVIEETPGVVSVLISGRKLHRMGAEAGQFFRWRFLAPGMRFSSHPYSLSAAPRPNMLRITVKAIGDHSSALRELEPGTRVWAEGPYGALTADKRSRGKVLLVAGGVGITPMRALFETLPGAAGDLTLLYRANTTQDLALWDELATIAEERGARLMYAVNSPEGERPDISAETLTRKLPDIDDHDVFMCGPPGFAQQVFEALRGAGVPARRIHHESFEM

SEQ ID NO: 14299 - protein, 165 aa, Streptomyces avermitilis
VHALKKNRPLRRVTLAAAGTVTGVVLLLSLKPHTPPAVAQASSPSGQSQSQSQSSGSSPGGSSGGSSGGTKSTGTRTVTGDTVQTRWGPVQVRVTVRNGVITEVTAVACPQENPKDREINSYAIPQLRREALAAQSAQIDSVSGATYTSDGYRQSLQSALDSAGL

SEQ ID NO: 14300 - protein, 453 aa, Streptomyces avermitilis
MTTVYERAALPRPTQGRKRPRPSPAGPPLALLWAGAAAVVALWWYDTRSVVGLSGWLTDAGRITGLLCGYSCAVLVALMARVPFLERRTGSDRVARWHAMAGRYTVCLLAAHVTLILFGYAAQDGAGIVRETLSVVFDYPDMLEATIGTIVLVAVGITSARAARRRISHEFWYYVHLLTYVAVFLAFFHQLALGSDLVGNSAARAAWYVLYLGTAALVGWFRLLAPVRLNLRHRLRVESVHREAPGVFSIVVRGERLDELDARPGQFFRWRFLADGMRWTSTPYSLSAPPRAGLMRITVKALGDHSAAVGLLRPGTRVWAEGPYGSLTADRSTASKALLIAGGVGITPLRALFETLPGQVTLVYRARTAEDLALGGELEAIAKWRGARLLYAVNGADGTRPRFTAESLRETVPDLAEHDVYLCGPPAMARDLYAALSAAGVPDRRIHHESFEL

SEQ ID NO: 14301 - protein, 262 aa, Streptomyces avermitilis
VRAPRGVMLEDDMNIPRSRGNGRPALTRPDGTPVRVLVVDDDPDLAEVLSGALRYEGWEVRAAGDGARAVDEARDLLPDAVVLDVMLPDTDGFAVLRELRTVRPDVCVLFLTARDAVEDRIAGITAGGDDYVTKPFSLEEVVARLRGLLRRAGMARQLDEGPRLIVGDLVMDEEAREVTRGGELIELSPTEFELLRFLLRNPRRVLSKAQILDRVWSYDFGGQAHVVELYISYLRKKVDAGREPMIHTVRGAGYVIKPVAGR

SEQ ID NO: 14302 - protein, 504 aa, Streptomyces avermitilis
MRSRWRSWAGRWPRVRAVVRGLPRPRTMRARLTAGLVVLLAVSCAAVGVAAVYELNGFLTGRLDQQLHDVGVRFPASLEHGGDAPRSDHDGDEHGDTRRQSTGTFGARLVGRDVTNAAVVPSGADTTDLNVTLTTADAKALAHVPADGRGHSVCLSALGDYRVMAARGLDRDVLITGLPMEPVDAAVHRLELVASGVLAVALAVAGVAGALWVRWSLRPLNRVAATATTVSELPLASGEVALPPRAPESDPRSEVGRVASAFNRMLGHVEDALTKRHASEERLRTFAADASHELRTPVASVRGHAELALLHPGPVPPKVTRALERIAAESARMGEMVDDLLLLARLDAGRPLERLPVDLTRLVLDSVTDARAAGPGHRWALRLPEEPVTVPGDAHRLHQVGANLLANARLHTPVGTKVTVALESDGRTAVLTVHDDGPGVPEDIQPGVFERFTRADRRRTDGTGGGAGLGLSIVAAVVEAHGGSVALESRPGTTTFTVRLPARY

SEQ ID NO: 14303 - protein, 233 aa, Streptomyces avermitilis
MRPGVVAALASVSLLTLGGAPGTARATLPELMADTGGGTQLITAQALRADATTGTVTWWDRQDGHWVKRGSAAARFGAKGLVEGTARKQGTNTTPTGLYDLPYAFGIKAAPSGTTATYRRVHQDSWWCQDNDSLSYNRWTEPRPADCRPAESEHLVSYEAQYAHAFVIGFNYARPVRGRGAGIFLHVNGSGATAGCVSVPAEAMRQILTWAEPPRLPHIAIGTASGTTALTRY

SEQ ID NO: 14304 - protein, 195 aa, Streptomyces avermitilis
MGKTYERIDGRLRTFIEAQHLFFTATAPLSGDGTVNLSPKGLTGSFAVIDELTVAYLDFAGSNAETIAHLRENGRITLMWCAFQGPPNIVRVHGRGEPVFRDDPRFGQLLTHFPRIDPAPHGLRAIIVVTAELVRDTCGYAVPFMSYDEDRDLHGKRFAREDDDSLSAYFRKKEHVATSLDGLPGLPLPLPPTTV

SEQ ID NO: 14305 - protein, 301 aa, Streptomyces avermitilis
MSRALPKYNKRRVALIGGAAAVVLSGAVIAGSALAGETSKSNGTSARTLADTGTIACPDVKSQLPSVPASAQAEVDRNLALLDTQLAEANKRLVDTVGQGGANFVQNAILGPLADKRKSTIDRIAISIGRTAEKPQGLDALAECALSTDGAAGTGDEAGAGDEAGAGEEAGAGEEATAAPSATATDAADDGAGEAGDTGDDATGVGTISCPDVASQLPAIPATAQAEVDRNLALLDTQIAEANKRLVDTVGQGGANFVQNAILGPLEDKRIATVNRIATAIGRTAEKPQGLDSLAACTLNE

SEQ ID NO: 14306 - protein, 404 aa, Streptomyces avermitilis
LQCEEKPVTERVVLAYSGGLDTSVAIGWIAEETGAEVIAVAVDVGQGGEDLDVIRKRALACGAVEAEVADAKDEFADEYCLPAVKANALYMDRYPLVSALSRPTIVKHLVAAAQKHGATTVAHGCTGKGNDQVRFEAGIVALAPGLKCIAPVRDYAMTRDKAIAFCEEKRLPIATTKKSPYSIDQNVFGRAVETGFLEDIWNAPIEDIYEYTSNPAEPREADEVVISFKEGVPVAIDGRPVTVLQAIQQLNERAGAQGVGRIDMVEDRLVGIKSREVYEAPGAIALITAHQELENVTVERELARYKRQVEQRWGELVYDGQWFSPLKRALEGFIDEANQHVNGDIRMTLHGGRAVVTGRRSETSLYDFNLATYDTGDSFDQAAAKGFIDIYSLSSKIAAKRDLA

SEQ ID NO: 14307 - protein, 477 aa, Streptomyces avermitilis
VSSNSGDVRLWGGRFADGPAEALAKLSASVHFDWRLAPYDIAGSRAHARVLHKANLLTDDELDRMLAGLDRLEADVADGTFVGTIADEDVHTALERGLLERLGPDLGGKLRAGRSRNDQVATLFRMYLRDHARVIGGLLADLQDALIGLAEAHPDVAMPGRTHLQHAQPVLFAHHVLAHVQALSRDAERLRQWDERTAVSPYGSGALAGSSLGLDPESVAKDLGFEHGSVANSIDGTASRDFVAEFAFITAMIGVNLSRIAEEVIIWNTKEFSFVTLHDAFSTGSSIMPQKKNPDIAELARGKSGRLIGNLTGLMATLKALPLAYNRDLQEDKEPVFDSCDQLEVLLPAFTGMMATLTVHRERMEELAPAGFSLATDIAEWLVKQGVPFRVAHEVAGECVKVAEGEGIELDGLTDEQFAKISSHLTPEVRGVLNVPGALASRDGRGGTAPSAVAVQLAEVRTDVAAQHAWATAKQKN

SEQ ID NO: 14308 - protein, 337 aa, Streptomyces avermitilis
LVRSRRGADRTEPAMPFARLSAATTPTAHIGLGLAAVGRPGYINLGREDDLPAVRSVEALRARTHELLDAAYAQGVRYFDVARSYGRSEEFLADWLNARPGIDDIVVGSKWGYTYTADWTTDAEQHEVKDHSAATYERQRAETAGLLGERLDLYQIHSVTPDSPALTDKELHAELAEAAAEGLTVGFSTSGPAQADAIRAALAVTVDGAPLFRTVQSTYNVLETSAGPALAEAQDAGLTVIVKEGMANGRLAGGHAPGPVREIAEQAGLGADAVALAFVLRQPWAGVVLSGAATTNQLASNLHAAVVDLDDEQVARLDALAEDPRTYWERRGQLPWH

SEQ ID NO: 14309 - protein, 192 aa, Streptomyces avermitilis
MSHLVYACLMAVDREHVLRSAADLLTRKSTATMDEVAKAAGISRATLHRQFAGRDALVRALEELGIRECEAALDAARLEAGTANEAVRRLVSEIEPAARLLAFLYTENQLFEGDAQHEGWARLDARIAALFRRGQESGEFRIDLSPAWLTEALYGLMASGAWAVLDGRVAAKDFSYMTVELLLGGALRREES

SEQ ID NO: 14310 - protein, 505 aa, Streptomyces avermitilis
MTSTLRPASVAEVEQRPGRWLALSVLVLAVLLVAVDATVLGLATPYISEDLKPSGTQLLWIGDVYSFVIAGLLVSMGSLGDRIGRKKLLLIGSTAFGAISVLNAYATTPELMILARALLGVAGATLMPATLALIRNLFHDPRERSFAIGVWGATASAGTAVGPVVGGFLLGHFWWGSVFLINLPVMIVLVLVGIRLLPESRNPDPGPWDLSSVVLSLVGMIGIVYAVKEAASHGPSLDALAAGALGAAALFGFVRRQLVMPKPLLDMRLFRNRGFSAAVLADLLTVLGMSGLIFFLSQYLQLVQGRPPFEAGLAEVPAAVGAVAAGLAAGRAARRYSVRAVVSGGLAAVGLALAALTLLSESTGYPLLGTALLVVGVGAGFSFTVTADVILSSVPKDQAGAAAAVSETAYELGAALGIALLGSIVTGVYRDFHGPAGTPAQAHESLGGAVESTAGLPAHTAEAVLSSARAAFVDGLALAAGAGAAVLLATAVAAWFLLRGQKLEA

SEQ ID NO: 14311 - protein, 223 aa, Streptomyces avermitilis
LSRFVLIKAVLGPIMRLMFRPRVEGAEHIPGEGPVILAGNHLTFIDSMIMPLFCDRQVFFIGKDEYVTGKGIKGRLMAWFFTGTGMIPVDRDGGRGGVAALMTGRRVLEEGKVFSIYPEGTRSPDGRLYRGRTGIARLTLMTGAPVVPFAMIGTDKLQPGGAGFPRPGRVTVRFGEAMEFSRYEGMDRDRYVLRAVTDSVMAEVMRLSGQEYVDMYATKAKAA

SEQ ID NO: 14312 - protein, 393 aa, Streptomyces avermitilis
MGTQETRRTQRSDEPGRGTGRRALLGAAVLGAGGAVLGLPAAARADERHGGGGYRSLPKPTVIGHRGASGYRPEHTFGSYELALDLGAHVVEAGDLVPTKDGHLVCRHEPEIGGTTDVSAHPEFADRRTTKTLDGVATTGWFTEDFTLAELKTLRAVERIPATRQRNTIYNGRWEIPTFEEVLRWQDEQTRKRGRQVWIYPETKHPTYFRKLGLGLEERVAKLLRKYGKDKKNSPVIIQSFEPSSIQRLNKLVGNPLVVLLSAANTRPWDFVEAGDPRTVADLVKPEGLAWIASYAQGIGPTLDLVIPKDASGNLTTPTTLVADAHDAGLILHPYTMRNENTFLPTNFKKGTDANAYGDVFGAFKTYFGTGIDGVFSDNADTALLARADFLNG

SEQ ID NO: 14313 - protein, 168 aa, Streptomyces avermitilis
MTHDMVATLRPLLAAEASAEAYAAGTDQSDLEQAVWLRLLERLESDGPLVDPQGWVRRAVRSEVRRSRRTARLELPYGSEPADDGAAGPEQQALTAARHRALHAAVRRLPGRCPRLMAALLSPQDLTYREIAGELGISQGSLGPERSRCLGCLRRLLSAEVAAREPRG

SEQ ID NO: 14314 - protein, 172 aa, Streptomyces avermitilis
VSGRRAHMGMSVTISVATERDAEQIFRLQYLCFQSEAALYGNYRIDPLVQSLESVRAEVAGDCVFVARLGDEVVGSVRGTVTEDGAASIGKLCVHPRLQGHGIGARLLRAAEAALAGERGATRFRLHTGHRSEGNLRLYRRVGYETVGTSKGADGVPMIVLEKPAGTYATTA

SEQ ID NO: 14315 - protein, 150 aa, Streptomyces avermitilis
MTSGEAEMTATQETKPARTRLIGGPGMLLVWLYGVMVVGAVSRSAVQISTEFDKAPLAYSLSAVAGVVYGFITYSLVRGGETARRAALVCCAAELVGVLTVGTWTLVEPSAFPDATVWSDYGMGYLFIPVLLPLSAMYWLRKRERSAGSR

SEQ ID NO: 14316 - protein, 119 aa, Streptomyces avermitilis
MLDALTVVTAVAALLLTAWCGWAAYRDQPTKDWHFIGMAVVSLLAVVQLVVGVVQLARGQQPEQGTTIFVAYLLGAFACVPAAGFMSLAERTRWGSITVAAGGVVLAVLEVRLYDIWGS

SEQ ID NO: 14317 - protein, 366 aa, Streptomyces avermitilis
MHPCPAHTHALHSTVTETPVITTTGLTKVYRSRGREVTALDGVDLHVREGEVYGVIGQSGAGKSSLIRCVNLLERPTSGTVTVAGQDLTALAGRGPRAGKELRTARSHIGMVFQHFNLLSSRTVQDNVELPLEILGVSGRERGRKALELLDLVGLTDKAKAYPAQLSGGQKQRVGIARALAGDPKVLLSDEATSALDPETTRSILQLLRDLNRQLGLTVLLITHEMNVVKSICDSAALMEKGRIVESGTVSELLGTPGSELASALFPVTGDASGDDRTVVDVTFHGEAATQPVISQLSRTYNIDISILGAAIDTVGGLQVGRMRIELPGRYEDNVVPIGFLREQGLQIDVVDKSDQESVLVKEGAK

SEQ ID NO: 14318 - protein, 259 aa, Streptomyces avermitilis
VTWSEMQPLLSQACWDTLYMVGWSTLIAIVGGLPLGLLLVLTDRGGLLQNVVANKVVGQIVNVARSLPFIILMVALMNFTRTITGTTIGREAAIVPLAIGAIPFFARLVETAVREVDGGLVEAVQSMGGNTWTVVRRVLVPESLPSLISSATTTIVALIGYSAMAGTVGAGGLGDIAIRYGYQRFETGLMWITVAILAVVISLIQFAGDYAARGLHRRGGRSGVAPKLRLLKDKAPADRTPAADAPTGEAATADVGKVA

SEQ ID NO: 14319 - protein, 275 aa, Streptomyces avermitilis
VRNTAKITTAVLAAGALTLGLSACGSDKDSASDTSGPLIVAASPTPHAEILDFVKKNLAKKAGLDLEVKEVTDYVTPNTATEDGSVGANYFQNQPYLDDFNKKKGTHIVPVVTVHLEPLGLYSHKVKKADDLKSGATVAIPNDTVNEARALKLLDANGIITLKSGVGNEATPGDITKNPKNLKFKELEAAQTPRSLDDVDAAVVNGNYAISSGLKPAKDAVVLESPKDNPYGNFLAVKKGNEKDPRVKKLAKLLTSPEVKKFIEDKYAGSVIPSF

SEQ ID NO: 14320 - protein, 279 aa, Streptomyces avermitilis
MRKPVISAAAAALALGLGLTACGSGSDSDSAKSGGDGDALVVGATAVPAGEVLAYIKKDLAEKAGLDLEIKEFTDYVLPNTALQEGELDANLYQNQPYLDDFNKAKGTDLVPVVKAYLPPMGVYSKKVTDVTKLADGATVAVPNDTTNEGRALKLLASKGVIALKAGAGTDASPADITSNPKHLTFKELEPAQLPRSLDDLAAAVINNNYAQDAGLSPTKDAILLESAENNPYANLLAVKKGNEDDPRVEKLAKLLTSPEVKKFIEDKYRGSVLPVVSG

SEQ ID NO: 14321 - protein, 212 aa, Streptomyces avermitilis
MTSTFPNISISTERLVLRPLDEDDVPALAEMMNDEQVGAWTDVPQPYTEDRARRWITEYAPAQRTAGRGLDLAVTEFLTQRLVGIVQLDKTNWHIRSTEISYVIAPWARGEGYASEAALATAQWLFGDQKFERIELRTAADNTASQQVAQKIGCISEGVLRNACIAHVRTEDGTWTDVRTDFIVWSLLPEDLDGVGEELADTGGFTSFSDWN

SEQ ID NO: 14322 - protein, 403 aa, Streptomyces avermitilis
MADRVTVIGWDGSPLTAAARSALGAATLVAGAAHHLTLAEVPPAAERIRLGSVALAARRIAAHRGTAVVLADGDPGFFGVVRTLRAPEFGLEVEVVPAVSSVATAFARAGMPWDDAQVVVAHRRTLRRAVNVCRAHTKVAVLTSPGAGPAELGLLLEGVHRTFVICEELGTEREQVTVLTSDKAADHTWRDPNVVIVIGGPVTAVEGGGWIAGREPGAEPRGWALPAEAYGGALGEGETDLLRAAQLARLGPRAGDLVWDIGSGSGAFAAEAARCGAAVIAVDRDQDACGRTTVSARRFGVQLQVVHGAAPHILENLPEPDVVRVGGGGAAVVSAVADRRPQGIVTHAATRDAAELIGRGLTEHGYLVECALLQSVELDTRAWTEKERSVAFLLSGRLPDRSP

SEQ ID NO: 14323 - protein, 1286 aa, Streptomyces avermitilis
MTDTGQVPGEGLPENAGMVEQPGVPAPGAYTYLDPSDTAADDDDLLLMPGQQGAWGNEMPQAMPAPAPVVHEPGPHETDGRDSGSVDLSAVRTLSQAAAPQATPPRRPLHLGPPTPDISSSPVRSLADRGPADAPLRQVGPPTTGPEYLDAPPQLAETPPQGAVPWGAPPQTQAVPPVSPEGPPAETVVPEAAPAAPVVPEAAPGLGTVPADEPAPFVEPEQASEMPPFAEAETPDAPAFVEAPQPPQTPDAPAFTEVPHASDEPPAADAQHAGAAAPTDVPPAAETPFAAPEAEALYAVDGSPDGVTHPQVQYADGTGPVPDGSPEPQAPDTTPFPAAPDPAQPTGDTGHIAVPPAAPDTAVPAPAADFPVPPYDAAPDPAQAAAAEAVPQAGTEQPGPAQDPHQAPEISLDLHAAPDPALDPQQAPDPALDPQAAHVPEPQLAAPAVHITDTAVQFADTALPDEDARPVADEVQPQLVAEAGAQGHAEAEPEPQYAEHAAAALHGVPVGVGAHAVAPQASAGQAQHGEQPAHGDPAGPPGFSPEPHADQSLGQFVPVEGAVPTTPHLAPTPSHAMTVPPLPAEEQPVAEEAAPAVVEPSEAPHELSEEAPHELSEEAPHELPAEVPTEAEAPAPVMAAQETPAVTVPAPREAEAPVAAQPPVSQLPTPEPPLADPEPVVAQHADDLDTQVADQEESTAAVEDVRESTGPAAPGYDEAEREAVLRVMRERRDIRNGFRSDPIPHEVLLRVLEAAHTAPSVGHSQPWDFVVIRSADTRRSMHELAMRQRDAYAKSLPKGRAKQFKELKIEAILDTPVNIVVTADPTRGGRHTLGRHTQPQMAPYSSALAVENLWLAARAEGLGVGWVSFFDEREMVRELGLPEHLEVVAYLCVGYVDEFPDEPELMQAGWSKRRPLSWVVHEETYGRRALPGEEPHDLLAETVSNIRPLDAKALGEAWERQKRMTKPAGALGMLEIISAQLSGLSRQCPPPIPEPAAVAIFAGDHGVHAQGVTPWPQEVTAQMVANFLGGGAVCNAFANQVGAEVCVIDVGVASDLPATPGLLPRKVRAGTADMTTGPALTREEVKAAIEVGIETARDLVSAGNKALLTGEMGIANTTASAALISVYTGADPAEVTGRGTGINDETLARKTEVVRRALELHQPDPADPIGVLAAIGGLEHAAMVGLLLGGASLRTPVILDGVSAGAAALVARAIAPEVLAACIAGHRSAEPGHVAALNKLGLRPLVDLDLRLGEGTGALLALPVVQSAARAMHEVATFDSAGVTEK

SEQ ID NO: 14324 - protein, 410 aa, Streptomyces avermitilis
MAEHPAYPVGLRLTGRRVVVLGGGQVAQRRLPALIAAGAKVHLVSPEATPSVEAMADTGEITWSRRRYEDGDLAEAWYALIATSDAAANVAASAEAERLRVWCVRSDDADAATAWTPATGHSEGVTVAVLTTNAKGRDPRHTAAIRDAVVEGLRDGTLVAPHHRVRTPGVALVGGGPGDPDLITVRGRRLLAEADVVIADRLGPRDLLAELPPHVEVIDAAKIPYGRFMAQEAINNALIEHARQGKSVVRLKGGDPFVFGRGMEEAQALAEVGIPCTVVPGISSSISVPGAAGIPVTHRGVAHEFTVVSGHVAPDDERSLVDWPALAKLRGTLVILMGVDKIGKIADTLVAHGKPAGTPVALVQEGTTAAQRRVDATLATVAETVRAQDVKPPAVIVIGAVVDVGPQTFE

SEQ ID NO: 14325 - protein, 272 aa, Streptomyces avermitilis
VADLITVEDPADPRLRDYTGLTDVELRRKREPAEGLFIAEGEKVIRRAKDAGYEMRSMLLSAKWVDVMRDVIDELPAPVYAVSPELAEQVTGYHVHRGALASMQRKPLPTADELLATARRVVIMESVNDHTNIGAIFRSAAALGMDAVLLSPDCADPLYRRSVKVSMGAVFSVPYARLDTWPKGLESVREAGFNLLALTPDEKAKTLDETAPHKMDRVALMLGAEGDGLSTQALVAADEWVRIPMAHGVDSLNVGAAAAVAFYAVATGRPQS

SEQ ID NO: 14326 - protein, 131 aa, Streptomyces avermitilis
VRDQREAIVAVLRRGERVLVIKRGPQAARPGYWAPLSGKLEPGETQEEALVREVREEVGLDVSPLRKVWECPTDDGHFRLHWWTAESGTGEVVPDPGEVAEARWVTPGEFLAMEPVFDGDREFFERVLPEL

SEQ ID NO: 14327 - protein, 433 aa, Streptomyces avermitilis
VARQTDRAAGMDMAMMRLRREDPRVVGSFRLHRRLGAGGMGVVYLGSDRRGQRVALKVIRPDLAEDQEFRFRFAREVSAARRIRGGCTARLVAADLDADRPWFATQYVPGPSLHDKVAEEGPLSAADVAAVGAALSEGLVAVHEAGVVHRDLKPSNILLSPKGPRIIDFGIAWATGASTLTHVGTAVGSPGFLAPEQVRGAAVTPATDVFSLGATLAYAATADSPFGHGSSEVMLYRVVHEEAHLNGVPDALAPLVRACLAKDPEERPSTLQLSLRLKEIAAREAQGIADVRPPAQRGEPDRPSGRLAEQYAEQRTQRRPQGAPGTPPPRTGGGPRSGSRPTPAPRNSTRSGSRPAPRSGAGRSSPRTTGTGRRPANPRLLRQRLFVFVVVTLLVALGIAAAQGCQGPARGLDDGGVRKDVRQEQSYEPWRGI

SEQ ID NO: 14328 - protein, 69 aa, Streptomyces avermitilis
MAHTAPRTAIRTQGRRAYTAAFGTRRTGRRHPLVATAMALPLAALLLLVFDGWETVVTQASSVGVMLGR

SEQ ID NO: 14329 - protein, 311 aa, Streptomyces avermitilis
MTADLLPGLTARVRAMAHPEAGPCGCDAAGTLADRADGTVVRHADTVAKAHAPDTDPAELALRLEIASRLAGILLPPLSPTPADLHGRPVTFWPYGSPVNPDCPRAAPWEAAATLLARLHKAPAPKGLPPMRGPAKAARALARLHAAGPHPAAAPILRAWAGLPAWARAEAPMPSSKTLCHGDLHLGQLVRHPATTGPWLLIDVDDLGVGEPAWDLARPAAWYACGLLPPDEWTRFLAAYRAEGGPAVPADGDPWPVLDVAARALTVQTAAVAVAKAVTADRPLDEVEQAVIDACDRMGGVPPEFIHGSAT

SEQ ID NO: 14330 - protein, 88 aa, Streptomyces avermitilis
MHTYNRNGVQIEQCSGCRGIFLDYGELESLTQLESQWSQPAPPPPAAPQAYPAAPAWGAPHGGHGGGHYGGHGGHQRHKSFGHMLFSS

SEQ ID NO: 14331 - protein, 373 aa, Streptomyces avermitilis
LCSVLRCACSKTWSGHPQVTRHRLDGVLDLPPLARFGGLVATGLLDVTSDPAALDSTGFWAVCADFEGRLTCARFRNVQEEAVRAPEPGRWRGPAAGDWTSSLDRTAYTAGVRRIREHIAAGEVYQANLCRVLSAPIAPDADVDALTALLARGNPAPYAGTIRLPGHGVEIATASPELFLRRTGAAVESGPIKGTGRTEADLLTKDYAENVMIVDLVRNDIGRVCATGTVTVPDLCVVEKHPGLVHLVSTVHGELRADVGWPELLAASFPPGSVTGAPKSSALRIIEALETAPRGPYCGGIGWVDADRRTAELAVGIRTFWIDRPAGLLRFGTGAGITWGSDPEGEWRETELKAARLLAVASGEYEESGRTLT

SEQ ID NO: 14332 - protein, 273 aa, Streptomyces avermitilis
VKIWLDGGLQDSETARVSVFDHGLTVGDGIFETVKAAEGRPFALTRHLDRLARSARGLGLPEPDLDEVRRACAAVLDANPMPLGRLRITYTGGYGPLGSDRGEKGPTLVVAVGESARRPDSTAVITVPWTRNERGALTGLKTTSYAENVVALARAREQGASEALFANTVGRLCEGTGSNVFVVLDGEIHTPPVDSGCLAGITRALTVEWTGAKETDLPLDVLDSAEEVFLTSTLRDVQGVHRVDSRELPGAPGPVTAKAMRLFDEQAGDDLDP

SEQ ID NO: 14333 - protein, 284 aa, Streptomyces avermitilis
MTEGRRAGRTPVMTTTLRPVEPLQHAADGTRSRRYHVCVNSRPVGVIHLATHPVFGPSVARIDELRIEEPDRRRGRGTVAALAAEEVVRGWGCKRIEVQVPGEAGLRLAGALGYVLRNRGMEKRLGTTAPGLPEGSRGRPMTAAEFGPWEERGRAHYAQSWIDRGVPEAEAREKAEKDHARHLPDGVDSPGTLLTVLEHEGVPVGTLWLALSEGSTFVFDVEADARHRGQGHGRSLMLLAEAQSVAAGKSRIGLNVFAGNTPAERLYESLGYEPTQYVLYKELL

SEQ ID NO: 14334 - protein, 176 aa, Streptomyces avermitilis
MNDSSPAPLAVPVLDVWCELQCPDCRSALDDLRALRARYGDRLELRLRHFPLEKHKHAFAAAQAAEEAAEQGQGWPYVEAVLGRVEELDRKGEPFLVEVARELGLDAEEFDTALIDGRHILIVDADQAEGKAIGVTGTPTYVIGGERLDGNKSQKGLRERVEEIADRLLAEREQEG

SEQ ID NO: 14335 - protein, 147 aa, Streptomyces avermitilis
MIAETVCSAVSAAGLGIAVVTAYRKRFLAAARIAAYSLVPVGLVMTGVVGWAADTTFSPTAWAGFALLGGAWLLFATTRAVERRSGGTRKERKAAKAAQREAVAPAASAPSLGEGARPAARPATTPRATGASDDFSDIEAILKKHGI

SEQ ID NO: 14336 - protein, 50 aa, Streptomyces avermitilis
MLDTTQSDTAAPPEERRGCLFALSQPPLMIFLAVIGCLLLMASLHDLLLL

SEQ ID NO: 14337 - protein, 186 aa, Streptomyces avermitilis
VLITHDTRCALDAVVDLVNTAPEDDDARDGLSDVASLADFVGKHEISDVGVLSEFDLSAVRKIRDRFAGVFAAADARIAAGLINELVAAAGTTPRLTDHDGYDWHVHYFAPGASVADHLAADCGMALAFFVVAGEQERLRRCEAPDCRRAFVDLSRNRSRRYCDSRTCGNRLHVAAYRARRKEAAG

SEQ ID NO: 14338 - protein, 159 aa, Streptomyces avermitilis
VACRFRRRANPRAHTERKALALMNTTVSCELHLRLVVSSESSLPVPAGLRYDTADPYAVHATFHTGAEETVEWVFARDLLAEGLHRPTGTGDVRVWPSRSHGQGVVCIALSSPEGEALLEAPARALESFLKRTDAAVPPGTEHRHFDLDTELSHILAES

SEQ ID NO: 14339 - protein, 144 aa, Streptomyces avermitilis
MNTGSDEPGEVAVAADETNAERGLGSRAPKFIKARRALHLSWQVGVFIVGLAVVVAGVIMLPLPGPGWLVIFGGMAIWATEFVWAQLVLRWTKRKVTEATQRALDPRVRRRNIILTTVGLVIIAALMAVYVWKFGFAMPWNIKE

SEQ ID NO: 14340 - protein, 428 aa, Streptomyces avermitilis
MQKNGNVERRTILKAAGASAAVLGLAATTGCGGDSDSGDGTVTIRYAWWGAEERAKRINQTIALFEKKYPKIKVKTDFQDYVAFWEKFQTQAAGGNPPDVFQNAVAYLRKYDKRGILLDLKSQIDAGNLSLDGFRAGVEKVGQVDGKQLGIPVGSNTMSLVIDQKVFDKAGIKPEQGWTWDEYFKALKKIHDTEKISGDTGYFGVMYLYDLYLRQNGKAFFTEDGLGFDEADLTEWWADGYNRLKAGIITDPKKIQQLRPKSALASGDAASEFTWDNFAVRYSTEGDSTYALAPIPTTDGKQTGQYLASLMLSASARTEHPKEVAQFIDFMVHDPEAAKIMGYDRGILATTEQFDAFKPTDPVSKEIAQYEEDTSAAGVLGAITPHPSGADTVEATFLRIADDMSQGKTKVADAVKQFFSEAKAALAA

SEQ ID NO: 14341 - protein, 323 aa, Streptomyces avermitilis
LMGTAVTLVKDSPPQVPAERPARPAVVKRRGRRENLAGYLFMSPWIAGFLLLTAGPMVASLYFAFTDYNLFNSPKWIGLDNFTKMFDDPRWQKSVEVTAKYVIIGTPLKLLLALGVALLLAQSRRGQAFYRAAFYAPSLIGASVSVGFVWRALFSDDAVVDKAQTFLGFHTGGWVGDADWVLYSLVALTVWQFGAPMVIFLAGLKQVPRELYEAAEVDGAGPFRRFWNITLPVISPVLFFNVLLETIHSFQIFGSAYVVSNGYCGPADATLVYTCYLYQKGFKEAQMGFASAMAWMLLLAVALVTAVLFWSQKRWVHYEEDAR

SEQ ID NO: 14342 - protein, 302 aa, Streptomyces avermitilis
VGALRGGRSMSATATTARKPRALGRRRKGSLAWHLGALLVLAVVLYPVVWVIGASFKPSKEIIGSLELFPTEPIISNFKGLADGIADVSIATFFQNSLVYALGSVVGILVSCSLTAYAFARIRFAGRNLMFSLMIGTLLLPYHVLLIPQYVMFQKLELINTYVPLLIGKYLATEAFFVFLMVQFMRNLPRELDEAARLDGCGHLRIYWSIVLPLCRSALITSAIFTFINAWNDFMGPLIYLNEPGNYTVSLGLMLFRDSDGVTSNYGGMIAMSLVALLPVLLFFLAFQRHLIDGMATSGLKG

SEQ ID NO: 14343 - protein, 215 aa, Streptomyces avermitilis
VPMTRTAEARRARPWAKARKPPRKPPRESALAERFGLFAECLLTGVWIAVASLPLLTYPAAFAAGARHLRRRTAHEGGGGREFVADFRAAVRGGWIAGLAGWAAAAAVWVDVQAARAGMPGGPLVGAVGLFALIGLVVAGLRAAAVWEPGVPWRVLLAGAGRRTVLDPAGSFLLIGGLAVVVCSGLFIAPLAVPVLGAVAAAAVAVEERYRRRAR

SEQ ID NO: 14344 - protein, 823 aa, Streptomyces avermitilis
VQSWPIAYWPDGSLKWTAHAVGTGAGAGKLTLAAGSPAAPDKKVTVDKRGGTIDVSTGVITAKLGKSGSTLVKSVTRGSTEIAKNGRLVLIRQPELEDGDQGTEKYERFESAISDVTVEQDGPVRAVVRIDGKHRKGDRSWLPFSVRLYFYAGAESFRMVHTITFDGKQEPGKASGDFIRGLGVRFTVPMRDAAYDRHIRIGGDDTGLLREAVKGITGLRRDPGAAVQAAQFAGERLPDPATWDQRVTTRLQYIPEWGDYTLAQLSADGFTLRKRTRKGYGWIAAGGGRRASGFGYVGGPSGGFSFGLRDFWEKHPAQLDIRDAHTDEAEVTLWLWSPEAQPMDLRFYHDGMDQDTYAEQLEGLNITYEDYEPEFGTPYGIARTSELLFWANESTPTPEKLAEQVEAVRVLPQLAAPPKHLIKAKVFGGLFSEPDRSTTAKAKIEDHLDFLFTYYKDQVEMRRWYGFWDYGDFMHSYDTVRHQWRYDVGGYAWDNSELSPDLWLWFAYLRSGRSDIFRFAEALTRHTGEVDVYHLGQWAGLGTRHGVQHFADSAKQQRIANTNYRRYYYYLTADERVGDLMHANVDSDETFLVLDPIRKIRTEPYTPDRHALSIGFGTDWSGLVSAWLTEWERKGPKWAKAKARVLSTMETIAAQPNGFVQGNGLYDLDTGKFAIAPAPVVSVSHLSAVFGLNELCAELIDLVDMPKFKEVYLDYCRYFNASKTEQAARYGSNFGSLLLFQGHSRLDAYAAVQTGDATLAKRAWTKFYSSDGYMESSPWKTEKLSGPVTLVAGSEANWVSSNDTALYGLAAIENLALLGDKMP

SEQ ID NO: 14345 - protein, 796 aa, Streptomyces avermitilis
MTHIPPPAEELRILDGELRQLDARRALLLTRRAWLIGVLHSAPVPPPPPPRRPETTAPSVQNVLLVLGGILLTVAAIAFTLVSWGHLGITGRAVVLAAVTLAALATPVALLRRGLRSTAESVAGLGLALTVLDAYALHEAALPGANGTAYAALASAVLAGVWAAYGQGLGALLGRPERAAARLPLRLPLPAALVAVQFPLLLWAIAAGAGPHTLTGALLTTAAFDTVVALRVSVRSVRLVAAVGAYGMGGWGVLAAGRLSFEATGPSAAARAAALLAFAAVIALGTAWRAPRVDLAVGTAVTGGLLLVAGLGGILRVSLPADWTVVGYLVCAVALLTVVRGPLPEPVRLGLAWASGSVQALAVVSALPPVAVALLGPAGWAGRIWSGAPSDIRAAVTAGTPWPPDAATAPLVLAVVAGVSVWALRTTQWRPQAMTGALVLGWATALVLPATLELPYVVGLFALGLTAATAVAVAAYARRAPTAYTATALALITSVSLSFLSLTSRPATLGVLAALTALFAVAAVKVRPASVWASTSLAGATALACAAGAAAGWAPAHTALLVLVVPCGAALLAARLDEPGTTTAVEVTGSVAGLVAVGLAVTDPPLLALVLALCGVIAAGTAVRADRRSVGYAATALFVLATWVRLGSWGVGAPEAYTLPVTVPALLVGVVRRRRDPLASSWTAYGPGLAATLVPSLLTAWGDAHWLRPLLLGAAALLVTLLGARHRLRAPLLLGGAVLALDALHELAPYLVQLAGVLPRWLPPALAGLVLLAVGATYEQRIRDARRVREVLGRMY

SEQ ID NO: 14346 - protein, 152 aa, Streptomyces avermitilis
MDWSHYRFRSLWALPAPPARVYAALERVEDYPRWWPQVREVTRLDEDCGVIRIRSLLPYDMTFTARDVRHDTAAGILEITMTGDIDGWARWTVTAGGPGTLARYDQEVDVRKPLLRRFAVPGRPVFRANHALMMRAGQRGLLAHLDGGRQAV

SEQ ID NO: 14347 - protein, 241 aa, Streptomyces avermitilis
MTCWYEGPLAAFDTETTGVDVETDRIVSAAVVVQDAPGARPRVSRWLVNPGVPVPAGATAVHGLTDEHLQRNGRWPSPVMDEIARELGEQATAGRPLVVMNAPFDLTLLDRELRRHRASCLDHWFESAPLRVLDPRVLDKHLDRYRKGRRTLTDLCAHYDVALEGAHDAAADALAAMEVVRAVGRRFATRLERLSPAELHTLQAVWHAAQARGLQAWFARSGTPEAVDPAWPLRPELPAAA

SEQ ID NO: 14348 - protein, 188 aa, Streptomyces avermitilis
MAIAQPERGGLLPQRTAPPRGTLATTACMETLQVGYLHAVAAAAGCSLSQPFPDNGIDWHVSHSAPGHTVDDEVTIKVQLKCTYQIPPNPPGPAFSFTLDNAHLAKLARTPVSVHKILVVMLVPRAQDDWLRASHDRLDLRHCCYWINLAGHAVTGRRRTTVRIPTSRIFDDRALCEIMTRVGTGGRP

SEQ ID NO: 14349 - protein, 406 aa, Streptomyces avermitilis
VTHRPTHEPLRPVRPHPVEALPENQPPDPGQVDPAVLSALLHRHGWQRRGGPAGRYGRWTPPGPGSGGTSLLVPESRAFPDSDDLLGEALVALSRSGSPSARDVLIALAVPSDEIHWWRDVPAGPAGAAPWPVEDQLRTAARQMLLAGALATRGRAGYHGARHRRPAAASLESVLVGAAPGGHRLTAFVPVETERPLAVRLHQALYSVREAVDYRRATGGMEAFDAAVQAGVSHELTEALVALVRGTEGARIAVEWAPAAGVPEGCAAPAEAVEFSPGDLPFLREAGARYLREEPSVPVRITGTVVRMRRSGPRGAGAVRLRVLAGAEVPHVRMTLDEESYRTAGHAHLVGLPVLVHGRLESRGGFRRLTDVSEVAPVQVDEAERDRLMKSLQENLDFFEEACSGD

SEQ ID NO: 14350 - protein, 658 aa, Streptomyces avermitilis
VSDVRVIIQRDSEREERVVTTGTTAADLFPGERTVVAARVGGELKDLAYEVKDGEEVEPVQISSEDGLNILRHSTAHVMAQAVQELFPEAKLGIGPPVKDGFYYDFDVAKPFTPEDLKAIEKKMQEIQKRGQRFSRRVVTDEAAREELADEPYKLELIGIKGSASNDDGANVEVGSGELTIYDNLDAKTGDLCWKDLCRGPHLPTTRNIPAFKLMRNAAAYWRGSEKNPMLQRIYGTAWPSKDELKAHLDFLAEAEKRDHRKLGNELDLFSIPDQIGSGLAVFHPKGGIVRRVMEDYSRRRHEEEGYEFVYTPHATKGKLFETSGHLDWYADGMYPPMQLDEGVDYYLKPMNCPMHNLIFDARGRSYRELPLRLFEFGTVYRYEKSGVVHGLTRARGFTQDDAHIYCTREKMADELDKTLTFVLNLLRDYGLTDFYLELSTKDPEKFVGSDEVWEEATETLRQVAEKQGLPLVPDPGGAAFYGPKISVQAKDAIGRTWQMSTVQLDFNLPERFDLEYTGPDGSKQRPVMIHRALFGSIERFFAVLLEHYAGAFPAWLAPVQAVGIPIGDAHVEYLQKFAAEAKKKGLRVEVDSSSDRMQKKIRNAQKQKVPFMVIAGDEDMTAGAVSFRYRDGSQENGIPLDEAIAKIAKVVEERTQV

SEQ ID NO: 14351 - protein, 187 aa, Streptomyces avermitilis
MLHLMTSEPEQQIGVGTQDAFQRLWTPHRMAYIQGENKPTGPGADDGCPFCSIPAKSDEDGLIVRRGEQVYAVLNLYPYNGGHLMVVPYRHVADYTDLTESETAELAELTKQAMTALRTASGAHGFNIGMNQGTVAGAGIAAHLHQHIVPRWGGDTNFMPVVGHTKVLPQLLADTRKMLAEAWPTAA

SEQ ID NO: 14352 - protein, 553 aa, Streptomyces avermitilis
VADDGFDFSPGAQVPLSGSAGQTAATFALASAAYRDNPVEEILKADNEWHQSTVKGPRRGAKILRPNLGEAFSRAVIDRMLGVGRNPLIQSFGTEPQVIVEHCLAAHNIRRERDNWLTAVIVLCGLIFLPGLIVWLLVFQIRTAIARREDKRASALGTTLLVAVGALAVIFLIRMPFTGFWGWYARAAVVVPVVGWLWAKQICERTAKDLRERWDSLLAGGAIGAKVPEAVPGSPGETAAEQLRQSLARLSAEQQSNSVFYAGPKGILGMGTRWGSWQLAEDLVPREAGKEIHPFRSWDVIRSIHDQLRMLERGPLNTGGFPKPSIKHWVVTPIGENAKAVSRPGGTDVDAYQVKNHAIQDICNKQQFGSGDRHYLGVQWTLWDGQLIITMLITVTVLHETLRIEVTGHALGPVNSLFTTKPEAPSKQVAKSVRFWETRTVKLPLVDADEVVRLAVRAPLTWYPPLLNWLGGSLTLPEPFGLRHAWADQPWRHRFMADDALRAATPVLRVVHAAAIRVLEENGVDTEKFGNRSSFLSTAVQDPTPRKADVYDA

SEQ ID NO: 14353 - protein, 732 aa, Streptomyces avermitilis
MGDKANAHPGAAGRATAADHPASVRNVVLVGHSGSGKTTLVEALALTAGAVNRAGRVEDGGTVSDYDDIEHRQKRSVQLSLVPVDWDGYKINILDTPGYADFVGELRAGLRAADAALFVVSASDGVDGSTRMVWEECAAVGMPRAIVVTHLEAARADFDEMTRTCAEAFGADDPDAVLPLYLPLHGEQGPDGHAPVTGLTGLLSQRLFDYSTGERKESEPGPDQLPLLAQARNRLIEGIIAESEDETLMDRYLGGEEIDVKTLVQDLERAVARGTFFPVLAAAPAAEGARQGLGTVELLELITGGFPTPLERAAPKVTTPDGTAREVTACDPGGPLVAEVVKTASDPYVGRVSLVRVFSGTLRADDTVHVSGHGLADRGHEDHDVDERIGALSTPFGKQQRSLTHCIAGDLACVAKLNRAETGDTLSAKDDPLLMAPWEMPDPLLPLAIQAHSKADEDKLSQGLGRLVAEDPTMRLEQNQHTHQVVLWCLGEAHADVALERLRNRYGVQVDVIPHKVALRETFAGRAAGRGRHVKQSGGHGQYAICEIEVEPLPGGAGIEFVDKVVGGAVPRQFIPSVEKGVRAQAARGVAAGYPLIDVRVTLLDGKAHSVDSSDAAFQTAGALALREAAADARIHLLEPVAEVTVLVGDDYVGTVMSDLSGRRGRVVGTEQAGGGRTLVRAEVPEIEIGRYAVDLRSLSHGTARFSRAYARHEPMPPQVAERLREQTRQAS

SEQ ID NO: 14354 - protein, 244 aa, Streptomyces avermitilis
MGQPVASRGRAATPTIGKAMLNKYARAFFTRVLTPFAAFLIRRGVSPDTVTLLGTAGVIAGALVFYPRGEFFWGTIVITLFVFSDLVDGNMARQLGRTSRWGAFLDSTLDRVADGAIFGGFALWYAGGGDNNVLCAVSIFCLASGQVVSYTKARGESIGLPVAVNGLVERAERLVISLVAAGFAGLHKFGVPGIQVLLPIALWIVAVGSLVTLIQRVVTVRRESAEADAATAAENASQGSGAAS

SEQ ID NO: 14355 - protein, 308 aa, Streptomyces avermitilis
VSSLQERLTDGAYALGWSTVRKLPEPVAARLGQTVADLTWKRRGKGVRRLESNYARVVPDATPERLAELSRAGMRSYLRYWMESFRLPAWSAERVKNGFDPKDLHHLTDGLASGRGVVLALPHLGNWDLAGAWVTTKLETPFTTVAERLRPESLYDRFVAYREGLGMEVLPHSGGSAFGTLARRLRDGGLVCLVADRDLSASGVEVDFFGATTRMPAGPALLAQQTGAVLLAATLWYDESPVMKGRLHPPVEVPETGTRAEKTSVMTQALADAFATGIADHPEDWHMLQRLWLADLEPRTESTDGGRL

SEQ ID NO: 14356 - protein, 386 aa, Streptomyces avermitilis
VRIGIVCPYSWDVPGGVQFHIRDLAEHLIRLGHEVSVLAPADDDTPLPPYVVSAGRAVPVPYNGSVARLNFGFLSAARVRRWLHDGEFDVIHIHEPTSPSLGLLTCWAAQGPIVATFHTSNPRSRAMIAAYPILQPALEKISARIAVSEYARRTLVEHLGGDAVVIPNGVDVDFFARAKPDPEWQGDTLGFIGRIDEPRKGLPVLMKALPKILAERPGTRLLVAGRGDEEEAVETLPKEMREHVRFLGMVSDEDKARFLRSVDVYVAPNTGGESFGIILVEAMSAGAPVLASDLDAFAQVLDQGAAGELFANEDADALAESALRLLGDPGRRAELRERGSAHVRRFDWSTVGADILSVYETVTDGAAAVAADERTGLRARFGLARD

SEQ ID NO: 14357 - protein, 184 aa, Streptomyces avermitilis
LPPVTATLIWILVGLFAIGLYLSWTAGRLDRLHARIDAARAALDAQLLRRASVAQELATAGVLDPAASIVLYEAAHAARQAEEEQREVAESELSQALRAVFGEQQQVEVVREAPGGEEAANELAQAVRRVPMARRFHNDSVRAARALRRHRKVRWFRLAGHAPFPMAFEMDDEPPVALADRPTT

SEQ ID NO: 14358 - protein, 304 aa, Streptomyces avermitilis
VSSTLSVPAQAPETGTARVKRGMAEQLKGGVIMDVVTPEQAKIAEDAGAVAVMALERVPADIRKDGGVARMSDPDMIEGIISAVSIPVMAKSRIGHFVEAQVLQSLGVDYIDESEVLTPADEVNHSDKWAFTTPFVCGATNLGEALRRIAEGAAMIRSKGEAGTGNVVEAVRHLRQIKNEIARLRGYDNNELYAAAKELRAPYEIVKEVAELGKLPVVLFSAGGVATPADAALMRQLGAEGVFVGSGIFKSGDPAKRAAAIVKATTFYDDPKIIADASRNLGEAMVGINCDTLPEAERYANRGW

SEQ ID NO: 14359 - protein, 201 aa, Streptomyces avermitilis
MNTPVIGVLALQGDVREHLIALAAADAVAREVRRPEELAEVDGLVIPGGESTTISKLAHLFGMMEPLRARVRGGMPVYGTCAGMIMLADKILDPRSGQETIGGIDMIVRRNAFGRQNESFEATVDVKGVGGDPVEGVFIRAPWVESVGAEAEVLAEHGGHIVAVRQGNALATSFHPELTGDHRVHGLFVDMVRANRTPESL

SEQ ID NO: 14360 - protein, 250 aa, Streptomyces avermitilis
MSGHSKWATTKHKKAVIDAKRGKLFAKMIKNIEVAARTGGADPAGNPTLFDAIQKAKKSSVPNKNIDSAVKRGAGLEAGGADYETIMYEGYGPNGVAVLIECLTDNRNRAASDVRVAMTRNGGNMADPGSVSYLFNRKGVVIVPKGELSEDDVLGAVLDAGAEEVNDLGESFEVVSEATDLVAVRTALQDAGIDYDSADANFVPTMQVELDEEGARKIFKLIDALEDSDDVQNVFANFDVSDEVMEKVDA

SEQ ID NO: 14361 - protein, 176 aa, Streptomyces avermitilis
VRVLGVDPGLTRCGVGVVEGVAGRPLTMRGVGVVRTPADAELGLRLVAIEQGIEQWLDEYRPECVAVERVFSQHNVRTVMGTAQASAVAMLCAARRGIPVALHTPSEVKAAVTGSGRADKAQVGAMVTRLLRLDAPPKPADAADALALAICHIWRAPAQNRLQQAVALHASKGRTA

SEQ ID NO: 14362 - protein, 203 aa, Streptomyces avermitilis
MIAFVSGPVAALAPDSAVVEVGGIGIAVQCTPNTLSGLRMGREAKLATSLVVREDSLTLYGFVDDDERQVFELLQTASGVGPRLAQAMLAVHTPDALRRAVSTGDEKALVAVPGIGKKGAQKLLLELKDRLGEPLGTGGPAIGRAVTTGWREQLHAALIGLGYATREADEAVAAVAPQAEAAGGTPQVGQLLKAALQTLNRTR

SEQ ID NO: 14363 - protein, 356 aa, Streptomyces avermitilis
VNWDDTTDATADERLVGASADREDQAVEAALRPKDLDEFIGQEKVREQLDLVLRAARARGATSDHVLLSGAPGLGKTTLSMIIAAEMGAPIRITSGPAIQHAGDLAAILSSLQEGEVLFLDEIHRMSRPAEEMLYMAMEDFRVDVIVGKGPGATAIPLELPPFTLVGATTRAGLLPPPLRDRFGFTAHMEFYEPHELERVIHRSAGLLDVEIDSRGAAEIAGRSRGTPRIANRLLRRVRDYAQVKADGVITREIAAAALKVYEVDARGLDRLDRGVLEALLKLFGGGPVGLSTLAVAVGEERETVEEVAEPFLVREGLLARTPRGRVATPAAWAHLGLTPPPRATGGNGQGDLFGA

SEQ ID NO: 14364 - protein, 167 aa, Streptomyces avermitilis
VNTLTLLPFIVLIGAMFLMTRSAKRKQQQAASMRNEMQPGAGVRTIGGLYATVKEVNEDTVLLDAAPGVDLLFAKNSIGAVLTDDEYNRIVHGIEHDLKTDGTVVPDDASSLTETDEPAADASSDASDDKPIDLGKKDAADDTADEPGKAKSDEAEPKKTDGETDAK

SEQ ID NO: 14365 - protein, 584 aa, Streptomyces avermitilis
VAAPKKGRSASAQSRPGRSLALILIAIAALTGGMFASGNTTPRLGIDLAGGTSITLEAKSGQESAINKTNMNTAVDIMNRRVNGLGVSEAEVQTQGDRNIIVNIPKGTNSEQARKQVGTTAKLYFRPVLATEVSGAAAASPTPSASNSSSKKATDKATEKATSSGTPSATATSQGRAVTDALKDDPTPSASNSASASAKASSSPSPSASSGAEAEAAKLQAAYTALDCRKEGQRAKAGEGAKPTDTTLACGTNSGGQWQKYVLGPAEVAGTDVKKASAVYDTQSGAGWKVTMDFTSGGSKKFASITGKLAKNQEPQNQFAIVLDGSVVSDPRVSEALTGGNAEISGSFDQTEAKDLANVLSYGALPLSFREQSVTTVTAALGGEQLHAGLIAGAIGLALVVIYLVLYYRGLSLIAIASLLVSAALTYAIMTLLGPTIHFALNLPAVCGAIVAIGITADSFIVFFERIRDEIREGRTLRPAVERAWPRARRTILVSDFVSFLAAAVLFIVTVGKVQGFAFTLGLTTVLDVVVVFLFTKPLMTILARKQFFANGHSWSGLDPKRLGAQPPLRRTRRPSAPADPKEA

SEQ ID NO: 14366 - protein, 368 aa, Streptomyces avermitilis
MSKLGNLGARLHRGEVGYDFVGNRKIWYGISILITITAILGLTVRGLNMGIEFQGGAVFTTPKTSVSVSQAERYAEEASGHDAIVQKLGSGGLRVQIAGVDTGKSDQIKAELSQNLKVDSEKINADLVGPSWGEQIANKAWQGLVIFMILVVIYLAIAFEWRMAVAALVALIHDITITVGIYALVGFEVTPGTVIGLLTILGYSLYDTVVVFDSLKEQTKDLTKQTRWTYSDVANRSINSTLVRSINTTVVALLPVAGLLFIGGGVLGAGTLNDISLSLFVGLAAGAYSSIFIATPLVADLKEREPQMKALRKRVLAKRAQAAAKGEDAEVVGQSCDEPDDAAPAVVGPRNQPASRNRGRGRPSGKRR

SEQ ID NO: 14367 - protein, 182 aa, Streptomyces avermitilis
MTELVNITELLLSRIRDVRDYPEPGVVFKDITPLLADPAAFTALTGALAELTVRHGATKIVGLEARGFILGAPAAVQAGVGFIPVRKAGKLPGATLSQSYDLEYGSAEIEVHAEDLVAGDRVMVVDDVLATGGTAEASLQLIRRAGAEVAGVSVLMELGFLGGRARLEPALAGAPLEALLQI

SEQ ID NO: 14368 - protein, 845 aa, Streptomyces avermitilis
LPDEAQPLTAAKPDQTSGPAATPAKNAAQGPVERAPSAPGDKAAEQPRPKSATPAPPERPAATPAARATTGQPARSGGSSNRVRARLARLGVQRSNPYNPVLEPLLRIVRSNDPKIETSTLRQIERAYQVAERWHRGQKRKSGDPYITHPLAVTTILAELGMDPATLMAGLLHDTVEDTEYGLDTLRRDFGDQVALLVDGVTKLDKVKFGEAAQAETVRKMVVAMAKDPRVLVIKLADRLHNMRTMRYLKREKQEKKARETLEIYAPLAHRLGMNTIKWELEDLAFAILYPKMYDEIVRLVAERAPKRDEYLAIVTDEVQSDLRAARIKATVTGRPKHYYSVYQKMIVRGRDFAEIYDLVGIRVLVDTVRDCYAALGTVHARWNPVPGRFKDYIAMPKFNMYQSLHTTVIGPNGKPVELQIRTFDMHRRAEYGIAAHWKYKQEPSAGASKVRTDAPKSVGKDKDAVNDMAWLRQLLDWQKETEDPSEFLESLRFDLSRNEVFVFTPKGDVIALPAGATPVDFAYAVHTEVGHRTIGARVNGRLVPLESTLDNGDLVEVFTSKAAGAGPSRDWLGFVKSPRARNKIRAWFSKERRDEAIEQGKDAIARAMRKQNLPIQRILTGDSLVTLAHEMRYPDISSLYAAIGEGHVAAQSVVQKLVQALGGEEAATEEIDESVPPARGRGRKRRSNADPGVVVKGVDDVWVKLARCCTPVPGDPIIGFVTRGSGVSVHRNDCVNIESLSREPERILEVEWAPTQSSVFLVAIQVEALDRSRLLSDVTRVLSDQHVNILSAAVQTSRDRVATSRFTFEMGDPKHLGHVLKAVRGVEGVYDVYRVTSARRPSDA

SEQ ID NO: 14369 - protein, 409 aa, Streptomyces avermitilis
VSSDPWGRVDETGTVYVRTADGEQVVGSWQAGSPDEALAYFERKYEGLVVEIGLLEKRVKTTDLSAKDAQTAIDHIREQVDAHHAVGDLDVLRKRLDKLVETVAARREERKAQRAKQSDEARHAKESLVVEAEELAQSDQWRAAGERLRSLVDTWKGLPRLDRKSDDELWHRFSHARSAFSKRRKAHFASLDAQREDARKAKEKLVAEAEALSGSTDWGPTAARYRELMGDWKAAGRAQREHEDDLWNRFRGAQDVFFAARSSVFAERDAEQSENLKLKEELAEEAEKLLPISDLKAARAAFRSLNERWEAIGHVPRDARPKVEGRMHAVERALQESEEVEWRRTNPEARARAEGLTGQLQAAVDKLQGQIEAARSAGNNAKADKLQKELDGRQALLDQALKGLHEFGG

SEQ ID NO: 14370 - protein, 277 aa, Streptomyces avermitilis
MRRNPVVTQEQRRRQLAREKFLRQQQRRTAARRKTRMRNTVVASVLGVVVVGSVVSYATGVFKDDGKKANAGAEVSPSPSPSKAPDPCEKAAAGKVKSLSWKKEPAVTIDKSADYTMKMATTCGDIDIALKTAQAPHTVNSFSFLAGKGFFDHTKCHRLTTNGIYVLQCGDPKGTGSGGPGYTIPDENLKDKTLKGGMYPAGTVAMANTGQKHTGGSQFFLVYQDSQLPASYTPFGTISTSGMKVLKKIAAAGESTGQGDGAPNATVVVNRATVTKS

SEQ ID NO: 14371 - protein, 235 aa, Streptomyces avermitilis
VLIAGFPAGAWGTNCYLVAPAAGEECVIIDPGHQAAQGVEDALKKHRLKPVAVVLTHGHIDHVASVVPVCGAHDVPAWIHPADRYMMSDPEKALGRSIGMPLMGELTVGEPDDVRELADGAGLKLAGLDLSVAHAPGHTKGSVTFTMPESADIPSVFFSGDLLFAGSIGRTDLPGGDMDDMLGSLTRVCLPLDDSTVVLSGHGPQTTIGQERATNPYLRQVAAGLGSVDAPRRGM

SEQ ID NO: 14372 - protein, 420 aa, Streptomyces avermitilis
VSTFKAPKGTYDLIPPDSAKYLAVREAIAAPLRNSGYGYIETPGFENVELFARGVGESTDIVTKEMYAFETKGGDRLALRPEGTASVLRAALEANLHKAGNLPVKLWYSGSYYRYERPQKGRYRHFSQVGAEAIGAEDPALDAELIILADQSYRSLGLRNFRILLNSLGDKECRPVYRAALQDFLRGLDLDEDTLRRAEINPLRVLDDKREDVQKQLGGAPLLRDYLCDACKAYHEEVRELITAAGVSFEDDAKLVRGLDYYTRTTFEFVHDGLGSQSAVGGGGRYDGLSEMIGGPALPSVGWALGVDRTVLALEAEGVELELPSSTSVFAVPLGEEARRILFAKVTELRKVGIAADFAYGGKGLKGAMKNANRSGARYTVVAGERDLAEGVVQLKDMESGEQTAVGVNEIVAELEARLG

SEQ ID NO: 14373 - protein, 212 aa, Streptomyces avermitilis
VMSKTRVKNVSTEPEAADTPRTVGGSRAFGLLLVITGAAGLLAAWVITIDKFKLLENPNFVPGCSLNPVVSCGNIMKSEQASAFGFPNPMLGLVAYGMVICVGVSLLARATFPRWYWLTFNAGTLFGVGFCTWLQFQSLYRINSLCLWCSLAWVATILMFWYVTSFNVRNDFLPAPRWLKSFFGEFTWVLPVMHIGIIGMLILTRWWDFWTG

SEQ ID NO: 14374 - protein, 453 aa, Streptomyces avermitilis
LRVEPDLFTAAAEERQEKDPSSSPLAVRMRPRTLDEVVGQQHLLKPGSPLRRLVGEGSGGPAGPSSVILWGPPGTGKTTLAYVVSKATNKRFVELSAITAGVKEVRAVIDGARRATGGFGKETVLFLDEIHRFSKAQQDSLLPAVENRWVTLIAATTENPYFSVISPLLSRSLLLTLEPLTDDDLRGLLRRALTDERGLKEAVTLPADTEEHLLRIAGGDARRALTALEAAAGAALDKGEPEIGLQTLEETVDRAAVKYDRDGDQHYDVASALIKSIRGSDVDAALHYLARMIEAGEDPRFIARRLMISASEDIGLTDPHALPTAVAAAQAVAMIGFPEAALTLSHATIALALAPKSNAATMAIGAAMEDVRKGHAGPVPLHLRDGHYKGAAKLGHAQGYVYPHDLPEGIAAQQYAPEELKDREYYTPTRHGAEARYADAVEWTRKHLGRGRP

SEQ ID NO: 14375 - protein, 204 aa, Streptomyces avermitilis
VANQSRPKVKKSRALGIALTPKAVKYFEARPYPPGEHGRGRKQNSDYKVRLLEKQRLRAQYDVSERQLVRAYERAAKTQGKTGEALVIELERRLDALVLRSGIARTIYQARQMVVHGHIEVNGQKVDKPSFRVKPDDVVMVRERSRQKPLFEVAREGGFAPDGETPRYLQVNLRALAFRLDREPNRKEIPVICDEQLVVEYYAR

SEQ ID NO: 14376 - protein, 151 aa, Streptomyces avermitilis
VHTVSGGEVAGILVAVFWAILVSFLAVALARLAQTLKATTKLVADVTDQAVPLLADASTAVRSAQTQIERVDAIASDVQEVTSNASALSTTVASTFGGPLVKVAAFGYGVRRALGSRRENVPPKTPRRTVIVGRPVPSARREKRDNRNKRD

SEQ ID NO: 14377 - protein, 116 aa, Streptomyces avermitilis
MFRRTFWFTAGAAAGVWATTKVNRKLKQLTPESLAAQAANKAIEAGHKLRDFALDVRDGMAQREAELGEVLGIDADPELPGPRRIAAIENSNNPKYSKDPRYVERSTYSHNRNEDH

SEQ ID NO: 14378 - protein, 890 aa, Streptomyces avermitilis
MESAEIRRRWLSFYEERGHTVVPSASLIADDPTLLLVPAGMVPFKPYFLGEVKPPWPRATSVQKCVRTPDIEEVGKTTRHGTFFQMCGNFSFGDYFKEGAITYAWELLTTPQDKGGYGLDPERLWITVYLDDDEAETIWRDKIGVPAERIQRLGKKDNYWSMGVPGPCGPCSEINYDRGPEFGVEGGPAVNDERYVEIWNLVFMQYERGEGTSKDDFEILGDLPQKNIDTGLGMERLAMILQGVQNMYEIDTSMAVIQKATELTGVEYGAAHGSDVSLRVVTDHMRTSVMLIGDGVTPGNEGRGYVLRRIMRRAIRNMRLLGATGPVVKDLVDVVIAMMGQQYPELISDRQRIETVALAEEAAFLKTLKAGTNILDTAVTETKASGGQVLPGDKAFLLHDTWGFPIDLTLEMAAEQGLSVDEDGFRRLMKEQRERAKADAQSKKTGHADLGAYREIADAAGETDFIGYTQTEGESTIVGILVDGVSSPAATEGDEVEIVLDRTPFYAEGGGQIGDTGRIKVESGAIIEVRDCQKPVPGVYVHKGVVQVGEVTVGAKAQVSIDVRRRKAIARAHSATHLTHQALRDALGPTAAQAGSENQPGRFRFDFGSPSAVPTTVMTDVEQQINEVLARDLDVQAEVMSIDEAKKQGAIAEFGEKYGERVRVVTIGDFSKELCGGTHVHNTAQLGLVKLLGESSIGSGVRRIEALVGVDAYNFLAREHTVVAQIQELVKGRPEELPEKVSAMLGKLKDAEKEIERFRAEKVLQAAAGLVDSAKDVRGIALVTGQVPDGTTADDLRRLVLDVRGRIQGGRPAVVALFTTVGGKPLTVIATNEAARERGLKAGDLVRAAAKTLGGGGGGKPDVAQGGGQNPAAIGEAIDAVERLVTETAK

SEQ ID NO: 14379 - protein, 156 aa, Streptomyces avermitilis
VGMRRGRRLAVDVGDARIGVASCDPDGILATPVETVPGRDVPAAHRRLKQLVEEYEPIEVVLGLPRSLKGGEGPAAVKVRAFAQELARVIAPVPVRLMDERMTTVTASQGLRASGVKSKKGRSVIDQAAAVIILQQALESERVSGKAPGEGVEVVI

SEQ ID NO: 14380 - protein, 605 aa, Streptomyces avermitilis
MTEYGRGPGSEPWHPEDPLYGDGGWGGQEPHAAQSAYGGQPQHYPQQPQQQYGDWGNGQQAGYDQGGQQYEQQYADQGQQYPQQNAAQQQYQQHAAQGQQHNPQNHQQHDPQGQQQHNPQGQQQYADQTHQQYGNGGWETGAHPQVPYAADPADPYGGQPAAYSGEQPDFYGTPDAYPPPEPPGRRRAEPKPEPEPETDWDPGPDEGEHAFFAGGGDDDDDLDDEAKGRGGRGDRRGRGDGKAKKRRNGCACLVVVLVFGGGLGGVGYYGWQFYQNRFGAAPDYAGDGTGEQVTVVIPKGAFGSVIGQKLEEAGVVKSAGAFVSAQATNPDGDKIQPGAYTLKKEMSAKSAVELMLSPKSKNNLTVYEGQRNARVYTAIDTRLGVKKGTTKGVAEKEWSTLGLPDWANTDKDIKDPLEGFLYPSTYPVSKGMKPKDVLKEMVNLAKDKYAALGIQAKAKDLNLKNPLQVLTVASLVQSEGNSKNDFEKVARVVYNRLKPDNTETYGLLDFDSTVNYLRGESKLATGSVNDLRKINDPYNTYKIKGLPPGPISNPGDVAINAALNPAKGNWYYFVSISADKTLFAETNEEQNRNREKYLEEQKNGQ

SEQ ID NO: 14381 - protein, 278 aa, Streptomyces avermitilis
MTGTDSKRRAAVLGSPIAHSLSPVLHRAAYAELRLSDWSYDRFDVDEEALPAFFGKLGPEWAGLSLTMPLKRAVIPLLDEITETAASVEAVNTVVCTRDGRRVGDNTDIPGMVAALRERGIEQVDSAAILGAGATASSALAALARICTGEVVAYVRSEARAAEMRQWGERLDVEVRTEDWAQAAEALRAPLVVATTPAGATDALAAAVPERPATLFDVLYDPWPTDLAARWSAYGGAVVSGLDLLVHQAVLQVEQMTGRSPAPLDAMRRAGEHALAAR

SEQ ID NO: 14382 - protein, 394 aa, Streptomyces avermitilis
LSRLRWLTAGESHGPALVATLEGLPAGVPITTDMVADHLARRRLGYGRGARMKFERDEVTFLGGVRHGLTLGSPVAIMVGNTEWPKWEQVMAADPVDPAILADLARNAPLTRPRPGHADLAGMQKYGFDEARPILERASARETAARVALGAVARSYLKETAGIEIVSHVVELAAAKAPYGVYPTPADVEKLDADPVRCLDADASKAMVAEIDQAHKDGDTLGGVVEVLAYDVPVGLGSHVHWDRRLDARLAAALMGIQAIKGVEVGDGFELARVPGSKAHDEIVQTADGVRRTTGRSGGTEGGLTTGELLRVRAAMKPIATVPRALATIDVATGEATKAHHQRSDVCAVPAAGIVAEAMVALVLADAVAEKFGGDSVPETRRNVRSYLDNLVVR

SEQ ID NO: 14383 - protein, 171 aa, Streptomyces avermitilis
VTVPRVVLVGPMGVGKSTVGALVAERLGCAYRDTDDDIVTAEGRTIADIFVDEGEPVFRAIEKRAVHTALAEHDGVLALGGGAILDADTRALLAGHRVVYLSMEVDEAVKRTGLNAARPLLAVNPRRQWRELMEARRHLYTEVARAVVATDGRGPEEVAQAVLDALELKEA

SEQ ID NO: 14384 - protein, 363 aa, Streptomyces avermitilis
MSEAVTRIHVGGTAGTDPYEVLVGRQLLGELAGLIGDRVKRVAVVHPEALAETGEALRADLAEQGYEAVAIQVPNAEEAKTVEVAAYCWKALGQSGFTRTDVIVGVGGGATTDLAGFVAATWLRGVRWIAVPTTVLGMVDAAVGGKTGINTAEGKNLVGAFHPPAGVLCDLAALDSLPVNDYVSGLAEIIKAGFIADPAILELIEADPQAARTPAGPHTAELIERSIKVKAEVVSGDLKESGLREILNYGHTLAHAIEKNERYKWRHGAAVSVGMHFAAELGRLAGRLDDATADRHRTVLESVGLPLHYRYDQWPKLLETMKVDKKSRGDLLRFIVLDGLAKPTVLEGPDPAVLLAAYGEVGE

SEQ ID NO: 14385 - protein, 296 aa, Streptomyces avermitilis
MQHAVGGPLPPPHHAGHQPATGWLSAAHHPGAHPGPAPAPPPGPAPAPPPGFAGAPVPPGPPHTQVPQHHAPPQHVPVPPAPDTTGHVQLPPGGPVPMPSTPPAVGPADATSTTLAVLLIGPAGAGKTSVAKYWADHRRVPTAHISLDDVREWVRSGFADPQSGWNDHSEAQYRLARRTCGFAARNFLANGISCILDDAVFPDRPVVGLGGWKRHVGPGLLPVVLLPGLEIVLERNAERSGNRRLTDEEVARIHGRMAGWYGSGLPIIDNSQLDVPATARVLDEVLARSIASPPQW

SEQ ID NO: 14386 - protein, 368 aa, Streptomyces avermitilis
MSEVYAARRERLRERCTAGGSAAALISRPANVRYLAGAAPQGAVLLLGKGEDLLLCTGPPGDQPAQGRLDEALRVQLLERPGGDPAVAAADCAGAQGAESLAVEEHHLTVARHRAIRSVAPRLRLADVGGAVEQLRVVKDEEEISFLRIGAEIADQALGELLESILVGRTERHLALELERRLVDHGADGPAFPTSVATGPNSGRRGHRPTDRRVEEGDFLSVCLGATYHGYRCEIGRTFVIGTSPAEWQIELYDLVFAAQRAGREALAPGAAYRDVDRAARQALESTGHAEGLPPLTGHGVGLEIDEDPQLAPAAMGKLDACVPVTVEPGVHLPGRGGVRIDDTLVVRPEADGGPELLTITTKELLAL

SEQ ID NO: 14387 - protein, 188 aa, Streptomyces avermitilis
VASTNDLKNGLVLKLDGGQLWSVVEFQHVKPGKGPAFVRTKLKNVLSGKVVDKTFNAGVKVETATIDKRDMQFSYMDGEYFVFMDMDTYDQLMVDRKSVGDAANFLIEGFTATVAQHEGEVLFVELPAAVELVIQETEPGVQGDRSTGGTKPATLETGHQIQVPLFITTGEKIKVDTRTSDYLGRVNS

SEQ ID NO: 14388 - protein, 144 aa, Streptomyces avermitilis
VAARNTARKRAFQILFEGDQRGVDVLTVLADWIRHSRTDTRQPPVSEYTMQLVEGYAKKVNRIDELISQYAVGWTLDRMPVVDRNILRLGTYELLWVDETPDAVVLDEAVQLAKEFSTDDSPAFVNGLLGRLKELKPSLRREEA

SEQ ID NO: 14389 - protein, 174 aa, Streptomyces avermitilis
MFQRPGSYMSSEYAKQLGAKLRAIRTQQGLSLHGVEEKSQGRWKAVVVGSYERGDRAVTVQRLAELADFYGVPVQELLPGTTPGGAAEPPPKLVLDLERLAHVPAEKAGPLQRYAATIQSQRGDYNGKVLSIRQDDLRTLAVIYDQSPSVLTEQLISWGVLDADARRAVSHEEG

SEQ ID NO: 14390 - protein, 192 aa, Streptomyces avermitilis
MDTQQYESDARPVLEGSDIARVLTRIAHEIVERAKGADDVVLLGIPTRGVFLAQRLAAKLEEITDRKVPVGSLDITMYRDDLRMHPPRALARTDIPGDGIDGRLVVLVDDVLFSGRTIRAALDALNDIGRPRAVQLAVLVDRGHRELPIRADYVGKNLPTSLRETVKVLLAEEDGRDTVLLGAKRTSSGAQQ

SEQ ID NO: 14391 - protein, 325 aa, Streptomyces avermitilis
MQRHLISAADLTRDDAVHLLDTAEEMARVADRPIKKLPTLRGRTVVNLFFEDSTRTRISFEAAEKRLSADVINFTAKGSSVSKGESLKDTAQTLEAMGVDAVVIRHGASGAPYRLATSGWIDAVVINAGDGTHQHPTQALLDAFTMRRRLVGRDAGLGRDLAGKRITLVGDILHSRVARSNVDLLHTLGAEVTLVAPPTLLPVGIESWPCEVAYDLDSTLPKSDAVMMLRVQRERMNAAFFPTEREYSRRYGLNGDRMAKMPEHAIVMHPGPMVRGMEITAEVADSDRCTAIEQVTNGVSIRMAVLYLLLGGNEPAVSHTRIEEK

SEQ ID NO: 14392 - protein, 428 aa, Streptomyces avermitilis
MSKILIRGAKVLGGEPQDVLIDGDTIAEVGTGLSAEGAEVVDAAGKVLLPGLVDLHTHLREPGREDSETVLTGTRAAASGGYTAVFAMANTFPVADTAGVVEQVYRLGQEHGYCDVQPIGAVTVGLEGKKLAELGAMHESAAGVTVFSDDGKCVDDAVIMRRALEYVKAFGGVVAQHAQEPRLTEGAQMNEGVVSAELGLGGWPAVAEESIIARDVLLAEHVGSRVHICHLSTAGSVEIVRWAKSRGIDVTAEVTPHHLLLTDELVRSYNPVYKVNPPLRTERDVMALREALADGTIDIVATDHAPHPHEDKDCEWAAAAMGMVGLETALSVVQQTMVETGLLDWAGVADRMSVKPARIGRATGHGRPVSAGEPANLTLVDTAYRGAVDPAGFASRSRNTPYEGRELPGRVTHTWLRGKATLVDGKLA

SEQ ID NO: 14393 - protein, 206 aa, Streptomyces avermitilis
VTSLHQTYLAAGQKSAEVTDWSARIGWLVGLALFIALVYWLMREGWKWRGTLQSDLPELPARPSPTTTLNGGGKPPPAGMPDEPDRVKLTMSGRYHGSTTAGQWLDRIVAHGLGTRSRVELTLTDAGLDVVRPGAADFFVPAAQLREARLDKGIAGKVLTEGGLLVVTWAHGDKLIDSGFRSDVSAEHNEWAYTLNNMINNTEGAR

SEQ ID NO: 14394 - protein, 380 aa, Streptomyces avermitilis
MTTSTRGAAKVPAVLVLEDGRTFRGRAYGAVGVTFGEAVFSTGMTGYQETLTDPSYHRQVVVMTAPHVGNTGVNDEDPESKRIWVSGYVVRDPARVPSNWRSRRSLDEELRHQGVVGISGIDTRALTRHLRESGAMRVGIFSGSALPDEGTMLAEVRQAPEMKGANLAAEVATKETYVVPAIGAKRFTVAAVDLGIKGMTPHRMAERGIEVHVLPATATAEDVYAVNPDGVFFSNGPGDPATADGPVAVMREVLARKTPLFGICFGNQILGRALGFGTYKLKYGHRGINQPVQDRTTGKVEVTAHNHGFAVDAPLDQVSDTPYGRAEVSHVCLNDNVVEGLQLLDQPAFSVQYHPEAAAGPHDAAYLFDRFVSLMEGQRA

SEQ ID NO: 14395 - protein, 1102 aa, Streptomyces avermitilis
VPKRTDIQSVLVIGSGPIVIGQAAEFDYSGTQACRILRAEGLRVILVNSNPATIMTDPEIADATYVEPITPEFVEKIIAKERPDALLPTLGGQTALNTAISMHEQGVLEKYGVELIGANVEAINKGEDRDLFKGVVEAVRAKIGHGESARSVICHSMDDVLEGVETLGGYPVVVRPSFTMGGAGSGFAHDEEELRRIAGQGLTLSPTTEVLLEESILGWKEYELELMRDKNDNVVVVCSIENFDPMGVHTGDSITVAPSMTLTDREYQRLRDIGIAIIREVGVDTGGCNIQFAVNPDDGRIIVIEMNPRVSRSSALASKATGFPIAKIAAKLAVGYTLDEIPNDITEKTPASFEPTLDYVVVKAPRFAFEKFPSADSTLTTTMKSVGEAMAIGRNFTEALQKALRSLEKKGSQFTFVGEPGDKALLLEEAVRPTDGRINSVMQAIRAGATPEEVFEATKIDPWFVDQLFLIKELADELAAADKLDPELLAEAKRHGFSDVQIAEIRGLREDVVREVRHALGVRPVYKTVDTCAAEFAAKTPYFYSSYDEESEVAPREKPAVIILGSGPNRIGQGIEFDYSCVHASFALSEAGYETVMVNCNPETVSTDYDTSDRLYFEPLTLEDVLEIVHAETLAGPVAGVIVQLGGQTPLGLSQALKDNGVPVVGTPPEAIHAAEDRGAFGQVLAEAGLPAPKHGTATTFAGAKAIADEIGYPVLVRPSYVLGGRGMEIVYDETRLESYIAESTEISPSRPVLVDRFLDDAIEIDVDALYDGEELYLGGVMEHIEEAGIHSGDSACALPPITLGGFDIKRLRASTEAIAKGVGVRGLINIQFAMAGDILYVLEANPRASRTVPFTSKATAVPLAKAAARISLGATIAELRAERLLPANGDGGTLPLDAPISVKEAVMPWSRFRDIHGRGVDTVLGPEMRSTGEVMGIDSVFGTAYAKSQAGAYGPLPTKGRAFISVANRDKRSMIFPARELVAHGFELLATSGTAEVLKRNGINATVVRKQSEGEGPGGEKTIVQLIHDGQVDLIVNTPYGTGGRLDGYEIRTAAVARSVPCLTTVQALAAAVQGIDALTHGDVGVRSLQEHAEHLTAARD

SEQ ID NO: 14396 - protein, 368 aa, Streptomyces avermitilis
MYKLFFRLVFKRMDPEQAHYLAFRWIRLAARIPVLRTFVAAALAPRFKELRTEAFGLRMHGPFGLAAGFDKNAVAVDGMSMLGFDHVEIGTVTGEPQPGNPKKRLFRLVPDRALINRMGFNNEGSAAVAARLAAREAVFRTVVGVNIGKTKVVPEEEAADDYVKSTERLARHADYLVVNVSSPNTPGLRNLQATEALRPLLSAVREAADRTVTERRVPLLVKIAPDLADDDIDAVADLAVELGLDGIIATNTTIAREGLGLKSEPTLVKETGGLSGAPLKARSLEVLSRLYARVGDRITLVGVGGIENAEDAWQRILAGATLVQGYSAFIYEGPFWGRAIHKGLAARLRTSPYATLADAVGADVRKSA

SEQ ID NO: 14397 - protein, 280 aa, Streptomyces avermitilis
MSLEPFGARLSRAMDDRGPLCVGIDPHASLLADWGLSDDVAGLERFSRTVVEALGEHVAVFKPQSAFFERFGSRGVAVLEKTVAEARAAGALVVMDAKRGDIGSTMAAYAEAFLRKDSPLFSDALTVSPYLGYGSLRPAVELARESGAGLFVLALTSNPEGGEVQHAVRTDGRDVAATMLAHLAAENAGEEPLGSFGAVVGATLGDLSSYDLDINGPLLAPGIGAQGAAPADLPGVFGAAVRNVVPNVSRGVLRHGPDVRALRTAADRFAEEIRAAVAAV

SEQ ID NO: 14398 - protein, 107 aa, Streptomyces avermitilis
VALPPLTPEQRAAALEKAAAARRERAEVKNRLKHSGASLHEVIKQGQENDVIGKMKVSALLESLPGVGKVRAKQIMERLGISESRRVRGLGSNQIASLEREFGSTAG

SEQ ID NO: 14399 - protein, 197 aa, Streptomyces avermitilis
MAVTPRGTSPVPPDARPRLTVLSGPSGVGKSTVVAHMRKEHPEVWLSVSATTRKPRPGEKHGVHYFFVSDDEMDKLIANGELLEWAEFAGNRYGTPRQAVLERLERGEPVLLEIDLQGARQVRESMPEALLVFLAPPSWEELVRRLTGRGTEPPEVIERRLDAAKVELAAEPEFDVTLVNTSVEDVARELLALVDVV

SEQ ID NO: 14400 - protein, 90 aa, Streptomyces avermitilis
VSSSITAPEGIINPPIDELLEATDSKYSLVIYAAKRARQINAYYSQLGEGLLEYVGPLVDTHVHEKPLSIALREINAGLLTSEPVEGPAQ

SEQ ID NO: 14401 - protein, 405 aa, Streptomyces avermitilis
VWGDPVDKPKVVLGVSGGIAAYKACELLRRLTESGHDVRVVPTGSALHFVGAATWSALSGNPVSTEVWDDVHEVPHVRIGQHADLVVVAPATADMLAKAAHGLADDLLTNTLLTARCPVVFAPAMHTEMWEHPATQENVATLRRRGALVIEPAVGRLTGVDTGKGRLPDPTEIFEVCRRVLARGAARPDLAGRHVVVSAGGTREPLDPVRFLGNRSSGKQGYALARTAAARGARVTLVAANTGLPDLAGVDVVQVGTAVQLREAVLKAASDADAVVMAAAVADFRPATYATGKIKKKDGQEPEAIVLVRNPDILAEISADRPRPGQVVVGFAAETDDVLANGRTKLARKGCDLLVVNEVGERRTFGSEENEAVVLGADGSEIPVPYGPKEALAETVWDLVVPRLG

SEQ ID NO: 14402 - protein, 402 aa, Streptomyces avermitilis
VSRRLFTSESVTEGHPDKIADQISDTILDALLREDPTSRVAVETLITTGLVHVAGEVTTKAYAPIAQLVRDKILEIGYDSSKKGFDGASCGVSVSIGSQSPDIAQGVDTAYENRVEGDEDELDRQGAGDQGLMFGYATDETPTLMPLPIHLAHRLSHRLSEVRKNGTIPYLRPDGKTQVTIEYDGDKAVRLDTVVVSSQHASDIDLDSLLAPDIREFVVEPELKALLDDGIKLETEGYRLLVNPTGRFEIGGPMGDAGLTGRKIIIDTYGGMARHGGGAFSGKDPSKVDRSAAYAMRWVAKNVVAAGLASRCEVQVAYAIGKAEPVGLFVETFGTAKVEADKIEQAIATVFDLRPAAIIRDLDLLRPIYSQTAAYGHFGRELPDFTWERTDRVDALRTAVGL

SEQ ID NO: 14403 - protein, 720 aa, Streptomyces avermitilis
VSSENGQGGGGGEEAPPEQLALIREAVRKAKVPKAKPRTWRGAALAKELPVARVLVDKGVLHLDRYFDYAVPEELAAVAQPGVRVRVRFGAGGRTVRDGRREGGSLIDGFLVERVAESDYGGPLAALAQVVSPEPVLGPELLGLARAVADRYAGSLADVLQLAVPPRHGRAEAGKTAEPLPAPPAPEPGSWRRYARGAEFVKSLAAGGSPRAVWTALPGPDWAEEIARAVQATLASGRGALVVVPAGRPAARVDAALRALMGEGRHALLTADAGQERRYREWLAVRRGAVQAVVGTRAAMFAPVRNLGLVVVWDDGDASHSDDNAPFPHVREVLELRATRDKCGFLLGSWSCTVEAAQLVESGWAAPLVAEREQVRAAAPLVRTVGDGDLARDEAARAARLPTLAWQAVREGLRHGPVLVQVPRRGYVPRMACAQCRAPARCRHCAGPLEAHDAGALRCGWCGREDAAWHCPECGGFRLRAQVVGARRTAEELGRAFPAVPVRTSGREQVLDTVSGAPALVVSTPGAEPVAEGGYAAALLLDGWAMLGRPDLRAGEEALRRWIGAAALVRGQAAGGTVVVVAEPTLRPVQALVRWDPVGHAVRELAERAELGFPPVSRMAAVSGTAEAVAGFLSGVELPSDAEVLGPVPLPVTEAGRPRRVGGPPPGERWERALVRVPPGSGAALAGALKTAQAARMARGGGGNGSEAPVRIRIDPPDIG

SEQ ID NO: 14404 - protein, 180 aa, Streptomyces avermitilis
MADHATHDAQARASLHLLVRDIERVRRQVDALRTLTAQLGNVYRPRRSGPSTGFVVYGRAPAPTVRLAQELRDSVETLVTAAVDFDRSLGFSWDAVGSALGVTKQAVHRRYGARRAAAQAAADAERATEPTAARTVSVNTGIPTVPTVPAARSMPTQPTAGSPTLRDEARPTAFPGPRNG

SEQ ID NO: 14405 - protein, 310 aa, Streptomyces avermitilis
MKLVFAGTPEVAVPALDALIASGRHEVAAVVTRPDAPAGRGRRLVASPVAQRAEEAGIEVLKPVKPRDEEFLARLREIAPDCCPVVAYGALLPRVALDIPAHGWVNLHFSLLPAWRGAAPVQHSIMAGDEITGASTFLIEEGLDSGPVFGTVTEEIRPTDTSGDLLTRLAFAGSGLLVATMDGVEEGKLKAVPQPADGITLAPKITVENAHVDWSTPALRVDRVVRGCTPAPGAWTVFRGERLKLIQVVPVPERTDLAPGALSVGKNNVYVGTGSYAVELLWVQAQGKKPMRAADWARGVRITDGEPLGA

SEQ ID NO: 14406 - protein, 476 aa, Streptomyces avermitilis
VSEQSRQPRKPGKPHRRPQKDPVRFLAFEALRAVDERDAYANLVLPPLLRKARQKGDFDGRDAALATELVYGTLRRQGTYDAVIAACVDRPLREVDPPVLDVLSLGVHQLLGTRIPTHAAVSASVELARVVLGDGRAKFVNAVLRKVAQHDLDGWLEQIAPPYDDDAEDHLAVVHSHPRWVVSALWDALGGGRAGIEDLLEADNERPEVTLVARPGRSTAGELLGVLGEESALPGRWSPYAVRLTEGGEPGAIDAVREGRAGVQDEGSQLVALALANAPLDGPDQAWLDGCAGPGGKAAMLAGLAAERGAVLLASEKQPHRAGLVAKALAGNPGPYQVIAADGIRPPWRPGTFDRVLMDVPCTGLGALRRRPEARWRRRPEDLDGFAPLQRGLLRTALDSVRVGGVVGYATCSPHLAETRAVVDDVLKHHTVAAELIDARPLLPGVPALGEGPDVQLWPHLHGTDAMYLALIRRTA

SEQ ID NO: 14407 - protein, 718 aa, Streptomyces avermitilis
VLPRGLVGCVCGRRGKWLIVALWLVLLVVAAPLASKLTGAQDNDAASWLPGSAESTQVLVTSGTFRPEQIPAVVVYAREGGLTAQDKRRIARDADRIKGLTAHGVRGDESRGPAYDTPSAPEAAQIHVPITMDEKGWQELAPAVDSLRDQVGGGGGGLAVHITGPGGTSADFSKAFEGIDSTLLLSAMGVVIVMLLVTYRSITLIFVPLTGVVAALFTAQALIYLLAEHTGLTVNGQSAGILTVLVFGAGTDYALLLVARYREGLRRHEDRHEAMALALNRAGPAVLASGATVVLSMLVLLAAEMNSTRGLGPVAAIGVAIALLAMLTLFPALLLVFGRWIFWPAIPHFGAADPTERGLWARMGRRIAHRPRLVWSGTALVLAALSLGLLQLRASGIGNADAFTGRPDSIVGQEVSARYFPAGTGDPLVVVADQARGDQVRKAVAGTKGVVADSVTVPPGTKPSSGGKVLFEATLTDPSDSDAAKRTVERVRDAVHAVPDARARVGGGSAALLDMDAATTHDNLVVIPAVLVVVLLILGLLLRALVAPLLLIGTVVLSFAAALGASALAFRHLFDYAGEQTDFPLFVFVFLVALGIDYNIFLTTRIREEAARRGTRPGVVTGLAATGAVITSAGLVLAGTFAALGTLPMVAFAEIGFAVALGVLLDTFVVRSVLVTALFLDGGPKVWWPHRLSHEDGGDAGAAATVAAPDAEVRQSGG

SEQ ID NO: 14408 - protein, 228 aa, Streptomyces avermitilis
MAVQINPSILSADFARLAEEAKAVEGADWLHVDVMDNHFVPNLTLGVPIVEALARATDTPLDCHLMIEDADRWAPQYVEAGAGSVTFHAEAAAAPVRLAREIRAKGARASMALKPATPIEPYEDLLPELDMLLIMTVEPGFGGQAFLDIMLPKIRRTRELISKHGLELWLQVDGGVSASTIERCAEAGADVFVAGSAVYGAADPADAVRALRTQAEGATALASWACDH

SEQ ID NO: 14409 - protein, 347 aa, Streptomyces avermitilis
VNSSEEMAVSGMSAGRSAMRMGPAELVQAAAMARRFYLEGKSKIQIAEEFGVSRFKVARVLETALERDLVRIEIRVPAELDAERSDALRARYGLRHAVVVESPAEAEESPDPENLGEVAADLLGELVTEGDVLGLAWGRSTIHMAAALDRLPPCTVVQLTGVYDAGTAERGSVEAVRRAAQVSGGDAHPIYAPMLLPDVATTAALRNQTGIARAFEYFDKVTVACVSIGSWEPGISTVHDMLSDEERAHYASLGVAAEMSAHLFDADGRRVGRDLGERCITVKADQLRRVPEVVAIAGGQRKAAAIDAVLRSGLVTSLVTDTSAADYLMAAGPTPRPALNRADPDGP

SEQ ID NO: 14410 - protein, 135 aa, Streptomyces avermitilis
MLLRSVPRVLAGLFVCLAVLLTGCSPTGPTKAPASSARPSWAAGMATVKESQLPAEARQTLARIDRGGPFPYAMDGAVFGNFERLLPRHQRGYYHEYTVKTPGSRDRGARRIVTGQSDEIYYTDDHYKSFRAVLR

SEQ ID NO: 14411 - protein, 125 aa, Streptomyces avermitilis
MTDGTLADVLRACGWTPIELDLGGVTTKPAFMDRVALALGLPDWFGRNWDALADCLADLSWAPPARGRLLVITGWQEYALAAPHDWGIAQEVFGEASDRGRGTGTELHVVLALGGSSQGTSDQPG

SEQ ID NO: 14412 - protein, 483 aa, Streptomyces avermitilis
VQHVRFLNDIKPPYDLTYDDVFMVPSRSAVGSRQGVDLTSPDGTGTTIPLVVANMTAIAGRRMAETVARRGGLVVIPQDIPIEVVTEVVSWVKGRHLVLDTPIVLVPHQTVADALALLPKRAHNAGVVVDEDGRPVGVVTDTDLTGVDRFTQLSEVMSRDLLLLDADIEPREAFNKLDGANRRYAPAVDRDGRLAGILTRKGALRATLYTPATDADGRLRIAAAVGINGDVAGKAKQLLDAGVDTLVIDTAHGHQESMISAIRTVRALDPQVPIAAGNIVAADGVKDLVEAGADIIKVGVGPGAMCTTRMMTGVGRPQFSAVMECAAEAKKYGKHVWADGGVRHPRDVAMALAAGASNVMIGSWFAGTYESPGDLQQDADGRLYKESFGMASARAVRNRTSEESAYDRARKGLFEEGISTSRMFLDPGRPGVEDLIDSIIAGVRSSCTYAGANSLEEFTEKAVVGIQSAAGYAEGKPLHASWS

SEQ ID NO: 14413 - protein, 166 aa, Streptomyces avermitilis
MKIAMCRAADVALLDQYIGSAGVTSSHARRFACQEAGESTYLVAWLDDRPVGHAEVRWTGCAAAEVRAARPGCPEINGLGVWPGELRSRGIGSALIRAAEELTRERGLDVIGLGVGTDNPRAAELYARLGYRPLTGYVDRWSYEGGDGTTHECADPCTFLVKELPR

SEQ ID NO: 14414 - protein, 492 aa, Streptomyces avermitilis
VLDQGAPPQSRSHPSAPGLGARLMRRKPVENLVAEGGQGEGGTLRRSLGLWQLTMISIGATLGTGIFVVLGEAVPKAGPAVTLSFVIAGLTALFSALSYAELAGTIPVSGSSYSYAYATMGELIAWICGWCLVLEYGVSVAAVAVGWGEYLNELLDGTIGVTIPDALSAPPGDGGIFNLPALIVVLLAMAFLLGGAKESARANTIMVIVKIAALLMFCAIGIQGFKSGNYENFMPLGMAGVSAAGATLFFSYIGFDAASTAGEEAKNAQRDLPRAIMLSLVIVTALYVLVAAVAVGAKPWKGFNDSEAALAGIMKDVTGQTFWGTLLAACAVIAIASVVLTVLYGQTRILFAMARDGLVPKVFARVHPKTGAPRANTVIVSLFCGVLAAAIPLGQLADATSIGTLFAFGLVNIAVVVLRRTRPDMRRTFRVPLSPVLPAIGFALCVWMMGSLSAVTWVVFGVWMAVGLVFYFSYGHRRSRLATADTAVSAQK

SEQ ID NO: 14415 - protein, 150 aa, Streptomyces avermitilis
LLNDLDERIVHALAEDARRSYADIGQEVGLSAPAVKRRVDRLRATGAITGFTVRVDPAALGWETEGFVEIYCRRNTSPETIQRGLERYQEVVAASTVTGEADAVVQVFASDMRHFERVLERIAGESFVERTKSVLVLSPLLRRFSSGSPT

SEQ ID NO: 14416 - protein, 65 aa, Streptomyces avermitilis
VAASARDAGPLGVRRTSPPLRVRRVTTAREGRPAERSDDHYRSDAVSFGAHHSTGNNALARKPAG

SEQ ID NO: 14417 - protein, 825 aa, Streptomyces avermitilis
VGNAGGTDQRPATRPFRRPGETMRWPIGRPTTVRARIVALALAPVIALMALWSFAMVSVTGELRALVRVQGVYEDFGTPVDTAIGQIQIERRLSAGYLGADHRTARAPDLMEQQHRTDLALTALRDAVRDGDRGRLSDRQRHALDAMLDSTGRLEKLRDRVLSRDITWDRAVAEYSGLVEPGFDVQSTLTALQAGQLAREAQVVIELVRVREFVSREDALVAGARAAGTLTDRQYDALTATIEDRRVFERTYVPDLPSDSRALFEEFQRGAVHRALTRGEDALLRAGADRAGEAVAADSWRTTTDRAVKRYMRLCTRSAVNSADRGRAFAYRELAKAAVVGVLGLAAVGLSLWFAVRGARRISRRLELLRDAADLLTNHQLPDVMTRLSAGEDVDAVAEAPPLADGELRPDEIGQVGRSFNTARLAAVEAAVKQAGLRRGLFAVLLNIARRNQALVHRQLKLVDTLERRTDDPDVLEELFRIDHLTTRMRRHAESLIILSGAAPGRRWRRPVPVADVVASAVGEIEDYARVVVPPMPEVGVAADAVADVVHLIAELAENATVFSPPHTRVTMRCGRAQGGFVLEIDDRGLGLGPDQIEEAHRTLTGPDDFDPTQHDRLGFYVVGRLAARHGIEVTLCRSPYGGTTAVVLLPEAVLATVEPAAADAEPRAARREPASRSGTAPAAREQASDGPREPASERPREPASQRPPEQALDRPREQALDRPREVSVERDREWLRRRTADTGPDPGAPALPTRTRQSSLAPGLRTEGPAADETPERAVTPEEVRAVFGAFQRGLDRGRKGIPAQAGPQERTDTEEGTDPDDAP

SEQ ID NO: 14418 - protein, 179 aa, Streptomyces avermitilis
MHREQAPEHRDRTSEHRDRTPERRDRTPEPPGRASGPAAPAPASEPPGTDLGWLLEDLVARTDHVRQAVLLTADGLPLSASDGMRARDIEHLAAVCSGFHSLARSAGERFAAGDVRQTMVMLDDAYLFITPAGDGSRLAVLSEVQTDVGQLAHEMALLVRRVGRHMDAAVRSAVHSAGS

SEQ ID NO: 14419 - protein, 125 aa, Streptomyces avermitilis
VTDDHWYEDETGPMVRPYTVTRGRTRPSDRHTIDLMSQVTALETDQGRPGVDHARASLLDLVRRGPRPVVELAADADLPLTVVRVLLGDLAEAGLLRIDAPRRMVPGGTVDPELLREIVERLREL

SEQ ID NO: 14420 - protein, 262 aa, Streptomyces avermitilis
MRTALLQSSGRPGSIAENLKVLDEAAGRAAAAGAGLVVAPEMFLTGYAIGDDVPRLAEPADGDSADAVAETASRHGVAIAYGYPERAGEQVFNSAQLISADGTRLANYRKTHLFGCFERDHFTPGDQPVVQTELNGLRVGLMICYDVEFPENVRAHALAGTDLLVVPTAQMHPFQFVAQSVIPVRAFENQMYVAYVNRVGQEGEFEFVGLSTLAGPDGVARARAGHGEELVFADADPAALAASREANPYLKDRRPDLYGSLV

SEQ ID NO: 14421 - protein, 565 aa, Streptomyces avermitilis
MTSTVPNAVQHADAQQPPITMFGPDFPYAYDDFLAHPAGLGQIPATEHGTEVAVIGGGLSGIVAAYELMKMGLKPVVYEADQIGGRLRTVGFDGCDPALSAEMGAMRFPPSSTALQHYIDLVGLETRPFPNPLAETTPSTVVDLKGESHYATTVDDLPQVYRDVMNAWNACLEEGADFSDMNRAMRERDVPRIREIWAKLVEKLDNQTFYGFLCESESFKSFRHREIFGQVGFGTGGWDTDFPNSILEILRVVYTEADDHHRGIVGGSQQLPLRLWEREPEKIVHWPYGTSLKSLHVNGEPRPAVTRLNRTSGNRITVTDANGDIRTYRSAIFTAQSWMLLSKIACDDSLFPIDHWTAIERTHYMESSKLFVPVDRPFWLDKDEQTGRDVMSMTLTDCMTRGTYLLDDGPDKPAVICLSYTWCDDSLKWLPLSASERMEVMLKSLGEIYPNVDIRKHIIGNPVTVSWENEPYFMGAFKANLPGHYRYQRRLFTHFVQDRLPEDKRGIFLAGDDISWTAGWAEGAVQTALNAVWGVMHQLGGTTDATNPGPGDVYDEIAPVELPED

SEQ ID NO: 14422 - protein, 309 aa, Streptomyces avermitilis
MATKLGLGLPQNKQYDLGRDVPDVARTAEEIGYESLWVYERLLVPDPATQGLYGIEGLPWPDGYRGVAEPLVTLTLAAAATERVRLGSSVLVAPLHVPFQLAKALATLDAASGGRVIAGFGTGWSHDEYAAASVRPFEERGAGLDELIGVCRAVWGPDPVSYDGRVTKIAPAVVGPKPARPIPILLAAGSGKAQRRLVDHADGWLPVGMGAEALAAQWRGLRELAAERGRTEPIRTVLRTNAQYLAKGHAGAGRSPFEGSADQIVEDLAAHAEVGLDEILVDLQSGTRDAQELKEVAAEVYEKARAAGI

SEQ ID NO: 14423 - protein, 224 aa, Streptomyces avermitilis
MVRSEQFTTPVDTVVSRMRALCEVLPERDGVAVFNRVYLAVTEEFDRRLDAGGFPDPQAAITLDVRFAERYLTVAEDGPGPACWRPLLQFRRHPGVRPLQFALSGINAHIGHDLALAVVDACRTLGCEPADLEDEFERVGDLLITLEERIREDLMPGPDLLQIADPLTHLLGSWSLERARDAAWSAARALWALRRLPDLAGEFTERLDAAVGCAGRMLLTPLPD

SEQ ID NO: 14424 - protein, 370 aa, Streptomyces avermitilis
MVAVASFVVAVGTATGMMSAFDDGRTPDQARPQVTGPPSRRPLPAVPSPSPATTSARPSPATPSAGPGPKSSPSKREPTTAAAPAQLYRHPESQVLDWVGAHPDDARRAVIESRIADRPAAVWFADFAPSTITARVRAVTAAAAAQDRVPVVVPYTIPDRDCGGASQGGAPDLAAYDAWIDKFAAGLGSGEVIVILEPDSVAQSDCLSEGRQADRFASLARAGRVLKAANPGVRVYFDGGHSEWNPAAKQASLLDQAGAASPAASDGIFTNVSNFHRTSDEIAYARQVLAGLGGPASLGAVIDTSRNGNGAPAGGEWCDPAGRKIGRAPTLTTGEAGIDAYLWVKLPGESDGCKGTPGTFSPAYAYELAR

SEQ ID NO: 14425 - protein, 479 aa, Streptomyces avermitilis
MDLGVRWKLHGDGRTPAPGAVVRPDERLSWPRTVGLGAQHVVAMFGASFVAPVLMGLDPNLAIMMSGVATVIFLLATRGRVPSYLGCSLSFVGVAAVIRAQGGTSATVTGAVFVVGVALFLVGLAVQRFGARIIHAAMPPIVTGAVVMLIGFNLAPVTASTYWPQDQWTALLVMAFTGLAVVCLRGFWSRIAIFLGLVFGYGISWASDRIFGKIHSVDASGKLTDHWRLDLSGVGKADWIGLPSFHGPSFQWSAILVALPVVIALVAENAGHVKAVGEMTGDPLDDKLGTAISADGVASMLSTAVGGPPNTTYSENIGVMAATRVYSTAAYWAAAGFALLFGLSPKFGAVVAAIPGGVLGGITVILYGMIGLLGAQIWLNARVDLRNPLNLVPAAAGIIIGVGGVSLKFTDNFSLSGIALGTLVVIIGYHGLRAMAPAHLKTQEPLLDSGTSSYDEAEGDKAGVSEAGDDKAEDQRASS

SEQ ID NO: 14426 - protein, 421 aa, Streptomyces avermitilis
MSARPRLAVLLAAAATLAAVVVPSASAHTPPKAPRTAVLDGTRLQQTRLRLDRGDPRLRRTLEDLTARADNWLNQGPWTVVDKPKPAPGGDVHDYLSQAPYWWPSQPKSADNPWGCPYVQRDGQRNPEVDTGTDRQDVEKVFDSAYDLSLAWYYTGRKQYAEKAATVLRTWFLAPATRMNPHLNHGQFIPCKYDGRAIGIIDFSQSYTSVLDALAILDTGAPGWSRADRTAMRAWNVDYRDWLVNSAFGAEEGAAKNNHGTFYDMQLAALAYATGDTDLARRTVLGARAGRIAPQIAADGSQPQELTRTRSWHYSTFDLVAYTRLAAIGRHVGVDLWAYEGPDGQSLFKAVDYLLPAATGAAPWPHPELEFHRFAASDVVHAAADAGDRAARAAVPKLEAPPGGDLWALRPAAEQLDSIAG

SEQ ID NO: 14427 - protein, 156 aa, Streptomyces avermitilis
VTAEAAEAPTAPAPSYGRLIPVTVHFDDLDALGLLHNARYLVMAERAWTSLWNERGFGGFEGDWEAAGDFCNAVKEQRISYEAPVTRPGAYAVHLWLERLGNTGLTFGFRFCSADGALTYAHGTRVLVRLDAGTLRPAPWSEPFRVVGRELLRSAD

SEQ ID NO: 14428 - protein, 403 aa, Streptomyces avermitilis
MGEVVDDVRELKRARYAVAAVFAVHGAVTGSFATRVPWIQDHASIGAGQLGLALAFPAIGASVAMPLAGRISHRFGSRTALRGLISLWTLALVLPSLAPNLYTLCLALFTYGATAGMADVAMNALGVEVENRLDKSIMSGLHGMWSAGALVGSAAGTLAAHLGSDARMHHVLAAGVLTVLGLVACRWVLDLKPTEDEEPPPRFALPPRSALLIGAVGFCAVFAEGASLDWSAVYLRDRLDSSAGLAAASTTAFTLTMAVARIAGDAVVDRFGAVRTVRVGGVLATLGGLLVVSAWHPAVAMVGFALMGLGIAVVVPLAFAAAGRSGPNPSQAIAGVATITYTSGLVAPSAIGTLAQATSLMVSFGLVTVLACGLVVFAGVLRAGDRSRPTVSPPSAAAPAPRP

SEQ ID NO: 14429 - protein, 395 aa, Streptomyces avermitilis
MPASPSTARAINDRLALRLLQQEGPLTAGQLKQLTGLSRPTVADLVERLTAAGLIAVVGESGEQRRGPNARLYGIVADRAHLAALDVRTEGVSVVVSDLLGAELARASVPIADDTGTGPAVEQAVALVERAAKEAGAERLHTVGIGAPGLIDPATGELRDSSGLPEWHRRLVAALQERLPARVTVENETNLAALAEQREGAARDRDTFVLLWLGHGTGAAVVLDGRLRRGASGGTGEIGFLPVPGTGALPSATDCEGGFHSLAGSAAIARLAREHGLVAAGPAHEPQAAALVRAAAATPSSPRSARFLDVLADRLAIGAAAVVAVLDPGCVVLAGEVGQAGGDVLAARVEERLVRMSPLPAEVRASTLGGDAVLRGALLTARDGAQDELFGPSPR

SEQ ID NO: 14430 - protein, 202 aa, Streptomyces avermitilis
VFTGIVEELGEVTAVENLGDASRFRLRGPVVTENAQHGDSIAVNGVCLTVVEHEGDEFTADVMAETLDRSSLGALAVGSRVNLERPMAVGARLGGHIVQGHVDGTGAVIERRPSENWEIVKVSLPADLSRYVVEKGSITVDGISLTVVDAGPDYFTVSLIPTTLALTTLGRKQPGDPVNLEVDVVAKYVERLLGDRTRETAK

SEQ ID NO: 14431 - protein, 214 aa, Streptomyces avermitilis
VNWLNSEAFTVLDQHIIWSDMIGNTVGLIALALGWLRNIGTWPAQLLSGAVLVAANLSVHQGGGVGKQLVVIVVALYGWYAWTRGRQQAQDGTIAVRFATWRERAYLVGGAAIGTLAVGGLFTAYPSLSWSPWADAYIFVGTLAAMYAQARGMVEFWFAWLLVDLVGVPLNFRSGLAFSGLIYIVYGALVLWGMRDWWLRSRKAGQPVLEGAPA

SEQ ID NO: 14432 - protein, 429 aa, Streptomyces avermitilis
MTTAPILYSTDNIEDFALDPVERAIADIAAGRPVVVVDDEDRENEGDLVIAAEKATPEIVAFMMSECRGLICAPMEGGELDRLQLPQMVDHNTESMRTAFTVSVDASGAHGVTTGISAADRATTLRLLAQGEAGAADFVRPGHIFPLRAKPGGVLVRNGHTEAAVDLARLAGLRPAGAIVEIAGEDGHMLRLPELIPFARKHGLTIISIEDLIAYRQSSEPTVRREAEVHLPTAFGEFTAYGYRSTVDGVEHVALVHGEIGDGEGVLVRVHSECLTGDVFHSLRCDCGPQLEASLERIRSEGRGVVVYLRGHEGRGIGLVSKLRAYELQERGRDTLDANLELGLPADARDYAAGAQILEDLGVRSLRLMTNNPDKTDALLRHGLKVTGREPMPVQAGEHNLRYLTTKRDRMGHDLPWLDTVPVSTCGNQ

SEQ ID NO: 14433 - protein, 161 aa, Streptomyces avermitilis
VSGKGAPELSVRNCGDLRVAVIAAQWHEKVMDGLVDGALRALHELGIDEPTLLRVPGSFELPVVAKVLAGRGYDAIVALGVVIRGGTPHFDFVCQGVTQGLTQVSVDTGVPVGFGVLTCDTEEQALDRAGIEGSHEDKGHEAVTAAVATAATLRSVSEPWR

SEQ ID NO: 14434 - protein, 90 aa, Streptomyces avermitilis
MSKKTFEELFTELQHKAANGDPSTSRTAELVGKGVHAIGKKVVEEAAEVWMAAEYEGKDAAAEEISQLLYHVQVMMVARGISLDDVYAHL

SEQ ID NO: 14435 - protein, 285 aa, Streptomyces avermitilis
MLRIAVPNKGSLSGPAAEMLHEAGYQQRRESKELRIVDPENEVEFFYLRPRDIAIYVSSGRLDIGLTGRDLLIDSGANAEEILPLGFARSTFRFAGKPGTAKGIEDLAGLTVATSYEGIVAKHLADSGIDASVVHLDGAVETAIELGVAEVIADVVETGTSLRNAGLEVFGEPIMKSEAVVIRRVGAGTDEAAESKVQQFLRRLQGVLVARTYVMMDYDCRAEHLEKAVALTPGLESPTISPLHNEGWVAVRAMVPAKEAQRIMDDLYALGARAILTTAIHACRL

SEQ ID NO: 14436 - protein, 154 aa, Streptomyces avermitilis
MPDLSALPALPVTFRPGRTRAVLLTAGVTIFVVLTTVVMLLETLTPAERLSFVFTAALLCGVLVLLSRPKVVADESGVTVVNITSRRHLAWAEILQVNLRPGDPWVFLDLSDGTSLPALGIQPGIAKQRAIADARTLRALAEARSARDPEEHQG

SEQ ID NO: 14437 - protein, 473 aa, Streptomyces avermitilis
MTDSLLLLGAAFLLILANGFFVAAEFGLVTVERPEAEKAAAEGDRRAGTVVESLKELSFQLSGTQLGITITSLVVGMLAEPALADLLHGPFTAIGLPEGAVPGIAVVVGMLLASAVQMVIGELVPKNWAISKPLQVARFVAGPQHVFSRLFRPVIAALNTVANRLVRALGVEPAEEMASARTPGELVSLARHSAQAGALEQDTADLFVRTLSLGELTAQHVMTPRVRVSALQSSATAEDVVNLTRATGLSRFPVYRDRIDEIVGMVHLKDALAIPSRDRLRTPVGRIAQPPLLVPETLPVQPLLARLRSEQPIAVVVDEYGGTAGVVTLEDIVEELVGEVRDEHDGQDLPELAVAPPEDGRPAWDADGSCRVDILQRIGLDVPEGPYETVAGLVADLLGRIPAPGDRAELPGWRLSVRQVGHYRAERVRLVKTADTTDTTDTTGIADIADASVTAGAGTRDTAASAPAAEAVR

SEQ ID NO: 14438 - protein, 364 aa, Streptomyces avermitilis
MTLLQLLLAALLVLANGFFVGAEFALVSVRRSQIEPLGTARARQVLYGLERLPQMMAAAQFGITICSLTLGAVAEPTVAHLLEPGFEAARLPDGMIHPLGYVIALALVVFFHLVIGEMVPKNLAMAAPERTALWLSPGLVAFARLCRPVTVALSACARVILMLFRVEPKDEVEAVFTSEQLNQLVEDSGQAGLLDPEEQERLEDALELGSRPVTDVLLDRDSLVTVGPSVTPGEVVALTARTGYSRFPVAAETGAFMGYLHVKDVLDLEESERAVPQQIWRPMTTLGAELPLDDALTVMRRAATHLAQVADGSGRVLGLVTMEDVLELLVGEVRDPAHRDAQPPSRVTEQRAETPGEALASQLR

SEQ ID NO: 14439 - protein, 620 aa, Streptomyces avermitilis
MDFGTRGPEAPADLAWLRGVDAYTMGAYPQAEEEFRTAVRMDPGMADGWLGLHALRVDTTTALLRMFRHRDRFGEQRTRHRRTLNSWYWLGWWVQPVLESPRDLLLAHASHWLDGRHVPDLDRALASLPPVDTDPQVRFLHACRAYLVKDWEQLVRHTDPLIDDAMLGIEAGLFGGMARVRLEMFGQAEPLLSAALMRCRSEQPQRKELRYWLARAHEGTGRSAAALPLYRAVHRVDPAFMDTSARLAAISDGDGYDEAVDLAAITLTGIGQDLIDGPDGVDPLFGGEGRELKLSEPEPAPPGALPQEADAVREKTVVPVQPLPAGPTDPELLEEALAELERMVGLEPVKRQVKALSAQLNMARLRAGQGLPVQPPKRHFVFSGPSGTGKTTVARILGRVFYALGLLGGDHLVEAQRADLVGEYLGQTAVKANELIDSAIGGVLFVDEAYALSNSGYGKGDAYGDEALQVLLKRAEDNRDHLVVILAGYPEGMDRLLAANPGLSSRFTTRVDFPSYRPLELTSIGEVLAAENGDVWDEEALDELRSISGHVIDQGWIDELGNGRFLRTLYEKSCAYRDLRLTGYPRTPSRDDLSTLRLPDLMQAYGEVLSGRGPQDPSAL

SEQ ID NO: 14440 - protein, 217 aa, Streptomyces avermitilis
MPTPRRPRGTTIHDLASRLRRLPPSCGPVRLVGVDGHAGSGKSTFAGRLAAALDGAPVLHLDDIATHEELFAWTDRLLREVVAPLGRGEPAHYRPYNWHTRDFDPARALPPAPVVLVEGVGAGRRALRPYLARLLWMELPHEASWTRGRERDGEAQREFWAGWVEAERRHFAGDPSRPFADLLVQQCPEGYEVLPGPAGTPGPDQDLTHSEGPSAMC

SEQ ID NO: 14441 - protein, 332 aa, Streptomyces avermitilis
VRNGVASDGDGQGSMAAGLFEGQYVWHPAADDRTLASVCVDVRAGRYRSAREALADTRDDFGLRAHRSLVLASEAADSDLAERWLAEEPTPEAALLWARVAVLRTLRAAAAHDERAEALERIALTACERASTAAPHDPTPWVAKLTMARLHDIREPAPQGLLTAPAGPWRLFSHVLRLDPWNREAHHRFLACFFTRYGGSVNAAWDVAAFLGQRAPATSPLRLLPLVALVESYNPAQLLADRVWEQPQWRATALAIYQNWLPETAGYRFTPVLDLAYLAHALLMAQREFEARAVFMAMGPYASRMPWSVFGDPEEQLSRARRSCGLPVPGAA

SEQ ID NO: 14442 - protein, 516 aa, Streptomyces avermitilis
VSERISAPGTSHARGRAGADPGALDDDATLHAMGYPRKLTRRFQAFDNFAISFTIINIISGIFSSFGFGMNAGGPRILVFGWIGVSVMVLFIGAAMAEVASAYPTSGALYFSAGKLAKRHKGAWSWYTGWLNFVGQVGGTAATGYAAATFIQAFIALQWSSYEPTAHQTVLITALIIALQGLANTYTVQLVAVLNRISVWWLLIGLVVIVSTLTVMPDDHQSASFVTHFANNTGFTNGIYGGMLGLLVTSWTFTGFDGSFHMSEETVRATVNAPKGITRAIGYSAITGLILMLALVYSIHDYDQVAGSSAPPVQILIDGLGMGTAKVLLLIVIGAMLFCGLANLTSNTRQIFAFSRDGAMPGSRWWHTVSPRTRTPVKAVWLAVGCSLALVLPGWWSHTAFTAIVSVNVVGLFLAYAVPIFLRLRLGDEFRAGPWNLGRWSRPVGILAVTWILLSSVLFMLPQASPITVDSFNYAPIALAVVLVVATVWWFATARRRFQGPVSYGRPDEVAAMDLV

SEQ ID NO: 14443 - protein, 450 aa, Streptomyces avermitilis
MTRASEPSRRTVIAAAVAVAAVGAAGPAAAAPTARPTKASPNLVDNRAWTSYSDWRGGTAKGTRAVAGARPGLAIATPAGRTDYTDPHTGRTATWEYATWTSPVHRLAVPSTEVIASWNAHTPAGTWLQVELTGTYSDGTATPWYVMGRWAAGDQDIRRTSVDGQSDGKSSIWTDTFAIDDTASGLRLVSYRLRLTLYRTPGGGITPTVWRLGAMGSDIPDRFTVPASAPGLAQELRVPRYSQEIHAGQYPEYDNGGEAWCSPTSSQMIIEYWGRRPTPGQLAWVDPSYADPQVCHAARFTYDYQYAGCGNWPFNAAYAATYKDLQGVVTRLGSLGDLETLIAAGIPVITSQSFLKTELTGAGYGTSGHLMTVIGFTADGDVIANDPASPGDDAVRRVYQRREFENIWLRTKRYNASGKVVSGTGGVCYLYFPAHPSARRRKALAAVGVR

SEQ ID NO: 14444 - protein, 46 aa, Streptomyces avermitilis
MTATSATAPRVRTGGPKEDGPKILEHVMGWTLVVVLAMLVTQLGLL

SEQ ID NO: 14445 - protein, 219 aa, Streptomyces avermitilis
LNNSQQRGVVRPGARGTDRSAARRAELIAIGRKLFADTSYDALSMDDIARQAHVAKGLIYYYFKSKRGYYLAIIEDSVTGLVTRAAEGLELPPDQRVHRTIDGYLRYAEHNQAAYRAIISGGVGFDAEVQAIRDGVRQAMVDAIAEGAYGRHEIAPLARMGLLGWLCSVEGATLDWTGRPELPRDIMRKLLVKMLGGTLRAIEELDPAYPAPPAARRDT

SEQ ID NO: 14446 - protein, 427 aa, Streptomyces avermitilis
MLSPHRPRVLPQTRKPVRTGGASLRALLSAACCAVLGAGLLAGAGTATATEAQAPARAAAAGSKVVGYFTEWGTYDRKYYVKNIETSGSGAKLTHINYAFGNVTGGKCAMGDAYAATDRAYTAAESVDGVADTWDQPLRGNFNQLRKLKKLHPNLKVLWSFGGWTWSSGFGEAAKNPAAFAQSCYDLVENSKWADVFDGIDIDWEYPNACGNTCDTSGKAAYKNLMGALRSKFGSGNLVTSAITADATSGGKIDAADYAGAAQYVDWYNPMTYDFFGAWDATGPTAPHSPLNSYSGIPKAGYHTSATIAKLRGLGVPASKLLLGIGFYGRGWTGVTQAAPGGSATGPAAGTYEQGIDDYKVLKTKCPATGTVGGTAYAKCGSNWWSYDTPSTIAGKMTYKNAQGLGGTFFWELSGDTSNGELIKAIN

SEQ ID NO: 14447 - protein, 390 aa, Streptomyces avermitilis
MPDRAPQPVDRQLPTDEARDLISLVRDIAQREIAPEAAEGEDAGHFPREVFGLLSESGLLGLPYDSEYGGGDQPYEVYLQALEELAAARLTVGLGVSVHTLACHALAQYGTKEQQVEHLPAMLGGGLLGAYCLSEPSSGSDAASLRTKAVRDGDDWVITGTKAWITHGGIADFYTVMARTGGEGARGITAFLVPGDAEGLHAALPEKKMGMKGSPTAQVHFDGVRVSDERRIGDEGQGFAIALSALDSGRLGIAACAVGVAQAALDEAVAYATGRQQFGRPIADFQGLRFMLADMATQIEAGRALYLAAARLRDAGRPFSKQAAMAKLLCTDAAMKVTTDAVQVLGGYGYTADFPVERYMREAKVLQIVEGTNQIQRMVIARHVAGPDSR

SEQ ID NO: 14448 - protein, 142 aa, Streptomyces avermitilis
MQSLKRPGRTAPKRQQLVIEPEPEGVEPGEDEFDAYDTFEMYRVVCPDCAQPIALLADEEVLPEHALCATPWNPFGLTVCAGTGRQAADARPADESVEPQEQDTALLLTLPQGLDWRTQPFSHVGGPGSRPMRVPDMRREAA

SEQ ID NO: 14449 - protein, 165 aa, Streptomyces avermitilis
MTCAAQVSEEIRRTVGSCAMEELDRQIVQLLVADGRMSYTDLGKATGLSTSAVHQRVRRLEQRGVIRGYAAVVDSEAVGLPLTAFISVKPFDPSAPDDIAERLAGVPEIEACHSVAGDENYILKVRVSTPHELEELLARVRTLAGVSTRTTVVLSTPYEARPPRI

SEQ ID NO: 14450 - protein, 540 aa, Streptomyces avermitilis
MSESTAPSDTVLLRGGEVHSPADPFATAMVVERGQVAWVGSEGAADAFSAGVDEVVDLEGALVTPAFTDAHVHTTSTGLALTGLDLSGAPSLEAALALVRDFAAARPDDRVLLGHGWDTARWPGGRPPTRAELDEAADGRPLYLSRIDVHSAVVSTALLDLVPGITGRAGYLDGPLTRDAHHAVRGAALGAVSPAQRTEAQRAALAHAASLGIGSVHECAGPEISSEDDFTGLLRLAAEETGPRVVGYWAEWGEEGIDRARALGAVGAAGDLFVDGALGSHTACLHQPYSDAGHTGTAYLDDDAVAAHVIACTEAGLQAGFHAIGDAAVTSVVEGVRAAAEKVGLARVRAARHRVEHAEMLTPETIAAFAELGLTASVQPAFDALWGGADGMYAQRLGAERARTLNPFAALLRAGVPLAFGSDSPVTPLDPWGTVRAAAFHRTPEHRVSVRAAFTAHTRGGWRAIGRDDAGVLVPGAPADYAVWRTEELVVQAPDDRVARWSTDPRSGTPGLPDLTPGGDLPVCLRTVVGGRTVFVRPNE

SEQ ID NO: 14451 - protein, 265 aa, Streptomyces avermitilis
VNDGDETLTAGAQGRQFGPLGTALVIIPTYNEAENIKSIVGRVRASVPEAHVLVADDNSPDGTGKLADELAVEDDQVHVLHRKGKEGLGAAYLAGFRWGLDNGYGVLVEMDADGSHRPEELPRLLTALKGADLVLGSRWVPGGRVVNWPKSREFISRGGSLYSRLALDLPQRDITGGYRAFRRETLEGLGLDEVASQGYCFQVDLARRTVKAGYHVVEVPITFVEREFGDSKMSRDILVEALWRVTTWGVGERVGRITGRGPKSS

SEQ ID NO: 14452 - protein, 190 aa, Streptomyces avermitilis
MTTGAPTPTYPARPRRSRLRTFLPLGVAAWLVLEIWLLTLVAGAAGGFTVFLLLVAGFVLGSVVIKRAGRRAFRNLSETLQQQQSDAPVTRGRSDGNGLMMLGGLLLMLPGLISDALGLLLLIPPVQKAVSRYAERTFDRKIREATPGTLGDAFQQVRIHRPDGKVVQGEVIRQDGPQDPEPGPRPPLNR

SEQ ID NO: 14453 - protein, 124 aa, Streptomyces avermitilis
MSERALRGTRLVVTSYETDRGIDLAPRQAVEYACEKGHRFEMPFSVEAEIPPEWECKVCGAQALLVDGDGPEEKKAKPARTHWDMLMERRTREELEEVLEERLAVLRSGAMNIAVHPRDSRKSA

SEQ ID NO: 14454 - protein, 448 aa, Streptomyces avermitilis
VGTDTAQARPTDEAAERRREQRGWYFYDWACSVYSTSVLTVFLGPYLTSVAKSAADADGYVHPLGVPVRAGSFFAYSVSLSVIVAVVVMPLVGAAADRTGRKKPLLAVTAYVGAAATAGMFFLDGDRYLLGGVLLLVANAAQAVSMMLYNSYLPQIAPPEERDAVSSRGWAFGYAAGALVLIANLVLFLAHDSFGVSESTAVRICLASAGLWWGAFTLIPLKRLRDRGSPVKEITAPGPRRLAATVRDMRRHPLTLSFLLAYLIYNDGIQTVISQASVYGSEELGLSQSTLIVAVLLVQVLAVGGALGMGRLARTYGARRTILGSLVAWTVTLGAGYFLPAGAPFWFFVLASGIGLVLGGSQALSRSLFSHLVPAGKEAEYFSAYEMSDRGMSWLGPLLFGLTYQLTGSYRDAIISLVAFFVVGFVLLARVPVRQAVRDAGNSVPERI

SEQ ID NO: 14455 - protein, 255 aa, Streptomyces avermitilis
VTAHIRHPYLDHPGPIAFAHRGGAADGLENTMVQFRRAVAAGYRYIETDVHTTSDGKLVAFHDSTLDRVTDGAGRIADLPWADVRHARVAGSEPVPLFEELLETFPGVRWNVDVKAEPALRPLLDLIERTDAWDRVCVGSFSEARVVRAQRLAGPRLATSYGIRGVLSLRLRSWGIPAALRRSAIAAQVPMSQSGVPVADHRFVRAAHARGLQVHVWTVNDPHQMHQLLDLGVDGIMTDHIDTLRKVLEDRGTWI

SEQ ID NO: 14456 - protein, 499 aa, Streptomyces avermitilis
MAQWTSAVGAAQLARLLNSQQERPAGPGTRRPPAYRALADGIRLLVLEGRVPVAARLPAERELALSLSVSRTTVAAAYEALRAEGFLESRRGAGSWTAVPAGNPLPARGLEPLPPESLGSMIDLGTAALPAPEPWLTRAVQGALEELPPYAHTHGDYPAGLPALRSMLADRYTARGIPTMPEQIMVTTGAMGAMDAICHLFAGRGERIAVESPSYANILQLMREAGARLVPVAMAEGLMGWDMDRWRQVLRDAAPRLAYVVADFHNPTGALADEDQRRRLVDAARSAGTVLVVDETMTELHLDDGVEMPRPVCGFDPGGSTVITVGSASKAFWAGMRIGWVRAAPDVIRSLVSARAYADLGTPVVEQLAVNWLLSTGGWEQAVEVRRAQARENRDALVAAVRRELPSWEFSVPQGGLTLWVRTGGLSGSRLAEAGERVGVRVPSGPRFGVDGAFEGYVRLPFTVGGAVAEEAAARLAAAARLVETGASGAGESPRTFVA

SEQ ID NO: 14457 - protein, 255 aa, Streptomyces avermitilis
MVASPPSRNWPWMASLSKPQSDTGQSTTTTGGHVLSGVLSTQNRRGRRLIQLYVGLALYGASSALLVESGLGLEPWNVLHQGLAELTGLTIGVVSIIVGAAVLLLWIPLRQRPGLGTVSNVFVVGIAMDGTLALLPGAHTLSVRIPLLAAGIVLNGVATGLYIAAGFGPGPRDGLMTGLHRRTGRSIRLVRTVIEVAVVATGFALGGTVGAGTVLYAVAIGPLAQLFLRLFAPSGASGGSTVVAEGPPPRAILRR

SEQ ID NO: 14458 - protein, 555 aa, Streptomyces avermitilis
VARRPLPRILSNGSAQLARSRELARTAADSATDVLHPLITITRGLRRLAAAGRRRWADTPKDRRGPLLFLLSSVILVVALAPYGPLLAAVALMAAAAWMGRDPGAKRPAGPDESQTKRLRSLYEALVPYFSTAEDPAPLYAHGGEWEEAFPAYDFDGTGRISRLLIRYPAYFTDGEAESRARIEQLLHAKSGRGREYHFTWDEEGNELTVTVLGPLPTDIAAQRFVTAPGETVLGFTDPTGVQRTLPLTYGEEQRDVPPVVWRTGVRSTEPHLLVVGEPGSGTTTLVRSIALQALQHGDVVIVEGGGTGEYACLTGRDGVLAVECGPAGAVASLEWATHETERRLIAANRARQEGYPAPEDIKRPLWLLLDRPSALGHLAAAEGRKDPQSLLQVPLRHGRAANVTVVVAEQFDGLDGLSEAVRQHTRARVVLGPATPDRLAEILGAPPHTTPAKDVPPGRGYARLGGGPVHRLQVPATPDPYDDATSETHRRAVLDLLPGRSTPADAAEPVPTVTVAAKTVPAEAVTAEAVVPETVATKAVVTEAVAAEAVPAEG

SEQ ID NO: 14459 - protein, 64 aa, Streptomyces avermitilis
MILSMSGVVLLGIVVFLFFRKDGLKGTHACTCALFGFYLSSTAIAPSIKAGGASLASLLGGIRF

SEQ ID NO: 14460 - protein, 134 aa, Streptomyces avermitilis
VVRPMSEAPDPEVVELATKIFDLARRGETEPLVAYVDAGVPANLTNDRGDTLVMLAAYHGHAEAVRALLERGAEADRVNDRGQTPLAGAVFKGEEAVIRVLLDGGADPAAGTPSAVDTARMFGKANLLELFGAR

SEQ ID NO: 14461 - protein, 472 aa, Streptomyces avermitilis
MFDPVIAPSGTLLGLLQRGRGDGTLHALTAPRAEALAALNHCVLRDPRHDWQVENRSLYYARLYLDLSGELDEIERHLFDAEDVLDTDESRTGLALAVLGHLASYGRLDALALLRRYAAVGTNWAWALDELALRDDDAGLRALAAPVLARFPVDAEGEAELAAAVRDAFEPRPWRLWAEDPRESIGTRVRGAQETGSFDRWQRQMRPAGPRPGWSVQAVFDWAQQGLERGALLHVPAARCLTAVAGPEDRPEIVEAARSGGDGARCTALRYLTDGNDPDALDLVEGAVATGSAVVVEAALDAFERMCSVAAVDRARGWAHRPDPLGAAAGRMLACRGGAQDSELVLGALREAVRGEGPDAPTLWTLVDGTGRLGIACAAPVLRHIYRETASSHLRGRAARALAATDPSFAAGFAVECLWDCEEFTREVAARHAETGDARVVDQLRRLAADPAEEAEVQTAVRSRIGPDMPAV

SEQ ID NO: 14462 - protein, 387 aa, Streptomyces avermitilis
MRVVIVTESFPPDVNGVAHCALQTARHLVERGHAPLVVAPASPKSPTSLGQGGAPFAGQGPDALAPCRVIRVPSLPLPGYPQVRVALPSRRVAAAITEHRADIVHLAGPFVLGVRGMAAAARLGIPAVAVYQTDLAGYARTYMGAGEATAWRRIRSVHAAADRTLAPSTAALHDLEAHGVPRVRLWPRGVDTVRFRPEHRDESLRRELAPNGEPIVGYVGRLAPEKQVELLAGACGLRGVRVVVVGDGPSEVTLRGALPGAVFLGRRTGDELARIFASLDVFVHTGPFETFCQTVQEAMASGVPVVAPAAGGPLDLVAHGRTGLLVPPRDAGAVRDAVWSLAADPALRAAYGAAGRATVEGRTWAAVGDQLIGHYAEVLSARTAVAA

SEQ ID NO: 14463 - protein, 402 aa, Streptomyces avermitilis
MSPRSDEGGVHEPPRTGGPAGALRIVRLANFVAPASGGLRTALRELGKGFKEAGHEPVLIVPGERHTDRETGQGRVITLPGPLLPGTGGYRVLTDKRRVAALLAELAPDRLEVSDRTTLRWTGKWARRARVPAVMVSHETADGVLRTWGLSENVSRRAADALNTRTAHTYARVVCTTEFAEREFVRIGARNVVRAPLGVDLEQRRPALRDPGLRERHARVDETLLVMCSRLSVEKRPGTALDALEALVRRGRRAVLVVAGDGPLRARLEQRARERRLPVTFLGHVGDRALLGALQASADVCLAPGPAETFGLAALEAMACGTPVVASASSALSEVVGSAGVTAADHGDAFADAVASLLERPEYERRQTARARAECFGWKTAVDAFLAAHDAGAPAPAREGVR

SEQ ID NO: 14464 - protein, 284 aa, Streptomyces avermitilis
MRPPRFVALGDSLTEGVGDPVGDTWRGWAALLAAGLAPADAPAEFTNLAVSGAQTRDVLERQTPAGLTLRPDIVSVVIGVNDTLRCTFDIHAVAARLDQVYAAFRARDAVLVTACLPDPGAMFGLPGALARPLARRQRAVNTVVHALSERYGAVHLHAAEEEWLTDRALWSADRLHPGERGHRQLAVRFHALLAQEGLVTGTAPAAEPEFPAPTRSASLWWLATAGTGWVARRCTDLLPQLLTLAASEVRHRARGTSARLDLSASHAAASALAALSGTEQPDAA

SEQ ID NO: 14465 - protein, 289 aa, Streptomyces avermitilis
MTDRALAVVRAGALTTVQDLGRPGYAHLGVPRSGALDPPAAALVNRLVGNPPEAAVLETTLNGCALRPRSAVTVAVGGAPCAVTVGGRPAPWGAPVRVPGGTLLDIGPAQSGVRGYVAVSGGVAVEPVLGSRSTDLLSGLGPAPLTDGTVLPLGHPVGPHARVDAVPQPGPPAELVLRVTPGPRDDWFTATAVRTLVTRAYRVSTASNRIGLRTEGPALERSRTGELPSEGMVWGAVQVPPDGRPVVFLADHPTTGGYPVIAVVRPADLPAAAQAVPGTPVRFVAVRRR

SEQ ID NO: 14466 - protein, 205 aa, Streptomyces avermitilis
MRALPVGDRALLVELASGDEAQALHAELLRRRAAGTLTVREVVPAARTVLLDGLEEPSRLAAQLADWTVPPVPPRAEEAIEIPVRYDGPDLAEVAALWGVPEDEVARIHSAAEFRVAFCGFAPGFGYLTGLPARYDVARRATPRTSVPAGSVALAGPYTGVYPRASPGGWQLIGTTDRVLWDHARVPAALLAPGARVRFVAVGSV

SEQ ID NO: 14467 - protein, 250 aa, Streptomyces avermitilis
MIDLNADLGEGFGRWELTDDERLLSVVTSANVACGFHAGDAATMRRVCELAAERGVRIGAQVSYRDLAGFGRRAMDVPPAELAAEVAYQIGALEVFARAAGTRVSYVKPHGALYNRVVHDEGQAGAVVDGVRLADASLPVLGLPGSRLLEVAEKAGLPVVTEAFADRAYTEEGTLVPRGEDGAVVTDPDAVVERSVNLARLGVVDAHSGRRIPVRARSLCLHGDTPGAVELARRVRSRLEASGVRVAAFA

SEQ ID NO: 14468 - protein, 274 aa, Streptomyces avermitilis
VNRVTPDRPLSRIDGHAHAWTPRKARARFRWGVFGPTAGVAAGHTQANLISLPADWAYDMLLFCQRNPKPCPVLDVTDAGSWTTPLAEGADLRTDLPRYRVWENGELVAEPTDVVAYWRDDLVSFLIGCSFTFEWALSEAGVPMRHIEQGRNVSMYVTSRACRPAGRLHGPMVVSMRPVPPEHLAAAIRESTMLPAVHGSPVHCGDPSGLGIDDLGRPDFGDPVDAEPDDIPVFWACGVTPQAAVMASRPPFAITHAPGQMFLTDARDEQYRVA

SEQ ID NO: 14469 - protein, 439 aa, Streptomyces avermitilis
MSTTPPSPQLTAATAPGAGEPASEDGAFGFLRALGPRGRRAFAGAFGGYALDSYDYFTLPLSMVALAAYFGLDSGQTGLFTTVTLVVSAIGGAVAGVVADRIGRVKALMITVITYAVFTVACGFAPNYETLLVFRALQGLGFGGEWAVGAILVAEYASARHRGRTLGAIQSSWAVGWALAAVVYTLVFSFVGDDLAWRVMFWTGALPALLVVWVRRRVHDAPEAAVERQKSAHKGSFTAIFRPGTADAPGLLRITVFAGLLSTGVQGGYYTLATWVPTYLKTERGLSVVGTGGYLTFLISGAFIGYLTGGYLTDKLGRKRNILLFAVLSAICVLVYANIPSGADTLLLVLGFPLGFCMSAIFSGFGSFLSELYPTAVRGTGQGFTYNTGRAVGAVFPTLVGFLADSWGVGGALVFGAIGYALAALALLGLPETRGKELR

SEQ ID NO: 14470 - protein, 233 aa, Streptomyces avermitilis
MADQLTGLADDRALLGRTSTAERVSDILRGRIAEGYFPPGTRLSEDSIGGALGVSRNTLREAFRLLTHERLLVHELNRGVFVRVLTVEDVQDIYRTRSLVECAVVRGLGEPPYALEGLAEAVAEGQRTVREGDWKGLGTANIHFHRELVALAGSARTDELMRSVFAELRLAFHVVDDPRRLHEPYLARNRQILQALETGDRDKAEGLLAVYLDDSLERVVEVYRRRVGDDGQL

SEQ ID NO: 14471 - protein, 505 aa, Streptomyces avermitilis
VTSPASTDSVPPQLSAGPRPSPGPAADEGLARRLRALACTAPLHDLDARKANLAGEYAVYGMAEVALAAIDLVTLNMDFDTGADHDQIVARLIPRIAAQAPRRPVAEHERVARWVLENLINVGSVDRGFRAVYGTFAPDGSYVRRDYDFKLIEEVPGYGGSVYLRTTDEAVNVLVGALDTDVTSAQIAAEVKLEVLISRGRLADAQLAAEQARYRTVQYSETLRKALDATRRNVRAVDWLNSVPDMIAEALDHVADRYRHENAILTNIRKARDESEDPEQKRRAAELVDIVKDCIRRHTLLQSRLLEAGPLFRAEQDRQAFATPMTTSGIDLYGHLVAPVLPLPVEQALRVTDAFFARGTGLRTPASVRVGDLVDLLLTPPVEREHLGAEMPEPDLIATPDDSRFSEEQLAAAMELLDLPADAPRRLSGLLAEARRQDSELPYLVALLAVHAASPPVGTAYRQGEEKLLFAVDDGVELDDDEFGGADLIVGMAMLDAMGMAADRK

SEQ ID NO: 14472 - protein, 292 aa, Streptomyces avermitilis
VTEHVEWSEPEVAATPVNAAVTPADAADAARLVAFGLQPKLQPARDQEYTELLRRYREDPPFARLADAVATGLGLVVLEVSPRAGMAVTAAEDSVFAVRMGDYARRTAADSGDRFLHGLAHLAVAAMAFPRPEDLADDGYIGRVSVNGVDAFVRQACRRLEERAEEQGENTDPATDAPGLEAAWRIWARRSAAGATKDARRLAGSTTGIVGKAVVFLTDSGFLQRTGDDSGGTYRTTARYQLQVRDMAGSAALAELLELGIVPVTDGTASLLPPEDTDDLELVADAGLPFHS

SEQ ID NO: 14473 - protein, 1566 aa, Streptomyces avermitilis
MYELSRVRLYSIGPAGARYADTVLDLRGVGAPVPDPAPTQAEFFEDEPVGPPRRPAPAGVLFLENGGGKSVLLKLIFSVMLPGHRNTLGGASSGVLRKFLLADDCGHVALEWQHTLTGECVVVGKVSEWRGRQVSNDPRKFAEAWYSFRPGPGLSLDNLPVAEATSVRPQAEGVSGAQGRRRTMKGFRDALTDAGKAYPHLEVHWEEIHDRWNEHLGDLGLDPELFRYQREMNADEGEAAGLFAVKKDSDFTDLLLRAVTDTRDTDGLADLVGGFGNKLGRRAELMAERDFTAGSVDLLGRIVDAADARARARDIHAAAERRTRTLARRLSARGVRERVRAADLAQRVTAAAYAVTHAEGARERSALIAAELAYRHASLALAGAEKSAAAQKRELADARTLHSAWQAAEAVLRHRAAADRSARVAVAIREAERDAAPALAARAKAAVDLVRALHGAAESAENLANEEEERSAGLQDVGERAYRDSTSAATEAQRARSEAGHLRQRLSEVAQETAEAVRAGWLDDSAPDADPARAALAASDAEKTAVAAWDTAREASGRASEHAREAASTESRAELTAARAADAATAAERAYEAEFRTAESLAGEERLADLLSLPASSRQGAVPTPRREGTAGATADRQGGAHSAAEGFAAPRPGAPRPASEGPLTPEELDRFADELRELLDDSVGSAERQLFELQTGAADDSRILGALGDGGLLPPGPDVLSTVEYLGEHGIPALPGWRYLAQAVDPADHARVLAARPELVDGVIITDPDTHTRAREALSEAALLPRSAVAVGTAAALLAPTPAPEAGDSGVFLVPPNPAMHDEHAADEERQALRARAARRDEEIRALAARLGKDRELAARLSSWRTGCPAGRLVELATAARDARGFAEETEAELAEARTVRAEADEAAAEAAHVRDERQEAAQKARRAADALAGLAFRLRERAGWQVKLRELADEAAESEARAQTCLERARAADEDRRAAQRAADDARRTARALRAERAEIAGAPDDVPEDEPGAAKSSLPALREAYRAASQLYEKVGVGADLRAEQARAESDESAALTELNRLSNKVRTRAAQLLESPDGSDGPSRQAAAARVEELVQLLETRMSTASEQLGRLRGEAERHAPENGEAHTELSDELVPENAEHAQTLLRTATGELAARADALGQAREAHAELLDAHRAAEDAAGGFDETAALLRDLLREQQAEDEQEESEAYPGTLEEARHSAAEARRSLRGCAADLSAAEAAVREASDILVRHANSTRYEQVRTPARQQIRELPASALPEHAQKWADAFAPRLRVLTDELAQLERNRDSIVDRLRGLVESALATLRAAQRLSRLPEGLGEWSGQEFLRIRFEEPDQATLTERLGEVVDEATRAAVKKNSDLRRDGMSLLLRGVGAALEPKGVAVEILKPDAVLRAERVPVGQMGDVFSGGQLLTAAIALYCTMAALRSNDRGRDRHRHAGTLFLDNPIGRANATYLLELQRAVSDALGVQLLYTTGLFDTTALAEFPLVIRLRNDADLRAGLKYISVEEHLRPGLPREAPAGEAGYSEITATRMYKRPAPSAS

SEQ ID NO: 14474 - protein, 516 aa, Streptomyces avermitilis
MSIDEFDYVVVGGGTAGNVVAARLSENPSVTVCVLEAGPSDVGDDDVLRLDRWMGLLESGYDWDYPVEPQALGNSFMRHARAKVLGGCSSHNSCIAFWAPAEDLDDWAAAGCTGWSAAELFPLYRRLESNDAPGDHHGRTGPVKLRTLKGEDPCGTALLEACAQAGIPTTAFNTGKTVVRGANWFQINSDENNIRQSSSVAYLHPIIGKRPNLEVRTGVRAKKLVLDGRRCVGAEYLDPDLIHTRTVLARREVIVSCGSIDTPKLLMLSGIGPAEQLREVGVDVVVDSAGVGENLQDHPEGVIMWEARQPMTTTSSQWWEAGIFYDTEPGLDRPDLMFHYGSVPFDMNTARHGFPTSENAFCLTPNVTRAKSRGTVRLRTRDYRDKPRVDPRYFTHEHDVRVMTYGLKLARRIASQPALSGWAGAELSPGPDIRTDDELLDYIHKTHNTVYHPSCTVKMGADDDASAPLDARLRVKGVEGLRVADGSVMPELISVNPCITTMMIGEKCADLLKEDA

SEQ ID NO: 14475 - protein, 522 aa, Streptomyces avermitilis
MTTTEQPSGPQSHHDDTELAEFGYKPELKRTLGNFHTFAAGISYISILTGTFQLFYFGYGSGGPAYWWSWPMVFVGQFMVALCFAELAARYPVAGSVYNWSKKIGNPHLGWLAGWMMLIASIVSISAVALAYQLTLPQISSTFQFIGDGTGKYDVATNAVVLAAVLILFTTLVNAFGVKLMATINSAGVFIELVATVVLIVLFAVHITRGPQVVTETAGTGAGHTTGYLGAFLVASLASAYVMYGFDTAASLGEESLDPSRNAPRAIIRAIVASFVLGGLVLLLALMSVSSLKGDKLSTDGLQYIVLDVLGPTAGKAMLWCVLIAVTVCALAVHTAAIRLAFAMARDNNLPASSLIARVSPRFQTPVLPAVIIGVLAVAILVVNIRQPQIFTVVTSIGIIMIYLAYLGVTGPMLVARLRGKWQPAGDGRFSLGRWGLLVNIVAVLWGAAMTLNLIWPRSEVYNAAAPFHWYLRWGAVLFVAVIAGGGFAYYWFIQRHKTGVLAEHRLQTTAAPAPLAAPTAD

SEQ ID NO: 14476 - protein, 507 aa, Streptomyces avermitilis
VAARAAGRRPCLTRTTPQEAIVPDLFIDGEWRAALDGRTREIRCPADGSLVGVVDEAGGKDTAEAIAAARRAFDEGPWPWLPAADRGDLLLRVADLLVRDRAKLARAESLDTGKRFVESEYDIDDIVNCFRYFGRLAAAESGRVIDTGSASTDSRVVYEPVGVCALITPWNYPLLQTAWKVAPALAAGNTFVLKPSELTPHTAIHLMRLLQEAELPPGVANLVLGAGPEAGAPLADHPDVDLVSFTGGLHTGRRLMAAAAGTVKKVALELGGKNPNIVFADADFDTAVDMALTAVFLHSGQVCSAGARLLVEDSLHDRFVDEVVRRAAEIRLGGPFDERAQTGALISAAHRAKVEAYVAKGLDEGAVLRCGGRRPEGLDEGFFYLPTVLDECTSGMSVIQDESFGPVLTVERFTGEAEAVRLANDTVYGLAGAVWTTDEAKAQRVVSRLRIGTVWINDYHPYVPQAEWGGYKQSGFGRELGPSGLAEYREAKHIWRNTDPSPQGWFA

SEQ ID NO: 14477 - protein, 382 aa, Streptomyces avermitilis
VTTTPVSPLSALPPSLLATLPGHYYTDPEIFRQEQADLFESMWFCAVRGADLGRPGAFRTVQVGRENVLITRSRTGELRAFLNICRHRGARLCTEESGEVRRNLQCPYHAWTYDLDGKLVAAPNLVRMPDVDRVEYGLVKVALREWLGYAWVCLADEPPSFEETVMGAAVERLGDAAAIEHYGTENLALGKRITYDVRANWKLIVENFMECYHCATIHPELTDVLPEFAEGYAAQYYVGHGAEFGQDVKGFTVDGSEGFAKLPAVDDDQDRRYYAITVKPTVFINLVPDHVILHRMFPLAEDRTIVECDWLYAPEVVESGADVSKSVELFHRVNVQDFDACERTQPAMASRAYRKGGVLVPTEHHIGIFHEWLLGQLGGDHA

SEQ ID NO: 14478 - protein, 384 aa, Streptomyces avermitilis
VSPTYDVIVIGLGGMGSAAAHHLSARGARVLGLEKFGPVHNRGSSHGGSRITRQSYFEDPAYVPLLLRSYELYEEVERSTGREVATLSGGVMVGRPDSLTVAGSLRSATQWDLPHEMLDAKEIRRRFPTLNPSNDEVALYEKKAGLVRPENMVAAHLQLATRQGAELHFEEPMTRWEPYRDGVRVHTAENTYTAGQLVICPGAWAPQLLTDLGVPFTIERQVMYWFQPRHGVGPFRPENHPIYIWEDAEGVQVYGFPSIDGPDLGAKVAFFRKGVVCTPETIDRTVHDHEVQAMADHMSRCIPDLPGTFLKAATCMYSNTPDEHFVIARHPAHPDSVTVACGFSGHGFKFVPVVGEIVADLALTGTTAHPIGLFDPRRLAAAPA

SEQ ID NO: 14479 - protein, 818 aa, Streptomyces avermitilis
MSSTPETRPRGPQVVIIGAGIVGCSLADELTARGWTDVTVLEQGPLPAPGGSTSHAPGLVFQTGPSRMLTSFAQYTVEKFNSLEADGVPCFDPVGGLELATTPERLADLHRKAGYAASWGVRGEIVSTARCKELWPLIDESVVLGGFHTPDDGLARALLAARAQMERATSRGAVFLDRHTVTGIERQDGRVTAVVTDRGTFAAHHVVSAAGFWGPVIGRMAGIDVPLQPLAHQYAKTPKLPELAGATAEASKPILRFQDRDLYFREHTDRIGIGSYAHRPLTVDAFAIPAYDEARANDMEMPSSYPFTAEDWAPSWEDCRRLFPALRDTEIEEGFNGVFSFTPDGMPVLGESRALRGFWLAEAVWVTHSAGVAKAVAEWMVDGRPSIDVHEADLTRFEDAQRSPSYVRERGAQQFVEVYDILHPLQPMERPRPLRVSPFHARQQALGACFLEGGGWERPHWYEANAPLVDALGPLPERDAWSARYWSPIAAAEARATREKVALYDMTPLRRLEVSGPGALDFLHRMTTNNLRKKPGAVTYTLLLDHTGGIRSDLTVARLGPDRFQVGANSPADLDWLTRHAPDGVHIRDITSGTCCIGVWGPLARDLVQPLTRDDFSHEGFGYFRAKETYLGHVPVTAMRLSYVGELGWELYTTADLGLRLWDTLWEAGRKHGVIAAGRSAFNSLRLEKGYRAWGTDMTDEHDPFEAGVGFAVRMDKEFVGREALDAAAPPTRRLTPLLLDDPAANVLGKEPVYVDGVPSGYVTSASYGYTLGRCVAYAWLPPLATGTGVHIEYFGEKVPATVAEEPLFDPKMTRIRR

SEQ ID NO: 14480 - protein, 208 aa, Streptomyces avermitilis
VTARGTVRVERVVTSGTFSLDGDTFDVDNNVWLIGDDEEVLIVDAAHDARTIHEAVAGRHVTAIVCTHAHDDHIDAAAELSVLTGAPVLLHPGDNELWSLTHPGRKPDGELSDGRVLTVAGIELQVIHSPGHTWGSCSLHAPFLNAVFTGDTLFHGGPGATGRSYSDRPTIEASLRNRILTLPGGTVVHTGHGEDTTIAAERLNVPAV

SEQ ID NO: 14481 - protein, 363 aa, Streptomyces avermitilis
LVVPHEVRAVVAVKKGAPVEVQTIVVPDPGPGEVLVAVQACGVCHTDLHYREGAITDDFPFLLGHEAAGTVEAVGAGVTDLAPGDYVVLAWRAPCGSCRSCRRGRPWYCFDSRNATQPMTLLDGTPLSNALGIGAFAEKTLVAAGQAVKIDPAARPEAAGLIGCGVMAGYGAAVNTGKVGRGDTVAVIGCGGVGNAAIAGACLNGAMKVIAVDIDDKKLDQAEKFGATHTVNSRGTDPVEAVRALTDGFGVDIAIDAVGRPETYKQAFYMRDHAGTLVQVGVPDPEMKIDLPLIDLFSRGGALKSSWYGDCLPSRDFPFLIDQYLYGLLDLNAFVSETISLEQVEEAFAKMHRGEVLRSVVVL

SEQ ID NO: 14482 - protein, 276 aa, Streptomyces avermitilis
MTRTQKQAERSDEHSGNSAKQNGRGTASAVQSVDRAVSVLEILARHGEAGVTEIAEELDVHKSTAFRLLGVLENRGLVAQAKDRGKYYLGAGVLRLAGAAAVRLDISQEGVPVCRELADELGETVNIAVFDDDAAVNIMQARGTASVTAQNWLGRRTPLHATSSGKVLLAHLPPTLREGLLARSLPRFTERTITGATVLRGELEAVIEQGCGVTIEELELGLAAVAAPVRAHDGKVIAAISVSGPVYRMGPDRLPELTKRTVAAGAELSRRMGYGF

SEQ ID NO: 14483 - protein, 106 aa, Streptomyces avermitilis
VIPVCRLEDLPAGESVRVDTTPPIAVFNADGELYAIDDTCTHQDASLSEGWLEGCLVECPLHAASFDLRTGLPTCLPARRAVRTHRVTVDDGVIHVHLALEEGNAA

SEQ ID NO: 14484 - protein, 413 aa, Streptomyces avermitilis
MRTVTVVGASLAGLYAARELRAQGFDGRLVIVGEEPHPPYDRPPLSKDFLTGRADQDRLALADAEETAELGAEWLLGVRARGLDPRGRTVLLDDGRTVSTDGVVIATGASARRLPGDDLSGVHTLRTLDDARALRDELSRGARRVVVIGGGFIGAETASSCAALGHDVTVVEAAPLPLVPQLGAEMAAVCAALHRRGGAGLVTGTGVAGLRGRAGAGAERSGHQGAGAAGPRRSVTAVELSDGRLLPADGVIVGIGATPNTGWLAGSTLALHDGVLCDDGCATALPQVVAVGDVARVGGTRAEHWTSATEQPRVAVRNLLAGRTTETVRSVPYFWSDQYGARIQFAGRRHDGDTVRITEGAIERGGPAEGGLLALYERDGRTTAVLSVDRPRPFMRARRELSRAADPVEPAAL

SEQ ID NO: 14485 - protein, 205 aa, Streptomyces avermitilis
MGTAELRATTGNGVAAPTVARPDAQAPDRDVPASGRRLPAQKSEAADGRRVPSGGHDAGAERRAAAAETEEEQGAYYRALWVEEPARRRRLPDPVRTAAVRAVLIIAVTLIQAVVAFLCTMAGSWLAFPMVLSSLVSTVVATWGVLDVWVTHQVWNQRNGVVSAPSSTARALRRERRRIRRQTRVAERAQERIRRRGGSGQLSHP

SEQ ID NO: 14486 - protein, 946 aa, Streptomyces avermitilis
MRFRGKSIRRKIVALLLVPLLSLTAIWCFATVLTGRAAQSLFSVSYIVEKAAYPTEDTVHVLQQERRQTLVYLADPRASDALSALRRSRAATDKAVAKIRKNAKDEKLREETGEATAERLTSILDALDGIDSLRRSVGDGTVNRSQALDLYNRLVDPCYALLANLHVLDNVEMDKQSRALVNVSRAHELLSREDALLGSALVAGRITRDEIRDVSDLVAQRSLMYDVSLPLLPSSERERFTRFWKNADTAPLRVAEQSVINASPGTPSGVSAKHWDSAAGQVLDRLGEMSTQAGDRYQDRVRPVAVGVIAKAAVAGVLGLIALLVSLIMSVRIGRSLIRDLRRLRLDAHEASGVRLPSVMRRLSAGEQVDVETEVPRLEYDKNEIGEVGQALNTLQRAAVEAAVKQAELREGVSEVFVNLARRSQVLLHKQLTLLDTMERRTEDTDELADLFRLDHLTTRMRRHAEGLVILSGAAPSRQWRKPIQLMDVVRAAVAEVEDYERIEVRRLPRVAITGPAVADLTHLVAELLENATVFSPPHTAVQVIGERVANGFTLEIHDRGLGMAAEALLDANLRLAETPEFELSDTDRLGLFVVSRLAQRQNVRVSLQPSPYGGTTAVVFIPDALLTDDVPDTNGIGFRLDRALPAKEPALDEDRTAALSQVPVQFLGLPTSILDGPVELEAPVDLDALDDFPGALSDEDSERGGLFRPRPSIAGVPGPQHQQPRDGRGEPGRSGDTDHPDAPVPLPRRRTPKLVSSHGRPVTGTRSRSAGADEGPVEGMDPMEPGVAAFDERRSKPSAARLADRRESSKRPRGDREIPNRPQGERSDAPALPQRRRSRPSAGTEETTPRLGAAAGKAESGAGPLPRRVRQASLAPQLKDGPERRAERDKARTASRADLAERDADEVRSRMASLQRGWQRGREENAVGDDAQDGSVRGTTRGDGR

SEQ ID NO: 14487 - protein, 146 aa, Streptomyces avermitilis
MTAPKAAGPTASSTASGELNWLLDDLVERVASIHKALVLSGDGLPTGVSKDLSREDSEHLAAVASGFHSLAKGVGRHFEAGSVRQTVVELDEAFLFVTAAGDGSCLAVLADADADIGQVAYEMTLLVKRVGVHLGSAPRTDLPSGG

SEQ ID NO: 14488 - protein, 131 aa, Streptomyces avermitilis
MSGDGQGRSHWFDDDAGPVVRPYAMTRGRTSHAAQHRLDLIAVVVAESHADEPEADHMLSPEHVDIVGLCRHTPQSVAELAAELDLPIGVVRVLIGDLVDEELVHVTRPVPPAELVDESILRDVISGLRAL

SEQ ID NO: 14489 - protein, 1204 aa, Streptomyces avermitilis
VTGWQFWVDRGGTFTDIVARRPDGRLLTHKLLSDNPARYADAAVAGVRELLEDGARIDAVRMGTTVATNALLERKGERTLLVVTRGFRDALRIAYQNRPHIFARQIELPELLYECVVEADERIAADGTVLRAPDLDALAGPLQQAYDDGIRAIAVVCMHSHLHPAHEQAIGTLAARVGFPQISLSSEVSPLMKLIPRGDTAVVDAYLSPVLRRYVQHVAGELHGVRLMFMQSNGGLAEAGQFRGKDAILSGPAGGIVGMARMSQLAGFERVIGFDMGGTSTDVSHFAGEYERVFTTQLAGVRLRAPMLDIHTVAAGGGSVLHFDGSRYRVGPDSAGAAPGPACYRGGGPLTVTDANVALGRIQPAHFPRVFGPRGDQPLDAGLVRERFAALARDIRDRTGDDRTPEQVAEGYLQIAVANIANAVKRISVQKGHDVTRYALTTFGGAGGQHACRVADSLGIHTVLVPPMAGVLSALGIGLADTTAMREQSVEAPLERASMPHILKTADDLEGATRAELLAEDVPEDRIRVTRRAQLRYDGTDTALTVELTEPDTMIRAFEERHRATYSFTLDRPVVVEALSVEATGLTEPPDLSALAAFEGRSATPETVSLHTGGAWRDVPLHRREALPPSETVTGPAVIAEAGATTVVDDGWQAVITGDGHLIMERVAVTESSDLGTEADPVLLEVFNNLFMSIAEQMGARLESTAQSVNIKERLDFSCALFDPDGSLVANAPHIPVHLGSMGTSVKEVIRRRGDGMRPGDTYAVNDPYHGGTHLPDVTVITPVFDTEGERVLFYVASRGHHAEIGGIAPGSMPANSRTLEEEGILFDDWLLAEDGRFREAETLSLLTEARYPSRNPNTNLADLRAQIAANQKGVGEVARMIENFGLDVVQAYMKHVQDNAEDSVRRVIDTLEDGEFAYETDSGAVIRVRVLVDREKRSATVDFTGTSPQLPTNFNAPFSVVNAAVLYVFRTLVADDIPLNDGCLRPLDIVVPPGSMLAPEPPAAVVAGNVETSQAITGALYAALGVQAEGSGTMNNVTFGNEKYQYYETVASGSGAGDGFPGASVVQTHMTNSRLTDPEVLEWRLPVELDEFAVRHGSGGAGRWRGGDGAVRRIRFREPMTVSTLSQHRRVPPYGMAGGEPGALGANRVERADGTVTELGGSDTADVGPGDVLVVETPGGGGYGPPPRDNDQAGEETDDLRAH

SEQ ID NO: 14490 - protein, 201 aa, Streptomyces avermitilis
MIFGRTERGKPPVEPVTLKILVAGGFGVGKTTLVGAVSEIRPLRTEEVLTEAGRPVDDISGVEGKHTTTVAMDFGRITLREDLVLYLFGTPGQDRFWFLWDELATGALGAVVLADTRRLEDCFAAVDYFERRSIPFVMGVNCFEEAARYPVEDVRRALDLDDDVPVVLCDARDRESVKEVLIDVVRHAMAHAAERRETVSG

SEQ ID NO: 14491 - protein, 507 aa, Streptomyces avermitilis
MPDNAQKYVAAIDQGTTSSRCIIFDHGGAIVAVDQREHRQIFPKPGWVEHDATEIWSKVQAVVAGAIAKAGLRADQLSALGITNQRETTVLWDRATGKPVHNAIVWQDTRTSALCHELGGSDGQDRFREQTGLPLASYFSGPKAAWLLDNVPGLRARAERGEIAFGTIDSWLIWNLTGGTDGGRHVTDVTNAGRTMLMNLETLQWDRSILSAMNVPEAVLPEIRSSSEVYGTAVGQLSGVPVASALGDQQAAVFGQACYDVGTAKNTYGTGSFLLLNTGNRPVPSKNGLLTTMGYKIGGEAPVYCLEGSIAITGALVQWFRDQLGIIRTADEIETLAASVDDNGGAYIVPAFSGLFAPYWRSDARGVVTGLTRYVTKAHLARAVLEATSWQTREVVDAMYQDSGVRITTLKVDGGMTKNNLLMQHQADVLGVPVIRPRVSETTCLGAAYAAGLATGVWNDLDELKSHWQKDVEWTPSMEASERDREYHNWRKAVEKSFGWHEEDGVN

SEQ ID NO: 14492 - protein, 249 aa, Streptomyces avermitilis
MSNGDIFVGEIIGTAILILFGAGVCAAVTLRYSKARASGWVVIAFGWGFGVLAGAYTAAPLSGGHLNPAVTIGIAIDTGTWGKVWIYLLGQLVGAVLGAVLAYLVYLAQFQANVRKEGTTEGTADEPVPTLGIFSTIPEIRNPVANLITEIIATIALVLPILAFGLTKGLGESGITVLIVSLLVVGIGLSLGGPTGYAINPARDLGPRIVHTFLPIPNKGTSDWGYAWIPVVGPLIGGALAGLIYHVAF

SEQ ID NO: 14493 - protein, 541 aa, Streptomyces avermitilis
VPSWMDTLRFAFQPVVNLTTGGVAALEILARPETGDVLAQARRDPELDGRLAASGIRAAALKETLLPLHVNVFAGTPADLGGLAALRDAVREAGRLPWEVTVDICPPYTHVPHQALLEAVAAIRSEGFRICADGIGDGDVPLRLLTDMAPDLLKLDVSLLTRPAAVRAMRTLCEQLGALLSVEGVETESQCAAALAAGAQLAQGELFAPPSRLPVADVYLPTLSPAAVPAPRTGPPVRQFVRPAALLPAMASAAQVRALLTGSPDVSGVLLVDAGGVPVRSVHRSRFLLSMSGRYGHALYADRPAAKLSDPPRTVGVDATAWEVLDVVAVGGPDRTSDDVAVVDRHGRCVGVVRLADLVRALAESRVEEAAGLNPLTRLPGSDAITGEVDRWIADGRMFALSWLDVDRFKQVNDGAGFAAGDELIRAVGRALQRAASGATRVGHIGGDDFLVLADADALDPVAASVLDAPWSAGGRTVTLSLATVLCPPGSVTDHRQAAACLAPLKQAAKALSGASWVLGRAGLPGHEIRRGSGAAAAHAG

SEQ ID NO: 14494 - protein, 396 aa, Streptomyces avermitilis
MTDDVAVLGAGMHPWGKWGRGFVEYGVAAARAALADAGVDWREVGSIVGADTVRGGYPGYVAGATFAKALGWQGARVTSVYAACASGAQAVSAARAQILSGLADVVLVVGADSAPKGFFRPAGGDRPDDPDWLRFRVLGATNPTYFGLYARRRMAVHGDTVEDFAQVKVKNAASGALNPNARYRKRVTAEEVAASAVVADPLRLLDICATSDGGAALVLSSMEFARRRGAPDPVRIRAVSTVSPRYPRTVLDLPDIATDSAVAVEPPAETFRTSIARVAYEEAGVGPEDLSLAEVYDLSTALELQWYEDLGLCSEGEAAKLLREGATAPGGRIPVNVSGGLASFGEAVPAQAIAQVCELTWQLRGDAGDRQVPGARVGITANQGLFGHGSSVIAVR

SEQ ID NO: 14495 - protein, 148 aa, Streptomyces avermitilis
LSRTRTPVVSGWFAGDGNDFRLLGTRCSACASVFFPREDAHCRNPGCPGGELAEVALSGRGRVWSYTDSRYRPPSPYVTDPELSWEPRALIAVELAAERIVVLGQSVPGVTVADLTVGMEVEVVPGVLNEDAGTTWTTWHWRPTGVTA

SEQ ID NO: 14496 - protein, 178 aa, Streptomyces avermitilis
VSASRHPTANCVPDSHCSSCGAPYGEGVSGWPRSCPVCGTVAYRNPLPVAVALLPVYDARGTALVVITRTIPPARGAVALPGGFIDHREDWRHAVVRELKEETGIDAASRDVRLADAMSSPDGHLLLFGLLPERPAADLPPSTGTDETEGWQLLRRPAELAFPLHTLAVRGWFEGRYV

SEQ ID NO: 14497 - protein, 788 aa, Streptomyces avermitilis
MDGRDLVRSVKAVGSGGAAGGLRTVRAAWRRRRADASGLPRRGAERARVPGPVQGVVPGPGGGVIRFARSELRITVAVNGAVFWGWDGAGPEPSYALAGRCPEPDPRAVLEPDKDGGWQVVAERGTVMVSRHGAVEVRTPGGVTLRRDLPPRWWEPADGGAAHWMQRSEVAADARFFGLGGRAAGPRLRGGTYRLWNTDPGHAVGPGDDPLYLTMPVQLVVADAATHLVFHDTSWDGTVTLREGEEGAGSGHDRAGTSELRMDGGPLRCWVMMGTPARVLHTWASLTGAPALPPAWALGHHHARRGSGSEQEVRGVVSGYQERGLPLDAVHLDNDHYDAHQVFTVDRDRFPKLPVLAEELRRDGIRLVSVVDPAVRAEPGNAVYDAGSAQDAFVRDAAGRVVEGVVWPGESVYPDFTHARVRKWWGGLYEERLAQGFAGFWHDLNEPVSFTAFGENTLPRSARHLLEGRGGDHREAHNVYALGMARAGYEGLRELSPQERPFIFSRSGWSGMQRYGGAWSGDVTTGWPGLRASLSLVIGLGLCGVPYSGPDVGGFDGSPSPELYLRWFQLGSYLPLFRTRAGLRAGRRELWEFGEDVLEHARVALVERRRLLPYFMTLAHLARRTGAPYVRPVWWGAPEDRALRDCEDAFLLGDSLLVAPVLDPGADRRAVQLPRGRWYDTVTEKAYDGPGQVLIGAPLSRIPVLARAGAVLPVRGDGGRLELEVWRPARGRTGGGLVVPDSGDGWDEPEIEQYVTRLRGQRVVVERDGDEGPGEPSYPVRVRGLPQA

SEQ ID NO: 14498 - protein, 655 aa, Streptomyces avermitilis
MTPANPSPLWRPDEERIAQAQITRFQSWAAEHHGAPADGGYAALHRWSVDELDTFWKAVTEWFDVRFSTPYARVLGDRSMPGAAWFPGATLNYAEHALRAADTRADEPALLHVDETHEPRPVTWSELRRQVGSLAAELRSLGVRPGDRVSGYLPNIPQAVVALLATAAVGGVWTSCAPDFGARSVLDRFQQVEPVVLFTVDGYRYGGKEHDRRETVAELRRELPTLRAVVHIPVLGTEAPEGALEWSALTSSDVAPEFEQVPFDHPLWVLYSSGTTGLPKAIVQSQGGILVEHLKQLGLHCDLGPEDRFFWYTSTGWMMWNFLVSGLLTGTTIVLYDGSPGFPDTAAQWRIAERTGATLYGTSAAYVMACRKAGVHPSRDFDLARVRCVATTGSPLPPDGFSWLHDEVRADLWIASVSGGTDVCSCFAGAVPTLPVYIGELQAPGLGTDLQSWDPSGKPLVDEVGELVVTNPMPSMPIRFWNDPDGSRYHGSYFDTYPGVWRHGDWITVTSRGSVVIHGRSDSTLNRQGVRMGSADIYEAVERLPEIKESLVIGVEQPDGGYWMPLFVHLAPGATLDDALLGRIKQTIREQLSPRHVPDEIIEVPAIPHTLTGKRIEVPVKRLLQGTPLEKAVNPGSIDNLDLLGFYEDLARKRA

SEQ ID NO: 14499 - protein, 439 aa, Streptomyces avermitilis
VATQYGISGTTAKGIASSVERGVSEGALGPGAALPPVRRLADELGVSPGTVATAYKELRRRGIVVTRGRGGTVVAAAPAVASRRPPRVPDGLRDLAGGHPDPALLPRLVPPSHLSPGARSHRSTPRLARLEDAVRDWLRPDGVPTEYVTFAHGALDLIGRLLSVELRPGDAVAMEDPGYHHLLDLVTALGLRTVSVAVDDEGVRPDALRGALRAGVRAVVCSPRAQNPYGGRFSTERRDALVEVLREEPEVLVVENDHASAVADAPLHTLTAGGLTRWVHVRTVSKFLGTDLRWAAAACDPTTLARHDGRLLLTSGWVSHLLQETVYGLLTDDGTRALVTRARETYALRRGALLQELEKHGLEGHATSGMNVWVPVRDESAVVNGLRSYGWWVAAGARFRLVAGPGVRISVAELEPVDAARLASDFAVVLGESEATYGG

SEQ ID NO: 14500 - protein, 424 aa, Streptomyces avermitilis
VNPKRRAAAWSTRIPGGRDGRRMLWIALVDRIGSGLWASVSVLYFTYVTGLSAAQVGTLAAVSGAIGIAGAPLGGRIADRLPLTRVLIALQLLRALASFALLTTGNYALLLAFSAVGSLGDRAANVLTKLYATRVSGPDRVRYQAVNRTVANAGWAVGGLAAAAALGLGTSTAYQALLAGDALSFLGAALLTVRCGEPPSPTRTVVTSKDPLPTTKPAKPWRDRTYLAYVATETALCLHDAVFKVGLPLWIVHGSNAPHGLAPLLLVLNNVLVVALQVPLARFGATTTAARALLLPLAAFFALGGVAMALSSAGGTPIATGCLTAAAVSFTMAEMLYATVSWELSVALAPATAQGAYLGVHGLAQSVQRSVGPLAVTAAIATGPAGWTVFGATIAVTCLIQHRLVRDRLAGPSLSVPPVTVSEH

SEQ ID NO: 14501 - protein, 297 aa, Streptomyces avermitilis
MAHTEHQTMRRVLRREIAGTIGLLTDEHDFTAMLRYRTFAFDDHATYLQQVEALLRTLAAQGGHTTVALFDPEEYAEFCAETGLEPDAPSSRTRFTAELAATGPTVPYEGQPLADLVPNLIDEAVRRATWQYATTVLTRIGSCASCGEDIGRAAFARASHLLARVLDTADPGHRHLVCSVSTTPEGVIAVLHADDDADGTARLDETEALEFTTVLALGIATRSAGGLVMRTSAPGRTDRVYGWRLRGEGLHPLTAGEVFDAYCTDIASGEIVSPESGVDYSEPPDLGDAEHPTGHTH

SEQ ID NO: 14502 - protein, 556 aa, Streptomyces avermitilis
METTLRGVGVSHGVAIGEVRHMGTAVLEPPAKQIPAEDAEREQGRAHKAVDAVAADLIARGNLAGGEAQAVLEAQALMAQDPELMADVERRIAVGSTAERAVYDAFASYRALLAGAGEYLAGRVADLDDVRNRIVARLLGVPMPGVPDSDEPYVLIARDLAPADTALLDPTLVLGFVTEEGGPTSHSAILARALGVPAVVALPGAGEIGEGIVIAVDGSTGEIFVNPSPEKKEQLEAAAAERKAALSASTGPGATSDGHKVPLLANVGGPADVPAAVEAGAEGVGLFRTEFLFLDDSKNAPSEEKQVEAYRQVLEAFPEGRVVVRVLDAGADKPLEFLTPADEPNPALGVRGLRILLEHPDVLRTQLTALAKAAEGLPVYLEVMAPMVADRTDAKAFADACREAGLQAKFGAMVEIPSAALRARSILQEVEFLSLGTNDLAQYTFAADRQVGAVSRLQDPWQPALLDLVALSAEAAKAEGKSCGVCGEAASDPLLACVLTGLGVTSLSMGAASIPYVRATLAKYTLAQCERAAAAARAADTAEEARNAAQAVLSGE

SEQ ID NO: 14503 - protein, 149 aa, Streptomyces avermitilis
MTTVTSPLAGRAIGLAAVPDPVFSGAMVGPGTAIDPVREPSEAVAPVDGVIVSLHPHAFVVVDGEGHGVLTHLGIDTVQLNGEGFELLVNKGDTVTRGQAVVRWNPAAVEEAGKSPVCPVVALEATVDSLGDVRDEGDVKAGDPLFSWQ

SEQ ID NO: 14504 - protein, 202 aa, Streptomyces avermitilis
VEVQETRVQTDRVLTIPNILSMARLVGVPVFLWLILRPEFGGPKSDGWALLVLALSGISDYLDGKLARRWNQISSLGRLLDPAADRLYILSTLVGLTWREILPIWLTAALLARELVLLVMVGILRRHGYPPPQVNFLGKAATFNLMYAFPLLLLSDSSGWIGSLAAIFGWAFAGWGTTLYWWAGVLYMVQVRRLVRADAVAD

SEQ ID NO: 14505 - protein, 831 aa, Streptomyces avermitilis
MKAVVMAGGEGTRLRPMTSSMPKPLLPVVNRPIMEHVLRLLKRHGLNETVVTVQFLASLVKNYFGDGEELGMELTYANEEKPLGTAGSVKNAEEALKDDTFLVISGDALTDFDLTELINFHKEKGALVTVCLTRVPNPLEFGITIVDEEGKVERFLEKPTWGQVFSDTVNTGIYVMEPEVFNYVEADVSVDWSGDVFPQLMKDGKPVYGYVAEGYWEDVGTHESYVKAQADVLEGKVDVEIDGFEISPGVWVAEGAEVHPDAVLRGPLYIGDYAKVEADVEIREHTVVGSNVVVKSGAFLHRAVVHDNVYIGQHSNLRGCVIGKNTDIMRAARIEDGAVIGDECLVGEESIIQGNVRVYPFKTIEAGAFVNTSVIWESRGQAHLFGARGVTGILNVEITPELVVRLAGAYATTLKKGSTVTTARDHSRGARALKRAVISALQTSAIDVRDLENVPLPVARQQTARGSAGGIMIRTTPGVPDSVDIMFFDGQGADLSQGSQRKLDRVFARQEYRRAFPGEIGDLHFPASVFDSYTGSLLRNVDTTGISESGLKVVVDASNGSAGLVLPSLLGKLGVDALTINPGLDESRPTETADARRSGLVRLGEIVASARAAFGVRFDPVGERLSLVDEKGRIVEDDRALLVMLDLVAAERRSGRVALPVTTTRIAEQVAAYHGTQVEWTTTSPDDLTRVGGDESTIFGGDGRGGFIIPEFSSVFDGTAAFVRLIGLVARTQLTLSQIDARIPRAHVLKRDLATPWAVKGLVMRRVVEAAGDRFVDTTDGVRVVESDGRWVMVLPDPAEAVTHLWAEGPDDASAEALLDEWAAVVDSAGR

SEQ ID NO: 14506 - protein, 301 aa, Streptomyces avermitilis
MCGMPQPPPVRSTPTRPPRPDASMSLLTNVMDHSLDDGYAEAAARKKAEGTGGMPKTVRAKLGLAAGLVLAALVVTVGAAQARIAAPTIAKERQELVDRIGRETTVADKLESSVDTLRDDVSARQREALKKYGGGDQADVVGILSGAVAVHGPGVKLVVDDAKEASTGGNGDPRETSGFSDTGRVRDRDMQRVVNGLWESGAEAVAINGQRLTALSAIRAAGDAILVDNKPLVPPYTVLAVGDGKHLSTGFQNSPDGLYLHALQENYGIRTGISVQGDVRLPAAPSVIVRTAQPSTEKGTS

SEQ ID NO: 14507 - protein, 110 aa, Streptomyces avermitilis
VIAVLGLVVGVVAGLLVRPEVPAVVEPYLPIAVVAALDAVFGGLRAMLDGIFDDKVFVVSFLSNVVVAALIVFLGDKLGVGAQLSTGVVVVLGIRIFSNAAAIRRHVFRA

SEQ ID NO: 14508 - protein, 291 aa, Streptomyces avermitilis
VRQMSHEDETPKGPDTPEAAEHRLRRELPEEVPETAAETANEDATKGSGPGLTGRQRLVQGLWPPRVSRAQLIVALLLFGLGFGLAVQVASNSDSGNALRGARQEDLVRILDELDNRTQRLADEKQGLEDQRSELENSSNQAEEARKQTVEKEKQLGILAGTVAAQGPGITMTIDDPKGTVRADMLLDAVQELRAAGAEAIQVNGVRVVANTYLTDSGKSVSVDGNKISQPYRFKVIGKSQDLEPALNIPGGVVQTLEKEQATVAVERSTKIIVDALRAAKRPDYARSSSE

SEQ ID NO: 14509 - protein, 324 aa, Streptomyces avermitilis
MGGAWWKLSGGYGRCEDVRVDRCVQSGFVLPHGRVCFGQGESPVKLFAKLFGKSSREGSDNATARHRAPRSGDAEAQGGERPLFRDQVGGPGGDISGGQGASSVDPAQSGRIGFGDPSTSGAGGGFGSDPYASNAPAGQPRQEDPSMSALVCTRCGNRNAENSRFCSNCGAPLRGGAAPERPSETTSTISISGLEAYDAEVTGQTAMPTLSPEAQAAVDALPLGSALLVVRRGPNSGSRFLLDGELTTAGRHPQSDIFLDDVTVSRRHVEFRRGADGTFTVADVGSLNGTYVNRERIDQVALSNGDEVQIGKYRLVFYASQRGI

SEQ ID NO: 14510 - protein, 251 aa, Streptomyces avermitilis
MLHTPSGGAGSGTAATDGELMSIGTVLNALRDEFPDITISKIRFLESEGLIEPQRTPSGYRKFSAGDIERLGHVLRMQRDHYLPLKVIREHLDALERGEEVRLPSMGRQRDPGEGESLVDLFGEPEAPTAARVGRAELLAAAEIGEQELEEWESYGLIAPLPDGAYDAETVTVATLVVELGRFGIEPRHLRVMKAAADREAGLVDQVVAPLRRHRNPQTRAHAEARTKELAGLAVKLHAALVQTALGVRLP

SEQ ID NO: 14511 - protein, 157 aa, Streptomyces avermitilis
VNELDVVGVRVEMPSNQPIVLLREVGGDRYLPIWIGPGEATAIAFAQQGMAPARPLTHDLFKDVLEAVGQELTEVRITDLREGVFYAELVFASGVEVSARPSDAIALALRTGTPIYGSDGVLDDAGIAIPDEQEDEVEKFREFLDQISPEDFGTNSQ

SEQ ID NO: 14512 - protein, 211 aa, Streptomyces avermitilis
VRSSGDGTAGGAPGRSLGESGPYPLHGSAAGPAHQRPTAVAGDEEAASEEVGYRGPTACAAAGITYRQLDYWARTGLVEPSVRPAYGSGTQRLYSFRDVVVLKIVKRFLDTGVSLQNIRTTVQHLRERGFRDLERMTLMSDGATVYECTSPDEVHALLQGGQGIFGIAVGVVWRDVESALSQLHGERVDTGETLVGHNPTDELARRRNRAV

SEQ ID NO: 14513 - protein, 569 aa, Streptomyces avermitilis
VRNAPTILHLDMDAFYASAEQAAKPSLRGKAVVVGGLGPRGVVATASYEARVFGVHSAMPMAQARRLAPNAAYLVPRFGLYREVSEQVMGLLRGLSPLVEPLSLDEAFVDLEAGGVAWDAESARLVGVKLRADIRTVTGLTGSVGLAASKMLAKIASEEAKPDGLVLIEPGTERAMLGPMSVRTLPGVGPATGDHLRRAGITTVEELAEAGEDELVRLLGKAHGHALYAMALARDERPVVAEREAKSVSVEDTYDVDIHDRTRVGMEVQRLADRCVQRLRGAGLSGRTIVLKVRRYDFSTLTRSETLRGPTDDPAVVREAAARLLDSVDTTGGVRLLGVGVSGLADYTQEDLFAQAHVGAAESVAQEQPETVGAVVSDEPAGEEPAVAERHWRAGHDVRHAEYGHGWVQGSGLGRVTVRFETPDSEPGRVRTFRTDDPNLEPVDPLPLVARRPEAAGAGASGAEETGPEVGVAGSSGGAGECSAGREGSEGGTEESSAVRDGASSGTGGPAARAAGSVAVPAGSGVGGAGVADGVDSEGAGPGGQASSVPARRPKSWSGSGGRGATSRP

SEQ ID NO: 14514 - protein, 140 aa, Streptomyces avermitilis
MCSFVVLTDELRPRGGPVQTDIDPRNLIGRKAFDCHGAKIGTIDEIYLDDATGVAEWAAIRTGLFSRDAFVPLEPSELVEGTLRIPFDRALIKDAPDFGVGRHLSPEQELQLYHHYGLDVAPLPPLPDHDFGRLAGTDEA

SEQ ID NO: 14515 - protein, 987 aa, Streptomyces avermitilis
MTEGEAVGVPAQGCPSKVASDQEASAMTAHRIPLSDLEQGIPFEQRHIGPDSEARAKMLAQVGYGSLDELTATAVPDVIKNAEALELPGARTEAEVLAELRSLADRNQVLGSMIGLGYYGTFTPPVILRNVMENPAWYTAYTPYQPEISQGRLEALLNFQTVVAELTGLPTSGASLLDEGTAAAEAMALSRRMGKNKKGLFLVDADALPQTIAVIETRAEPTGVEVVVADLSEGIPAGIAEREINGVLIQYPGASGAVRDIKPLVEQAHELGAVVTVAADLLALTLLTSPGELGADIAVGTTQRFGVPMGFGGPHAGYMAVREKFARSLPGRLVGVSVDADGHKAYRLALQTREQHIRREKATSNICTAQVLLAVMAGMYAVYHGPDGLRTIARRTHRYATILAEGLKAGGVEVVHGAYFDTLTARVPGRAAEIVAAAREGGVNLHLVDADLVSISCDETTTRAQLGAVWTAFGVEGDIEALDAAAEDTLPAALLRTDDYLTHPVFHQYRSETAMLRYLRRLSDRDYALDRGMIPLGSCTMKLNATTEMEPVTWPEFGQLHPFAPAEQAQGYLTLIRELEERLAEVTGYDKVSLQPNAGSQGELAGLLAVRGYHRANGDEQRTVCLIPSSAHGTNAASAVMAGMKVVVVKTADDGEIDVEDLRAKIEQYRDELSVLMITYPSTHGVFEEHVADICAQVHEAGGQVYVDGANLNALVGLAKPGHFGGDVSHLNLHKTFCIPHGGGGPGVGPVGVRAHLAPYLPNHPLQPEAGPATGVGPISAAPWGSAGILPISWSYVRLMGGEGLKRATQVAVLSANYIAKRLEPHYPVLYTGPGGLVAHECIIDLRPLTKATGVSVDDIAKRLIDYGFHAPTMSFPVAGTLMIEPTESEDLGELDRFCEAMIAIRAEVEKVGSGEWPAEDNPLRNAPHTAAALGGEWEHAYSREEAVFPAGVSAADKYWPPVRRIDQAFGDRNLVCSCPPLDAYDD

SEQ ID NO: 14516 - protein, 68 aa, Streptomyces avermitilis
MCQHQPLCPTAASADRESARLMAHHPEQGWSLLCNGVLLFEDTGELLPDGRIIAPHRPLGTDQVMTAA

SEQ ID NO: 14517 - protein, 194 aa, Streptomyces avermitilis
MPLHVPPAPAPALRTVLTALGSPTAVREARTPSLRNAQGPVTPELPLPVHVLDRITPAGASATRLAGWRFLIRCGDRAVAAAETMLTPDGWAFSHFFEGPYITATERALRQAETMKQPYQARLLSVPELYMLTLWLHGDSTADGATGHPAATDLLVPLAPAPPGIAAHRPHRVAELLPVLTTRVTPAPLLGSPA

SEQ ID NO: 14518 - protein, 561 aa, Streptomyces avermitilis
VLLHARRMCRMAVAFSVAGAGSTRGVMDRVAWASSPVTRGHQRPDRRPAHPRRDTSMGEKVVAGSFDLSDRQRYRGKLRQCLAGLARLLEEKRFDRPKNLMGLEIELNLAGADGLPKMMNEQVLERIASRDFQTELAMFNLEVNIAPHRLGGRVFDRLAEELRTSLAYAHRKANEVDAGIVMIGILPTLGRDDLISSNLSGGDRYTLLNEQIVAARGEDFVLDIDGIDRLVCTSKSIVPEAACTSVQLHLQVTPGRFADVWNAAQAVAAAQVAIGANSPFLFGHELWRESRPPLFQQSTDTRPPELQAQGVRPRTWFGERWISSAYDLFEENLRYFPALLPICDDEDPLRVLDDGGIPKLAELVLHNGTVYRWNRPVYGIADGVPHLRVENRVLPAGPTVSDVIANAAFYYGVVRALAEEPRPVWTRLPFESAAANFDAACRDGIDARLEWPRRGRYGGTTQVDAVHLVRDELLPLAEAGLDAWGVEPADRDFYLGIIEERCRRRVNGASWQAATFHRALEAGLDRDAALAATTRRYSELMHVGEPVHTWPVGLPEPVPLG

SEQ ID NO: 14519 - protein, 623 aa, Streptomyces avermitilis
VRDRPLGDGRRTGVPPPRVLPYVRLTAHGSTGRATVMGRHSLPDGYGAGGVDPRTRARRRTVAIATALVLTVAAGTAAAVRGGLLSFGSSCQDHAVRLKIAASPDVAPALRAAADEARRKNITSDGHCLDIHVTARDAYQVTESLLSGRKSDIQAWVPDADLWVRRVTADARATQVTQAGNIASSPVGMAVVPTAAKSLGWPDKTYTWTELAGATLREDRPKLGTADPSRSATGLLALTRLTGATAKVKEGDTRTAAMAKALSQRTADSDSQVLETLPRDSSGTEQGDPKRNQALILSEQAAFTHNTSADSDLKLDLFYPKDGSPRLDYPFTLVDQPRLSTDESRAALRFMTLLEQPKGTRILQKHGFRIDDEDVSATVVTAAGGRSPQPYEEPAPEPASEKTLQESLGTWTITVQSARITTVVDISASMSEAVPGSSRSRMDVTKASLLQTLTTFTPDDEIGLWNFSAKLDGDKDYRVLVPTGRLGDRGGRDTQRDRLSAAFSALEPVRGGATGLYDTTLAAYKAATASYVKGKFNALVILTDGVNEDPGSISRSTLLTQLRKLADPRHPVPLIMIAVGPEAHRQEAERIAGATGGSGHQVDSPAQIHSVILKAIMEAGNQS

SEQ ID NO: 14520 - protein, 260 aa, Streptomyces avermitilis
CRWRRGRWPILFRRSGHDGFSGTRRCSSWGSHSVRAGCPRSALSARSPNPGVSRTRRPPSMPRPRPVVPGSIWRGSCSVSRPRWCRSRSWRIFCCVRGRGGRSASTARGRGRTSGAARRSRRSAVRGSPSTWRPEGWASTSPWCPRRCPTCGGSTPYSFRRCRTPSWRRSSSSAICCGAWASWGGRRARRWWPAPCCVARTTSIRASAGSSATWWAWPSSTCTGAGDGWAPWWWPTRCSTSGRSWGTRCWRGRWAGCLRR

SEQ ID NO: 14521 - protein, 272 aa, Streptomyces avermitilis
MRIRIVDAFTDRPFAGNPAGVLLLDAFPDDAWLQDVAREVNHAETAFAHRLPRGEGGEADWALRWFTPATEVAMCGHATLATAHVLHTSGTHEGPVRFATRSGVLIATPREDGSITLDFPTAPLTPVEIPEGVAEALGAEPLTACDTGPNVGDLLIELADEKTVRGLAPDLRALARYSERGIIATARAEDPAQGHDFVSRCFFPNVGIDEDPVTGSAHTALAPFWSQRLGRPDLTGLQASPRSGHVRTELRDDRTLLTGRAVTVIDGELLTP

SEQ ID NO: 14522 - protein, 217 aa, Streptomyces avermitilis
VMAMRSRGEDFGYEHGHGHHGGPGPRGRGGFEGRRGAFGPFGPGGPGGPGFGGPGFGPGPWGGRGRGGPRGRARRGDVRASILALLKDRPMHGYEMIQEIAERSGGAWKPSPGSVYPTLQLLEDEGLIANESEGGKKLFSLTESGRAAAAEGPEAPWEEASRGVDWEALSEIRQAGFGLMEAFGQVWKTGSKEQRDKALTVINEARKKLYLILADEG

SEQ ID NO: 14523 - protein, 168 aa, Streptomyces avermitilis
MLQALRLRSATPWLRRAQHPTRRGGRMAEVSAEARIEAPAEKVWAQLTDWSAYGEWNATHTGFPKGGPETLEVGGTFAENMKLMGFPAEVDWTIDQLEPVRVLAISGKGPMAVNVATRYTLTPDGDATTLRIDGEFTGAAVSIMAGKLKDSATAALNESLRKLSALVA

SEQ ID NO: 14524 - protein, 250 aa, Streptomyces avermitilis
VPCRSPPERRGCLRREARRRASHRGNGAMSFVRRRGRVRLPNLRRTREWFPAGMTSVDEADEVGDVPSRTPRQPAAESGSRRAELDAGLTAELASAVAGARRRAVRDGDRQVDTAHLLHTLLETDPQVHAVFDGGPQVARLLGYLVQRSIGYGLRWRSRVEDSAAGPTVGEPEGWSPVAAGAMGAAHERAARRGEDRARGVDLLAAIAADPESRAVEVLGRAGVDVRVLLTRIEAWLEFEDLVGGGEVAP

SEQ ID NO: 14525 - protein, 335 aa, Streptomyces avermitilis
VPVRTSQASQGNRGKGVGLGLALASAVAFGGSGVAAKPLIEAGLDPLHVVWLRVSGAALVMLPLAVRHRALLRRRPALLIGFGLLAVAGVQACYFAAISRIPVGVALLVEYLAPALVLGWVRFVQRRPVTRAAALGVVLAVGGLACVVEVWSGLGFDALGLLLALAAACCQVGYFVLSDQGSETGEDAPDPLGVIAFGLLIGALVLTVVARPWTMDWSVLGGRADMNGDSVPAALLLGWIVLIATVVAYVTGVLSVRRLSPQVAGVVACLEAVIATVLAWVLLGEHLSAPQIIGGAVVLVGAFIAQSSAPAKPSDGPVTGGGGAERQLSARGTAA

SEQ ID NO: 14526 - protein, 330 aa, Streptomyces avermitilis
VSNAVSGLPIGRGLLYLTVAGAAWGTAGAAASLVYRAGDMGPVALSFWRCAGGLVLLLGARLLRSRGRRAALRPLGRCEPTEPRESPARKALRIGATGLGLAVFQTAYFAAVEATGLAVATVVTLGAGPVIIALGARLTLGERLGRGGITAVAGALAGLAVLVLGSGGATVRPWGVLLAVVSAAGYSAMTLLTRWWGRDGRADASATTVGAFAVTTLCLLPAALAEGLLPYTAEPVHVLGLLVYIAAVPTALAYALYFAGAAVVRSATVSVIMLLEPVSAAVLAVGLLGERLTAATLVGTLLMLGSVAGLAAAETRAAAAGVPQGEPTLV

SEQ ID NO: 14527 - protein, 233 aa, Streptomyces avermitilis
MESAMPETSTQPGTTQPAAYTPTDRTVPTRSRERAAYDHELVHAILDEGYVCHLGFVRDGAPVVLPTLYGRVGRRLYVHGSTGSRPLRMTGQADPGLPVCLTVTHVDGLVLARSAFHHSLNYRSVVVHGIAHQVTDPDEKREALDALVDHVVPGRSYDSRPANAKELAATAVISLDLDEVSAKLRTGGPNDEPEDLTLPHWTGVLPLTRGYGAPVPAADLAPGIELPDYLAAL

SEQ ID NO: 14528 - protein, 443 aa, Streptomyces avermitilis
VLGEYRIEGRRAAEIAASVERAVGSGELEPGQLLPPMRELALDLGVNPNTVAAAYRTLRERGVIETSGRRGSRVRPKPATTGREDIRVEVPAGVRDVADGNPDPALLPGLAEAFAGAAGEADRAPVMYGEDAVEPELARLARAALDADGVPDGPLVVTSGSLDAIERVLAAHLKPGDAVAVEDPGWGSLLDLVPALGLRTVPVRVDGEGPLPDDVRSALEAGARALVVTDRAQNPTGGAVSAPRARALRAVLAQHPQTLLIEDDHGHAIVDLPLHPLSGTTRHWAFVRSVAKAYGPDLRLAVLAGDPVTVDRVHGRQRLGPGWVSRLVQRAVVRLWVSDAVDVPAVSAAYGRRRDALIGALAERGVEASGRSGLNVWVPVPDETGAVARLLHAGWAVAPGSRFRMSAPPGIRITVSTLTPDDVGPLADAVASAVRPAPARRYV

SEQ ID NO: 14529 - protein, 311 aa, Streptomyces avermitilis
MSTVATSRPVTPTGSTPRRRTALDWRIRFGVLSLIWGFSFLLIKVGTAGYAPFHVTLGRLVFGTAVLAVAMAVKRERLPRGARTWGHLAVAAFFLNALPFSLFAYSELTIPSTLAGICNATSPLWGMALSLVALSEDRPTRRRVAGLGIGFLGVLTVLGAWQGFHGLDATGTAMALLASLSYPIGWIYVRRTLAGSSHSHLSMTGAQLLLATAQLAFVTPLFTTLPSHFPVVPLLAIAALGALGTGLAVLLQYGLVAEVGPTTAQMVTYFIPVIATAAGVAILGESLTWSTPVGAAIVLAGAALTQARARR

SEQ ID NO: 14530 - protein, 299 aa, Streptomyces avermitilis
LNLERLRTLDALARHGSVSGAAEGLHVTTSAVSQQMSKLEREVGQRLLARNGRGVRLTDAGRLLADHAARILSQVELAQSDLEAQRGQVVGELRLSAFPTAARGLFPTALAALRAEHPALRVRSSELEPEAGVAGVVRGDLDLAVVLDWYNKPMPLPDGLVKAAILDDPADVALPADHRLAGRAEVDLGEFADDEWITWGEGEFCHEWLMFTLRSKGVEPCVGHRAAETHTQLGLVAAGLGVCIVPLLGRHPMPAGVVTVPVRQRVRRHVYVVWRADADRRPSIRAAVGALRAAGEAIG

SEQ ID NO: 14531 - protein, 155 aa, Streptomyces avermitilis
MAVTQRRGRKIMMTPGELDEFLTTQRTCRVATVAKDGAPHVSTLWFVWDSTSLWLYSVVRSKRWTELRRDPRIAVVIDTGEEYGELRGVELSGTVEFVGEVPRTGELCAELDAPETLFARKNFGLEEMPHDGRHAWARLTPTAIASWDFRKLGPM

SEQ ID NO: 14532 - protein, 240 aa, Streptomyces avermitilis
MRRLPSPRNARYSRPLRLRRQGDTVASYEQLSELLDPATTVLLTVECQQGVVGPDSALPELAKEARSSGALANVARLVAAAHESGLQVIHAIAERRPDGRGAGRNARLFRAAERLPVQQLSGTTAVRVAAPIEVAEQDLVVRRLHGLSPITGTDVDALLRNLGCRTLIVTGVSANVAIPNTVFDAVNRGYTAVVPADAIAGVPSDYTPVMIRNTLALVATIATTDEVLACVTRPRRAGRP

SEQ ID NO: 14533 - protein, 163 aa, Streptomyces avermitilis
MTSESLHPVSAPARRTVVAAVGAAGLAVALTACGGSDDKSSGSSDVQDNSSASGGGTAGGDSAAAGSDGTVLAKTADIPEGGGKVFADQGVVVTQPTAGTYKAFSSKCTHQGCAVKGIADGVITCPCHNSQFSATDGSVKKGPATQALAAAKITVDGDSIKLA

SEQ ID NO: 14534 - protein, 251 aa, Streptomyces avermitilis
MLKEVIATRYIAPLREGGSLPGLVEADDLGTYVMKFTGAGQGRKTLVAEVVCGGLARRLGLRVPGLVTIALDPVLGLGEPDQEVQELLKSSGGLNLGMDFLSRALGFDSLAFGVSREEAGRVVWFDALVNNVDRSWRNPNLLVRQGELWLIDHGATMIWHHNWPGAQASAAKPYDASDHALAPFGPDVAGAAAELAPRVTEELLAEVTAEIPDEWLTDEPGFESPDELRRAYAEPLLARAAVIHERIKGAQ

SEQ ID NO: 14535 - protein, 127 aa, Streptomyces avermitilis
VTERDVFEYALLRVVPRAERGECFNAGVLVYCRAKSFVAARTYLDETKLLALDPEADVAGVRAALRAVEGVCTGGEAAGQAAQDDAGRRFRWLIAPRSTVVRPGPVHTGLTTDPEAEAERLLGLLVR

SEQ ID NO: 14536 - protein, 253 aa, Streptomyces avermitilis
MSTTEQRVAVVTGAARGIGAATAVRLAAEGRAVAVIDLDEAACKDTVEKITAAGGKAIAVGCDVSDEAQVEAAVARIAEELGAPTILVNNAGVLRDNLLFKMSASDWDTVMNVHLRGAFLMAKACQKHMVDAKFGRIVNLSSSSALGNRGQANYSTAKAGLQGLTKTLAIELGKFGVTANAVAPGFIVTDMTAATAARVGMGFEEFQAAAATQIPVQRVGQPADIANAIAFFTGEEAGFVSGQVMYVAGGPLN

SEQ ID NO: 14537 - protein, 253 aa, Streptomyces avermitilis
MTALPELSGKVALITGASRGIGYGVAEALVARGDRVCITGRNEDALKEAVEALGAERVIGVAGKAHDEAHQAAAVERTMEAFGRVDYLVNNAGTNPVFGPIADLDLNVARKVFETNVVSALGFAQQTWKAWQGENGGAIVNIASVAGVSASPFIGAYGISKAAMINLTLQLAHEFAPKVRVNAIAPAVVKTKFAQALYEGREAEAAASYPLGRLGVPSDIGGAAAFLTSAQSDWITGQTLVVDGGIFLNAGVG

SEQ ID NO: 14538 - protein, 540 aa, Streptomyces avermitilis
MVCRPWYGRSRSERVSNRYRALRQVAAVTSISLVAGCGVLGSGSADDEGPIVVGTTSAPSTLDPAASWDGSWELFRNIYQTLLSYPSGAAAPEPDAAESCGFTNSSNLAYRCVLRTGMKFSDGDTLDARAVKYSIDRIRRIDLSGGPAGLLGSLDRISTRGDREIVFHLNKPDATFPFVLATPAMSIVDPDDYPARSLRKDGKVFGSGPYSLRSYEDGKQAELVKNDHYKGFAERKNDAVTIRYFQNSAAMVKALRDKKIDATYRGLAASDIVSLQSKQSEEDLQLVEGAGTEISYLVFNPKDPWAGKAAVRKAVAQIVDRAAIAHKVYKDTVDPLYSMVPKGLTGHTTGFFDDFGEPSSSKARKILLEAGISQRVPLTLWYTTDRYGSETAPEFEELKSQLNDSGLFSVKIEGRPWKTFEAGYRKGEYPAFGRGWFPDFPDAENFIAPFVGEQNALGTPYPTREITGVLLPQSRRQSDRGAVVKEFEQAQQILVDDARLLPLWQGKQFVAASEDISGGERALDPSTIMMMWELYRKTSW

SEQ ID NO: 14539 - protein, 227 aa, Streptomyces avermitilis
VTDTAMLPESWRGVLGDELQQPYFKELTEFVEEERARGPVYPPREEVFAALAATPYERVKVLVLGQDPYHGEGQGHGLCFSVRPGVKTPPSLRNIYKEMKEELGTPIPDNGYLMPWAEQGVLLLNAVLTVRSGEANSHKGKGWEKFTDAVIRAVADRPDPAVFVLWGNYAQKKLPLIDEERHVVVKGAHPSPLSAKKFFGSRPFTQINEAVAEQGHTPIDWTIPNLG

SEQ ID NO: 14540 - protein, 216 aa, Streptomyces avermitilis
MSVAAVSVVGGWATTLEDVVAERQEQVAPDAMMTRIGQVAMLHHAGDREEARGRFLGLWAEIGDGGDPLHRCTLAHYLADTQDDPVDELAWDLRALSAAEELTDERVAEHEHEDALAVRAFYPSLHLNLAADYVKLGRSDAARSHLRRARGAVGVLGDDSYGDGVRAAIGRLELRLDGDGPAGGGSDPAGGAGPFGGPGPFDGPGGERPGPPRQRP

SEQ ID NO: 14541 - protein, 154 aa, Streptomyces avermitilis
VHRTTTTATLLVTAAVTVLSGCVTVQRLPAPAPSVAPPHPSVPRPDGSGDPQVVQAPAREALELIEPSHRPSPTAAAPHRTPPPARAAAPVTVPRRPHADPPAKPAHPEPRDAVPTSVSKLVPKDGDVCALGRKYGGWQPDSPEATICKNAYGR

SEQ ID NO: 14542 - protein, 170 aa, Streptomyces avermitilis
MTTQRTEPATDADERSMLEGWLDYHRRTLEVKCEGLDDAQLRTASVPPSELSLLGLVRHMAEVERGWFRKVLANDDPGPIYYSDEDRDGEFHLTEADTWAEAYGTWQAEIGIARHNAARFGLDDVCEGTSKFTDSPINLRWIYTHMIEEYARHNGHADLIRERVDGTTGE

SEQ ID NO: 14543 - protein, 301 aa, Streptomyces avermitilis
VKVGCIGLGDIAQKAYLPVLGVQPGVELHLQTRTPATLARVADSLRLPPAQRHTDLSELLAQDLDAAFVHAPTAVHPEIVERLLAAGVPTYVDKPLAYELADSERLVRLAEERGVSLAVGFNRRYAPGYAQCADHPRELILMQKNRVGLPEEPRTMILDDFIHVVDTLRFLVPGPVDDVTVRARTGGGLLHHVVLQLSGEGFTALGVMNRLSGSAEEILEVSGQDTKRQVLNLAEVVDHKGQPTVRRRGDWVPVARQRGIEQAVLVFLDAVRAGKVLSARDALATHELCERVVRAVTERSA

SEQ ID NO: 14544 - protein, 524 aa, Streptomyces avermitilis
MRMPEDWLGSRWWRGAAAVLAGALPMLAFPAPSWWWFAYVALVPWILLARTAPTGGRAAYDGWLGGLGFMLAVHHWLLPSLHVFTVLIAALLGALWAPWGWLVRRFLAGVPSPGRVAAAMLVLPSGWLMVELVRSWQGLGGPWGLLGSSQWQVEPALRLASVGGVWLLSFLVVTVNIAVAVLVSVRASRMPALAGLVATAAATSAAWAWSPRPDHDGDMRIAIVQPGVIDGTGSADRRFDREEQLTRELAGQNVDLVVWGESSVGFDLADRPDLARRIAGLSERVGADILVNVDARRSDRPGIYKSSVLVGPHGPTGDRYDKMRLVPFGEYIPARSLLGWATSVGKAAGEDRRRGSEQVVMNAGHGLRIGPMVCFETAFPDMSRHLAEDGAEVLLAQSSTSTFQQSWAPEQHASLAALRAAETGRPMVHATLTGVSAVYGPSGERVGSWLGTGKSTSAVYDVPLARGVTPYVRFGDWPVHAALLILAALCTAEGVREFRLRRTVPSPRVPPARTVRESPARPGR

SEQ ID NO: 14545 - protein, 155 aa, Streptomyces avermitilis
MDRLGIDELITEYAVAVDDGDWEAYRGLFTADGRADYRSAGGIEGDARQVAAWLAENMRLFPMRQHLIVNRRVRFGVREQDIGDTARVQADYVNPMRFAGSDGGPDGGSGEPDFVCGGRYAFAFARTYDGWRLREVVVQEKWRRMQPAREGNATP

SEQ ID NO: 14546 - protein, 338 aa, Streptomyces avermitilis
VDDSYTDRMITVPLSALEVAMVQAGARAADTLRDTTEFALRLEDLGYLRLWYAEHHHSPAIGAFPPVVLTAHAAALTSSIRLGSGGVLAPNHAPIMLAEQFGTLSALHAGRIDLGMGRGPGTFDDSTARALRRGAGPTTDVEYRDDVSSTLGFLVDEVALGPLPEPWLLSSSTAGAALAAELGLPIAFAHHIRPDNTLAALSHYRERFSPSRWCERPRVLICVETVCAETQEEAARLAGPMDVVKAGLLKGRGDIPFPTPEEAATHSFTAEEAQALTAFRAQQAHGSPETVAKHLTDLVDLTGADELMLVTPIYALADRLRSYELVRQHVMMPTASWQ

SEQ ID NO: 14547 - protein, 286 aa, Streptomyces avermitilis
VGFDRSMALASSALTTLLPLAVLGGTVVSSFAHYDAAERVIKRYGLTGAGAEAVESLFSPAQHTSASVGIFGVVFLTISVLSFARATQRLFEQTWELKPLSMRNTRNGLWWILTLGGYTVVTGWLSAVLGGGRLGLAALVCDVPVTAAFLVWSGWILSAKRINRPDLLPFGIAAALLEAAYSVGTTVYLPRLFNSYAARYGALGAVFAMISALFGGMLVIVASAALGREVRDELTRIRHGHRPSDHDVRRQWDSVVEQTRSRWRTAREQVSHRRPKDANRRDRSKA

SEQ ID NO: 14548 - protein, 99 aa, Streptomyces avermitilis
MRDVTSVRLAVSARDLANTVPLLPAGGFVTQAVADGGIVARRGGTTIRFDAVPRDQVGLRQVELSLNRPVEYRHEERLGRSTLVVGPGARAVWTFGTAE

SEQ ID NO: 14549 - protein, 291 aa, Streptomyces avermitilis
MSWFESLILGLVQGLTEFLPVSSSAHLRLTAAFAGWEDPGAAFTAITQIGTEAAVLIYFRKDIARIISAWFRSLVNKEMRHDHDAQMGWLVIVGSIPIGVLGVTLKDQIEGPFRDLRITATMLIVMGVILGIADRLAARDETGGKHRAAKERKKLQDLNIRDGLVFGACQAMALIPGVSRSGATISGGLLIGYTRESAARYSFLLAIPAVLASGVFELKDAAASGHVAWGPTVFATVIAFVSGYAVIAWFMKFISNKSFMPFVWYRIALGIAIIALVATGALSPHAAESAG

SEQ ID NO: 14550 - protein, 480 aa, Streptomyces avermitilis
VLITSMPTARTASTSTANTASASTARTAPTSTAHDTSTSTAHDTSTPTARDATSPEPSSPPDSRPNPTPYPNRPAAPLAGRRIRAALIGTGAIGGGSHLPALATLAEEGETEIVAAVDINADAITAFCAEHGIPHAYTDLDRMLQEQRPDLVSICTPPTLHREQTLAALRAGAWVWCEKPPVPTLADFDAIESQEGTDGGPYAAIVFQHRFGSGARHVRRLLAEQALGRPLVAHCQTTWYRNTAYYAVPWRGRWQTEGGGPAMGHGIHQMDLLLDLLGPWSEVRAMAGRLVHDVETEDVSTALVRFENGAMATVVNSVLSPDEVSRIRIDCERATVELTHLYGHSNANWRITPAPDVPEEEAAAWRDFGADVPSSHLAQLRELVASMRAQARPRSSGADGRTSLELITALYKSAFTDTTVRAGAIGPGDPYYTALHGGAPGWAPVGFTGSQSADSQSAGSRPAGTGSTVNDSASSKEVPA

SEQ ID NO: 14551 - protein, 311 aa, Streptomyces avermitilis
MSEATGLRIVHAHGDRITITERSTGVDLLSYVYAPEAAWEAPKPYLHPLRTLAGDVVTDYRPNDHRWHKGLQMTASHLSGQNLWGGNTYVHGKGYLALPERVGSMAHVGFDAVDADGARAVIAERLTWHPYSGELWAEEERRVEVHDVDPESGSWALTWTSAVTNRRDEPLLFGSPTTAGRELAGYTGLFWRGPRAFRDGRIIGPDSEGHELMGRQAPWLAYSGEHDGADGHATLVFAHAPENDHDGSQGAHPAHWFVRNEPFAAVAPSWAFHDELELGPGDTLTRRYRVVVADGAWEREEVAKYLQEHPW

SEQ ID NO: 14552 - protein, 254 aa, Streptomyces avermitilis
VVSPGEFAGLPGEFAGLPGVFTGLPGAVAVSHLSVYDWPAVDGVCGGTPHMHLTCSEAYVVTGGRGAVQTLTTSGYEVTPLAPGTVAWFTPGTIHRLVNEDDLRITVLMQNNGLPEAGDAVLTLPPEYLTDPGTYAAATVIPADASEEEQARVALARRDLAVRGYRALRDADGPEPLAAFHRAAAALVRPRVAAWRERWRRGAEAATAATGDQLDRLEHGDASHLADALVRAEQPSTYGRFGMCGRLDVYQGTS

SEQ ID NO: 14553 - protein, 156 aa, Streptomyces avermitilis
MAATKDPRPCSIADTLALVGEKYSLLVLREVCLGNGRFDQLVRNIGAPRDILATRLRRLVDAGMLKKTVYSERPQRFEYRPTEAGLELEPVLMTLMAWGDRHLRKDDDRPMVIEHICGNELIPLVTCSVCGEEVHHEDLTAHPQAPGWTVKGPAAA

SEQ ID NO: 14554 - protein, 389 aa, Streptomyces avermitilis
MRDAVIVEAVRTPIGKGKPNGSLAHVHPVELLAHTLRTLVERSGVDPALIDDVIGGTVDQVGEQAMNTTRYAVLSAGFPETVPATTVDRQCGSSQQAVHFAAQGVMSGAYDLVVACGVESMSRVPMWSNVPAGQDPFGPGVARRYPEGLVPQGISAELIAAKWSITRDQMDAFAVSSHQKAAAAWAGGLFDAEVTPLEGVRRDECVRPASTTEILAGLKPAYYDPNFAERFPGIEWNVTAGNASPVNDGASAVLITSSETAARLGLRPIARLHSFAVTGSDPLLMLTGVVPATEKVLRKAGLTIDDIDLFEVNEAFSSVVLAWRQETGADLSRVNVHGGAIAIGHPLGASGTRLTTTLVHAMRARGARYALQTMCEAGGLANAMVLETV

SEQ ID NO: 14555 - protein, 269 aa, Streptomyces avermitilis
MLDATTRSGGTATATPRATATDLTVATAAAAAGVTAPGAAVAVPTGFTARCTRVLLSPWSRLSLLVALLAAAASSVLLFEPQKLLAHGWPPQLGGAAAAVVFAVAYGLCTVAFVPRPLLNLAAGALFGSQWGTGTALAGTVLGAGVAFGLGRMLGQDALRPLLRGRWLKAVDGQLSRHAFRSMMAARLFPGVPFWAANYCAAVSRMRWVPFLVATALGSIPNTAAYAVAGARASRPTSPAFLIAMGFIAVPALVGAVVAWRKRHHLRGN

SEQ ID NO: 14556 - protein, 390 aa, Streptomyces avermitilis
MPKTAYVRTKPHLNIGTMGHVDHGKTTLTAAITKVLAERGSGTFVPFDRIDRAPEEAARGITINIAHVEYETDTRHYAHVDMPGHADYVKNMVTGAAQLDGAILVVSALDGIMPQTAEHVLLARQVGVDHIVVALNKADAGDEELTDLVELEVRELLTAHGYGGDSVPVVRVSGLKALEGDPRWTAAIDALLDAVDTYVPMPERYVDAPFLLPVENVLTITGRGTVVTGAVERGTIRVGDRVDVLGASVETVVTGLETFGKPMEEAQAGDNVALLLRGVPRDAVRRGHIVAAPGSVVPSRRFSARVYVLSTREGGRTTPVATGYRPQFYIRTADVVGDVDLGETAVARPGDTVTMTVSLGRDVPLEPGLGFAIREGGRTVGAGTVTTVED

SEQ ID NO: 14557 - protein, 281 aa, Streptomyces avermitilis
VDEPIPVTRDVDHGTAKLMPDVDRRRAWLLTVDGAPQSYVDLDAPTHLEFEYARRLGHALDTVAEPGRALDVLHLGGGALTLPRYLAATRPGSRQDVIEADHGLLDLVVEQLPLPADAGIALHRADARAWLEAAVPDSADVVIADVFGGSRVPAHLTSVAYARAAERALRDGGVYLANLADAAPFAFLRSQLATFATVFGELAVIAEPAVLRGRRFGNAVLLASHRPLDTATLARRTASDAFPARVEHGAALRDFMGAAEPVHDENAVPSPEPPDGAFGIG

SEQ ID NO: 14558 - protein, 447 aa, Streptomyces avermitilis
VTSAADSAGRPRRTRRPRRPDWADRNYTLLAAAAVVTNLGSHGALIAAAFAVLDTGGDGGDVGLVAAARTLPLVLFLLIGGAVADRLPRHRVMVAANALNFLSQGAFAALVLGGEPRLWQMMLLAALGGTGQAFFSPAAEGMLMSSVSGEQASRAFALFRMAMQGAALGGAALGGAMVAAIGPGWVLAVDAVAFAVAGSLRSFLDVSHIPPREPGGGLLADLRDGRREFTGRPWLWTIVAQFSVVVAVVGAAESVYGPLVARDSLGGAGPWGLALGAFGAGTVGGALLMTRWKPRRLLLAGTLCVFPLAAPSAALAVPLPVGGLCAVMFVTGVAIEVFGVSWMTALHQEIPEEKLSRVSAYDWFGSVAMVPLATALAGPAERAVGRTTALWGCATLVVVVTVAVLFVPDVRNLTRRTKAVAQEVPESGAADAGRGSADAEGSVGRLG

SEQ ID NO: 14559 - protein, 346 aa, Streptomyces avermitilis
MWPGQQPPGGEQNPQDQNPYQQPGYQQPNPYQQPEYQQPPGFQQPNAYPQQPGQPGQPGWGTPAPAGAPQSPGGGGGGGGNRTKVVAIVAATAVVVAAGVTGFLVLGNKKDDKADGGKDAKASGSASKDPSPSVSADNPRGGDDEKPTIKGWKVVVNPKWGTAFDVPADWEVQSPGVFIAFEDESGESTKPLVTMTGTAVLKEQWCSSDEDKDGRTEDTSLAAAGTKGANGAKNTDEVAVNQVAWWVYGGYTQPDKKSLTFDEKAKPYKTAAGIEGSIAWARSKNTPRKGKCASDGKAITFGFKNSAGDYVAWNFFGATGVNEEVPDATIMKVLSTVRLHGDPSES

SEQ ID NO: 14560 - protein, 322 aa, Streptomyces avermitilis
MWPGEQPPGGGQNPQQPPADAAQPNPYQQPGYHQTNPYEQQPQPQPWNAPTQPAGAPVPAPAGGGNRTKVVAIVAAAAVVIAAAVTGFVLLGGGKDDRADPDPTKSGSPRPSSSDPRGADTDRATIKGWKVVKNPQRHIAFDVPAQWALKASSWVTYVSENDDPDDTPLIGMSAPAYLEEQWCGSDDDRDGTKEYAPLAGAGSRRSNGAKTPAEAARDDAATWVYGAYTQPDKKLVTSGAVESYTTKSGITGSLATASSSGVEKSKKCRTDGKATVFAFKDDAGDIVSWAFFGARGVSDEVPDATVKRILGTVRLYKDPSDS

SEQ ID NO: 14561 - protein, 145 aa, Streptomyces avermitilis
MSIGEMLAATVPMARTLNLEFLETSPEKAVVALPDQSDYHNHVGGPHAGAMFTLGESASGAIVLAAFGEQLARAVPLAVSAEIAYKKLAMGPVTATATLGRPATEVVAELDAGRRPEFPVHIAIQRADGAVTGEMTVVWTLRPNG

SEQ ID NO: 14562 - protein, 181 aa, Streptomyces avermitilis
MHRRTSKKWPRVVAAGVTATAFLVLFGSTGHATPTAGPVSSAPAPATTALDPTAYRWKNAHGTRELDGHGYFKRSCVSFAAWAIRADGHPHTESPDFLGDAGHWRGAATSSVPHVGDIAQWDPGVHGTGRRGHVAYVAAVRDDGRVTLYEYNYRSEFNDQRPDVLSVRAAAASDASRYLRF

SEQ ID NO: 14563 - protein, 543 aa, Streptomyces avermitilis
VTDSAAAVFSSGVVVSSGVIDEFTLRLTLVLFVSVVVVTLFAALLTAPQRDEISEFYLGNRNMSPLRNGLAMCGDYVSAATLLGSTGLVALTGYDGLLYLGGTTVAWVLVLLVIAEPLRNSGRFTLGDTLALRLPHHQRPVRLALAVTTLVVTTLYLVAQLVGSVALLTQFVGEPSGTTRTLCVVAIGTVVVVYASLGGMPGATFIQVVKAVMLVSGVAITAFMVLHHYRWNVDALLAAAADNSGVGERFLASGLRYGGGTTSKLDFFSLQLAIVLGLAALPHVAMRLLAPRTGRVLRASVVWAMGLVGFVCLAAGVLGLGATAVVGRDAIARIDPKGDAAVLLLAQSLGGGVLTALISSLAFVTLLAVAAGLTLAAASSLAHDLYGQVIRKGRATQAEELGVARLSGVVVGVLGMLLALVSWEISTATLAFLAFAIAASAILPVLVYSLFWRRFTGRGALLSLYGGLICSVLLVVFSPVVSSTPASLYPDVDFAWFPLQNPGIVSIPAGFLLGWLGSVPGRHQDSARYADFEVRALVGTDHE

SEQ ID NO: 14564 - protein, 136 aa, Streptomyces avermitilis
MSWHSVPQDSLRPPPPADPELLPTQAIHDHPEFRAMRRAHRSFGARAATLGVGGYLLYVLLSGFAPGALNQPLAGRMTVGLALGLVQFVVLALVAWRHTVHMRRRVDPVARGLRAQLDRRRAEQPPLPGPRRYRSW

SEQ ID NO: 14565 - protein, 216 aa, Streptomyces avermitilis
LHVQEWLETVPAVSIYALVGLVIGLESLGIPLPGEIVLISAALLSSQHGGINPVILGICATVGAVVGDSIGYAIGRKGGRPLLAWLGNKFPRHFGEGHIATAERSFEKWGMWAVFFGRFVALLRIFAGPLAGVLRMPYWKFLIANVLGGIIWAGGTTAVIYYVGVVAESWLKRFSYLGLVAAVLIGLASMLVIKRKAKKAAAEREAAEPETVPAAD

SEQ ID NO: 14566 - protein, 178 aa, Streptomyces avermitilis
MTHKALITGIGGKDPKVDQEAFTAPTSVVIGEVTLHAGASLWYGAVLRADCGPIVVGADSNIQDNCTLHVDPGFPISIGERVSVGHNAVVHGATVEDDCLVGMGATVLNGAVIGAGSLVAAQALVPQGMRVPPGSLVAGVPAKVKRPLTDEEREGIKLNGTYYVELAKSHRAVHAQED

SEQ ID NO: 14567 - protein, 254 aa, Streptomyces avermitilis
VPRSKNTFSSWRRRLAQRAVHAGWAWAQRTGAVSAEHPGRLRFGAMGTATRLAFPQGTVFGEPWIHLGSHCIIAEQVTLTAGLMPDLDLGPDPILRIGDGVVLGRGSHVIADTTVTIGSDCYFGPYVYVTSTNHSYDDPHEPIGKQWPRMEPVSIGSGCWIGTGAVILPGARIGRNVVVAAGAVVRGVVPDHAVVAGAPARVVRRWTPADGWQPPLRTPAPVPIPEGVTPEQLLALSELDDESAARLAELDVES

SEQ ID NO: 14568 - protein, 288 aa, Streptomyces avermitilis
MAALPALFALATSLLWGLADFGGGLLTRRTPALTVVVVSQSIAVVVLGAVVVATGGWSEAGPQLWFAVAAGLVGPVAMLSFYKALALGPMGVVSPLGSLGVAVPVGVGLVLGERPGLLQFAGVAVAVTGVVLAGGPQLKGAPVQRRAVFLTLLAAVGFGAVMSLISEASTTVTGLFLALFVQRVTNVAAGGAALFIAVRRGAPALPESGFPWRALPALGFVGLADVAANGTYSIAAQHGPVTVAAVLASLYPVITALAARGFLSERLRGVQAAGAGLALVGTLLLATG

SEQ ID NO: 14569 - protein, 201 aa, Streptomyces avermitilis
LNSVIQNIGRNVSDLDLLTQSLARNVKRWRTERGFTLDTLAARAGVSRGMLIQIEQARTNPSIGTVVKIGDALGVSVTTLLDYEQGPKVRIVPADQAVRLWHTDAGSYNRLLAGTEAPGPLEMWDWLLMPGEGSPSDPHPNGSVELVHVTAGELTLTVDGVVHHVPTGASVSFEANVPHRYANSGDAPLEMIMTVSVPPVR

SEQ ID NO: 14570 - protein, 184 aa, Streptomyces avermitilis
MRAPIGDFDHATPAPDSLDELTRPVADAVRHWRGSVPADRIVYVDTEPEWADTAVFLEHYGKDLLDRSANCVVVAGRRGGETVLAACVVLSATRVDVNGAVRRRLGARKASFAPMDTATGETGMEYGGITPIGLPGGWPVLVDSAVVDLPYVLVGSGRRRGKLLVPGKAFAELPNAVVLEGLGI

SEQ ID NO: 14571 - protein, 391 aa, Streptomyces avermitilis
VTDRHQAHSHGPDHGPDRAHTHAHAHPHAHPDAQPHDRSRDHGPDRAPAHDHAHHHRPTTLLPRLRHLLTPHSHETADKLDSALESSARGMRALWVSLAVLGVTAAAQAVVVVLSGSVALLGDTVHNAADALTAVPLGIAFVLGRRAATRRFTYGYGRAEDLAGIAIVLTIAASAVFTAWAAIDRLLEPRPLNHLPVVALAAVIGFAGNEWVARHRIRVGRAIGSAALVADGLHARTDGFTSLAVLVGAGGAALGWPAADPLVGLAITAAIALVLRDAAREVFRRVMDAVDPALVDRAERALEEVPGVRDVGELRLRWIGHRLRAEVAVVVDGEVSVRQAHHIAVEAEHALLHAVPRLTAALVHADPAPLPGETDPHLALAHHTDPSVTAA

SEQ ID NO: 14572 - protein, 125 aa, Streptomyces avermitilis
MHLPPAHGAHSRTGGEPEAHPRTPGEEQFVLAAELLALLADRTRLALLHALTGGEADVSTLTQVCGAARPAVSQHLARLRLAGLVNTRKEGRRVIYSLRDGHLRRVVDEALSLADHRLSDRPAHD

SEQ ID NO: 14573 - protein, 186 aa, Streptomyces avermitilis
MSVRILALVGSLRAGSHNRQLAEAAVKHAPEGVEIELFEGLADVPFYNEDLDVEGDVPAAAARLRAAAGATDAFLLVSPEYNGTIPAVLKNAIDWLSRPYGAGALSGKPVAVVGTAFGQFGGVWAQDDTRKAAGIAGGTVLEDVKLSIPGSVTRFAELHPADDAEVVEGLTKVIEQLSSQAAPAAA

SEQ ID NO: 14574 - protein, 223 aa, Streptomyces avermitilis
MTQLLPPFPAPQDDPGGRTDLTLTPGGETPQLRADAARNRSRLLEVAARLAAERGAANVTMEAVACGAGVGKGTVFRRFGDRTGLLEALLDHHEKQLQAAFLTGPPPLGPDAPPVERLRAFGSAVIRREHTHSDLYLAAHAEAARRHTAPPYQLRLTHVCLLLRQARTEGDIELVAHTLLGYLDTILVDHLLTRRGMTLERVEAGWYDLVDRCTGGQSRCSTG

SEQ ID NO: 14575 - protein, 183 aa, Streptomyces avermitilis
MTTPGRRAEMFVAADRDPRVLGPATGTERTLLVDFLAAQRATLELKCSGLEAELSQRSVAPSTLSLLGLLRHLADVERRWFRQVMAAQDAPPRFSSPSDPDGDFTGAVPDLSVVAEAWRAWRSEVAFAEDYVAEAPHLDVEGHDSWRGTVSLRWVLVHMVEEYARHNGHADLLRERIDGATGV

SEQ ID NO: 14576 - protein, 371 aa, Streptomyces avermitilis
VQPLPISTAMRLTAVEAPDARGKAHDMSDHGHDHGPHGHTGHSGHSGHAGHSHGVSADADRRWLGIALALITLFMAAEVVVGVVASSLALISDAAHMLTDAASIVLALIAMRLAARPAKGGFTYGLKRAEILSAQANGLTLLLLGVWLAYEAVRRLVEPPDVEGGLMLITALAGIVVNVAAAWCISKANRTSLNVEGAYQHILNDLFAFIGTAIAGLVVVVTGFARADAIATLVVVVLMVKAGYGLLRDSGRIFLEAAPADVDPDALGDKLVAQAAVVEVHDLHVWQITSGQAALSAHVLVQPGSDCHAVRRDLEELLRQDYGITHTTLQVDHIPEQLLQVALRGDRIPPDGAPHCEDAHGPVHREEPHGH

SEQ ID NO: 14577 - protein, 135 aa, Streptomyces avermitilis
VYGDSATTRKILTELGDTWAIVGLSSNRHRVAYGVADVLQRFGKRIVPVHPKAETVHGEQGYPSLEAIPFPVDVVDVFVNSDLAGPVADEAVTIGAKAVWYQLGVVDEAAYERTREAGLDMVMDRCPAIEIGRLR

SEQ ID NO: 14578 - protein, 270 aa, Streptomyces avermitilis
VSEAHTGAPVGRARELGRRTHVRNGPHLPAPEGPGAYAHPVLRITDAGTGEPTDVRPGLTRIHAHVARADTSALRVLLVADVLARALELGGTPVVMVADPPAELRARADALGIRRAETDTLGGGRILHVLGPEDPVVDGIRVEVAPAGGPADSAESAGSSSAVRLALLAHPRSSPADLDSGALTEAQETLARWRKTVALWANHPSKPIPEHVRQELRAAWEDDLDLPAVLDVLRRLEGADDVPDGARFESYAYADRLLGLELTREIGAWA

SEQ ID NO: 14579 - protein, 182 aa, Streptomyces avermitilis
MNAPRPGTGPLRRLVVLRHAKSAWPAGVADHDRPLAPRGRRDAPAAGRVLAEADLLPDLALCSTAVRARQTWELAAAQWGTPPAVRLDARLYAADAPDLLAAVREVPGQVGTLLLIGHNPGLEELVLELAGDGVDDTLDRLGVKFPTSAIAVLAWHGESWQTLAPGTALLTELTVPRGHKHR

SEQ ID NO: 14580 - protein, 658 aa, Streptomyces avermitilis
VDSKDTAEPDEPGPSAATPRWRAWLLEGLSEQTARHPGPHATTDEGHAGHRWWRVMCLTGVDYFSTLGYQPGIAALAAGLLSPLATLVLVALTLLGALPVYRRVAHESPHGEGSIAMLERLLPWWAGKIFVLVLLGFAATDFLITITLSGADAAAHVVENPFAPHWLHGANTWITLVLVTALGAVFLKGFREAMGIAVTLVATYLTLNVVVLAVSAWEVLSHPVKIGDWTDAMTTEHSSPLAMAAVALLVFPKLALGMSGFETGVAVMPQVEGDPTDTYEKPTGRIRDTRKLLTTAAVIMSCFLLLSSLATTILIPQDEFRSGGAANGRALAYLAHQHLGEAFGTVYDVATIAILWFAGASALAGLLNLVPRYLPRYGMAPEWTRAVRPLVLVFMAAAVFITLWFNANVDDQSGAYATGVLVLMLSASFASTVAVHKRGHRGAATGFGAITAVFAYTLVTNVIERPDGIKIAAIFILAILITSFASRVRRAFELRAAAVTFDETASRFLDEAAASGPLRLIANEPQEHSTREYRAKEYSQREQTHIPDGRPVLFLEVFVTDSSDFTADLAVHGDEKHGVRRLRVEGATVPNTIAAVLMQLRDRTGEVPHAYFNWTEGNPFSQLLRFLVFGDGEVAPVTREVLRRAEPDPQRRPRVHVG

SEQ ID NO: 14581 - protein, 208 aa, Streptomyces avermitilis
MQDEYRTVAHAGVHETEINRSRFLCALAPAATEQEAQDFIAAVRKEHADATHNCYAYVIGAGAAVQKASDDGEPGGTAGVPMLQMLLRRDMRYVVAVVTRYYGGVKLGAGGLIRAYGGAVGEALDVLGTLTRKRFRLATVTVDHQRAGKVQNDLRSTGRTVRDVRYGEAVTIEIGLPDADVDAFRSWLADATAGTAGFELGGEAYGDA

SEQ ID NO: 14582 - protein, 498 aa, Streptomyces avermitilis
MNRSARTNDRFSNTRKKDGSAGSGRGARSGGNGRRPSTPQGEFALPVTVTPALPAAATFGELDLPAELLKTLTSLGVNEPFPIQAATLPNSLAGRDVLGRGRTGSGKTLAFGLALLVRTAGQRAEARKPLALILVPTRELAQQVTDALTPYAQLLKLRLATVVGGMSIGRQASALRAGAEVVVATPGRLADLIERKDCRLDRVSITVLDEADQMADMGFMPQVTELLDQVRPDGQRMLFSATLDRNIDLLVRRYLHDPVVHSVDPSAGTVTTMEHHVLHVHGTDKFATATEIAARDGRVLMFLDTKHAVDQFTKHLLGSGVKAAALHGGKSQPQRTRTLAQFRTGDITALVATNVAARGIHVDDLDLVVNVDPPSDHKDYLHRGGRTARAGESGSVVTLVLPNQRREMARLMSDAGIRPQITQVRSGEAELSRITGAQAPSGVPIAGSGPVTERPKRGGAPFRGMGTRPGRAGGESRRSAEARQTAEARKAARIRRGA

SEQ ID NO: 14583 - protein, 387 aa, Streptomyces avermitilis
LRILHTSDWHLGRAFHRVNMLGAQAGFIGHLVTTVRERGVDAVVVSGDVYDRAVPPLAAVELFDDALHRLADLGVPTVMISGNHDSARRLGVGAGLIGRAGIHLRTEVSACGTPVLLSDTFGDVAFYGLPYLEPALVRDQFGVEKAAHEAVLAAAMDRVRADLATRPPGTRSVVLAHAFVTGGEASDSERDITVGGVAAVPAGVFDGVDYAALGHLHGSQTITERVRYSGSPLPYSFSEAEHRKSMWLVDLGADGSIEAERVDCPVPRPLARIRGPLEELLADPGLTRHEEAWVEATLTDPVRPAEPMARLTERFPHTLSLVFDPERAPEDPDVSYARRLAGRSDQQIAEDFVAHVRGAGPDAREQAVLQDAFDAVRADEAVREVAR

SEQ ID NO: 14584 - protein, 999 aa, Streptomyces avermitilis
MRLHRLDITAFGPFGGAQTVDFDDLSAAGLFLLHGPTGAGKTSVLDAVCYALYGAVPGARQSGQGMTLRSDHAAPSTRTEIRLELTVAGRRLEITRQPPWARPKKRGAGTTTDKAQSRLREHDAAAGSWKDLSRSHQEIGEEITQLLGMSREQFCQVVLLPQGDFARFLRADAEARGKLLGRLFDTHRFAEVEKRLAERRRAVEAEVRAGDATLLADAHRMQQAVGDVVEVPLPDLAPGDPGLAETVLTWAAVARSTARERLTLAHCARTAAESAQAAADRVLDDVREVARLQRRYTEARERAALLEERSDAHREAQTRMERGRKAEAVAPALDLRDAAEAEHRRAATDEARARTALPETFADAGAPGLAAAARKAAEELGGLESARRAERRLGELTEERASLDRQERADDDVLQDAESWLATWEATRADLQAGIESAQEAATRAEQLAVRRDPAQARLAAARRRDRLSQDTDEARARALAAREHATDARVHWLDLKEQCLQGIAAELAAGLVDGAPCAVCGSLDHPAPARKITGHVDRETEERALTAYQRADETATVDERRLGSVREELAAATAEAGDAPTAHLAQEAAELERQHAEARAAASGLHTARQRLAQAELEHERRVADQQQAALRAAARVSHRDTIDRERASLEEELAKARGAADSVAARAAQLERRTALLTDAADAVRTAEDTAQRLKDADARLADAAFRAGFDTPGDAAAALLDDAAHRDLQRRLDAWQSEEAAVRAVLAEADTAAAARQPAAGLAAAEETAELAARRLRDTASAQDAAARRCAELDRLSTRALTSVRRLAPLREEHDRVARMAGLAAGTSADNERKMRLESYVLAARLEQVAAAATARLRRMSSGRYTLVHSDDRAGRGRSGLGLHVVDAWTGRERDTATLSGGETFFASLALALGLADVVTDEAGGVRLDTLFIDEGFGSLDDQTLDEVLDVLDSLRERDRSVGIVSHVADLRRRITAQLEIVKGRTGSVVRQRGGL

SEQ ID NO: 14585 - protein, 148 aa, Streptomyces avermitilis
MTTYSPDATDWRILDVLQREGRASFAELARAVSMSSSAVTERVRRLEEAGVIQGYAAVVDPDSLGLPILAFVRLRYPNGNYKPFHDLVAVTPEILEAHHVTGDDCFVIKVAARSMRHLEEVSGKIGALGSVTTSVVYSSPLPRRPLGR

SEQ ID NO: 14586 - protein, 228 aa, Streptomyces avermitilis
VNHSFRTGITGRRFSAMRVPYGRSRRTHRNGGAGREGTTMTTTTTPTTTTPTSPPTVKAPTVKAPTAKTATAKTADNPVLRVAPASPAAAAAYFGASLAFHADVSDVATALAAGGDPGFVVLDSRSTASWDQGHVPGAVHLPTALIPEQAEQLLDRSVPVVTYCWGPGCNGATRAALALAELGFQVKEMLGGFEYWVREGFEYETWEGRDHRVADPLTAPVDADDCGC

SEQ ID NO: 14587 - protein, 74 aa, Streptomyces avermitilis
MASCTDAGVGAVAWVESGGGPLIAVPEVVLPFWAGADGDELSTDYDRACDVDAFIGLVPVGDTRALVLGDDPGS

SEQ ID NO: 14588 - protein, 563 aa, Streptomyces avermitilis
MSETKSPLPREVADAYVDDLIALDPVTGTYLGDKASAGKLPDFSPAGHEALAKLTRTTLARLDEAERQPGADSDIERRCARLLRERLTAELAVHEADEGLRAVGNMDSPAHSVREVFTITPTDTDEDWASVAERLRAVPAALAGYRESLALGLERKLYAGPRPTATFIGQLTEWSDTDGQGRGWYEDFVASGPESLRTELDAAARTATGALVSLRDWMRDVYAPTIEGAPDTVGRERYARWSRYYNGTDLDLDEAYAYGWAEYHRLLAEMKTEAEKILPGAETPWVALAHLDEHGAHIEGVDEVRDWLQALMDQAIEALDGTHFELAERVRKVESRIAPPGSAAAPYYTAPSEDFSRPGRTWLPTMGLTRFPVYDLVSTWYHEGVPGHHLQLAQWAHVAENLSRYQATVGGVSANCEGWALYAERLMDELGFLTDAEQRLGYLDAQMMRAARVIVDIGMHLELEIPADSPFHPGGRWTPELAEEFFAAHSSRPADYVESELTRYLSIPGQAIGYKLGERAWLLGRENAKKRHGDAFDAKAWHMAALSQGSLGLDDLVDELSRL

SEQ ID NO: 14589 - protein, 154 aa, Streptomyces avermitilis
LLRLLQNDARTTYRDLAAQVGVAPSTCLDRVTRLRRAGVILGHQLRLDPAKLGRGLEALLSVQVRPHRRELVGPFVDRIRALPESRTVFHLTGPDDYLVHVAVADMADLQRLVLDEFTSQREVARVETRLIFQQWDCGPLLPPGPQVTPSAKSG

SEQ ID NO: 14590 - protein, 413 aa, Streptomyces avermitilis
VDDGRGAGGFGGGPAVRALDTEAVHAGRDDLARQGLHAAPIDLSTTYPSYDSRAEAARIDAFAADGAEPAGPPVYGRLGNPTVARFETALARLEGTDSAVAFASGMAALSAVLLVRNAMGLRHVVAVRPLYGCSDHLLTAGLLGSEVTWVDPAGVADALRPDTGLVMVESPANPTLAELDLRALAHACGSVPLLADNTFATPVLQRPAEHGARLVLHSATKYLGGHGDVMAGVVACDEEFARGLRQIRFATGGVLHPLAGYLLLRGLSTLPIRVRAASSNAAELARRLAADPRVARVHYPRIGGAMIAFEVYGDPHEVIAGVRLITPAVSLGSVDSLIQHPASISHRIVDAADRRGAGVSDRLLRLSVGLEDVEDLWADLDGALGTDRLPETAGAGREPSRTALRLPERAADR

SEQ ID NO: 14591 - protein, 477 aa, Streptomyces avermitilis
MTPDMSDVTRAKHGRPVHHWRRDVVELAALFTAVAVADAVANLIGHAPDGPALLVITAVVLAATAGFHTWWARRPGHAPPVDDTGPRPPAERQQAGPSDANAVAGATVLWRMRTTVQDEPGSLAALCTALAGQRVDILSLQTHPLAQGTVDEFLLRAPAQLAGAEVTYAISRAGGTGTWIERADAHDLVDAPTRVLGLATRTALDAAELPLALRQLLGRCTIRSLPAASPGSGRVNEGAPVEGALEGTVLRLRAPEGGVITVERPYLPFTPTEFARARALVELDARLGPRIPRSHDVLQLPEGSAITVRRADVSDLAAAKAMHERCSPRTLSMRYHGPLGDVDRYLNHLLSPRFGRTLAVQTASGRIVGLGHLLWDGDETEIALLVEDDWQRRGIGAELLGRLVAMAVEAGCENVYAVTQASNTGMVAAMRGLDLPLDYQIEEGTLVITARLDAAAVPPQPPYDPALGQHTGHGTRD

SEQ ID NO: 14592 - protein, 555 aa, Streptomyces avermitilis
LWFPCALRRTSSCGVAHRPESVPGGSSMSLLPLPGRRSVLRGSLAASAALTLPAMPGSAPAFALSGRPKAGWGVQAGDVTAHSGLVWVRSDRPARMIVETSATEAFRSPRRWQGPLVGANTDFTGTTRLHGLPAGEQIHYRVLLADPDDPRRTGEPVTGTFRTTPPGRRGGVRFLWSGDLAGQGWGINPDLGGYRIYDAMAGLDPDFFLCSGDSIYADGPISATAALPGGGTWRNITTEEKSKVAETLAEFRGNFRYNLLDENLKRFNAQVPSIIQWDDHEVRNNWYPGEVIADSDTRYTEKSVDVLAGRARRAFSEYFPISTLHPGAGEGRVNRVVRHGPLLDVFVLDMRTYRNANSPGRQTTDPQGILGAEQLGWLKRELATSRAVWKVIAADMPLGLVVPDTTEGKPNIEAVAQGDPGAPLGRELQIAELLRFIKHRRVTGTVWLTADVHHTSAQHYQPSRAAFTDFEPFWEFVSGPLNAGAFPASALDDTFGPERVFVKAPTASNVSPAGGYQFFGEVDIDGDSGELTVRLREQDGTVLFTQVLQPGRVGQ

SEQ ID NO: 14593 - protein, 495 aa, Streptomyces avermitilis
VPGGLGAVPGESGPAPSGQVSGAGESVSSGSAPWAAAWELLLPAAAAPARARGRGLQAALRTAVRSGRLAPGTRLPSSRELAADLGVSRGLVTEAYEQLTAEGYLRSGRGAGTWVGGAARAAHPRARDFAPRSPGARADFLPGTPDLSLFPRTAWAAAHRAVLAELPHHALGYPDPRGLARLRTALAELLARRRGVVADPERIVVVSGVAQATTLLGFVLHARGTTTVGVEDPGSPEHSALYASAGIGTVPLPLDEEGLATGPLRDSGVRAVVTTPAHQFPSGIAYSARRRAELLDWARSVNGLVVEDDYDGDFRYDRAPVGALQGLDPEHVAYTGSISKSLAPGLRLGWLLVPASIAEEVVERKRTMDLGNPVVDQALLARFVEGGDYDRQLRRCQRAYKERRDTLVSALEEHFPGAEVSGIAAGLHVIASLPDRYGPVDRFLKRAAAAGVAVRPLASYGTAPDDAVRLVLGYAHLPPARIRAGVRLMSDAVRG

SEQ ID NO: 14594 - protein, 388 aa, Streptomyces avermitilis
MNATTTRGALLAALACVLVGGSFTANSVLGHYPYAGGQFLRYGLACLLLLPLVGRGGTAPLRCLTSRQWVRLAALAAVGMVGFNLSVIAAERSAEPAVPGVFVGCAPVVVAVVMPLVEGRRPQRLVLCGASLVAVGAFTVQGWGRADGAGIAFSLSALAGEVGFAVLAVPVLRPLGPRLLSAVVCAMAAAESAAVGLVVDGTAWLRTPDRTEAAALLWQAAVVTVVGFVCWYMGMQRIGAERATLFSGLIPVAAACTAPLVGTGSYGAVQAAGSGLVGAGVALGSGALRRGAGRSATAVQDDPRDQRRIVVHRDVPATGQPHQPGPGDDLLRPHPLAADQEPVLGTPRHGDRHGGDVVRELDGGARLEGLGERRGVGQGERLGDDRLG

SEQ ID NO: 14595 - protein, 307 aa, Streptomyces avermitilis
LTVTGGYPSVAVADKLSTKASVSASPDKERPMSATVSFSVPSPRGPRTATVSYARVGAGEPLLLLHGIGHHRQAWDPVVDILATERDVIAVDLPGFGESPALPDGLRHDLSTVVPVLGALCEALGIERPHVAGNSLGGLLALELGREKLVRSVTALSPAGFWTPVERRYAFGVLMAMRQGARQLPLPVVERLSRTAVGRAALTSTIYARPGRRSPEAVVAETLALANAAAFSETLKAGTTVQFTDDIPAVPVTVAWGTKDRLLVRRQGVRAKQIIPRARLVRLPGCGHVPMNDDPALVARVVLDGSR

SEQ ID NO: 14596 - protein, 294 aa, Streptomyces avermitilis
VTTDAATEVFVEHRPVLMGVAYRMLGRVADAEDVVQEAWLRWSGADRSDVREPRRYLVRITTRLAIDRLRQLRSRNEAYVGPWLPEPYLTDFGDTVPDAAERAVLADSVSLAVLVVLESLSPLERAVFVLREAFGFPFADIAVTLERSEAAVRQLAGRARKHVDEGRPRYEVDPAERRDLTERFLAAAAEGDLEGLMSMLAPDVRLVGDSGGRARAPRRVLESADKVGRFLVGVTRKGVADVSFRSLEVNGGPALLVLSAGKPDSVFQLDVADGRIQCVYIIRNPEKLVSLSAG

SEQ ID NO: 14597 - protein, 253 aa, Streptomyces avermitilis
VGTTQLESVPEPKYWHLKTVLSEALDSEFSVGEILPNERDLAARFGVARATLRQALEQLELEGRLQRRRGVGTTVAPPRMGVAVGSEQHTWPGAAGDAWQPVDCTVAAPPPAVAGVLETGRNEQVHTVRRSRVTHGHPVAAELLYIPDFSVPDLSAIDAPSGAARARAVLRELQRLELEGQDRAVELGSARAEDAKELDRLPGAPVLVVTTRFFAEGRAAAVSVATYRADTCRLTFGDSGGVEIHHDPERRAS

SEQ ID NO: 14598 - protein, 385 aa, Streptomyces avermitilis
LGRLTGGDPSLLRRINSAVVLHALRAADCATLTEVTRVTGLSRPTVEGVVEGLIEAGLVVEKAAEEGAARRQGRPARRFRFRAEAGHLLGLEIGPHRVAALLADLDGRVLGAMAKDVDETASADERLERLRTAVAELLRRAGVARSSLRAVGVGSPGIIEADGTVRLGTALPEWTGLRLGERLNRSFKCPVLVENDANAAAVAEHWKGAATESDDLVFVLAGLSPGAGALIGGRLHRGYGGAAGEIGALHLLGRGATPETLLSTTDEPLHPLDERAVAEVFAHAREGDQRARAAVDRFIQRLVHDVAALALALDPELVVIGGWAAGLDGVLDPLRRELARYCLRPPKVTLSMLGEAAVATGALRLALDHVEEQLFAVEGTVTARR

SEQ ID NO: 14599 - protein, 220 aa, Streptomyces avermitilis
VPVTVLLVDDEPLVRAGLRAVLEAQPDIEVVGEAADGAAVIPLVRQLRPDVVAMDVRMPLMDGIEATRAVLRTVDRPPKILVVTTFENDEYVYEALRAGADGFLLKRARPAEIVHAVRLVAEGESLLFPASVRQLAAEHGDGGGNRAARAVMERAALTDREGEVLRLMARGLSNAEIAGQLVVGTETVKSHVSAVLAKLGARDRTQAVIAAYESGFVAPG

SEQ ID NO: 14600 - protein, 392 aa, Streptomyces avermitilis
MGRFLRPLSRGTTYTRLLHLWVPMLFESVWLFIDMRRWWMPALVLIPLGLIPAVRLGEGVQAQLLLAPGDRGGRNAAISAAPSATWGDRLRTVLWLEVRMALGAVTLGATVWLPTIAVDLVRSATGPAPVDNPLFRVSDPHWAYALLIPLTLLVLYGAVVGLGELITAVARGLLGPSAGERLAALEERTEHLLERTRIARELHDSIGHALTVAVVQAGAARAAGDPRFTDRALDAIEETGRAALEDLERVLGVLREAERPASSRPTLAEADRLLESARASGAKVEAEWSGPVESVPGPVSREGYRILQESLTNVIRHAGGVPVHVRIAVQDADVTLEIRNPLTTRPPGPGPGGGLRGSGLRGIRERAALLGGRARTGPADGDWQVHVELPLR

SEQ ID NO: 14601 - protein, 308 aa, Streptomyces avermitilis
MTSIDVQDLTKEYGTGRAVDRLTFQVLPGRVTGFLGPNGAGKSTTMRLVLGLDRPTSGTATVGGRPYAALHEPLRQVGALLDARAAHGSRTARAHLRALAASNRIPDRRVDEVLEETGLASVARRRVKTYSLGMRQRLGIAAALLGDPPVVLLDEPSNGLDPEGIIWIRELLRRLAREGRTVLVSSHLMNETASFADQLVVLGRGRLLADLPMREFIDARVQPRVRVRTSDGAVLGALLARHGYEAAEAEDGRWTVRHARVADIGRLASDAGVSILELAAEEGTLEQAYLDLTAAEAEFTTPTQPQEA

SEQ ID NO: 14602 - protein, 240 aa, Streptomyces avermitilis
MPFAPALHAEWIKIRTLRSLVGGLLAVFLVTVLFSALAGLDSEGPDFDPLFSAFFGVNFGQIAAIAFGTTAVSAEFEGGALQVSLAAMPRRGRWFAAKAVAIGVPVLAVGLVTGFVSLAVGKAVLGAEASGLTWDEGLRGALGCALYLTLMALFAAGLAALLRSGVATLSVLVPFLLIVSFVVGGASGTAADLLPDQAGRLVLHETSDSVLGPWTGLAVTALWAAAALFAGAWSVRRRDA

SEQ ID NO: 14603 - protein, 146 aa, Streptomyces avermitilis
MTIEQCLATIDLLCARPFPAEHGRTDVGSGGPGYHIAELGTSDGYGAEDCWDRAETAEECYERGEEVRDQLTGRWGPSDHIGLQTVQLRTETEDIPEPWVHLSARVGDIHLWRTEGNGRWIALGVADRDEADEIRLLVVVTEIDPP

SEQ ID NO: 14604 - protein, 146 aa, Streptomyces avermitilis
MTAATGHHFARPGNRFWPVLHLSGFTPRLLKPSEQGELLSYGLGITNVVARATARADELTAQEYREGGRLLGAKVERLRPRWLAVVGVTAYRAAFDDRKARVGPQERTIGASRVWVLPNPSGLNAHWTAATMAEEFGRLREAARDA

SEQ ID NO: 14605 - protein, 479 aa, Streptomyces avermitilis
VTAPAKPRIPNVLAGRYASAELATLWSPEQKVKLERQLWLAVLRAQKDLGIEVPDAAIADYERVLDQVDLASIAEREKVTRHDVKARIEEFNDLAGHEHVHKGMTSRDLTENVEQLQIRLSLELMRDRTVSVLARLGKLSGEYAELVMAGRSHNVAAQATTLGKRFATAADELLVAYGRVEELLGRYPLRGIKGPVGTAQDMLDLLGGDAAKLAELEQRIARHLGFSQAFTSVGQVYPRSLDYEVVTALVQLAAAPSSLAKTIRLMAGHELVTEGFKPGQVGSSAMPHKMNTRSCERVNGLMVILRGYASMTGELAGDQWNEGDVSCSVVRRVALPDAFFALDGLLETFLTVLDEFGAFPAVVARELDRYLPFLATTKVLMGAVRAGVGREVAHEAIKENAVASALAMREQGAERNELLDKLAADGRIPLDRAQLDELMADKLSFTGAAADQVAVVVGRIEEIVKQHPEAAAYTPGAIL

SEQ ID NO: 14606 - protein, 116 aa, Streptomyces avermitilis
VTTVVINLKGRIHDFGPRLEDAPEDLVYIGRRWTMGHWDLPQHPLYNPFAPDTPTRKRDGTRAEVMAKYRAYLVEHPELLAQVPALRGRTLACWCAPELCHGDVLAEIADGAAPPS

SEQ ID NO: 14607 - protein, 260 aa, Streptomyces avermitilis
MQTNANHTSLVAIGDSFTEGMSDLLPDGSYRGWADVLAGRMAARTPGFRYANLAVRGKLIGQIVAEQVDVAAAMQPDVITLVGGLNDTLRPKCDMGRVRGLLEEAVERLAPSCKQLVLMRSPARQGPVLERFRPRMEELFACVDDLAARHGALVVDLYGAPSLADPRLWDFDRLHLTAEGHRRVAEAVWQTLGYEAEDTEWHTPMPATLPPGWAARRIVDVRFARQHLLPWIVRRLTGRSSGDGLPAKRAELLPYEGPAA

SEQ ID NO: 14608 - protein, 337 aa, Streptomyces avermitilis
MTAVQLLIGLLTLVVNAFFVGAEFALISVRRSQIEPYAEEGDRRARSVLWGLEHVSALMAAAQLGITLCTLVLGVVAEPAIAHLLEPVFHAVGVPAGAGHAVSFVIALTLATYLHMLLGEMVPKNIALAEPVRSALLLGPPLVTLARTLRPVIFAVNAFANGLLKLLRVETRDEVTATFSDDELARLVKDSVDAGLLDDRAQERLHDALELGRRPVRDVVLPLERVVYARVGITPEQLERLSAESGFSRFPVVDEGRRIVGYLHVKDALDATPRDVPFAVRDMRPIARVRETTPLDDVLTAMRGSRTHLAAVLGSDGRLAGMVTMEDVLRQLFGQPA

SEQ ID NO: 14609 - protein, 448 aa, Streptomyces avermitilis
MTEVLLLLVAILLSVACGAFVAAEFSLTTVERSELERAAERGERGAAGALKAVRNLTFQLSGAQLGITVTNLVVGMLSESSIAKLIAGPLESVGVSPSVSNSVALVIGTALSTVFLMVVGELVPKNWAISSPLAVAKRVGTPQRLFSSAFRPFITHLNNTANHVVRRFGLEPAEELASARGPQELVALARHSAKAGALEADTAELFVRTLNLADLTAENVMTPRVQVVALDVQATCEDVANATRATGLSRFPVYRGNLDSVVGIAHIKDVVAVPAEERTRRPVSRVMREPLFVPESLTVDRLLDRLGGKRTMAIVIDEYGGTAGVATLEDIVEEVVGEVRDEHDPHETPDLAPAGTDDDGRALYSADGATRIDQLARVGLRAPDGPYETLAGLIAAELGRIPAEGDTVEVAGWRLDVVDASGRRAARVLLHAPGAQDEASSVSHERER

SEQ ID NO: 14610 - protein, 141 aa, Streptomyces avermitilis
MTELRMRAAAPEDLSAVLAFWKTAAEGTSISDDRDGVQRLVARDPEALILAERDGELVGTVIAGFDGWRCHLYRLAVHPQRRRLGIGSALLAAAEERFVRLGGRRGDAMVLRRNETAHHAWRAAGYTPEEQWRRWVKPLAD

SEQ ID NO: 14611 - protein, 296 aa, Streptomyces avermitilis
MARPFRFGVNLLDPAPAEEWRAKCRRAEELGYDVILVPDHLGMPAPFPALVAAAEATERVRLGTFVLNAGFWNPALLAREVATTDALTGGRLELGLGTGYVQAEHDTAGLPYGSPRERVDHLVRTVEELERLLGSPEHRPGIVQKPRVPLLIGGNGDRMLRLTAEHADIAAFAGAHLVPGSTTGKLAPVTAGELDERVARYRRLAADRAEPAELNLLVQMVAVTEDRAAAVQGLRERVPQLTEEQVLELPIVLVGTPAQITAQVLAQRERYGFSYLTVLEPYMEAFAPVIEALRGA

SEQ ID NO: 14612 - protein, 855 aa, Streptomyces avermitilis
VLKATLRSFLAHKGRLLLSALAVVLSVAFVAGSLIFSDTVTRTFDRLFASTAADVTVQPKEDLTSQVPTGATETVPAALAERLKSVDGVAATHVDAAVQNITVVDVRNEPVGSTTGAPTIATNWDPTDRSPVRLTSGHAPHGSGEALLDADTAEKKHVRIGDTLTVLAQPGSFKVRIVGIATFTTTNPGAALVFLDTPTAQTKLLGRADAATSISVDAAKGVSDAQLKRRIAAELGSGTYDVQTADEQATSDAADLGGFLDVIKYVMLGFAGIAVLVGVFLIVNTFSMLIAQRTRELGLLRALGADRRQVRRSVLTEALLLGLVGSTLGLAAGIGLAAGLIKLMGAFGMNLKSTEMVIGWATPVTAYVVGVGVTFLAAYLPARRAAGVSPMAALADAEIAGVGRPLKVRGVVGTVVGVLGAAALAGCATSSKTASAASLLGLGVVLTLIATVIAGPLLVRPVIRVLGAAFPALFGPVGRMSQRNALRNPRRTGATAAALMVGLALVGGMSVASASMSASFDQQIDKTLGADFVVQNSNFLPFPQEVTDKVRATDGVGLVVRQRFTPVAVRLPDDKRVETTAAGYDNRLDDVAHITYTQGDTAAALAGGGIAMDADFAKKHDARIGSTVAVEFPGGRKTELKVAALTDQEGSDGFGMQGGLYFGIATVEKYLPGGQDSALYVNAGSGTGADRLRPRLERTLDPYPQVQVRDQADYKKLVHDQIAVLLYLVYALLGLAIVIAVLGVVNTLALSVVERTREIGLLRAIGLARRQLRRMIRLESVVIAVFGAVLGLALGLVWGVCVQQVLALQGMRVLAIPWTTIVAVVVGSAVVGIVAALLPALRASRMNVLAAIAHD

SEQ ID NO: 14613 - protein, 294 aa, Streptomyces avermitilis
LSTPAAEHAPGRPEADGFAARTRGLTKAYGSGETTVLALDSVDVDIARGRFTAVMGPSGSGKSTLMHCLAGLDSVSAGQVWLGNTEITGLKDGELTRLRRDRIGFMFQSFNLIPTLNAVENITLPMDIAGQKPDQKWLDQVIDTLGLRDRLRHRPAQLSGGQQQRVACARALASRPELIFADEPTGNLDSRAGLEVLGFLREAVDELGQTVVMVTHDPGAAAHSDLVLFLGDGRIVDEMARPTAEAVLERMRLFSGGPSQTPESDTNHAASDGAVPPGAVPPGGDSADGTPDQD

SEQ ID NO: 14614 - protein, 79 aa, Streptomyces avermitilis
MAKTQLNVRVDEGTARAARERALERGMSVNRYIEELVRQDTGEAGHTFVEAAADFMKQYETVFAEEFGADREGTRESRR

SEQ ID NO: 14615 - protein, 124 aa, Streptomyces avermitilis
LENLRIDLAWLLMIAEQKTPGDPQVTDWGALVAAVSRHEAEIFGIPVYDTPHARAAALLQLLLHVPALERSNALFASAVAYAYLVAGGAKVVTSPEQVRELARLVKSGEAGVDDIARELRQWSL

SEQ ID NO: 14616 - protein, 228 aa, Streptomyces avermitilis
MPLRSAGSGKASRDAVHHPLFARSYARISVTAETRLGMGGVRDRLLAGLSGRVIEIGAGNGLNFAHYPGAVSEVVAIEPERLLRQLAVEAALRCDVPVDVVPGAAEALPVKSEAFDAAVVSLVLCSVRDVSRALGELRRVLRPGGTLRFFEHGAGGGRAMAATQRALDRTVWPRLNGGCHLTRDAVSAVREAGFELGPYRRMLLPEKGPRLPTSYCVLGTAWRPGSAD

SEQ ID NO: 14617 - protein, 228 aa, Streptomyces avermitilis
MQRRVRRVTAVFSAAVASILLSLSLAAVPARAATHDPVIFVHGISSSASSWDDWIADFEADGYTASELDAWSYDWSQSNVTTAQQLATEVRSVLARTGASKVDLVVHSMGALSARYYLKNLGGTSYVDDFVSTAGVNHGTTVASWCKWLYTSCSEMYTGSSFLTSLNSGDETPGGVAYASYWSNCDDLLTPDTSAILSGATNVEVGCVSHTDMNNDYGVYQQVRTFVG

SEQ ID NO: 14618 - protein, 741 aa, Streptomyces avermitilis
VVTSVNPSPLPRTSTPQVTHAWPRLDPPLPEGVRVRVLRAAHGDPRAALELASVLSTRQLTGLDPLPADPASLVPATLRAHRREIRALPDDTRLLLLLAAADQYPVATHAFLRAVAAARLDTRPLDAAETAQLAHTTPGGIVFRDPWTRIAAYETASAADRREAHQLLGRVLSGAGEAPRRFWHRGAAALGPSRRLAAQLGPAAAQARRAGEHALACALAERAAALTPDPHERPRLLARAAADAWQSGDGDRARRLIAATDNDALGGLLALRAGNAGDAFDALLAAAARHAAAAHALPPGAPDPAVHLLARATEAAIYTGDLRRCREAAAVADRLGIVPSGTLGGLAAAFEGRYADARDLLQAAAGRCGPGGDPTLLIHSGIAALLLGDHTGAATATARAAASARTRGETVTVPQAMEFRAYAEFWTGRPRAAEAGALESLRQAYTTGQDNGACHLQAALAMFAALTGDAEVCRDRAEAARSYALPRGLGLPAALALFALAFLDLSTGRFAAAAARLRALAAFGPGHGHRAIRHLATPHYVEAAVRTGDTRVARAAHADYDHWARTIRNPDELALSARCRALLAGGPEAVDHYRTALDLHACGTRDFERARTELLFGGALRRLRRRAEARDRLHSALAAFEHFGAPQCAAQARAELRVLGGLGGLGEPSAPARGADDLAARLTAQQLMVARMAAEGATNREIAARLLLSPRTIDHHLRGVFARLGIRSRIELVRLLGETDV

SEQ ID NO: 14619 - protein, 238 aa, Streptomyces avermitilis
MSVLVITGTGTEVGKTVTTAAVAAVAVAAGRSVAVLKPAQTGVRPDERGDADEVARLAGAVTTLELARYPEPLAPATAARRAGLPPVGPHEVAEAAAKLAVEHDLVLVEGAGGLLVRFDDADGTLADAARLLDAPVLVVASAGLGTLNTTELTARELRRREIGFAGVVIGSWPESPDLASRCNLADLPAVAGAGLLGAIPAGAGAHSPVGFRAGAPGWLAPRLGGTWDADTFASAFVP

SEQ ID NO: 14620 - protein, 437 aa, Streptomyces avermitilis
VPERTSRPMPDLSLAELLDLDRRHVWHPYGPMPGRQEPLVVEAASGVRLRMADGTGELIDGMSSWWSAIHGYNHPVLNEAAREQLSRMSHVMFGGLTHEPAVRLAKRLVDISPEGLEHVFLADSGSVSVEVAVKMCLQYWRSLGRPGKQRLLTWRGGYHGDTWQPMSVCDPQGGMHELWQGVLQRQVFADAPPVAYEESYADQLRELIERHADELAAVIVEPVVQGAGGMRFHSPAYLRVLREACDAHDVLLVFDEIATGFGRTGALFAADHVGVTPDVMCLGKALTGGYLTLAATLCTARVADGISRGEVPVLAHGPTFMGNPLAAAVANASIDLLLGQDWQTEVKRIETGLREGLAAAADLPGVRDVRVLGAIGVVQLDRPLDEAAMAAATRAAVREGVWLRPFRDLVYTMPPYVTGDADVARIAGAVCAAAREG

SEQ ID NO: 14621 - protein, 388 aa, Streptomyces avermitilis
MDLLNTLVEKGLRRELPSRAEALAVLATSDDDVLDVVAAAGKVRRHWFGRRVKLNYLVNLKSGLCPEDCSYCSQRLGSKAEILKYTWLKPDEASQAAAAGLAGGAKRVCLVASGRGPTDRDVDRVSDTIKAIKDQNEGVEVCACLGLLSDGQADRLREAGADAYNHNLNTSEGTYGDITTTHTYADRVETVQKAHAAGLSACSGLIAGMGETDEDLVDVVYSLRELDPDSVPVNFLIPFEGTPLAKEWNLTPQRCLRILAMVRFVCPDVEVRIAGGREVHLRTMQPLALHLANSIFLGDYLTSEGQAGKADLEMIADAGFEVEGADQVTLPEHRAPAGGCGSEQSAGCGSHEGGGACGSAPAPRTDEARTDLVAVRRRGAGTDLAPNA

SEQ ID NO: 14622 - protein, 375 aa, Streptomyces avermitilis
WRSAGSTSRRTRAAGPVSYAPCARAPPTRPSSISRATTTSASPAIPRSPRARPRRPGRGAAAPPAPASSPAPRNCTANSNASWPTSAASRRPWSSPPGTRPISPRSPRSPRTAPSSPTRATTPGSSTAAGWRGAPPRSSRTPIRTPCARRWGRTRARPSPSRTRSSRWTATRPRWRTSPKPAGSTVRGWSTTRTGSASSATAAGAPPGRRGSRARRTWSRSRCPSRSAARAAPCSVRPGSTTSTRPVRSSSTPGWPRRRRARPSRRCGCCAANRSVPHGPVRWRRNCTPGRRRATKRYGRTPPSSPCGRPPPSRRCGGRRTAGRRVSPSAVSAHRPCPTASPGGPLARTSPTVRSTVPCGSARRGHTSARPCIAP

SEQ ID NO: 14623 - protein, 384 aa, Streptomyces avermitilis
RRPGRPLGGGARGRAGRGRDGHAVQVARQPGRRRARSGPGDRPPDQRGPYVHLRHRAGPGGGGRGPRGAAAAAPRTGACRTGPYGGEGTAHPADGGGPRSGTAGRRRRLRAGALPRAGGAVGGGLPGGGSRRRLFPPTVRARRHLPAEADRSRGPHRRSDRPCRAGDRRDAAIRRRNGRASHLVRDERSAVSPVRRRIPPRPRGRTAGRGRSRSSSRGRRPGRPRGRGPAGPSRRSCSFPVLRLLRSHRTPGREVLEDTHRGSAVMVPPYEPSPNAAHVIQRVLGKGVEPKGVEGLAVGLEVFFPLEIEATRQVVENNHIQIRSARKGEDNERPGDSDVGPRGERQYLKPHLRQLGRLQQPFQLLRHDLRAADLPAQHRLVEDR

SEQ ID NO: 14624 - protein, 59 aa, Streptomyces avermitilis
VCGGCAAAAARGMNNCVETARPGPGPWAGLVAVRDSKNVSGPALLFAPEAWEGFVAGLD

SEQ ID NO: 14625 - protein, 283 aa, Streptomyces avermitilis
MQYGPAVRRRKLGAELRSLRARAGLTSGQAAGLVGWHQSKVSRIETGSSGVKPPDVRLLLDVYGVEDPELRELLLVLAGSDDGGVRQNWWHAYRGVLPPTYRDFISLESQASAMRTLETSVVPGLLQTPEYARAVTRAAVGSAEDAKLDTLVEVRLARQDVLRSNPPLELTAVLDEAVLRREVGGPEVMTQQLERLLEAAKLPQVRLQVLPFAAGAHIGITGPFVIFSFPSRSDLDVVVLDHLTSSLYLERKEDLQAYSEAFDTLRFHALSPKDTLDYMRRIR

SEQ ID NO: 14626 - protein, 152 aa, Streptomyces avermitilis
MADHQEASVTLPSDPASVSAARKYVASVLAEWGLPGDAEVADTVRLIVSELATNAVQHTFGQSPTFTVDIALDRDEHLHIGVTDSHPRFPKRLPAAVQQDNGRGMVIIRWLTAECGGRMRVRPTREGGKTVLIELPWAVSAQPVTAGGQQEP

SEQ ID NO: 14627 - protein, 184 aa, Streptomyces avermitilis
VTRAETVTRSPMADRPARALRDETSLERADRNFAELLQELRVTQTGVQILFAFLLTLAFTPRFPALDTVQRATYVTTLLLSMLAAALFTAPAAVHRGLFQQNAKPTIVRLSSRLASIGLGVLMLAFTGSVLLVVDVALGRGAGIAAGAGTLAVCVALWVVLPLMAQRSALARPAGPEAEPRREP

SEQ ID NO: 14628 - protein, 157 aa, Streptomyces avermitilis
MSALNRVPSLLTRAGTASALTLAAVGGSIAVPGVASDAAAATPATKALQIAASKKGSPYKWGAAGPRRFDCSGLTLYAFKKAGKSLPRTAAAQYNKTHHVSASHRKAGDLVFFHSGRSVYHVGIYAGKGKIWHSPKTGEVVKLQKIWTKSVWYGRVS

SEQ ID NO: 14629 - protein, 102 aa, Streptomyces avermitilis
MLPPELPPLPALTRAEAELIDRYLDVVDLLGRINPARPGDTYRGLRAAQALVGKATALRDALTLMHQRGESELHAPTLAQALRVLDGERRAARVTVPPRSDS

SEQ ID NO: 14630 - protein, 211 aa, Streptomyces avermitilis
MNRPSARYALPEFTERLSTGLRTLDPYSKLLDERIVFLGTPIDDTSANDVMAQFMHLEHLAPDRDISLYINSPGGSFSAMTAVYDTMQFVSCDVETICLGQAASAAAVLLAGGTPGKRLALPGARVLIHQPSLPAPVQGQASDLVIQAAELARTREQLEELLVRHTGQSPERVAADIERDKILDAPAAVAYGLVDRVVPSRKSSAAAPGAR

SEQ ID NO: 14631 - protein, 91 aa, Streptomyces avermitilis
MAYEIPVTQARAELADLINRVVYGGERVVVTRHGKPLVALVSAADLERLDKLDAAEEQVVSAVSSVREVAAAPRERQRFGIAAEHRGPNAS

SEQ ID NO: 14632 - protein, 93 aa, Streptomyces avermitilis
MTAPYTVRSSTTSRAVPTWGWRSVSNAPSCRSRCRRMRPVAAAGPGMPSGRPPGGHGRRVRVAGRPTATGAPFSPVRDPGAGGHQKERAFGPS

SEQ ID NO: 14633 - protein, 100 aa, Streptomyces avermitilis
VQLTPHEQERLLIHVAADVAEKRRARGLKLNHPEAVALITSHILEGARDGRTVAELMSSGRKLLTRDDVMEGIPEMIHDVQVEATFPDGTKLVTVHDPIV

SEQ ID NO: 14634 - protein, 103 aa, Streptomyces avermitilis
MIPGEILFADGPVAYNEGREVTRLTVLNAADRPVQVGSHYHFAEANPGLDFDRAAARGKRLNVAAGTAVRFEPGIPVDVELVPLAGARVVPGLRGETGGALDA

SEQ ID NO: 14635 - protein, 573 aa, Streptomyces avermitilis
MPEISRPAYADLFGPTTGDRIRLADTDLLIEIEEDRSGGPGLAGDEAVFGGGKVIRESMGQARATRADGTPDTVITGVVIVDHWGIVKADVGMRDGRITGIGKAGNPDTMDGVHPDLVIGPETEIIAGNGRILTAGAIDAHVHLICPQIADEALGSGITTLVGGGTGPAEGSKATTVTPGPWHLARMLEAMEEYPLNFGLLGKGNTVSHDAMLSQIRGGALGLKLHEDWGSTPAVIDAALTVADRTGVQIAIHTDTLNEAGFVGDTLAAIGGRGIHAYHTEGAGGGHAPDIMSVVSEPHVLPSSTNPTRPFTVNTAEEHLDMLMVCHHLNPAVPEDLAFAESRIRPSTIGAEDILHDLGAISIISSDAQAMGRVGEVIMRTWQTAHVMKRRRGALPGDGRADNHRVRRYVAKYTINPALAQGLAREIGSVETGKLADLVLWEPAFFGVKPHLVIKGGQIAYAQMGDANASIPTPQPILPRPMFGAIGRAPASNSFNFVAPLAIEDGLPERLSLGKRFVAIESTRGVTKADMRENDARPRVRIDPDSFAVHIDGELVEATPAAELPMAQRYFLF

SEQ ID NO: 14636 - protein, 224 aa, Streptomyces avermitilis
MSRAALLVLADGRFPAGGHAHSGGAEAAVKAGRITDAASLENFCRGRLHTAGLVSAALAAAAALGIDPVTLDSAADARTPSPALRVAARRLGRQLMRAARATWPSTELDALAREFPKGAHQPVVLGMAARAAGLAPDDAAYCSVYESVSGPATATVRLLSLDPFDATAVLARLAPELDRIAHQAAGAARQALDDGVDMLPAASAPLLEISAEAHAAWPVRLFAS

SEQ ID NO: 14637 - protein, 227 aa, Streptomyces avermitilis
MHLDHAHTHDGPSAVSADAHRPDGTRRALRIGLGGPVGSGKTATVAALCRALRDAFSLAVVTNDIYTREDAEFLLREAVLPPERITAVETGACPHTAIRDDISANLEAVEDLEDEVGPLDLVLVESGGDNLTATFSKGLVDAQIFVIDVAGGDDIPRKGGPGVTTADLLVVNKTDLAPYVGSDLGRMAADAKAQRAELPVVFQSLRTEPGVAPVADWVRARLAAWAA

SEQ ID NO: 14638 - protein, 252 aa, Streptomyces avermitilis
MTAAGVRATARIGARGDGRGGTSLPVLEGEGPLALRRTRASGSEARVMLVGAMSGPLGGDHFTVEATVAAGARLHVGSAAATIALPGQAKGEARYDVLLDVAAGGELRWLPEQLISAGGSELYVSTRIDLEPGARLVFREEQVLGRVGEEPGRLTSRLTLRIGGRAVLDQELACGPGAPGGWDGPAVLGGHRALGQLVVVRPEFEREPVRARLLGESAALTPLGGAAALVTALAPDALLLRRVLDEALSSLG

SEQ ID NO: 14639 - protein, 531 aa, Streptomyces avermitilis
LRGMRPTRRVTALGSAGALVTATLIAGAMAAPSATADSRHGQDREARGAAIAAARAAKAGIDWQDCPADWGFAKPIQCGWVTVPLDYARPNGKKIKLAVDRIGNTGTKEERQGALVYNPGGPGGSGMRFPTRVTNKNPIWTNVAKAYDFVGFDPRGVGHSAPISCIDPQEFVKAPKADPVPGSEADKRAQRKLAAEYADGCAERSGDMLPQMTTPNTARDLDVIRAALGEKKLNYLGVSYGTYLGAVYGTLFPGHVRRMIVDSVVNPSREKIWYEANLDQDVAFEGRWKDWEDWVAKNDATFHLGDTRAKVQKQWLTLRATAKKSPLGGVVGPAELISFFQSAPYYDSSWVPVATTFSKYVAGDTQALVDAAAPDLSDTAGNIASENSNAVYTAVECTDAKWPTSWKKWDKDNTRLNKDYPFMTWANAWMNLPCATWPAKQHTPVNVKTHKGLPAVLIVQSENDAATPYDGAVELHKRFKGSRLITEKDAGSHGVTGLLNPCVNDRVNTYLLTGGTDGADVTCAPHATPKP

SEQ ID NO: 14640 - protein, 241 aa, Streptomyces avermitilis
VFYYVLKYVILGPLLKLVFRPRIEGLEHVPSSGPAIVAGNHLSFSDHFLMPAILKRRITFLAKAEYFTGPGIKGRLTAAFFRSAGQIPVDRSGKDAGQAAIREGLGVLRKDELLGIYPEGTRSHDGRLYKGKVGVAVMALRAGVPVIPCAMIGTFEAQPPGKVIPNIHPVVIRFGKPLEFSRYAGMENEKAVLRAITDEIMYAILTLSEQEYVDRYAAVVKAEEAAEKAAKARKFPRIPLS

SEQ ID NO: 14641 - protein, 408 aa, Streptomyces avermitilis
MTAPARTRSSADLIRAEAPVLAHNYHPLPVVVARAEGTWVEDVEGRRYLDMLAGYSALNFGHRHPVLIEAAHRQLDQLTLTSRAFHNDRLAQFAESLAELTGLDMVLPMNTGAEAVESAIKVARKWAYEVKGVAPDQATIVVAADNFHGRTTTIVSFSTDDTARTGFGPFTPGFRIVPYNDLAALEAAVDETTAAVLIEPIQGEAGVVIPDDGYLAGVRELTRRTGCLFIADEIQSGLGRTGRTLAVEHESVVPDMLLLGKALGGGIVPVSAVVARRDVLAVLRPGEHGSTFGGNPLAAAVGSAVVGLLETGEFQRGAAELGVVLRDGLAALVGKGVVGFRARGLWAGVDIDPAIGTGREISERLMREGILVKDTHGSTIRLAPPLTITGEELASALGTLEKVLTQEA

SEQ ID NO: 14642 - protein, 289 aa, Streptomyces avermitilis
LVSTPSRHRRKRRYPSVAESRVPRPRRFLVCEPSHFGVQYAINPWMHPDTSVDVDLARGQWQALINAYRAHGHTVDTVQPVADLPDMVFAANSALVLAGRVFGSYFHAPQRRPESTVYDSWFKAAGFDVYRPESVCEGEGDLVPAGRYVLAGTGFRTTVEAHREVQEFFGVPVISLRLVDPYFYHLDTALFVLDDGHEANIVYYPEAFSPGSREVLQRLFPNAVLATREDALAFGLNSVSDGRHVFISPGATALADQLVRHGYVPVPVDLSEFFKAGGGIKCCTQEIRS

SEQ ID NO: 14643 - protein, 167 aa, Streptomyces avermitilis
MNSKPTTFDDLDRKIITALTAHARSSFAEIGAAIGLSATAVKRRVDRLRETGVITGFTATVKPSALGWRTEAYVEVYCEGAAPPRRLAEVVRNHPEITAAMTVTGGADALLHVRATDVEHFEEVLERIRAEPFIRKTVSYMVLSHLLPESPEAGASQPAPQDASDLR

SEQ ID NO: 14644 - protein, 251 aa, Streptomyces avermitilis
MLRALAVDDEQPSLEELLYLLNADPRVSSAEGASDATEALRRINRALESGPGGPEAIDVVFLDIHMPGLDGLDLARLLTGFAKPPLVVFVTAHEGFAVQAFDLKAVDYVLKPVRRERLAEAVRRAAQLTDTAPLIPVHEPDPDHMSVELGGVTRFVPVEDITHVEAHGDYARLHTAQGSHLVRIPLSTLEERWRARGFVRIHRRHLVALRHIDELRLDTGTVSVLVDSVELQVSRRHARELRDLLMRRTTS

SEQ ID NO: 14645 - protein, 119 aa, Streptomyces avermitilis
VPQDPTERRVVVTGPPRRARRAFDYYRPRTEIDEQTTLGHTYVRSLMRSQLRAGLAVFAVLVLLVGPLPLVFAAIPDARRLTWAVLGFCLYAPLVLLARWYVRRAERNERDFVRLVEDR

SEQ ID NO: 14646 - protein, 575 aa, Streptomyces avermitilis
VNSSYAVPAVALVVLATVLVGAFGLRISRTTSDFYVASRTVGPRLNAAAISGEYLSAASFLGIAGLVLVQGPDMLWYPVGYTAGHLVLLLFVAAPLRRSGAYTLPDFAEARLASQAVRRLAGAFVVGVGWLYLLPQLQGAGLTLAVLTGAPDSLGGVIVAVVVVATVAAGGMRSITFVQAFQYWLKLTALLVPALFLVLAWQGAGAPRTAFDEPAAFREQRVVTVDESLDLKLSRPLDVTASGTVDGRRYRGKRVALAPGVHRVEGGTRLTFAEGDPVPAADRGGNGGMSTSLAAGREERPLYATYGLILATFLGTMGLPHVVVRFYTSPHGVAARRTTVAVLGLIGAFYLLPPVYGALGRLYAPELGLAGDADAAVLLLPDRLIGGLGGDLLGALLAGGAFAAFLSTASGLTMAVAGVLTQDVLPSRGVRHFRLGTVLAMAVPLAASALVGGLPVADAVGLAFAVSASSFCPLLVLGIWWRRLTPPGAAAGMLVGGGSALVAVGATMAGYPRGGALHALLAWPALWSVPLGFLTMTLVSLATPGRVPAGTAAILARFHLPEELSGGPVRAEAKA

SEQ ID NO: 14647 - protein, 401 aa, Streptomyces avermitilis
VSGFLAGLCVAVLPLLAAGFWLGRRTARPESLGGLGTPVEHATFQTLHTASLAAPPLRAGLTEETARKSTRRLRTLLGTDALCLTDPETVLAWDGVGEHHRTEIMERLAGPLESGRGEAFRLTCDIPDCPLRWAVVAPLTVDERVHGALVACAPRESAVLVRAAGEVARWVSVQLELADLDRSRTRLIEAEIRALRAQISPHFIFNSLAVIASFVRTDPERARELLLEFADFTRYSFRRHGDFTTLADELHAIDHYLALVRARFGDRLSVTLQIAPEVLPVALPFLCLQPLVENAVKHGLEGTADKRHISITAQDAGAEAWVVIEDDGAGMDPEVLRRILAGEVSPSGGIGLSNVDDRLRQVYGDDHGLVIETAVGAGMKITARLPKYQPGVHSAGRLPRE

SEQ ID NO: 14648 - protein, 245 aa, Streptomyces avermitilis
VAHLPPGGGDAKPYGAAVALAAPLKDGDCVVADWPGAAFQGTPKLAVDPTCAEKVPDGQVMAVVAATSAEAARQHGPAACEQRTQEIREKLADVRSYAVVPTRAGFEAAGRRTACLVLGAHGAVYGPLDRHRTPGMWFVDTANMQKRDCLDAPSLRRAQLVSCAGPHDQQVLGFTRLSAGTTLKKAAAQSDAACARDVPPAQYGYDPGVYEAASWAAKGAWHSGTHLVVCSVQRQNGGTMEGTEP

SEQ ID NO: 14649 - protein, 692 aa, Streptomyces avermitilis
MPSGSPQSGVGRVIAGRYLLLNRLGSGGMGHVWLAHDQRLACEVALKEIVFRSPAEAGQERTARVARARAEARHAAGLRGHPHVVTVHDVLEHEGLPWIVMEYVAGALDLRDLVRRRGPLAPAECARIGLAVLDALTAGHERGIMHRDVKPANILLAPDRTGAAYARVLLTDYGISVQPDAGETRYTLTSALVGTPGYLAPERATGGPPTATADLFSLGCTLYFGVEGCGPFERDTHLAEVTAVVLEEPRPPVRAGALEPVLAAMLAKDPGQRITAEDTEAALSAIVTPQPHPRTQFDLGSQPPWAEAGWTTETGYPGHGPGAGPGGNGTSGAYGPGGTGSGAGSAPGSPPPGATAGTAGRGTPSEPGPVRGPAAGPSGQDPNAAPYAHDPATPSYGQEPGAPRPGPGPTASPYGRSPTAPSYGQSPAATPYAHDPTASPYGQSPAATRTARPQCLLVRFGCHRPARRSGVRCRWFRFRSAASQAPSCPSVRHRLHPRPRPRAGRCLVRGGASAARRRRREALRSGRGPRRAAQGRRLRRRRLARRRLPGHAEAGRGPDLRREGAGRPGHGGRRGDVRRGGAAARSGRVRAAHAGDPGEARRRAQLRRGADAGGIRGGRAAHRLSGAGRARCGVRAARPSPHARHVVRGHGEHAEAGLSGRPFPPQGPAGLLCRTARSASARLHPAQRRHHP

SEQ ID NO: 14650 - protein, 486 aa, Streptomyces avermitilis
MTFCMPMQRAGKSVVRRLGILLVCALVLSGCDRGPQLLTVKAVAARVPSLAPFFDEESGLGHDSTVRRQQPHSGLQAGNTPGLYGGTRKPTICDVNRLKKFLTDPRNDRKAHVWAQVLKISQDEIPAYLDRLTPVLLRHDTLVQNHDYKKGRAAPFNSLLEAGIAILVDEQGLPAVKCSCGNPLRPFAGDASRISVKFENGNKKWDGYDRASLVAVKPAPRRIEQLALVDVDNPDRGITRPAGTTGAHDSPFDTHERHKVPEVAGMGFGDASQRLADKGLAAAYGEKGPPPDDARVTGSDPAPGTELEFGEYVTLSVERGTAGKTGRGSGDGTTGETGEGRTGGTSAPPASGSTTPGGSGQPPPSSGGATTSSPPPASSPPSSATSGGPPGASRSSGSSESSEPPPASSASASRPPPAVSSPPPAVSSSPPTSRPVTSAPVTSAPVTSAPVTSAPATAQPVTSDPVASDPVASGPVAGEATSTTTA

SEQ ID NO: 14651 - protein, 317 aa, Streptomyces avermitilis
MDHSGGHGMTTDLPPFTLGRGLEWSADPFFLVACLLGLGLYGWGVVRLVRRGDKWPVGRTVAYVIGVLTVMLMMCTRLNDYGMVMFSVHMVQHMVISMLSPILILLGAPITLALRALPTAGRDRTGPRELLLMLLHSRYLRIVTHPAFTIPLFIASLYALYFSALFDFLMGSKVGHIGMMVHFLAVGVVFFWPIMGVDPGPHRPGYLLRMLELFAGMPFHAFFGIALMMASEPMVNSYKNPPASLAVDALTDQNAAGGIAWAFSEIPSVLVLLALLFQWYNSEQRQARRTDRAADRDGDKELEAYNAYLASLNARGN

SEQ ID NO: 14652 - protein, 341 aa, Streptomyces avermitilis
MRIGVLTSGGDCPGLNAVIRSVVHRAVVDHGDEVIGFRDGWKGLLECDYLKLDLDAVSGILARGGTILGSSRVQPAHLRDGVERARGHVAELGLDAIIPIGGEGTLKAARLLSDAGLPIVGVPKTIDNDIAVTDVTFGFDTAVGVATEALDRLKTTAESHQRVLIVEVMGRHTGWIALHSGMAAGAHAIVVPERPFDIEELAAKVGERFEAGKRFAIVVAAEGAKPRAGSMDFDEGKKDVYGHERFAGIARQLSLELEERLGKEARPVILGHVQRGGTPTAYDRVLATRFGWHAVEAVHRGEFGKMTALRGTDIVMVSLAEAVETLKTVPEERYAEAECVL

SEQ ID NO: 14653 - protein, 242 aa, Streptomyces avermitilis
MTDNQLRLVWIYPDLLSTYGDQGNALVVERRARQRGLDVARLDVRSDQPIPTSGDIYLIGGGEDRPQRLAAERLRRDGGLHRAVGNGAIVFSVCAGYQILGHEFINDLGQREPGLGLLDVVSTRGEGERCVGDVLGDIDPRLGLPQLTGFENHQGVTHLGPSARPLAQVRLGKGNGTGDGTEGAYNDTVFGTYMHGPVLARNPLIADLLLKLALDVNALPPIDDRWYEALRGERIAAAQQPA

SEQ ID NO: 14654 - protein, 412 aa, Streptomyces avermitilis
MAGNSDPLTPRAKLAVTAGKAVAAASRAAGRGSGSVIGGRVALKLDPDLLARLAQHLDVILVSATNGKTTTTRLIAEALRAAGPVVSNALGANMPAGITSALAGGSDAKYAVIEVDEKYLAGVARDTDPKCIALLNLSRDQLDRAAETRMLAEHWREGLAGSKAVVIANADDPLVVWAASSSANVIWVAAGQMWKDDAWSCPSCGGVMQRPGDDWFCGECGFRRPTPSWALSGDHVLDPHGSAWPIHLQLPGRANKANAASSAAVAAVFGVPPQVALERMYAVQAVAGRYDVVQFMQRDLRLLLAKNPAGWLETFSLIDPPPTPVILSVNARGADGTDTSWLWDVDYTRLTGHPIFVIGDRKLDLAVRLEVANQSFQVCENLDQCVQQAPPGRIEVIANYTAFQDLRRRVGN

SEQ ID NO: 14655 - protein, 186 aa, Streptomyces avermitilis
MRHGSIPGTRGHVRPLALLGDPVLHAPCEEVTDHGPELARLVEDMFATMYAANGVGLAANQIGVPLRVFVYDCPDDEDVRHVGHVVNPRLIEADGVVLRGPEGCLSLPGLEAGTERYDRAVVEGFTTDGEPVRVLGTGWFARCLQHECDHLDGGVYVDRVSGWRHRRVMRQAARAPWNRQRAPEPR

SEQ ID NO: 14656 - protein, 232 aa, Streptomyces avermitilis
VLVCAGVTENSTGGERLMDTTQQRTDQQRSADRRRRELLEAADRVVLRDGPGASMNAIAAEAGITKPILYRHFGDKSGLYAALAKRHTDALLDSLRAALDAPAERRERVESTLDTYLAAIEARPQVYRFLMHPSEGGSQSDQGFDTGKNSVPVLRRMGEELAQVIEERLDLGPGSQQLARVWGHGIVGMMHAAGDWWLGERPCSRAELVRSLADLLWGRLAAAGDKIGGPGF

SEQ ID NO: 14657 - protein, 409 aa, Streptomyces avermitilis
MAEFTMELNDEQKEVRDWLHGFAADVIRPAAAEWDEREETPWPVIQEAAKVGIYSLDFYAQQYFDPTGLGIPMAMEELFWGDAGIALSIVGTGLAAVGVLANGTEEQIGTWIPQMYGDANDVKVAAFCSSEPDAGSDVSSMRTRAVYDEAKDEWVLNGTKTWATNGGIANVHVVVAVVDSELGSKGHASFIVPPNTPGLSQGQKFKKHGIRASHTAEVVLENARIPGSCLLGGKEKLDERLARARERARAGGGERVKNAAMATFEASRPAVGAMAVGTARAAYEEALEYAKTREQFGRPIIDNQGVAFQLADMRTSIDAARLLVWRASWMAVNGKPFTAAEGSMSKLFASETAKKVTAQAVQILGGNGFTREYPVERMHRDAAIYTIFEGTSEIQRLVIARTLSGMPIR

SEQ ID NO: 14658 - protein, 175 aa, Streptomyces avermitilis
MTATEGLLVPPGHGRVVRTPAQHVTFKVTGTHSRMASSFEVVVPPGFDVGAHVHTRSEELFYVLEGELDVLAFEPRVRTPDNWKHWESRSGTRVVRATPGTVIVVPPGCPHAFANPTDTPAKMFFQASPPPDHERYFDELLEILGSGGPPDHAAIEELRARYDIQQLTPLRLKHH

SEQ ID NO: 14659 - protein, 404 aa, Streptomyces avermitilis
MTEKTITEALPPVRHWPALNLTGVEFDPVLSQLMSEGPVSRIQLPNGEGWAWLVTRYDDVRMVANDPRFSRAAVMGRQVTRLAPHFIPTAGAVGFLDPPDHTRLRRSVAAAFTARGVERVREKSRRMLDELIDELLRGGPPADLVETVLSPFPIAVVCELMGVPAADRHSMHTWTQLILSSAHGAEVSEKARNDMGAHFERLIGERRGSTGEDVTSLLGAAVGSGEITLDEAVGLAVLIQIGGEAVTNNSGQLFYILLTRPDLAERLRAEPKIRPQGIDELLRYIPHRNAVGLSRIATEDIEIRGVRIREGDTVYVSYLAANRDPDVFPDPERIDLTRSPNPHVSFGFGPHYCVGGMLARLESELLVEALLDRVPGLRLAVPPGLVPFKKGALIRGPEALPVTW

SEQ ID NO: 14660 - protein, 352 aa, Streptomyces avermitilis
MATLCKPAVSVPEHVITMEETLELARSRHPDHPQLPLALRLIENTGVHTRHIVQPIEETLKHPGFEERNHVYEAEAKARVPAVVQRALDEAELLTTDIDVIIYVSCTGFMMPSLTAYLINSMDFSSDTRQIPIAQLGCAAGGSAINRAHDFCTAYPQANALIVACEFCSLCYQPTDLGVGSLLSNGLFGDGIAAAAVRGKGGTGITLERNASYLIPKTDEWISYDVRATGFHFLLDKRVPGTMEPLAPALQELASQHGWDASDLDFYIIHAGGPRILDDLSKFLRVPPEAFRFSRATLTEYGNIASAVVLDALRRLFDEGGAEHAARGMLAGFGPGITAEMSLGRWHRTDEA

SEQ ID NO: 14661 - protein, 238 aa, Streptomyces avermitilis
VGGQQSSEAEGVAAMARTARELLETTTGRLAPDPHANRLLPLIARGAARRTTLAALALEQRHVIAADRQAFLHLAQRSVNEPECAAFFDILTESEDLAGDRLAAYAAACGVDEAWTAAYEPLADCQTYPAYVAWLALNGSPADVVLALSANFATWGGYCATIAEALRRHYGFDDAACGFFDLFAEPAPELEQKAQAAVQAGLDYGLVDEDEAQRYGRLLQGYEARFWHALWELDQRTA

SEQ ID NO: 14662 - protein, 79 aa, Streptomyces avermitilis
VNREVTLPLIVDDRGTLQVSAADVSKLLRTVGGRWLHLVEAGQDGLDEDTVATLTIELAKLADRIDVACIAHSSGTTAG

SEQ ID NO: 14663 - protein, 464 aa, Streptomyces avermitilis
MPIATVNPATGETLKTYEALDAEAIERRLAAAQSAFRTHRTTTFAERARLLHRAADLLDEDQRDIARVMTTEMGKPVKQARAEAAKCAKAMHWYADHAEELLADEEPADSDVKDSGASRALVRYRPLGPVLAVMPWNFPLWQVVRFAAPALMAGNVGLLKHSSNVPQTALYLEDLFRRAGFPDGCFQTLLIGSGAVEGILRDPRVRAATLTGSEPAGRAVASVAGDQVKKTVLELGGSDPFVVMPSADIDRAAKTAVTARVQNNGQSCIAAKRFIVHTDVFDAFAERFTAGMAALKVGDPLDEDTEVGPLSTEQGRTDLEELVDDAVENGATVLCGGERPEGYTERGYYYAPTVLTDITPEMRIHLEEAFGPVATLYRAADLDEAVAIANDTPFGLSSNVWTREDAEVDRFVRDLEAGGVFVNGMTASHPAFPFGGVKRSGYGRELSGHGIREFCNITTVWHGA

SEQ ID NO: 14664 - protein, 154 aa, Streptomyces avermitilis
VSGKRSAGLLLFRHTDDGIEVLLGHMGGPFFARRDAGAWSVPKGEYEPDEPAWDAARREFQEELGLAPPDGQAVPLGEVRQANGKIVTAWAIEADLDPATVVPGTFTMEWPPKSGRSQEFPELDRVEWFGLDRARAVIVKGQTGFLDRLAEHSG

SEQ ID NO: 14665 - protein, 512 aa, Streptomyces avermitilis
MLLSRLAHVSREVAATSARSRKIALLAELFRDADADDVPIVIPYLAGRLPQGRLGIGWKLLGRPVTPASEPSLTVRDVDARLTAVGAVTGTGSQAGRGRLMGELMAAATDVEQAFLRGLLTGEVRQGALDAVAVEGLAEATGAPPADVRRAVMLAGSLQTVARALLAEGPGALDGFRLTVGRPVLPMLAHTAGSVAEAVGKLGACAVEEKLDGIRVQLHRDGDHVRIYTRTLDDITDRLPELTAAALELKGDRFILDGEVIALDGNGRPRSFQEIAGRVGSRVDVAAAAASVPVSPVFFDALSVDGRDLLDLPFTERHAELARLVPEPLRVRRALVSGPDDGAAAETFLADTLARGHEGVVVKALDAPYSAGRRGASWLKVKPVHTLDLVVLAAEWGHGRRTGKLSNLHLGARAADGSFAMLGKTFKGMTDAMLTWQTERLTELAVEENGSVVTVRPELVVEIAYDGLQKSTRYPAGVTLRFARVVRYREDKTPAEADTVETLLAAHPEVTR

SEQ ID NO: 14666 - protein, 329 aa, Streptomyces avermitilis
VEVVTMTERYEVVVVGGGAAGLSAALVLGRARRHTLVVDAGEPRNAPAAHLQGFLTRDGMPPAEFLAEGRREIGRYGVELVQGRVVDVVRGGVGAFEVTLAGGRTVHARRLVLATGLVDELPPVPGVAERFGRDVLHCPYCHGWEVRDEAFGVLASTPMSVHQALMVSQWSKDVTLFLHTVGEDELTHDDRRRLAAAGVTLVSGEVAGLEVDEDRLTGVRLADGTTRDRSVLFVAPRAVPRTDLFDRLGAELRETPFGTYPVVDETGLTTVPGVWAAGNAIGFAEQLVNAASGGYRAGAVINGDLLFADLDAAAGPAASGEAENAAERV

SEQ ID NO: 14667 - protein, 206 aa, Streptomyces avermitilis
MGMSEEEQSEEEQSEEVQTDAVLAEVGPRLRRIRKERGATLAGLSEATGISVSTLSRLESGLRKPSLELLLPIARAHQVPLDELVGAPPVSDPRVRAKPIVRHGRTHWPLTRQPGGLQAFKVLEPQRKLEPDLRTHEGYEWLYVLSGRLRLVLGEHDVVLGPGEAAEFDTRVPHWFGSTGEGPAEFLSLFGPQGERMHVRARPTRS

SEQ ID NO: 14668 - protein, 347 aa, Streptomyces avermitilis
MGKRPLSMRSTPVRRAVPWRPRMQAWQVHQNGEPSEVMRLEDVERPVPGEGQVLLKVRAANINFPDALLCRGQYQVRPPLPFTPGVEICGETEDGRRVLANPVLPFGGFAEYAVADAAALLPAPDALDDAEAAALHIGYQTGWFGLHRRAHLEAGETLLVHAAAGGVGSAAVQLGKAAGATVIGVVGGADKAAVARELGCDVVVDRRTEDVIGAVKEATGGRGADVIYDPVGGAAYTQSTKVVAFEGRIVVVGFASGTIPSPALNHALVKNYAILGLHWGLYNTKNPKLVQHCHEQLTELATRGAIKPLVSERVPLGGAAAAVQRVADGVTTGRVAVVPSLENGATA

SEQ ID NO: 14669 - protein, 393 aa, Streptomyces avermitilis
MTDAAELRRLTQELLAAHPPETTDRLDFLKDRFDAGLAWVHYPEGLGGLGVPRTLQAVVDAELEAAGAPDNDPRRIGIGLGMAAPTILGYGTEEQKRRYLRPLWAGEEVWCQLFSEPGAGSDLAALGTRAVREGDEWVVNGQKVWTSSAHVARWAILIARTDPDVPKHRGITYFICDMTDPGVEVRPLRQITGEAEFNEVFLTDVRIPDSRRLGDVGDGWRVAQTTLNNERVAIGGMRLPREGGMIGPVAGTWRERPELRTHDLHQRLLKLWVEAEVARLTGERLRQQLVAGQPGPEGAGMKLSFARLNQEISGLEVELLGEEGLLYDDWTMRRPELVDFTGRDAGYRYLRSKGNSIEGGTSEVLLNIVAERVLGLPSEPRTDKDVAWKDLAR

SEQ ID NO: 14670 - protein, 376 aa, Streptomyces avermitilis
MEGPRPMTTRSTQPDLLYSEEEEALRAVVRDLLRDHCGAADVIARTESDAPHDRALWKALADGMGLAGLLVPEAQGGQGASHREAAVVLEELGRAVAPVPYLTSAVVATEALLAGEGDEAAKLLAALASGRTVGALAVALSVAPGGAYRAVRHEDGALHGELTGIADAAAADVLLVPAEDGGLYAVNADDTATVTITPQVSFDLTRPVATVTFEGAPARRVGAAEPAVRRALRAGAGLLASEQLGVADWCLTETVRYLKERKQFNRPVGGFQALKHRLAQLWLEVVSLRAAARNAADALATGSADSDVAVAVAQAYAAPVAVRTAEEALQLHGGLGMTWEHPVHLYLKRAKADSIAYGTAGGHREALAELVDLRAP

SEQ ID NO: 14671 - protein, 286 aa, Streptomyces avermitilis
MALTTRRRALTTLGAALAGSVALPAHARASERGHGPRPLRRAHAHNDYEHPRPLFDALGHRFGSVEADIYLVGDQLLVAHDPADLDPARTLESLYLDPLAARVRANHGSVYRGWRTPLQLLIDIKTEGSSTYLELDRHLRRYRNLFTTYAHGRVHPGPVTAVISGDRAARTPMEAQSVRRAFYDGRLTDLGSSAPASLIPLISDNWTLNFSWLGAGPFPGAERQKLRGIVAAAHARRQKVRLWATPDRAGPDRDALWAELLAADVDYVNTDDLAGLEAFLDAHERP

SEQ ID NO: 14672 - protein, 64 aa, Streptomyces avermitilis
MAISISVVLLLLILVVVFVRNGALKLSHCLICVLLGFFLAGSSMAPTIHNGLLATADIVSSLHP

SEQ ID NO: 14673 - protein, 409 aa, Streptomyces avermitilis
VTRRGGRLRTVLTVLTAWSALAGAALAGAAPAGGAPRSVPLAPGVEYTQFDIPADRGVTHAHLLSVDLADPRVRVGLLHPGAVAARAPVSRLADSQGALAGINGDFFNITETQHPGVEATGSTDGPAIADGHTLKAAVPNGQRFGPALPPGTTTEDVLGVGDDRRARLDRLALEGSVDTAAGELPLRGLNQYALPEGSVGAYTADWGSVSRARAVCGTDTDRAAPCSTDTYEVTVRDGQVVSFADSPGSGPIAAGTTVLVGREAGAQQLRKLSTGEEVSVEHRLVAAGSQVAYSFAIGGYPVLRQGKPLPGLDTVTSAVRTAVGIKDAGRRLLLLAIDGAAAYRSGLTIAEVASVMRGLGATEAFSLDGGGSTTLVARAPGATSVTVRNHPSGGAERPVPNGIGVFTRT

SEQ ID NO: 14674 - protein, 122 aa, Streptomyces avermitilis
MDPTVEMVPRVELTPAAAELVRRLRAAHGPLMFHQSGGCCDGSAPMCYPDGEFRTGGSDVLLAELEVEGVDEAVGFWMSRNQYEVWSHTRLIVDVVPGRGSGFSLEAPEGVRFLIRSRVVDA

SEQ ID NO: 14675 - protein, 255 aa, Streptomyces avermitilis
MSRHRNPATPVRLDFALDRNSPVPLYYQLAQQLEHAIEHGALGPGSLLGNEIEFAGRLGLSRPTVRQAIQSLVDKGLLVRRRGIGTQVVHSQVKRPLELSSLYDDLEAAGQNPATRVLRNEVQPASAEVAAALGLAEGGDVHHIERLRLAHGQPVAFLSNHVPAGLLDLGTARLEATGLYRMMRAVGITLHSARQSVSARGATAQEAERLDEHEGAALLTMRRTAYDDTGRAVEYGTHIYRASRYAFEFQLLVRP

SEQ ID NO: 14676 - protein, 629 aa, Streptomyces avermitilis
MSQVPMDQSTRRLTVAQALVRFLSAQYTERDGVRHRLIAGTWGIFGHGNVAGIGQALLEAGEQAMPFHQGRNEQAMVHAAVGYARQLGRLSAQAVTTSIGPGATNLVTGAALATINRLPVLLLPGDYFATRAADPLLQQLEHPVEADLSVNDTLRPVSRYFDRITRPETLVPSALAAMRVLADPAETGAVTLALPQDVQAEAYDWPEEFFAERVWRVRRPAPDPVELAEAARAIRGAERPLIVAGGGVHHSEAETALRELVDATGIPVASTQAGKGSLRHDHPADLGGIGHTGTAVSDDLARTADLVIGVGTRYTDFTTASATLFRNPGVRFVNLNITAFDAHKLAARPLVADARAGLEALAEALAGHRVDAAYEAEYRSGKERWERVVADAFRADDENAVPTQTQVLGALDSVVGDADVVINAAGSLPGDLHKLWRARSPRQYHLEYGYSCMGYEIPAGIGVQQAAPGTPVWSLVGDGTYLMMPTEIVTAVQESLPVNLVLIQNHGYASIGGLSESVGGERFGTAYRYRAADGTFSGAPLPVDLAANAASLGMDVIRAKTVRELRDALAEARASDRPTCVYVETDPAPTAPPAQAWWDVPVAEVASREAAVDARATYDGHTAERRRHL

SEQ ID NO: 14677 - protein, 301 aa, Streptomyces avermitilis
MTTTHHLPAGKAANGPYTVDISPESAGWGHSSLRVLELPAGGWHSFDTGDSEWIVLPLAGSCTVAVGGETFRLAGRESVFSGVSDFAYVPRDAQVSLASRGGGRFALTGARCTERLPARYGPAAAVPVELRGTGTCSRQVNNFAAAVPAGGDAGQGFACDQLIAVEIITPGGNWSSFPPHKHDEHRPGEESELEEIYYFEIAAHDGTPGLGYQRVSPSGHGRGTDVLAEVRSGDTVLIPDGWHGPSMAAPGHDMYYLNVMAGPGAERDWLIRDHPDHAWIRATWPDQPVDPRLPRYTAPSQ

SEQ ID NO: 14678 - protein, 292 aa, Streptomyces avermitilis
LTISIPDLATVRARHPEAIAEAAGRRTRRPLIGESGRLLIVAADHPARGALGVGGRGLAMAHRADLLERLCVALSRPGVDGVLATADILEDLLLLGVLENKVVMGSMNRGGLAGASFEMDDRFTGHRAEDIERLRFDAGKLLLRIDYADQGSSATLESTARAIDDMAARRLPVFVEPFISRRVDGTVRNDLGAEAVTRSIAIASGLAGTSAYTWLKLPVTEDPDDMGEVLEASTLPAVLLGGEVGEDQEGAYERWRKALRLPTVQGMVVGRSLLYPADGGVATAVDTAVGLL

SEQ ID NO: 14679 - protein, 318 aa, Streptomyces avermitilis
MPDSVETFDLITMGRIGVDLYPLQPGVPLPQVESFGKFLGGSAANVAVAAARLGRSTAVITRTGNDPFGTYLHQALEEFGVDDRFVTPVDAYPTPVTFCEIFPPDDFPLYFYRQPKAPDLEIRTEELDFFALRAARIFWITGTGLSEEPSRSATLAALKARTKGGTTVFDLDWRPMFWQDPRAARPYYAEALRHATVAVGNLDECEIATGVREPRACAEALIEAGVELAVVKQGPKGVLAVHRDGTTAEVPPVPVEVVNGLGAGDAFGGSLCHGLLAGWELERTMRYANAAGALVASRLACSSAMPTLDEVEDLVARG

SEQ ID NO: 14680 - protein, 339 aa, Streptomyces avermitilis
MDRTFYPRSRRIAPLVAAAAASALLVAGCSSGSGGKKAEEGGSGASAGKANTPRMTVALVTHQAPGDTFWDIVRKGAQAAAAKDNIKLVYSADPNAGNQANLVQNAIDQKVDGIAITLAKPDAMKSVAAKAEKSGIPVVGLNSGLSDWKSLGLMEFFGQDEGVAGEAFGKKLNEVGAKKAVCVVQEQGNVGLTQRCAGVKKTFKGTTVNLYVNGTDMPSVKSTITAKLKQDSSIDYVVALGAPYALTAVQSVSDAGSKAKIATFDLNKELTSAIKKGDIQFAVDQQPYLQGYLAVDSLWLYKNNGNYSGGGEQPVLTGPAFVDKTNVETVAEFAAKGTR

SEQ ID NO: 14681 - protein, 357 aa, Streptomyces avermitilis
MTQATAPATSPSSPASPAAPKDGRTGERSLGRRLLARPEVGALIAAVGVYVFFFAVAPSFRDASALSTVLYQASVMGIMALPVALLMIGGEFDLSAGVAVTTSALTAAILSFQLTMNVWTGVFVALLVSLAVGAFNGWLLIKTGLPSFLVTLGSFLVLQGANLAVTKIFTDNVASDSIADMDGFEQAKKVFASEFDIGGVSFKITIVYWLVFAAAATWLLLRTKFGNWIFAVGGNKDSARAVGVPVGLTKIALFMGVGAGAWFVGMHLLFSFNTVQSGEGVGNEFLYIIAAVIGGCLLTGGYGSAIGPVIGAFIFGMVSQGIVYANWNPDWFKAFLGAMLLVAALVNLWVRRQATRR

SEQ ID NO: 14682 - protein, 303 aa, Streptomyces avermitilis
MTTNGTPPDGTPVEETGPADAEPIVELRGAGKSYGNIRALHGVDLSVRPGRVTCVLGDNGAGKSTLIKIISGLHQHTEGEFLVDGAPVHFNTPREALDRGIATVYQDLATVPLMPVWRNFFLGSELTRGPWPVRRLDIARMKRTADDELRNMGIVLDDLDQPIGTLSGGQRQSVAIARAVHFGARVLILDEPTAALGVKQSGVVLKYIAAARDRGLGVIFITHNPHHAYMVGDHFSVLRLGTMELNAARSEVSLEELTNHMAGGAELAALKHELAQVRGVDVEGLPDADDLQAPVAAASEGTS

SEQ ID NO: 14683 - protein, 300 aa, Streptomyces avermitilis
MTPALDRIRVGSAPDSWGVWFPDDPQQVPWQRFLDEVAEAGYQWIELGPYGYLPTDPARLTDEVARRNLQVSAGTVFTSLHRGPSVWDATWEHVGQVAALTRAMGARHLVVIPSFWRDDKTAEIIEPPELTGEQWAHLAKGMERLGHEVKETYGLDIVVHPHADTHIDTEAHVERFLDSTDSGLVNLCLDTGHYAYCGGDSVKLIETYGERIGYLHLKQVDPDILAEVRAGEVPFGPAVQRGVMCEPPSGVPELAPVLTAAQRLGVELFAIVEQDMYPCPPDQPLPIARRTRTFLRSCGA

SEQ ID NO: 14684 - protein, 394 aa, Streptomyces avermitilis
MENEGSGAARRPLGVAVVGFGWMGRVHTQAYARVLHHFPQLAVRPELVTVAEEVPGRAEEAAAQFGFARTARDWREVAADPRVHAVSITAPNFLHREIGVAMAEAGKHIWIEKPVGLTLEDARAVSDAVTKAGVQGTVGFNYRNAPAVETARELIASGEIGTVTHVRIRLFSDYAAHPHGALTWRYERERGGSGVLGDLASHGVDLARFLLGDIASLTADTAVFVPERARPTGATAGHTLATGGEPGPVENEDYVSCLLRFASGARGVLEACRVSVGEQNNYGFEVHGTRGAVFWDFRRMNELGVSRGTSYQDQPLTTVHVGPGHGEYGAFQPGAATSMGYDDLKVIEAYRFLRSIAEETPYGATLPDAVHSAAVLEAMAASAESRAWVDVPTP

SEQ ID NO: 14685 - protein, 338 aa, Streptomyces avermitilis
MSEAQSEGRPTIRTVAERAGVSKSLVSLVLRGSEQVRPEKREAVLRAMAELGYRPNAAARSLSEQRTRTVGVLLNDLRNPWFVDLLDGLNSLLHDNGLHMILADGRLNRRIGQDLTRPFLDLQVDGLIAVGTLPDPAALGTAAARIPVVVAGTREPVLPGVDVVANDDEHGARLATEHLIGLGHRAIAHIAGYGAVGDLRRRSFEATMHAHGLADDALVEPSDMTEEGGYRATVRLLSGPRRPTAVFAVNDIASVGALSAADELGLRVPRDLSVVGYDNTSISRLRHLWLTTVDTASHDVGRRAARCLLDRFTDPGRPAGVHLSTPTLEIRRTTAAPS

SEQ ID NO: 14686 - protein, 119 aa, Streptomyces avermitilis
VESPRHRDQPCGQAQHTAADLEVSPLSDRPGVRAAGEVTLTTLTEWERALDQLVRRREDALYVELSAVTFIDVAGASALALAAQRLPAGQHIHLDRPPFGLRRMFEMFWPDLLTIEMVA

SEQ ID NO: 14687 - protein, 310 aa, Streptomyces avermitilis
VMSTAAPADPFVHPALFYRGDRQYVAGTVPFVLDGLSAGEPVAVAVPGPQLKLMKTELGADADQVHFLDMTQAGRNPGRIIPGVLRAFADARSTARVRIIGEPIWPGRTSAEYPACVQHEALINAAFRGREVTILCPYDADGLDEKVLADAYATHPLVIDEGRELASAAYSPDTVVARYNEPLAPPPAAVAAAFTVEELSAVRHFMVRQAEDLGLSGVRLQDLALLVAELTTNSAVHGGGSGTARIWTEGDQVVCEVQDGGRLVDPLAGRRPAERGQIGGRGLLLVHQLSDLVRMHTSESGTTVRCYLSR

SEQ ID NO: 14688 - protein, 482 aa, Streptomyces avermitilis
VSILNDVPKQLFIGGTWADAADGATMPVDDPATGEILCHVADAGPKDARLAADAAVEAQDGWARTAPRERSEILRRAYEIIVSRTGELALLMTSEMGKPLAEARGEVAYAAEFFRWFSEEAVRIDGGYGVLPDGRNRMLLMRRPVGPCLLVTPWNFPLAMGTRKIGPAIAAGCTMVLKPAPQTPLSSLALAGILKEAGLPDGVLNVVTTSRAGEVVEPLLTGGRIRKLSFTGSTRVGRLLLAQCADAVVRTSMELGGNAPFIVLDDADLSAAVDGAMTAKMRNMGEACTAANRFFVHRSVADEFGRRLAERMGALVVGPGTRDGVDVGPLIDEAGRAKVEELVADAVERGARVLVGGVAPDGPGRFYPPTVLADVDPGSRLMETEIFGPVAAILVFDDEDEVVRRANDTPWGLVGYVFTQGLDRALRVSERLEVGMVGVNTGLVSNPAAPFGGVKQSGLGREGGRVGIEEFLEYKYLAVPLR

SEQ ID NO: 14689 - protein, 419 aa, Streptomyces avermitilis
MSALSPHLRQATPVVAVRGEGVHLYGEDGRRYLDFTAGIGVTSTGHCHPRVVAAAQEQAGTLVHGQYTTVLHPPLRRLVDRLGEVLPAGLDSLFFTNSGSEAVEAALRLARQATGRPNVLVCHGGFHGRTVAAAAMTTSGTRFRSGFSPLMSGVVVTPFPTAFRYGWDEETATRFALQELDYTLRTISSPDDTAAIIVEPVLGEGGYVPATRAFLEGLRERADRHGFVLILDEVQTGVGRTGRFWGHDHFGVTPDILITAKGLASGFPLSGIAASAELMGKAWPGSQGGTYGANAVACAAACATLDVVRDEKLVDNAEAMGARLRAGLAAVAATTPAIGDVRGLGLMLASEFVTEDGGPDPETAARVQRAAVDEGLLLLLCGAWNQVVRMIPALVIDEAEVDEGLRAWSAAVEVGVPAR

SEQ ID NO: 14690 - protein, 551 aa, Streptomyces avermitilis
VSEPHPAAPPPPADERAAGRPLTVAGALALPVLAAGQPTVVTGESQLGRPVRWVHVTELTDPASFLKGGELVLTTGMPLPEEPARIRRYVDELADIGAAALVIELVRRYHRPPEALVAACRTRDLPLITLSQDVNFLEVTQVVHTLVLGDQTDAMRRTQRIHEAFTALTLRGADPEDVVRAAAEMSGHTVVLENLVHQALICEPAGATVEDALTGWERRSRAAPPGDQADVRGPENWLVAPVEFKGERWGRVVMLPTRRGRPFGPEQVTVLERTAMTLTIARLVHTTTWERRAHRNTLRDIAEQRHRSPHELRSRAAALGLPTEDCRFLAVLVDIGPDEDSAELEARLAEELTAAGIPALTGTLPLGRVGSLLALRPSRTPWRQTVERLARTTLRLHPHAIVSVGCEVTDLRHAARSFREAARVAEAAPPDSPRLPGSPERSFHELSDVGLRQLLYALREDTRIQDYAERRLGRLADHDTRHHTDLLTTLRHYLEAAGNKTTAARRDDLSRQTLYQRLQTIERLLGCDLESGDRRTELHVALMVFDILRPR

SEQ ID NO: 14691 - protein, 360 aa, Streptomyces avermitilis
VPVISVPYAFNEEELYVDLRSIFGHSLFLKCEGFNFAGSIKLKAATEMVEAAERDGVLTPESILVESSSGNLGVALSMIAASKGYRFLCVTDSRGNLSTRMMMEALGSEVHMIAGQEANGGFLGARIAYVRALCASDDRYVWLSQYTNPSNWKAHYRKTAPEIARQFPRLDVLFVGAGTTGTLMGCARYFREWHRPVRIVAVDSVGSVSFGGPPGRRMIPGLGMSMRPPLLDESYVDEVIRVEEADTIRTCHRLARRGFLFGGSTGTVVSGATDWLAGHDARELTAVAVGPDLGERYLDTIYQTNWLKDLYGDEVLDSDDVAAGSWASSPAQPTRWGRSLDLQTGDHHGNQHHQFHDRKT

SEQ ID NO: 14692 - protein, 356 aa, Streptomyces avermitilis
MTTIGSTTTESATSAPMTVPPFAVISGAQVRHALHGREKHIVELVEATYRVHGAGDSVNPPSYFLRFPDRPSSRIIALPASVGGEVRVDGLKWVSSFPENVTAGIPRASAVLILNDHDTGYPFACLESSIISATRTAASAASAADRLSRGRPRPTRVGFFGVGLIARYIHTFLVGTGWSFDEIGVHDLSADSTAGFQSYLEQSGTPGRITVHDSAEELIRGSDLVVFATVAGQPHVGDLSWFAHNPLVLHVSLRDLAPEILLASTNIVDDIEHCLKADTSPHLAERLTGSRDFLHGTLDDVLAGRVTVPADRPVVFSPFGLGVLDLAVGKYVYDDVVRRGELHVVDDFFHELSRYG

SEQ ID NO: 14693 - protein, 323 aa, Streptomyces avermitilis
VELKPGRPPLLRAEAAADALHWAAEHRDALRAVVAEHGCVLVRGLGLRDAAGTGAVFSKLATGLMTEKEVFAPRETYSDGVYSSTKWPTNQPMCMHHELSYTLEFPGLMMFACLGAPSDGGATAVADSPTVLDALPAELTERFEREGWLLTRSYNDEIGASVAEAFGTEDRGAVESYCRANGIMFEWQPDGGLRTRQRRSAVVRHPVTGRRCWFNQIAFLNEWTMAPEVREYLVDVYGADGLPFNTRFGNGDPIGEDVVQLLNGVYEANTAREPWQDGDLMLVDNIRTAHSREPYEGPREVLVAMADPVRLADCSPTVEVTAV

SEQ ID NO: 14694 - protein, 905 aa, Streptomyces avermitilis
VQGADAHGRWRSKVAQGACMEEKSIEVLASGPDESARDKSRDSGPKAGIERDLAEVLADVMSVEQVSVDSHFFDDLGANSLVMAHFCARVRKRADLPSASMKDIYRHPTIRSLATGLADAAPTPVESSVPAPTEVVTPASTRQYLLCGTLQFIIFVGYCCLAGLVTGRGYEWVSAGSGLRNVYLRAVLFGGAGLVGLCIFPIAAKWILIGRWKSREFPIWGLTYLRFWTVKTLVHANPMIFFVGNPLYVLYLRALGARIGKGVTIFSRTIPVCTDLLTIGAGTVIRKDAFFLCYRAHAGRIQTGHVTLGRDVFVGEKTVLDIDTSMGDRAQLGHTSALQSGQVVPEDQRWHGSPAQRTEFDYLSIAPAACGTLRRAGYGLISVLQVFFLYVPLTVGGAYMLITEVPELRNLLGPDMVGFTSPTLYIDALVLSLVLFFGFIVLGLALLFTVPRLLSLMVKPDKVYPLYGLHYSAHRAIARMTNLKFFKWLLGDSSYIVHYLRGLGYDLSHVEQTGSNFGTEVQHETPYLTSVGSGTMIADGLSVINADFSSTSFRVSQASIGPHNFLGNNIAYPSGAKTGDNCLLATKVMVPLDGEVREGVGLLGSPCFEIPRSVERDSRFDQLRSGDQLRRHLAAKNRYNLRSMGLFLLVRWLHFFVLTVLGLAAVDMHGVFGWVVITASLALALVVSAVYLVLVERGIAVFRPLQPQLCSIYDPNFWLHERLWKMPIEYFHVFNGTPFMNVVWRLLGVQVGSRVFNDGCLVTERTLATIGSDSTLNVGSKIQCHSQEDGTFKSDRSTIGDGCTLGVGAIVHYGVTMGDGSVLAPDSFLMKGEEVPRHARWGGNPATEWRDAPYRPVALGRKAALNPLDQHAPPAERQGRPADPPRKPRRLRRRADRRSTAPWRP

SEQ ID NO: 14695 - protein, 652 aa, Streptomyces avermitilis
MQKPFPRAPAVRCLYRTACATAAAALVVPLLVTGPSSDAQGEATTRLQRAFADAAAEYRVPQSVLLGVSYLQSRWDTHDGAPSVIGGYGPMHLTDTRTALAEAPHHGVTRDTAPPLAVAAGPQQPAPRLPGQLTTLERVAGLIGVPAARLRTDADVNVRGGAALLAATQRRLGKPLSADPADWWSAVARFSGADDSATAATFANDVFAVIRAGAHRTTDTGQRVTLAASPGVRPDSRQVRAIRPRATADPDVECPATLACDWIPAPHTEFGDDQYGNHDLADRPKDQRVEYIVIHDTEATRTSMIDTVQDPSEASWHYTVRSSDGHITQHVKTKDVAWHSGSQFVNARSIGVEHEGFLTQPDAWYSEQMYRSSARLVAYLAKKYGVPLDRQHIFGHDNVPAPTASSIPDMHDDPGPFWDWRHYFDLLGAPLRATAGADSDLVTVLPDFRTNQPLYTGCNESGKPCAPHGSSAVRVHTEPHEDAPLIQDPGRRPDGEDSTADVNDLGSRISTGQTYAVAERRGDWTAIWYLGQKAWFKNPKRNPTAVGASGLMVTPKDGLRSVPVYGRAHPEEEAYPSEVPVQPDSPLPYELLEGQRYATQGRTSGSYFQPSATDAALNHVVKGEDLYYEIQFGHRIGFVRAADVDVVHADKR

SEQ ID NO: 14696 - protein, 196 aa, Streptomyces avermitilis
LARSNAPSRERIVAGAADLISRRGLNATSIRELAKHAKAPLGSTYHFFPEGKQQLATEAVRYAGEAVARILRKELAAGPVAGLRAFLALWRGIVVESDFRAGCPVLAVSVEEPPADEIPPALVAAAEAFEEWEHLLAQALRAHGADSDQAPGLAALIVASVEGAIAMCRAKRSTDPLDQVAQQLEVLIVGALDRPA

SEQ ID NO: 14697 - protein, 179 aa, Streptomyces avermitilis
VTSGYNDCYRSCAQSCAQSCAHSCAQNCAHPKGDFAMPMIRLTVPPGSLTEEGRRTVQRDLAAVLLRWEGAPDTAFFRAQAWSYLVELPEGAQTTAEDDAPRFLVEVTVPRGALSERRRAGLVEDATRTVLDAAGLTQSDAPRVWALVHEQPDGTWGAGGSVIRYADLVALAKGQRADA

SEQ ID NO: 14698 - protein, 336 aa, Streptomyces avermitilis
MRELTYTGRNTVEWREAPDPKLQSDQEAIVVPVAATSCDVDSMILAGHGFIDPPFALGHECVGRVVETGDAVTTVAPGDLVVVPWSINCGTCDNCRAGLTAHCTAVPHMAMYGAPIGGSWGGLFSDLVRVPWADAMLVPLPAGLDPVAMASASDNWSLSWRLVAPHLKNKPGARVLVVARGSIGLYVCDIARALGASDILYVDPDPEHREIARGYGAATAETLEPFPHGFDIAVEATGRVDQLALAVKSLAPEGICESAGNHFRPGELPLLDMYLTGVTLRIARDNVRNHIPDALELAASGKVAPERVVSHVLDWEQLPDALPEKHLKPVFVRADS

SEQ ID NO: 14699 - protein, 175 aa, Streptomyces avermitilis
VLQQPRQSQQRSRGRGGRVTRTARLARAAVLAGSLALLPLSTACSGGEDDAAKKSKASPTTVTDAPAAGAVAPAKVEVIANLTGCKPKIRIDADELRQGLCHTKEIDYLITTFPEEKYQQAWLDSAAVYGGKYLVGLRWIVSAKKPEMLEQFRTKLGGTIRQLRGIGPTPAPSTS

SEQ ID NO: 14700 - protein, 191 aa, Streptomyces avermitilis
VNVLEPPGVPAVTDPEGVTMTAGRARARFLSAAVLLAALSCATTACGSSTSAGSAETKPQSTWEEPVSYSYTLTSNTQVLAGTFQVQVRDGKVAEVVGLDEDSRRQVQDLRAEVPTIGELLKTLKQARSEDADTADADYAADGHPVRISLDWDKNSIDDEALYTISSYEPTPGRRDSPLPTAPARGFQRPD

SEQ ID NO: 14701 - protein, 794 aa, Streptomyces avermitilis
MDRFPHAADVDFHSPLDLSKAAAAVLDDEGRISGWGFSAQRLLGHSPEDVLGKSATRLLAAPSGQPTGQRLSALCKAHKPRSTVLDLCCRDGRTLRAAVTFSPLSDRGVAATVVVAAEVEALRSWEAQLAMLQGLATESSVGLTIFDSDMRVVWGNISTDLELGGVAQYTGRPAADLFPEGEFISRHHPPDEDQIMEHVLTTGEPIIGMHYRGRAPADPGREHVWSCSYHRMLDARGEPLGLFEESLDITDRYRAQERLSLLVRAGKRIGASLDVRRTAAEIADVAVPQLADEVLVDLPPAVIEGRQPPTGSAPGHSLLRMHGRTPEGFRTSPVSYPPSSPQALSLATSRPVVDASPPEAPGGEGSAAPHSCLFVPLLTRDAILGLVTFRRSSNPDPFGPEEQTLAVELAERAAVGIDNARRYTSQHAAALVLQRSLLPQHLPEQSAVDVAYRYLPADSRVGVGGDWFDVIPLSGARVGLTVGDVVGHGVHAAATMGRLRATVRTLALLDLDPAELLTRLDDLVAQDSDSHAEGGPIDEALGVTCLYAIYDPVSSRCVWASAGHPPPIVADASGSVALSALAPGPPLGLGGLPYENVELNLSSGSVVAFFTDGVVEDRRTDIDIGIDRLAQVLTWQRCPLEELCDRALSDMPPGPQADDATLLLVRTRRLGADHVADLELPPEPTMVAHARTLTERQLAIWGLSELSFTASLVVSELVTNGIRYATGPVMLRLIRDRCLLCEVSDNAHTAPHLRRARRDDEGGRGLFLVAQVSQRWGTRYTSSGKTIWAELAIP

SEQ ID NO: 14702 - protein, 106 aa, Streptomyces avermitilis
MSGCGRTSSPSEPDSSPRRRLTKVREAMTATQNGPQLSGSRDEPPKSNKKTDALIAVLIAIIGGCFAGIVRRTMEGVSYYEAISTGALAALGLGGFIFVILTYIRS

SEQ ID NO: 14703 - protein, 177 aa, Streptomyces avermitilis
VIMKRELIVARAVCLAPSTSSAGVHAFEAEHRIVLPEPYRAFVAEIADGSYSGPPEYGLLSVAELPDDWGDDEQERDLSKPFPLVEAWMWEEDSDPSEDADELLEQVYNHGSIVLGTDGCAMNWHLIVTGPHRGHVWLISDVGAVPFGAQFGFTTAEPGFAGWVRHWAANKPWHDAA

SEQ ID NO: 14704 - protein, 68 aa, Streptomyces avermitilis
MNESRPHLVPVRSRDAEDFVRLRHRHHPPPAGQVFSVGAADDTGILRAVAVVGRPVAQPTASSRSLNP

SEQ ID NO: 14705 - protein, 86 aa, Streptomyces avermitilis
VSWWSSPIDRAVNDGGATDTYFPRLDPVTFAARGVVPMAQAAFAFVLGVALGLVIRRTLPAMATPLVVYAAVQMTRQQVRTATPDR

SEQ ID NO: 14706 - protein, 507 aa, Streptomyces avermitilis
MTRFAAPGTDGAIVSYQARYDHFIGGEYVPPARGQYFENPSPVNGQPFTEIARGTAEDVERALDAAHAVAPAWGRTSVAERSDILRRIADRMEANLEKLAVAESWENGKPVRETLAADIPLAIDHFRYFAGAIRAQEGSLGEVDDDTVAYHFHEPLGVVAQIIPWNFPILMATWKLAPALAAGNAVVLKPAEQTPASIHYWLSLVADLLPPGVLNIVNGFGVEAGKPLASSPRVAKVAFTGETTTGRLIMQYASENITPVTLELGGKSPNIFFDDVWSANDDFRDKALEGFTMFALNQGEVCTCPSRALVQRGQYAEFMEAAVARTELIKTGHPLDTDTMIGAQASNDQLEKILSYLDIGRQEGAKILTGGERIEHDGELKGGYYVQPTIFEGDNRMRIFQEEIFGPVVSVTSFNDFDDAIKIANDTLYGLGAGVWTRDINTAYRAGRAIQAGRVWTNCYHAYPAHAAFGGYKGSGIGRETHKMMLDHYQQTKNLLVSYSPKKLGFF

SEQ ID NO: 14707 - protein, 429 aa, Streptomyces avermitilis
LSDPWVALEPGADPAERVRALRRAHETFTAAGTAAGTVPRPVRSVVADSWRRSARAGVGPDGTASVELTDGDLGSYRAEHPLAPVMPLFRELMGTFAADGEHLLAVCDAQGRLLWVEGHPAVRQRADGMNFVPGARWAESAVGTNAPGTAVALDRPVQVFAAEHFIRRVQPWTCAAAPVHDPRTGRVLGAVDITGGDGLAHPHSLGFVQAVARAAESQLALLAPARGTADTLELTALGRDEAQLLAGGRKIRLSRRHSEILVLLAHHPEGLTGDELLCALYEDESVTPVTLRAELARLRRLLGPGLLASRPYRLTAAVESDVAVVERRLGTGAVTAAVAAYAGPLLPGSQAPAVARLRRRIADGLRTALIARRDPDLLADWAHAPWGEDDLDVWRALAAVRPTAPVRARLDELEYELSAPAGWARSAPR

SEQ ID NO: 14708 - protein, 199 aa, Streptomyces avermitilis
MERARALPSRRQLLKGAAVAAVPYALLPAAQAGAEPRAVDYPSAEWTAASTSNYTASSRPSSYPLDYVVIHVTQETYPTTLDIFRNPQKGVSAHYVVRSADGHVAQCVRERDIAWHAGNWDYNTRSIGIEHEGWVDQPAYFTDALYEESARLTAAICAQYGIPKDRAHIIGHYEVPGTDHTDPGPNWDWVRYMRLVNFA

SEQ ID NO: 14709 - protein, 412 aa, Streptomyces avermitilis
MTAPLHEAHPAGRGRRLPDTQQGMRRRNLARVMHTVSAEGPLSRAAVASHIGLTRAAVSTLVDELIRSGLLEELGPERPGRVGRPGSALAVSGRGPAGIGAEIGVDHLAVCAVDLRGAVRARAVRNGTNRGREPAAVIGELTRLVRRVVAEAEQEGLWPAGLAVAVPGLVARDARTVVRAPNLDWHDTDLGALLPDELPLTVDNEANFGGLAELWLGDGTPRDFLHVSAEIGIGGAVVVDGRLLRGTRGFAGELGHVPVHPDGPECPCGGHGCLEQYAGEEAVLRAAGLEPGEDRVGLLAERAAQGDEDVRGALRDAGTALGIALTGAVNLLDPETVVLGGALAGLAPWLLPSLERELARRTAGPACAVSVSRLGSEGPLLGAAHAVVRAVLDDPAAVAERAQDSARAATHR

SEQ ID NO: 14710 - protein, 524 aa, Streptomyces avermitilis
MCLRRETRCFRSRGTGCPEALWSQRCFRSQQARSREPRKRESPMSAAEGPLVVGVDTSTQSTKALVVDASTGRVVASGQAPHTVSAGAGRESDPRQWWDALCEALHQCGDAAHEAAAISVGGQQHGLVTLDAHGDPVRPALLWNDVRSAPQARRLIEELGGPKAWAERTGSVPGPSFTVTKWAWLTEHEPEAVRATAAVRLPHDYLTERLTGQGTTDRGDVSGTGWWASATESYDEEVLTHVGLDPALLPRVVRPGEVVGTVRDSHDLPFSKGTLVAPGTGDNAAAALGLGLRPGTPVLSLGTSGTVYAVSTRRPADPTGTVAGFADARGDWLPLACTLNCTLAVDRVAALLGLDREAVEPGTGVTLLPYLDGERTPDLPHASGLLHGLRHDTTGGQLLQAAYDGAVHALLGALDLVLDADADRSAPLLLIGGGARGTAWQQTVRRLSGRPVQVPEARELVALGAAAQAAGVLTGEDPAAVARRWDTAHGPVLDAVERDEATLARISGVLSDAAPLLEREPDRR

SEQ ID NO: 14711 - protein, 388 aa, Streptomyces avermitilis
MNYQPTPEDRFTFGLWTVGWQGRDPFGDATRRALDPVETVQRLAGLGAHGVTFHDDDLIPFGSSDTERESHIKRFRQALDATGMAVPMATTNLFTHPVFKDGAFTANDRDVRRYALRKTIRNIDLAAELGAKTYVAWGGREGAESGAAKDVRVALDRMKEAFDLLGEYVTAQGYDLRFAIEPKPNEPRGDILLPTVGHALAFIERLERPELYGVNPEVGHEQMAGLNFPHGIAQALWAGKLFHIDLNGQSGIKYDQDLRFGAGDLRAAFWLVDLLESAGYEGPKHFDFKPPRTEDLDGVWASAAGCMRNYLILKERTAAFRADPEVQEALRAARLDELAQPTAGDGLTALLADRTAFEDFDVEAAAARGMAFEQLDQLAMDHLLGARG

SEQ ID NO: 14712 - protein, 202 aa, Streptomyces avermitilis
MANGRGDGSTDKKSPAESSKGTGRSPTPSLSIPSAIPSEIPTELPSGFPSKLPSGFPSGLPSDFPSDFPSELPSGLESLFAAPAGDEVPYYMLKKGDCFDTSVSRPGQAAKRSCRTPHDAEVVKVTELKGGYATDAALKKAAAGLCEASLARTEAQHAAGTVRGTLVQYPDTAGYKLGIDKVACSLTADVGGGDRKFTAPLK

SEQ ID NO: 14713 - protein, 1517 aa, Streptomyces avermitilis
VPDSSVPVEERLRSALDTVEEQQQTISKLLREKHEPIAVVGIGLRFPGGSNTPDEFAEFLREGRSGIGPFPTDRFDTDTYVADGSGEDDEPGRIRTIGGGFLDRIDQFDAPFFNISPKEAQYMDPQQRLLLETAWEALEHANIDPTPLRRANGGVYIGASSIDYALELDSLPYEELDGHLASGITFFPLSGRLSYFLGWRGPCMSLDTACASSLTALHSAAEGLRRGECDIALAGAVNALHHPRIPVIFSAANMLAPDAQCKTFDESADGYVRAEGCAVAVLKRLSDAQRDGDTVLGLIRGSAVGQDGDSAGLTVPNGPAQEAVMRAAIQRASLQPSDIQYVEAHGTGTPLGDPIEMGAISDVFATSHDKERPLTVGSVKTNLGHMEPVAGLVGVIKTLLQMREQTIFPHLNFTTPSGRIPWDSYPVTVPTENRPWKADTRRAVVNSFGFGGTIAAVVLEEPPVPEQPATAPAAVQADRTDSASAVEQHVFTVSAKNHRSLKQLIERYQRHLDDSPSTDLGSLCYTGNVGRAHHPLRLAGVVGGREDLDALLKKGLGQIEKRSIAAERARKTAFLFTGQGSQHAGMGRPLYERFVVFREHLDECDRLFAPLLGRSIRALVLGEDDDPDAIHQTRFTQPALFSLEYSLAQLWLSWGARPSVLIGHSIGEVVAAAVAGLFSLEDAVTLVAARARLMQSVSAPGGMAAVPEAAEQVAPLLESYPDLTMAAVNSPRQCVISGGTDSLAEVSETLRGRGLDVKQLRVSHAFHSPLMAEVLDEFREALKDITFRQPQLTLVSNITGKVARVAEISKPEYWVRHIVEPVNFEAGMRAIERRGRHVFVEIGPSIALTGLARSCVDAGEHRWLNSLHPKEKQGLTILQAVAKLYSAGVRVDWNGFHDGRPGRRVDLPLYAFDRKRYWLPNGTGPSAQDEAAGPRSAFLHEPRWVEQPPTARTVAGPRHVLVVNRAAQDVTGLVEQAAGQDVRLSFAADPEQALDVVRAGEPTDVCWFWQSDDGPVSAESLRAECEHNYRDLLTLLGLLEQEEGGLARRLWLVTEAAQVLPGDEPGSGAHLAAATLWGFGHVLLNEYPSYRVTLVDLPAGGGRTAEEMLLGEWLAADTGEFQVAYRDRTGRHVHRLLPSAFDSPEQPAEPGTAPVRPDRNYLITGGLGALGLLTAHRLVDEGARYLTLVSRRAEPAADAAGLWERLRDRAEVTVLRGDVGDSGDVHRIVESLHAAPQPLGGIVHTAGGLDDAPVAAQTWESIDALFSAKVYGSWMLHEAAQGFDELDFFVAYSSAAAVVGGASQSNYAAANAYLDQLLHWRAAQNLPALGVNWGPWSEAGMSARLNARHIEALEREGIVFIPPRQALDTMVSLLGEPVTQVLAGECDWDRFSAAKPVVNAFYQELVGADGTSSRTLDLDALLASPDGERVEKITDFIRHRVADVLHIDDADDISPYTEFVQLGLDSLVAVELKNALEAAFRIPLPLTMAFDYPSAAVLGEFIGKRLEQARPTAPAGS

SEQ ID NO: 14714 - protein, 427 aa, Streptomyces avermitilis
VKVSVSTAGSRGDFEPYVALTQALISAGHEVTFAAPRDARRLVAGTDAKFIEMDLEVREVLRSEEGQQWLAAGNVEAYLGGITKMLSDARHTIGTSVLAAADGADILVTGVNTEDYALAVSQARGTPIVLGHLTPWLLTDEFPQPLTPQVVPADQSAEQYNLGTHQVAEDVYWQGKRDDINEFRGSLGLPPAPSAALTWTVELGLPTLQAFSEEVVPRPHDWGPRNVMTGFWRLQSEVRRRVGEAEIPEWLAGWLAIGPPPVFLGFGSMPVLDPPKLLDLIVRAAERTGLRLLVGAGWSDLSGLTGELPDTVRLIGAIDHDWLFPRCRAVVHHGGAGTTAAGLTAGLPTWIYTVFSDQPFWGDRVARLGAGGYSNFLEFDLDHLTGVLGQLVGEDVRRRAAAIGERLRAEDGVSAAVRLIGEIAGRH

SEQ ID NO: 14715 - protein, 397 aa, Streptomyces avermitilis
MTQTAAVTTAWPLHRTCPMSQPPALAAFRDGPPRQVLLRGDQPAWLITRYADVRQALADPRLSVNDQHPNWPNRLLFPVPPRAVSFWRMDPPEHGAYRKMVAAEFIAHRTQALRPLLQSITDELLDEMAAMPKPVDFHSVFALPLPCIAIARIFGVPDEDMSEFKENTSALLNQKEPEKAVQAFLATTAYLDGLARAKEREPKDDLLSRLVVNFVRPGQLSHDDLVAMVRLMLVAGHETTANQIALSIFTLLDRPGVLAELRADPRLLTPVVDELLRYWSIAQDNVVRTATEDLSVGDARIAAGDAVVISVPGANHDEAVFPDAADFDIHRDNSRHLAFGHGPHFCPGGPLARTELEIAITSVFRRFPDLRLAIGRDQVPVHTDTLVYGLECLPVTW

SEQ ID NO: 14716 - protein, 521 aa, Streptomyces avermitilis
MRPTQWTGLLTWARIHGADASAVRADKPNGGLSMTTEELSESELAGAPAATVAEPPPRWSPLILVSLGTFITVLDFFIVNVAVPDIQQSLHASSVAVQFVLAGYGLPLATLMITSGRMGDLYGRRRLFVTGLALFTAASACAGLAQSPAQLVAARVFQGIAASLVTPQVLALLGAMYQGRARAVAFNVYGLAIGLAAVFGQLIGGSLIALDPGGLGWRAIFLVNVPVGLVAVALVPRLVPESRGGGRTRLDVIGMLLVMLGLVAVVLPLTEGRELGWPLWSVLCLIAAVPVLAVFAVQQHRGTVRGGAPLVNTTLFRSRAFSVGLFAMMFYYATMGACFLVLSLYLQQGRGMSPLGSGLLYLPLGAGFFAATALAGRLVGRLGRQAPAVGALLVVVGYGTLAVLVSGIGVGGRVEWLAGPLLVAGLGMGLTMAPLSSMVLAPITADHAAAASGVLTTAQEIGATVGTALIGSIFFRMVGDHTQAPATSHAFSVCLAVLVAFDLLVVVLVQLMGKASEPASD

SEQ ID NO: 14717 - protein, 335 aa, Streptomyces avermitilis
MRIGIMGLGRIGAFHAETLSGLPAVTSLVVTDPFTDAAKSAAERFGAEVADSPEAVLAAGVDGVVVAAATDAHPGLVLAAVEAGVPVFCEKPVARTMREGVAVLEAVRDAGVEIQIGYNRRFDAGFVAARAAVASGELGALHTVRSTTLDPAPPPPAYVAASGGIFRDCSVHDFDIIRWVTGREVVEVYATGGNRGADYIAAAGDADTTAAVLTLDDGTLAVVSNSRHNARGHDVRMELHGFRDSIAVGLEDRLPLRSVEPGTSFPAGTPHDFFMDRFAAAYRAELTAFTEVVAGRRPSPCTVADALEAGWIAEACTLSLHSHRPVTVEEVRRQS

SEQ ID NO: 14718 - protein, 273 aa, Streptomyces avermitilis
MGHLHDSGKRLLDDTGGLLDGKIVLVNGGSQGIGAAVARAAAREGAAVTVTGRRPEPGEALVGELRAAGCEAAYVRVDLADAGQARGSVARVIEAHGRIDCLVNAAGLTSRGTLLETTPELFDAHLAINLKGPFFAMQAAVADMLEREAPGTIVNIGSNCAHGGPPNLTAYSTAKAGLAGLTRNAAHAHRWDRIRVNALNIGWTATEGEDATQRAFHGAGDDWRERAGRGLPMGRLGDPDEIADFVVLLLSDRSGVVTGSVIDWDQNVLGALD

SEQ ID NO: 14719 - protein, 391 aa, Streptomyces avermitilis
MSPTTDVRPSWLAEEDCDLDAFRVLVERTTDADDYPYADAVERNVLFYDSDRLRSAVAAHELRHVQAELVRAFSEGPGVVVFRRAFPDPSVVARATAAFDALITAQRASGTVAGDHFAAPGANDRVWNALQKLAVHAPEAFADYYANDVIALVSQAWLGPGYQITSQINVVNPGGAAQSVHRDYHLGLLSNAVAATYPAHVHRLSPALTLQGAVAHCAMPVESGPTMYLPYSQTYEPGYLAWRLPDFQAYFESRHVQLPLAEGDAVFFNPALFHAAGTNRSSDIRRMANLLQVSSAFGRAMETVDRATVVNAVYPALLTRKAGGASVEWLDTVVAACAEGYPFPTNLDRDPPVGGLAPPSQADLVRRALREEWTADALREALNAGAERRTS

SEQ ID NO: 14720 - protein, 349 aa, Streptomyces avermitilis
MGHPYPLREIARQAGLSEATVDRVLNGRGGVRESTAREVHRAIADLDRQRTQVRLVGRTFMIDIVMQTPERFSTAVRAALEAELPALRPAVMRSRFHFRETGPVAELVATLDRIARRGSQGVILKAPDVPDVTAAVGRLVSAGIPVVTLVTDLPASGRLAYVGIDDRAAGATAAYLMGQWLGDRSGNVLTSISSGFFRNEEEREMGFRAAMRALHPRRTLVEVAEGQGLDATQYDLVVAALERDPEIRAVYSMGGGNVATLRAFEATGRRCQVFIAHDLDHDNTRLLREHRLSAVLHHDLRQDMREACRTVMRAHGALPPAGPVLPSPIQVVTPYNMPTVAEATPAAAD

SEQ ID NO: 14721 - protein, 121 aa, Streptomyces avermitilis
VNTQSPPASEVQVVLTDCSATDAGHLFDALRRRFECDREDSDSPAETPTAWTATFDTAAVCPPASGASVPLSGPVTAEVQGSPHAVRELEDALADVFTVHEVGSVSGDQEVEVELRLEPRG

SEQ ID NO: 14722 - protein, 336 aa, Streptomyces avermitilis
MRMSVVDVGSNTVRLVVADAEGGVPLPVHTAKWRLRLSEVVGPDGRIPEEAVHRLVGAVAAADETARKWGAAGPLAFATAVVRGAPNRLEVLRAVRAETGVRLCTLPGEEEAELTFLGARRWMGWRAGPLALFDIGGGSLEVAFGRGRLPDFVASLPLGAGRLTREFFEGEDLPSAAMVKALRRKVRHQLRDVAARIRWEGPRTVVATSRTFQQLGRLCGAAPGRQGPFVDRHLERRELRGCLDRLTALPAAERYLLPGISAPRARQSLAGAIVGHTVMKTTGVSRVTLCPWAIREGVLLRYIEDGAAWWADITDRAAELPPTAAPVPLRVAAPPS

SEQ ID NO: 14723 - protein, 221 aa, Streptomyces avermitilis
MGMPAGPYLLTPPGVYAPQHDTDLLARALRREDIDTSTEVLDLGTGSGALAVHAARLGARVTAVDISRRAVLTARLNALLAGRRVTVRRGDLTAAVPGRSYDLVVSNPPYVPSPSARLPSRGAARAWDAGHDGRAFVDRICDTAPAALRAGGALLIVHSALCGTRPTLDRLAAAGLDASVTDRAFVPFGPVLRARRAWLRRQGLLTDENLEELVVIRAEHS

SEQ ID NO: 14724 - protein, 69 aa, Streptomyces avermitilis
VPNTPERPRRVTVDRDGPLLVEGPVEVVCEDGTVVTSRRFKVAICTCRRSRAYPWCDTSHRRRVKGDTP

SEQ ID NO: 14725 - protein, 340 aa, Streptomyces avermitilis
VRSPELPTPRGELSKSVFSTLAYSTPLPTWSHEVQEADPYGDDLQLALYVLYELHYRGFAEVSDEREWDPGLLGLRRAMELRFTEALRSDVPLEPDVDVEKVLAALLVEPVGQDDTSVSHHLQRDGELWQFKEYAALRSLYHLKEADPHAWVIPRLHGRAKAAMVAIEYDEFGAGREDQIHARLFADLMADLGLRTDYGHYVDAAPAEVLATVNLMSLFGLHRALRGALVGHFAAVEVTSSPGSRRLATALRRVGAGPAAQRFYDEHVEADAVHEQVVRRDVIGGLLESEPELEPDVAFGILATGFLEDRLGARLLDAWRSRRSALRVPLTGDEEGAPHA

SEQ ID NO: 14726 - protein, 293 aa, Streptomyces avermitilis
VPPMPDNPTDQHPRPDFPQQDQEHPGWTGPMDPPPDHGEDSYEGSGLLQDRATLLTGGDSGIGRAVALAFAREGADVMFTHLPEEEKEAAETVRLVEDAGRKAVAVACDIRTEEACRRLVERAVAEFGRIDVLVNNAAYQMSQPDGIGAISTEQFDRVVRTNLYGMFWLCKLALPHIPAGGSVINTTSVQAYKPSPHLLDYAMTKGAIVTFTQGLAQMVAGDGIRVNAVAPGPVWTPLIPATMPDTTEFGKQAPLGRPAQPAEMAPAYVFLASPRASFITAEILNATGGTPLP

SEQ ID NO: 14727 - protein, 299 aa, Streptomyces avermitilis
VCLSPLVTTPVSPPVSPTWRDRSMTVLRRVSVNGVELNVALAGKGPAVLLLHGFPHTWELWTDVMAGLSERYQVIAPDLRGFGASTRAKTGYDAGSLADDAAALLETLGAGPAAVVGIDAGTPPALLLALRRPGLVRRLVVMESLLGRLPGAESFLAGGAPWWFGFHAVPGLAETVLEGNEARYLDWFLDTGTLGDGVRPAVRDAFVRAYTGREALRCAFSYYRALPVSATQIERAFDTARLTVPTMAVGSHPVGAALERQLRPFADDLTGHLVEDCGHIIPLHRPDALLALLHPFLKD

SEQ ID NO: 14728 - protein, 128 aa, Streptomyces avermitilis
VTKANRGDLFDPQCPTRRLLDRIGTKWTSMAVKVLAEAAPDEVRFAELRRRMPGISQKMLSVTLQSLARDGLVARRVEPTVPPRVHYRLTELGLSLEGPLAALRHWAERHMSEIDRNNRLEDARSSAG

SEQ ID NO: 14729 - protein, 281 aa, Streptomyces avermitilis
MAERLKRLGLIGELSAEFAGTMILILFGAGVVAQVVAGGALTTPPGGLGNHDSIAWAWGIGVTMGVYVAARLSGAHLNPAVTVTLAAFKGFPWSKVAPYAVAQTLGAFVAALLVRWNYTEALAKADPGHTLKTQGVFSTLPANGNPNLPVHEWGAFRDQVIGTAILLLLILAITDLLNTPPGANLAPFIIGLVVVAIGMAWGTNAGYAINPARDFGPRLASFITGYGSAWRDQYGNFYFWVPIIGPLIGGLLGGVVYKFFVGRFLPTAEPEPPGRVPTPEA

SEQ ID NO: 14730 - protein, 505 aa, Streptomyces avermitilis
MADFVGAVDQGTTSTRFMIFDHAGNEVAKHQLEHAQILPRSGWVEHDPVEIWERTNSVIQNALRHGNLSPDDLAAIGITNQRETTVVWDPRNGRPYYNAIVWQDTRTDSIAAALERSGQGDVIRRKAGLPPATYFSGGKIQWILENVDGVREAAEQGHAVFGNTDCWVLWNLTGGPDGGIHATDVTNASRTMLMDLETLDWDDELLGLFDIPRSMLPTINPSSHPEAYGQTRTSRPLRAAIPIAGVLGDQQAATVGQVCYAPGEAKNTYGTGNFLVLNTGTELVRSQHGLLTTVAYQFGDSPAIYALEGSIAVTGSAVQWLRDQMKIIKSAAESETLARTVEDNGGIYFVPAFSGLFAPYWRSDARGAIVGLARYHDNGHLARATLEAICYQSRDVVEAMEQDSGVHLDVLKVDGGVTANDLCMQIQADILGVPVSRPVVAETTALGAAYAAGLATGFWQDTDELRTHWQESKRWEPQWSEDRRAEGYAGWKKAVERTLDWSKVE

SEQ ID NO: 14731 - protein, 175 aa, Streptomyces avermitilis
MTETTPGWLTSDDLEMARARMPILYVEAVPVRVDDSGEVTSIGLLLRIGPEGTVSRALVSGRVLHHERVRDALLRHLEKDLGPVALPRVPASLQPFTVAEYFPTQGVTPFHDPRQHAVSLAYIVPVAGDCRPRQDALDLVWFSPREASSELVQNEMPGGQGVLLKQALAHVGCLS

SEQ ID NO: 14732 - protein, 516 aa, Streptomyces avermitilis
VEKAQAGGRISGAEGAGGESGSGGGGALGHRDEAPGTGEAGPAEGAYDFAELRAQEFGYLDSGGHTYLDHTGAGLPPRSLVTASAERITGGCFGNPHSESPASRASGLLLAEARRAVLRHFNADPAEYAVIFTPNATGALRLIGEAYPFGRHSRLVMSLDNHNSVNGLREYARAKGASTAYVPVSGPGLRIDEERLTAALTARGRGLGLFRSRDGGRSRGLLAYPAQSNFTGVQHPLEWITRAKEHGYDVLLDAAAFVPANTLDLSRFHPDFTAVSWYKVFGHPTGVGSLIARREALATLRRPWFSGGTIYAASAQAGWHVLADDEAAFEDGTVNFLALPDVTAGLEWLDRIGVRRVHDHVSSLTDQLLRGLGELSHSNGSPLVRVYGPGEGEAARGGTVALNLLAADGGIIDERVVTRDSALRGISLRTGCFCNPGAGEAAFALSPPRLRSATRRQLSSMEDYLELLRLPSAGAVRISVGLSSQPRDIETVLRFVTETYRDQVPGVAGLAARSGC

SEQ ID NO: 14733 - protein, 506 aa, Streptomyces avermitilis
VRTDRTLRSQPVNQDSSGRSISRREALRGAGAVAVAGAGAAVLGGASTAVAADAFAHPGLLHTRADLDRMAAKVKAGTGQWKAGFAKLTANSHARSGWQANPQRTVYRGSGTPENYGTLYNDIHAAYQNALRWHITGETAHADTAVAILNAWSGRLTALDGSADRFLAAGLYGYQFANAAELVRDHDGFELARFQKMMLNVFAPVSEDFLTNHNGAYLTNYWANWDLTALACVLAVGILCDDRAKVRRAVTYFKSGQGMGSVRNAIPVVHADGLAEWVEAGRDQGHALLGVGLMGTVCEMAWNQGIDLYGHDDNRFLKGAQYVAKWSMGGDVPYTANTRKKGAPGVWSGTESATRAADVDPTMTRPIWAMISNHYTKRRGLSAPYLTRIAAKAAPEGGGGDYGPNSGGYDQLGFGTLAFTREAGDTAESTKAPTPTRTDAAPSAASSAGPATSPSASASEGSRSQGGSGDLAVTGTGGVAAVAGTGVLAIAGGLIALRRRQAGTRP

SEQ ID NO: 14734 - protein, 265 aa, Streptomyces avermitilis
MTALPRVLTIAGSDSGGGAGIQADLKTMLALGAHGMSVLTAVTAQNSVGVQGAWELPVEAVRAQYRSVVDDIGVQAVKTGMLGSSALVTAVAELLSDVAAPVVVDPVSVSKHGDRLLADDALDAVRTRLLPLATVATPNLDEVAQLTGIAVNDESGMRRAAAHLLAYGPRWVLVKGGHLPGEAVDLLTDGSAEHWLRAPRHDNRHTHGTGCTLASAVAVGLARGLPVPDAVREAKDYVTAAIAAGFALGAGIGPVDHGWRLRSQA

SEQ ID NO: 14735 - protein, 471 aa, Streptomyces avermitilis
MPLAHVPGGLPADGRRTVFDGRMPAAPGDLRVEGHGIEPVPENNRYGGAGRLFTVWFAPNLTMTGVFTGTIGIALGLDFATALAAVVLGTVVGAVPTAYLSTWGSRTGAGQLPLARLAFGRAVAVPGMLQWLSSVAWDALIGLFGGDALAQLCGWPFWLGVLVMMAGQGALGVLGYEAIHRLQIVMTFVLAAAFALIAWRMLDGVHAASTGGAHGADRAGAFVLTSTIALSLALSWAPYASDFSRYLPRSTSRPRMFWCTLLGLAVSFVAVQALGLWGASVLTDQTAAGVDQVLGGGALGAFGLLAVALAALCSNAMNDYSGSLALQTAGVRVPRPVAAALAAALGFPLVLWMHAANTTARFQNVLLFVGYWIPGFVAIVVVDWIARARTREGAEIDLAAEAGRPQPWWPPLVAFVAAFAAAVPFMDTSLYVGPVADALHGADLSYYVAFVVALALYAPVRLRHRREESLV

SEQ ID NO: 14736 - protein, 445 aa, Streptomyces avermitilis
MRRLLACLATAAVAVGGLTVSASPAAAADSGTFSVLTYNVAGLPESLSSASTPRDTSTTEIGRRIAPYDIVNVQEDFNYHAYLYSTDTHPYRTATSGGAGIGSGLNTVSTYAWDGDDFERAGWNSCQIDSGDCLTPKGFTFMRERLAEGVYVDFYNLHTNAGTNDGDEASRADNLDQLTSFIGTHSNGNAVVVMGDTNTRYTRSADTIAEFAAANGLTDAWVKLIRGGAAPAKGSDALVCDQTGATVPNTCEVVDKILYRGSKLVTLDATSYDNEHAAFLNSDGLMLSDHDPITAAFSWSRASAFQLSDQFGGPHGDYFNDIDSVPAGARATTVSLRSGSRVDRMGLTLGNGTTLAHGGTGGTASSLTLGSGEYVTSAHLCQGVKDGHTRIFYAKFTTNLGNSLAGGTTTSDCVTRTAPSGRQIAGFHGRAGDEVDKIGFIYTQR

SEQ ID NO: 14737 - protein, 318 aa, Streptomyces avermitilis
VSLLSAPPDGTAPRPLAAQRVLPLRRPGRWILTAIVLVLVAQIGHGLVTNPFYQWDRFAYWFLRPTILDGLLITLEVAAYSAVLGLLGGILLALARLSRSPVLRAVSWVYVWLLRSVPLIVVLIFLYNFSALYKTLSLGVPFGPAFLTFDESRLATDMAVAVVGLSLNEAAYAAEVVRGGILSVDQGQHEAAAALGLPKSYQFTKIVFPQALRSITPNYVNQLIGLIKGTSLVFYVSLLDLFGSAQTMGSTYPGDIVPLLLVVTVWYLILTSIVSVVQFYVERHYARGATRSLPPTPLQKLRTALGDLRARIRREAAL

SEQ ID NO: 14738 - protein, 261 aa, Streptomyces avermitilis
MTTETLKVDSAAVEVHDVHKWYGAHRVLNGVELTVRPGEVTVILGPSGSGKSTLLRVINHLEKPEVGYVSVNGELIGVRRHGDRLKELSERVILAQRSRIGFVFQNFNLFPHLTVLDNVAAAPVATGRLKKPEAQELARDLLGRVGLADRTGAYPRQLSGGQQQRVAIARALALRPGVILFDEPTSALDPELVGEVLAVIKDLATSGTTLVVVTHEIGFAREVADRVVFMDGGRIVEQGPPAEVLDHPKHERTRDFLSKVL

SEQ ID NO: 14739 - protein, 341 aa, Streptomyces avermitilis
MRTLSLRSRLLRGLTAGTAVASLAAGLAACGGDSDAATTTDSAASGTVTVGRLSNGAAKETELKVSEVKSISAELPESVAKSGKLVIGVGGLPSGSAPLNYVGEDQKTLTGVEPDLGRLVAAVLGLKPELKNSTWENLFVGIDSGKSDVGFSNITVTEERKKKYEFASYRQDNLAFEAAKKNNWNFDGDYKNLAGQTVAVGAGTNQERILLEWKAKLAKEGKKLTVKYFQDNNSTYLALSSGKIDAYFGPSPAFAYHVTRVAKTPAPTRIAGKYSGAGATLQGLIAATAKKDSGLAKPVADAINYLIKNGQYAKWLAAWNLSNEAVAKSEIDPAGLPLDNS

SEQ ID NO: 14740 - protein, 252 aa, Streptomyces avermitilis
MSTSVLPVASRSPEAPHVLDNAAWAALTGPHARFAERVGRAARYPLDVSPFTALADPSDPRAWDDLAALVGPGTVTPVSGATVPPAGWETVRSGHGVQLVATALHSEPAPEAVRLGPGDVPEILELVAETEPGPFLPRTVELGTYLGIRHRGRLIAMAGERLRPPGWTEISAVCTHPDHRGRGLATRLVRAVAAGIRERGDTPFLHAAASNTTAIRLYESIGFTLRRATESVRVRTPDRRQEQTAGPCRCDA

SEQ ID NO: 14741 - protein, 420 aa, Streptomyces avermitilis
VASTPPSSLPSSSPSASSTPSSSALHLAVALDGAGWHPAAWREPVARPRELLTAGYWAGLVTEAERGLLDFVTIEDGLGLQSSHFTEPDGRTDQVRGRLDAVLIAARVAPLTRHIGLVPTVVATHTEPFHISKAIATLDYVSTGRAGLRVQVSARQNEAAHFGRRTFPRFDIEDLDTPAVREVTTDLFDEAADYVEAVRRLWDSWEDDAEIRDVATGRFIDRDKLHYIDFEGRHFSVKGPSITPRPPQGQPVVSALAHQSTPFQLVGRSADIGYVTPHDLDQARAIVDEIRAAQTAAGRAGDTLHIFADLLVFLDDDPGTAAARRERLDSLAGHPYTGDARVFTGTPAQLADLLLELRQAGLSGFRLRPAVVGHDLPQITRGLVPELQRRDAFRRAYEADTLRGLLGLTRPANRYAAATV

SEQ ID NO: 14742 - protein, 458 aa, Streptomyces avermitilis
MSKPLKQIHLAAHFPGVNNTTVWSDPEAGSHIEFSSFAHFARTAERAKFDFLFLAEGLRLREQGGKIYDLDVVGRPDTFAILTALAAVTDRLGLTGTINSTFNEPYEVARQFASLDHLSDGRAAWNVVTSWDAFTGENFRRGGFLPQGERYSRAKEFLATANELFDSWRGDEIVADQQAGTFLRDARAGAFVHKGQHFEIEGQFNVPRSPQGRPVIFQAGDSDDGREFAAAGADAIFSRYSTLKEGQAFYTDVKGRLARYGRTHDQLLILPAATFVLGDTDAEARELAREVRRQQVSGATAIKHLEFVWNRDLSAYDPDGPLPDIDPDLGEHTIARGRAQVRMYRDPLATAREWRERAAANNWSIRDLVIETGSRQSFVGSPATVAETIDSFVQADASDGFILVPHITPGGLDAFADTVVPLLQERGVFRTEYEGTTLRDHLGLAHPDADAPGERVAS

SEQ ID NO: 14743 - protein, 739 aa, Streptomyces avermitilis
VTDSTIIYTHTDEAPALATYSFLPVVQAYASQAGVAVETRDISLAGRIIALFPEYLEDGRRIPDALAELGELAKTPEANIIKLPNISASIPQLKAAVAELQEQGYALPDYPDDPKTDEERDIRARYDKVKGSAVNPVLREGNSDRRAPASVKNYAKTHPHRMGAWTSESKTNVATMGVDDFRSTEKSAVISEAGSLRIELKGDDGSTTVLRESVPVLPGEVVDASVMHVTALREFLTAQIARAKAENVLFSVHLKATMMKVSDPIVFGHVVRAFFPKTFAQYGETLAAAGLTPNDGLGGIYKGLESLPEGAAIKASFDAELAEGPELAMVDSDKGITNLHVPSDVIVDASMPAMIRTSGHMWGPDGQEQDTLAVLPDSSYSGVYQVVIDDCRANGAFDPSTMGTVPNVGLMAQKAEEYGSHDKTFEIPTTGTVRLVDQAGNVVLEQTVGAGDIFRACQTKDAPIKDWVKLAVTRARATGDPAVFWLDETRAHDAVLIEKVKQYLPEHDTEGLDIRVLSPVEATKFSVERIRRGENTISVTGNVLRDYLTDLFPILELGTSAKMLSIVPLMAGGGLFETGAGGSAPKHVQQLVRENYLRWDSLGEFLALASSFEHLATTTGNARAQVLADTLDRATATFLNEDKSPTRRVGGIDNRGSHFFLALYWAQELAGQTDDADLAKAFGPVAETLGTNEQKIVDELISAQGKPADIGGYYQPDPEKAAAVMRPSATFNEAIASLA

SEQ ID NO: 14744 - protein, 391 aa, Streptomyces avermitilis
VASDETSHPAGRPFRLSRGRRPMNRALTLDDLMVAGIALAAGLVAAFLLRMLMRWLGKHALRTRWSGDDVIVDALRTVVPWAAITGGAAAAATALPLTKSVGHHVSQTLTVLLIAVVTLTAARVISGLVRAVTQSRSGVAGSATIFVNITRVVVLAMGFLVMLQTLGISIAPLLTALGVGGLAVALALQDTLANLFAGIHILASKTVQPGDYIRLTSGEEGYVVDINWRQTTVRQLSNNLVIIPNGQLAGTNMTNFTRPEQQMTLLVQVGVGYDSDLEHVETVTTEVVAEVMTEITGAVPDHEPAVRFHTFGDSRIGLTVILGVGEFSDQYRIKHEFIKRLHKRYREEGIRIPAPARTVALQQGSVSIPHQRTGDDLPAGQGGPASALLDQ

SEQ ID NO: 14745 - protein, 255 aa, Streptomyces avermitilis
MSVRIERQGYVSTVVLSRPAARNAVDGPTAAELAAAFREFEADETARVAVLWGEGGTFCAGADLKAVGGERGNRVAQDGDGPMGPTRMTLSKPVIAAVAGHAVAGGLELALWCDLRVAEEDAVFGVFCRRWGVPLIDGGTVRLPRLIGTSRAMDMILTGRPVPAREAYEMGLANRLVPPGRARAEAEELAAAIGRFPQDCLRGDRASVLDQEGLDETTAMRGELRHGMRVLAQGVEGAARFAAGAGRHGSFGEQG

SEQ ID NO: 14746 - protein, 288 aa, Streptomyces avermitilis
VRQRSVLTEGFGQLATARWPWLAVAVAATCLTWVAAAVTRQGAVVERLPARRLLATQFAAGAANHLLPTGLGASAVNLRFMTVCGVPLARSSAALALYMLAEAITRLALLLVLLIAFPDALHLGSLVPDGALGPLLLAVAGALGLAVTVLLLVRRLRTAVLSFLRTALGEARSVHARPARALALWGGALAFPALQAAGLAAVGQALGLPVPPLHMAVAYLAATAAVALVPTPGGIGSVEAALVVALVAAGGPAAVATAVVLAYRIITVWLPLLPGALTLGALVRLKVI

SEQ ID NO: 14747 - protein, 635 aa, Streptomyces avermitilis
MSMETTAWTQLHSVMNAQRETRPFARATLRRIAAFARPHRRRIAQFVVLSVVTALLAVATPVLAGRVVDAIVSGGDESTVVRLAVLIAVIALAEAGLGLVSRLLSATLGEGLILDLRTAVFDHVQRMPVAFFTRTRTGALVSRLNNDVIGAQRAFSNTLSGVVGNVVTLLLTLAVMLTLSWPITLLALALLPVFVLPARRMGSRMAKLQREAADLNAAMGTRMTERFSAPGATLVKLFGRPDEESAEFAARARRVRDIGVRTAMAQWAFITALTLVSALALALVYGLGGWFALRGRLEPGAVVSLALLLTRLYAPLTSLAGARVEVMSALVSFERVFEVLDLKPLIEEKADARAVPDGPASVEFDNVRFGYPAADKVSLASLEEVAALDTRGGAEVLHGVSFRAEPGQTVALVGSSGAGKSTIAQLLPRLYDADEGTVRIGGVDVRDLSAPSLRATLGMVTQDGHLFHDSVRANLLLARPSAAEDELWDVLRRARLDELVRSLPDGLDTVVGERGYRLSGGERQRMTIARLLLARQRVVILDEATAHLDNTSEAAVQEALAEALAGRTAVVIAHRLSTVRAADVILVVEAGRIVERGTHEQLLAADGRYAELHRTQFGKPVPGAAEVAEAGEAVA

SEQ ID NO: 14748 - protein, 741 aa, Streptomyces avermitilis
MSSQTGAFRGRRKPGECGVTEPEAGAGPRRRRAAPKQPWHRRVLSSFTTSADAEAGAAERPSARPADGAASAHRRGARRKAAEPTAIARVTVRLTPYARRLKPEYPRPGLDGWRRWMPSVRQWLGICLVSLGLSGTFLAVAYAATDIPDNLNTYATQQDNVYFWADGTPMARTGWVRRQAMPLKDIPEDVRWAVLAAENASFYSDPGISVSGIGRALWRTVGEGDTQGGSTITQQYVKNVYLTQNRSVTRKFTEAMIAVKLDQRMSKDQILEGYLNTSWFGRGTYGIQRASQAYYGKDVGELNASEAALLASLLKGAGLYDPTLSQANHQRAVERWKWILDRMVELGKLSPTERAKYTHFPEPTKQAQTYDTGNQSDYLVELAAQYAKKAGHISDKQFDLGGYQIYTTFDKKREEALTAAVKKARKKAQKDDKGKAETAHYGGSSVAADGRILAVYGGPDHRKQGFNESNASTVPAGSAFLPFVYAAALEHGVHKDRGSTTTPVTPDSVYNGDDGVPVTTPEGPYWDRSGKKVAAHNDGGTSWGQITLRKALAESVNTPFMQLGMDAGLATVRETAEATGMLSSSMGPQVPTLSLGTSTPSAIRMASSYATFAAGGTHTAPYSVRRVTRNGSKVDLDTPRPRRAVGADVARQVTDALTDSFRTQHPTAAPASAQVAGKAGTTDKDTAAWYVGTNRSVSTAVVVYRMDLTKSLEPLPLKGIAGTPATGVPYDIWSSAMSPLG

SEQ ID NO: 14749 - protein, 408 aa, Streptomyces avermitilis
MAVLLVVACIAATFLALNGTDDTKPTASSTDGGRSGDDTDKSTSEPKWDGKTKVLGDGSTSYTGPQKGQLKPERLKPGEKPPQFVVFSWDGALQGDDQLFSHYRELAKEYNAHMTFFLTGIYVLPKAKKTLYEPPMHSPGSSAISYPTDEHIRTTLTELGKAWKDGNEIGTHFNGHFCDAKGGKDWSVADWESEIKQFFSFVEKWKTNTGYTDLPALPFDAKREISGGRAPCLEGQKNLLKAMRATAKDYNWRYDASSAGDFQIWPAKKNGIWDFPLQMLPYEGGKYQGLSMDFNFLYNQSDGETEGDPVQYPQWQAETVQSYMAGFNRVYYGSRAPLFIGNHFENWNGGIYMEAVDQVIKNVCTKKGVRCVSFRELADWMDAQTPEVRAQLRTLDPAQSPDWSEVVK

SEQ ID NO: 14750 - protein, 377 aa, Streptomyces avermitilis
LSRRRATVLAVAVSAALLPVSAAGAATGSAATSGTADRATTDAFGRIADAVLTDRTAALLDRQQLKSTAAKIKGGVRLSSALTKTEGTALSALRGRQSRLAALGEAYTAADTRVGVDKTRIKGSRATVEVTETTVLTYKKIRGDEPRTTGFKAHHELTFVAQADGTWKLSGLRSTDKGPRAVNEPVTTAPAKVRPSAVIDAPRAATTYPAPANPKQTTGTGYDYTAMAAYAEKYWKNYNTAYRKFNGVGGDCTNFVSQSLLAGKWQPISTVTPEEYDTWYYVANGQSDSWAGVNEWSWFTQTAKRTTPLANVYQLDVGDVLQMDFDKDGSKDHTMITSYRGSNGVPYLTYHDADTYRRSLSSLIASYPTAAFYGYRT

SEQ ID NO: 14751 - protein, 539 aa, Streptomyces avermitilis
VSAVVRTLGGMEGNEGKPVRGAEADAEAWQRLSAYSYLSAPERLEYVAVMRVFCGTLLADLSVPDLLAKLAEKGGPGAALDAETLTRRLEELVRWGNLLRSTHTVRATSIAEYQRSRSRYQLSKLGERVQRDADEVLAGADAAREVSSELLALVDRGLREIAAMAAAPGGADPQQALERISTLFVQFAEFAESVRDFYAYLGQVLARYDLDSAEYQGFKELLLDYVEAITEDVSFRAPRIAAHLDAVRPHLPALLDRVDAHAAGIGALAHGLTETRVQRSRGRDLADWEGLRDWFTDTGGHGSQVDQLRDATLRALESLLANAKRMLRSASGEMSRRKDLLRLAAWFDAAEPEEAHDLAVAAFGLYGARHLGVAPDPDRSVPAYVSWWTGPVVDVPVALRERGSRAPRGRAAAAEDHSEQKRRLMERARQQAEARQAAADELRSASGRFEQVRLSAPAMRLLLELLTTALGNAQLHKDAHDFLLDGAQAHDADLDIRLTAWRTPGRSTVLRSVDGDLTADDLTVAVESASAPAVGEASA

SEQ ID NO: 14752 - protein, 445 aa, Streptomyces avermitilis
MPLPSAHDVALAAERHTAARLLLAQPLVTGAGPHSDAFPLIRRHADWLAQRFQQVFGYRLLVEASYARLFKAGLGPGSGHRLERPSTGTPFSPRTYAYLSLALAVLVTAPEQLLLSRLVADLRAAAVDAGIEIADTGRQGERRTLAAALRQLVDWGVLVETEGHVAAVAEERAGEALLTVDREIARAVVAGPLAQSRDGADLVRRAADPGFGGPRTYVRWRLVETPVVHLDDLTDAEREWLRTRQRREAQAFSELLGLEAEIRAEGIALVDTEDELTDLHLPGTGTVAQAALLLVERLVDRLRPEDPGHPAVGGRLVIGVPVPDGLLPALLDELIEEYGRRSNWQRGHLEDRDGFLAAVLDLLVRMRLMAPAGPVRAEGHGLPEGYGETVADDRSVTDVSQARGQGRTDGVWILLAAAARYATTVAVKPRTDQPPADDVSKESPR

SEQ ID NO: 14753 - protein, 1399 aa, Streptomyces avermitilis
MNRPPNPHRYRLHRAGIRNVWQYDEQEFAFGEGRLLLRGKNGAGKSKALEMLLPYLLDGDARALDATGTGRTTLAWLMLDGFEQTNRLGYLWLEFVRTDDEENDHHLTIGAAVRASRSTKTAKPIFFTTRLRVGKDVDLAPAGRPLPVDQLKSLVGPENVTDRAVEHRARVARELFGLTDSARYRNLLHLLHRLRRPTIGDRIDSGGLVSVLAETLPALDDEVVEQVARSLDDLDSVRAYLGRLERTDRALRTFLADYRGYLHGTLRRRTGRANGALEQLMEYRTFAGDATRNAEGLRERERELDARTEALEGEASAAETDLAALHAGAGYRGVKELAEKRATVTALHSAAAAAFKAVRQAHSNQEEAGRRLTDESGRFGEELVELSTLQGELVREAERSGVDPVHLGEPVGTPAAPVAPARTAELTAPEGDFHLVRHSEVLAVDIETCATALYAWDARLDAAQPVIRNRSRFVTELRALMGRSDEAQREAQAADAARERLEEQADHARSGAEQRRQETVHEGEAYAAAARAWTEQLRSLTGVPVDTAVSALAGHDPADGPLSAHAPDEVADAARSAVDPWLAELGEERDTLTLAARELQTERDRLRHRREEWERRTDPEPPPPSHRAAPRAPGTGAPLYRLVDFAHDLEPDARAGLEAALEASGLLDAWVRADGTVLDPATRDTLLVPAAPVPGETLARVLRPVDAPDSGVTAEQVERVLRAVALARGGIGAGEADTAGAAHTAIGVDGSWRLGVARGRHAKQVAEYVGAEVRAETRRRALAELDLRLTRVQDELAERQRSLRMLTQHRDQVGDLLRRPPSARGLTDAWARTAEAERTAESFAGQAATAAREAEQARAGAVVARREAEATASAQDLPADPAALETVRLALDRLGQGAQRLRRRVRAVLSAADGHRGSRTDYGRAESARREAESDYAEPLGRLEAARRTVRALEEAIGATEQEILDREAETMRRLDAVGRQLPRIRRDLADVHDLRVRAEEEERARREALADQEAEALACGRGLRKALALPGVLRGAGLDTDGDEVALKSPDPLHLDVRERIAALRLLVDAVRRGLDAERHDISDTTLLNRHTDLRDQLSGGYDATIEEHDGIKLCRLVDDHGLHDIAVVGERIAAEAAEARDRLTEREREVFQRFLAGELGDHLSSQVLAAGALVAALNTTLATVRTSHGLGVALDWKLADGVEADVKAAVDLLRSPSGLRTREQSEQLRDVLQRRIEDARRADPAAGYAAHLRTALDYRDWFAFTPWVVNDAAPGSRRRLSGRTGLSQGEQRVLSYLVLFAAAAAHFTSLADAAPHAPRLILLDDAFAKVDEPTHARLGRILVDLDLDFVLTSERLIGNWPDVPSLHIYECLRDPHVRGVATLHYTWNGRQRRLMSV

SEQ ID NO: 14754 - protein, 445 aa, Streptomyces avermitilis
MTGPERADVRPPDADALAFLTRPGLARLWTAVRTRLERNGLRPAGAIRLDQLDAREREALSLLLARPVTGLTVTMRLTDLDTRLRASAVGRGLVAMLEELGPPLTDRRAVRDAAAAERAHVWSTARSELEATLLSAQPWAAQWLEEIRRGGTLARQDSHTAITVITQAIQTLGALFPGTNQPPTPATWGRGELATRTTGSAHGLDDGTLLSRLVLRGIALARGVESPADAPARRALWRMASVTPDEVSSTVLTYGLRPTGGTWRERALRERADHHMETHLTLRELRALRLEVPPRTRVHVCENPRVVEAAADTGGGTEPLICTSGSATTVVLTLLDALAAAGCTFAYHGDFDWPGIALANRIRHRYAAEPWRMRAADYEYLATRAQLHGTPQIPLTGTPTDAEWDPELTPTMAALGIALHEEAALDLLLEDLGTSVGTHPSGDSP

SEQ ID NO: 14755 - protein, 402 aa, Streptomyces avermitilis
MASIRSRVFGAHVRPLQLDLADLSSLKTAVDRLGLDHLDVVVHNAGVALDEPPRRETEDGHELMFGTNHLGHFALTQWLVPPAVRGVGGPQRDGGKLRGAVGATGPGRSAVDPGSPQPFDFRPSPPGLRPARWSYTFESEAGGAAGCALSRPPVHAPATHRREGAPMKVQGSVAFVTGANRGLGEQFVRALFDAGAAKVYAGSRDPTRVTVPGAVPVAVDITDLESVHAAADQAQDVTLLINNAGLSTRADVLTADLDSFRLEFETHVLGTLAMSRAFAPVLGRNGGGAVVNVLSVLSWISITASAGYAAAKAAEWSMTNALRVALAEQGTQVTALHVSYLATELAAKVTAPKSDPAAVARATLDGVEAGLHEVLADDFSRQVQAALAVGPEALYPQLAGRH

SEQ ID NO: 14756 - protein, 178 aa, Streptomyces avermitilis
MLTVRPILPKIEGGRVQGLLQLIEDGIHLVVAALLVLLAGLLTVGVVHDVIRSVQGPYREETVVLSALDNGLVLFIVAELLHTVRLTIRNQTLDAEPFLVVGLIAGIRKVLIVTAEAEASFRWNVEGIELLILAGLILVMATAAYVWRRSTRPGDYFPLQEARRSSSPAPSPAPGRGP

SEQ ID NO: 14757 - protein, 784 aa, Streptomyces avermitilis
LPALRPGRTDGGRSAVSAVSAVAAPGPAAAAASLFAGRVGGFLARRLPHLDQADATRQGVPARLTPVTWLRAFGEVVRSGLTIEETRLEPLLALRTAAGVAIVVGPALWLASPAYAASAALGAYSAGGATFQRTWRPRKVIALGAGAGLALSTFVGYLAAGRLVTFLPLLAVWAFVAGMAWAVGSTAGIVAATTVGSMLVTITLPTSVGRALEHAGVIALGGVVQAVLILLFPIRRWGAHRDALADALAAVADYARRLRHDPTAPFDPEPLMTARDAAAVTPSQARTRPPVLHGPRGLAERIRPVVAALADPDVGAPAEGPGRDRARELLDAAADVLDAAARSIRRGTPAEVPPRSTDVLRVDEDHEVLEGPARQAAERLVELLGEVLEIAGSGGTSGRTPTPPGPADAQFLVRPTMFRLVPVVVRAVRRELRRDSPVFRHAVRLAAVATLGYLIAARLPLGHGYWAPIASVMVMRPDFHRTYARAVARLAGTLAGVALATGMVRALGPDAHVFGALAVVSAGLSYTLIRTGYAYSQCFTAAYVVFLLGMGGQAWEQTVPERVVLTLLGGALAMVAYVVFPAWETPMLAGRLADWLAANGRYAAAVLRSYAEPTREHRADMRRALLASRKARAAWQETYDRARQEPVGPRGLTSREAQDAQEALKGFGRAAMLMESHVPRADSRFVPEAERFAEALEADTAQAAVDVREHRNPDWGRVEEALHAWEGSAAGDRSPVMRRGAELQKQALEDLATAVSRTPLERDVGSAREEQRVRATLAAEGDGR

SEQ ID NO: 14758 - protein, 391 aa, Streptomyces avermitilis
MKAAVYEGPRTVAVKDVPDAKIEHPCDIIVKITTTNICGSDLHMYEGRTSFESGRTLGHENMGQVVEVGSAVRKVQVGEYVVLPFNIACGFCKQCERGLTNYCLTMQPEPALAGAAYGFADMGPYQGGQAELLRVPYGDFNALRLGEDAAEWQTDYVMLADIFPTGYHATEMAHVKPGDQTIVFGAGPVGLMAAYSALLKGAGRVWVADHQPDRLRKAEEIGAIPINTAEQKPGEVVKEATLGLGADNGCECVGYQAHDPEGHEDASLTLNGLIDSVRFTGDIGVVGVFLPQDPGGAEAQGELEAQGKVPLDFGLMWFKGQHMGTGQAPVKRYNRALRDLIAGGKAKPSFVVSHELSLDEAPTAYEHFDARDEGWTKVVLHPNGHGNGHKR

SEQ ID NO: 14759 - protein, 473 aa, Streptomyces avermitilis
VRDVLVGAPELALVAVVDAVLLRLDVHGGLLVRVQQPVPVLLPEPAPRSVDVDPQAAHDTAQNRTACTCWQGPACHAASAIPRGHPVGTGDRWGSRREGVMRVSSQGVTVVALLADPDAPTEIAQRMARILPARLADKSGQGRRFDVEVVSEPFTARTEDPPTLMRRIMDRGRAESWDIVVALTDLPLHSHGRRLVVDLSHEHGLALLSLPPLGGLRLQTRARRAVEEAVLSLAGPRATGAEGPPRSQPLLGPFVSRLAPIHPGQVGEEETVDLRYVVSGPRGYLRVLVGMVRANRPWRLVPGLSKALAAALATGAVATVNSTIWNLAESLSTPRLVIATVGSVALMIGWLIVDAQLWHRSAEVSREARQRARLYNASTVMTVGIGVLVCYVGLIVINLVWALFILNDQVFASTTRTPLNAAEYWTLSWFVASVATVGGALGSGLESDEAIRAAAYSKREQERRHMLQDDDGD

SEQ ID NO: 14760 - protein, 218 aa, Streptomyces avermitilis
LQSTEKGCGQALPGVPTARVVQPATREGSRTMTQELRGMRVGILATDGVERVELDQPRGALQGAGAKTEIVSLHPGEIQARQFDLNAAGTFPVDRLVADASVDDYHALLLPGGTMNPDQLRMDRDAVQFVKDFMASGKPVASICHGPWTLVEADAVRGRRLTSWPSIRTDLRNAGAEVVDQEVVVDGQLVTSRSPADLPAFCAAVVEQFARAHHPMPG

SEQ ID NO: 14761 - protein, 201 aa, Streptomyces avermitilis
MLLCQGKRGCPFSAWGAEALSRGLCESRPGNSRWRRGRERTTSSVPGEEARGMTVMGVSKFERFFRAAASLDVDKNDLKRYGDFVDAKLYDLLVVGQASAKANGRDTVEPWDLPITKGLQESIHRFRQLDEEVELKPILEQLAAHPPLDRTPTQETEERYPEIIGGLSVALAETFKILYPDVKNPQTSHWEGVTAVFDRLL

SEQ ID NO: 14762 - protein, 281 aa, Streptomyces avermitilis
MSAESARTVALPSGEEVAALGQGTWYLGEDPARREQEIAALRLGVDLGMTVVDTAEMYGDGAAEELVGEALWGRREEVFLVSKVLPGHADRKGTVAACEGSLRRLRTERLDLYLLHWKGRWPLEETLAGFTDLMEAEKIRYWGVSNLDVADMAELTTLPGGDAVTVDQVLYNLSRRGIEWDLLPWCREAGVTVMAYSPIEQGRLLKVEALGAVARALGATPTQVALAWMLEQGVAAIPRSGSPDHVRENRGAVDLNLPTEALDALDEAFPPPSGPTPLEVL

SEQ ID NO: 14763 - protein, 397 aa, Streptomyces avermitilis
VAVAFTVLMAFGTAPTPLWPLYEARDHFGATTVTVAYASMVVGAAAAFLGLGHLSDRLGRRRIIVPALLVGIVASVVLIVWRDLPGLIAGRILNGVGLGLMASTATTYLHDLHHEARPERTGSVLPGIVATAANLGGLASGPLVAGAAAEWLPTPLITTQAIFTLAMAVCLALVLSTPETVDLELPAAEPPSRFVLRPGGWRAFGAAGALGAFAFAILGLISSLGASVLHGTLHTDSHLVVGLAAFLMFGSAAAAQLVLGRLPLPRVLTVGAVVFPVGLVLCAVALYHPALWLYLVAVSLSGAGSGLLFKGGLERAVSVAEPASRAGVLAVFFVVAYLGMGLPSVLFSIALRHFAVQTAMIGFAAVLSCGAVVSVAVALRDRAPGPGTLSAQSARPS

SEQ ID NO: 14764 - protein, 296 aa, Streptomyces avermitilis
VELRQLEHFIAVAEELSFTRAARRLHVVQSGVSAAIRSLERELGCALFERTSQQVRLTGAGAALLPEARATLHAAQAAQDAVRAAQDTLRGTVNVGAMASVEVVDLPALLGQLHARHPAIDVRLRLATTGSAGLAHALLSGDLDVAFLSLPEHKPAGIDARELATVPLVLVVSADHPLAQRGEVALADLAAEPFVDFPPGYGNREVVDRAFAGAGVVRRVALEVPDIDMGAALVRHGLGIAFLPAFAVARTPGLHVLDVHGTMLRWSMHLGTSSTRRPSSALRALLDLVDLHVIAL

SEQ ID NO: 14765 - protein, 593 aa, Streptomyces avermitilis
MASSRAHNLYRRCSDRESSLPRGSAGRHHTAARRGPRPPAPTLADHALRDLTVLSRALLDTPDEGEILRLAMEHIAAAGPYSAEAGYLKVDGDLVPSPRNRQTHASAVNRRVRELAGQDGAVTVPGRPWGRALGLRGLEGLHGYLVVTSRSRPTEAERSLLATLVRHTAAALSVAFAYRHQREDALELHRLRDERTALQRQLISVVAELRYQRAVHALMADVTASSGGEEAITRVLHKLTGFPALVEDRFGRLRSWTGPSRPDPYPEPDPVRRDEMLHAVARQAGPVRIKDRLITLVRPHGEILGVLALVDARDEADEHAVLALEHAAASLAPELAHLRNLAEVELRLHRGLVDDLLAGTDEGSAYARSEAVGHDLHRSHYIVVVQWPNRTADDSFAQTVGRAASAVGMRSLLTRRSDHVVLVADARPHARALYEALARETGTRSGTIGVSAPCDSPDDIPHHYQEAQRALEVRLHSREHYGTTFFDELGLYRILGPGNDYRELETFVQEWLGQLIDYDSRHHTAMVETLSRYFDCGGNYDETADSLAIHRSTLRYRLQRIRDISGNDLANVEDRLNLQVATRVWKIVLGGPG

SEQ ID NO: 14766 - protein, 633 aa, Streptomyces avermitilis
MAKAVGIDLGTTNSVIAVWEGGEPSVVPNSEGNRTTPSVVAFTDTGERLVGQLARRQAILNPKGTIYSAKRFIGRHFDEISDEARAVTYDVVEGDGGAARFKVRDKLYAPEEISAQVLRKLADDASKQLGERVTEAVITVPAYFNDAQRTATKDAGRIAGLEVLRIINEPTAAALAYGMDKKEHETVLVFDLGGGTFDVSILDVGDGVVEVRSTAGDSHLGGDDFDRRLVDYLADDFQQENGIDLRKDPQALQRLFEAAEKAKTELSSVTQTQVSLPFITADASGPKHLTDTVMRSTFEQITSDLVERCLGPVQQAMADAKVGESDIDEVILVGGSTRIPAVQALVRRLTGGKDPNMSVNPDEVVALGAAIQAGVLKGEVKDVLLLDVTPLSLGVETRGGVMTKIIERNTTIPVRRSETFSTAEDNQPAVDVVVLQGERERAADNRVLGRFQLTDIRPAPRGEPQVEVTFDIDANGILNVTARDKDTGKEQGITISESSNLDRSEVERMVQEAERNQGQDQALREAVDARNELDAVAYQVEKRLAELGDAAPAHEKARAEMLVSDARAAVKEEAGVERVRPLTSELQQVLAGLAAHQGAATADGGPAQHAATGGPTSGGGGGDDVIDAEFDKG

SEQ ID NO: 14767 - protein, 203 aa, Streptomyces avermitilis
MPTRPQEPDRAASDPVEPVPEGAGRPPRGDLPQPGPPARPEATNGEPGPDAAGPAPAEDEYTTAIQELEDRWRRTLADLDNLRKRHARELERERAVERSRTAAAFLPVLDNLELALTHAGADPGAIVEGIRAVRDQAVNVLELLGYPRHAETGVAFDPARHEVVGVVQDPDAPPGTVVEVLRPGYGDGERQLRPAAVTVTKRE

SEQ ID NO: 14768 - protein, 317 aa, Streptomyces avermitilis
MARDYYEVLGVSRSASQDEIQQAYRKLARRHHPDVNKDPGAEERFKDLNEAYSVLSDPKTRARYDRFGEDFRKIPEDFDERVAAGAGGGFRGRRTAGGGGPRVRYAPGFGDDFGAEGIDIEDLFGSMFGAGAARGGVPGADQEAELPLTVEEAYRGGRRTVTLAGPDGQPRRYEVDVPPGVTDGQRIRLAGEGGRGSGDAAAGDLYLRVRIQPHPRFRLDGRDVHVQVPVAPWEAALGATVPVPTPGGGTAKVTVPAGSSSGRRLRLRGEGMPNPRGANGDLYAELRIVVPPTLGDQERELFEELAATSSFDPRRTR

SEQ ID NO: 14769 - protein, 135 aa, Streptomyces avermitilis
MNDRPAGAAGIGRAGVGDRPGRTGADLTASTAVRYALVPAPRLSLEAVARRSGLHPDLIRRFVALGLIDAERDAAGRLVFDPTAPAVLARIQRLRTGLCLNYASIGLVLDLLDRISLLEAALRGRGTRSETPPWT

SEQ ID NO: 14770 - protein, 879 aa, Streptomyces avermitilis
MDMNRLTQKSQEALQEAQTAAGRMGHTEVDGEHLLLALLDQEDGLIPRLLQQAGTEPKELRAAVREELSHRPKATGPGAAPGQVFVTQRLARLLDAAEREAKRLKDEYVSVEHLLLALAEESSSTAAGLLLKQAGITRDSFLSALTQVRGNQRVTSANPEVAYEALEKYGRDLVLEARSGRLDPVIGRDAEIRRVTQILSRKTKNNPVLIGDPGVGKTAIVEGLAQRIVRGDVPEGLRDKTVFALDMGSLVAGAKYRGEFEERLKAVLSEVKAAEGRILLFVDELHTVVGAGAAEGAMDAGNMLKPMLARGELHMIGATTLDEYRKHIEKDAALERRFQQVLVDEPSVEDTISILRGLRERLEVFHGVKIQDTALVSAATLSHRYITDRFLPDKAIDLVDEACARLRTEIDSMPAELDEITRRVTRLEIEEAALSKESDPASKTRLEELRRELADLRGEADAKHAQWEAERQAIRRVQELRQELEQVRHEAEEAERAYDLNRAAELRYGRLQDLERRLAAEEEQLAAKQGENRLLREVVTEEEIAEIVAAWTGIPVARLQEGEREKLLRLDEILRERVIGQDEAVKLVTDAIIRARSGIRDPRRPIGSFIFLGPTGVGKTELAKTLARTLFDSEENMVRLDMSEYQERHTVSRLMGAPPGYVGYEEGGQLTEAVRRKPYSVVLFDEIEKAHTDVFNTLLQILDDGRITDAQGRTVDFRNTVIIMTSNIGSEHLLDGATAEGEIKPDARALVMGELRGHFRPEFLNRVDDIVLFKPLGERQIERIVELQFDELRQRLAERRITVELTDAGREVIAHQGYDPVYGARPLRRYISHEVETLVGRALLRGDVQDGATVRVDAEHGELVVTYDQPEDVKGAWAA

SEQ ID NO: 14771 - protein, 151 aa, Streptomyces avermitilis
VGGMSTMQATTVSCPNCGRTNRVPVAAEGRPKCGHCKQPLPWMVDASDDDFTEVAERADVPVVVDLWATWCGPCRMVSPALEKVATDLAGRIKLVKVDIDKNPRLSRRFEVQAVPTLLVLDQGETVARQAGAAPAPVLRQWVEQSITAREG

SEQ ID NO: 14772 - protein, 616 aa, Streptomyces avermitilis
LALVLRPRGVRLMSGDQPLPGEEPVPEEADEAVFLETPDIYGAYPRLTEDQIARLAEHGQRRSMAPNDVLIREGERCETLFVVLSGSVAVVEDHGTPEEHVLRVHGPGRFIGELGLLYGQVAFYTAVAREPGEVLVVSLDQLRRLVSQDSTLGDLVLRACLGRRALLVGQGAGFRIIGSRYSPDTRRLREFAVRNRLPHRWIDLETDEEAEDLLRRFGVGPEETPLVIWRDTTLLRNPSNAELARLIGLPSLPAGNRHGDVLIVGSGPGGLAAAVYAASEGLSTTVVEAMATGGQAGTSSRIENLLGFPAGISGAELTERAVLQADKFGARISIPVEASGLHPKDEDHYVVAFADGSEIAARAVVLATGARYRRLQVPGIERLEGTSVHYSATVYEAQQCRTDPVAVVGGGNSAGQAVLFLAGYAPKVHLLVRGPSLEANMSRYLVDQVERHPRVEVMLHTEVTEVIGQEVLEELDVVDNRTGGHRRLAVRGLFVFTGADPHTEWLAGIIALDSRGFVLTGPEAQEACAHPEVWHGRGRSCMTLETSLPGVFAVGDVRSGSVKRVASAAGEGAMAIHFVHRHLGHSAAPGPTGTSAAAGGSDVSPRIRHKESAWLA

SEQ ID NO: 14773 - protein, 120 aa, Streptomyces avermitilis
MRSRPPLSIPWSSSTNCKDIAVEANGPELVVTGDIKERERKGVLPGSTRHVGAFEYRLRLPGELATHKIKADMQDGVLGITVPKGEAAGPRRVQISESGEGAREDAARSGAAAGGGTTAA

SEQ ID NO: 14774 - protein, 139 aa, Streptomyces avermitilis
MLRTMFKSKIHRATVTQADLHYVGSVTIDADLLDAADLLPGELVHIVDITNGARLETYVIEGERGSGVVGINGAAAHLVHPGDLVIIISYAQVSDAEARALRPRVVHVDRDNRVVALGADPAEPVPGSDQARSPQAVTA

SEQ ID NO: 14775 - protein, 114 aa, Streptomyces avermitilis
MSDIEIRDDRTAGRLEAYAGDEVVGHIEYFVLETPRRALVPVHTIVEPAHEGQGIAGSLARELYGIAARESVVVAPLCPYVVKWAARHPEEAPAADPELLAAAKAWLVAHPGRF

SEQ ID NO: 14776 - protein, 246 aa, Streptomyces avermitilis
VARGAPRTVLMTSRGGVGAPHATLALLHTSPAHVPVFDALRDEGHPGLELTHLVAGELLARARAEGPEAVAGEVRAALDRAVAAGAGAVLCTCSTIGAVAEAAIADVPVLRVDRPMAAAAVAAGPRIVVVATVESTLEPTVALVEEEAAGRPVDLRTLLVADAWARFEAGDTVGYVRAVAEAADTVADADAIVLAQASMAPAQHLTTTTVPVLSSPRPGLAAGAAAARSGQGPSQAHLGPRRRATG

SEQ ID NO: 14777 - protein, 73 aa, Streptomyces avermitilis
MTHPHPDPVPPGPTPGPGPGPGPAPFPDPSPLPTPTPDPAPSPEPSPIPEPSPIPKPPGPDPVPEPEPGPPLS

SEQ ID NO: 14778 - protein, 479 aa, Streptomyces avermitilis
MSTTAQIGVTGLAVMGRNLARNFARNGYTVAVHNRTASRTRDLVEEFGHEGDFVPAETAKDFVAALERPRRLVIMVKAGAPTDAVIEEFAPLLEPGDMIIDGGNAHFADTRRRERELREQDIHFVGTGISGGEEGALHGPSIMPGGSPESYDSLGPMLEKISAKAADGAPCVTHVGPDGAGHFVKMVHNGIEYADMQLIGEAYQLLRDVAGYTPAQIADIFRTWNTGRLDSYLIEITAEVLSHVDAATGKPFVDVVQDQAEQKGTGRWTVQIALDLGVPVSGIAEAVFARSLSGHQELREASRGLAGPKAAPLGESEAAAFADRVEQALYASKIVSYTQGFHEIAAGSDEYDWNIDLGKIASIWRGGCIIRAAFLDRIREAYDARADLPSLLSDDTFAQEIAAAQDDWREVLIAATRQGVPTPGFAAALAYYDALRAERLPAALTQGQRDFFGAHTYRRTDREGSFHTLWGGDRSEVTA

SEQ ID NO: 14779 - protein, 397 aa, Streptomyces avermitilis
MSRGSPMAVRGRHRRYQPNRINRASLTVTAGGAGMAIPLMGTGVAHAADADTWNKVAACESSDNWSINTGNGYYGGLQFTQSTWEAYGGKVYAQRADLATRDQQIAVAEKVLEGQGPGAWPVCSVRAGLTRGGGTPDIDPSGSATHTADRSTKRTVRDVKPQTTPQSQAGTAEMYTVLHGDTLSGIADSRHVRGGWEQLYAANRGTIGADPDLILPGQRLHLRAKATTRTDDASTSTHKSSTSSSKSSTEKASSDRTEKATTSHSLVAPVNAGTGTQYHAAGSSWSKGYHTGVDFPVPTGTSVKAVAAGHVVSAGWGGSFGYQVVLRHADGRYTQYAHLSAISVKAGQSVTADQRIGRSGSTGNSTGPHLHFEVRTGPGFGSDVDPVAYLRAGGVRI

SEQ ID NO: 14780 - protein, 375 aa, Streptomyces avermitilis
MSALALSVLLSLVSAVAYAGGAIVQERVAATTPDRPYAPLRHLLWWAAVGLNGLGALLHVVALACGPLSLVQPLGALTIVFALPMAALFVRRKAGATAWRGALMATVGLAGLLSLTGTADSQTLDTTQRVLVAVVSGGAIVALMTAARAVHRHPVVRSVLLASAAGVAFGIASVFTKTVAVDWEDGVALASLPTLAVIAVLAAAGLLLSQASYRGAGLAAPLATVTVVNPVVAAAVGLTMFGETFRYGTTGTLLALGCGVVAAGGLILLTTERIGREQRAATVSADATHAPAAASGPSPAEELLAGLPPQPGASSAQDVHEPEPVRMPPEESGYDDDLAPSDAAATPLTYASFYGGPYVPLPVLPRHRARDRVRS

SEQ ID NO: 14781 - protein, 241 aa, Streptomyces avermitilis
LVLLLFVDLDPDLTALDALGGFFVLRTEAPPRGPLPTLAQAYAGQHVDVYGDPLIFRVRKVTESLRAPEPRIAVSVAQQALAARLWSIALGCAALYDQVPDLDPRLLRWDPDASAPDDLWLSEVRPRPATAIGDLVREGHLAPLITALRRQQHVSARLLWGNAASALAGALRQLNRWAHAGGRDEVADRARAFAAASLAHPDLSGTLDPATLRRRSCCLYYRLPGGGLCGDCCFDRPPRHS

SEQ ID NO: 14782 - protein, 383 aa, Streptomyces avermitilis
VRVGLLTREYPPDVYGGAGVHVEFLARELRSLTDLAVHCWGEGGAGGVVRHRPWTALDGANDALRTFSVDLSIAAALEGRELVHSHTWYAHLAGHLGKLLHGIPHVMTAHSLEPLRPWKAEQLGGGYALSGWAERTAIEAADAVIAVSGAMREDILTCYPTLDPAKVRVVHNGIDTTLYRPDHGTDVLARIGLDADRPFVLFVGRITRQKGVPQLLRAVRDIDASAQVVLCAGAPDTPEIDQEFRDLFQELSRVRAGVHWIPQMLPRPDVIQLLTHAAVFVCPSVYEPLGIVNLEAMACGTAVVASRVGGIPEVVDDGRTGVLVPVDEDFEASLAHALDSVLGDPEAARRMGEAGRERAVREFGWDAVARRTVHLYEEVLKQG

SEQ ID NO: 14783 - protein, 406 aa, Streptomyces avermitilis
MRRGGPSVLGIVLAGGEGKRLMPLTADRAKPAVTFGGTYRLVDFVLSNLVNADILRICVLTQYKSHSLDRHITTTWRMSSLLGNYITPVPAQQRLGPRWYLGSADAILQSLNLVYDERPEYIAVFGADHVYRMDPRQMLGEHIESGAGVTVAGIRVPRAESSSFGVIAPGSDGQTVENFLEKPADPPGLPGDPECVFASMGNYVFTTKVLIEALQRDAEDGDSVHDMGGSILPALTDRGEARLYDFSANHVPGETTRDQGYWRDVGTLDAYYDAHMDLIAERPAFNLFNRSWPIYTHSGQLSPARFNAGGIASESIISAGCLIRGQVTRSVLSPGVVVDPGAVVQGSVLHDNVHVGRGAVVRGAVLDKNVEVPPGATIGVNPGRDADLYTVSKGGVIGLGKGQRVS

SEQ ID NO: 14784 - protein, 777 aa, Streptomyces avermitilis
MRWKLRTAGGLTALALLGGALAGPAARAAEQGSDRLGDLVNPFIGTQNEGNTYPGAAVPFGMVQLSPDTGHNTGYDYTQNHIRGFSLVHLSGVGCRIGGDLPVLPTTGDVTETDYAKYAAGFSHDSERASPGYYRVGLDSGIVAELTATGRTGVQRYTFPATDKANVLLNAGQALHKTVSTDVEVLDDRTVRTRISGSGFCRDTGPYTVYTITRFDRPFTAYGTWHGGTVTEGSAESAAGTGRNGAYARFDATEDRTVEATTALSYVDARGAEVNLRSAEGRSFADVREAARRSWEDRLDDVRVRGGSDTLRRTFYSSLYRSFLAPNIGSDADGRYTGWDHRIHRARGFTYYQNWSLWDTYRTQCQLLALLAPRESRDMAISVLKIDEDGGWLPKWGYGTVETNIMSGDPVTPFLTNAYQQGLLKGYEEQAYRALAKNADGLPPAAYPGVGRDGNREYIADGFVPYIKGGPHAKPGDSDYAHGASATMEYALSDAMLSRMARDLGHDADAERYTARSRNYRTLFDASTGFFRARDTSGAFAGPADPADSEGFHEGTAWQYQWLVPQDLPGLVDLIGGKQAANDRLDAFFAYEQLLQDPARTAREVWVDGPYEYYNSDKYNPQNEPDLIAPYTYLSTGQPWKTTDVVHAALTLFTDTPTGMTGNDDLGTMSAWHVLSSIGLFPVQPGYDTWGLSTPVFERVDLRLDRGYYPRGTLTVTAPGTSDRDRYIQSVRVDGASHDRTYLTTRVLRGLEALHFAVGARPSAWGTAPHAAPPALK

SEQ ID NO: 14785 - protein, 447 aa, Streptomyces avermitilis
LTSDLLAPLDLAFWNIESAQHPMHLGALGVFSCHSPTAGAHAADLLASRAAAVPGLRMRIRDVWQPLAFPLTFPLPFGGATREPAPDFDPLDHVRLHAPAADFHAVAGRLMQRPLERGRPPWEAHVLPGEDGTSFAVLFKFHHALADGLRALMLAAALMDPMDMPTPRPRPAEPARGLLPDVRKLPELLRGTLSDVGRALDIGASVARATLGARSSSALTSEPSGTRRTAGVLIDLDAVHRVRKTVGGTVNDVLIAIVAGALRTWLDERGDGSAGVAPRALIPVSRRRPRTAHPQGNRLSGYLIRLPVDDPDPLGRLRTVRMAMDRNKDAGPNRGAGAVALLADHVPPLGHRLGGPVVGQAARLLFDILVTSVPLPSLGLKLGGSPLTEVYPFAPLARGQSLAVAVSTYRGRVHYGLVADAKAVPDLGRLARAVTEEMETLLTVCGP

SEQ ID NO: 14786 - protein, 494 aa, Streptomyces avermitilis
MTVTEDGPVGMDEVADASYGPGIDPERLAVCLGVLDELDKLEVDHPDAIAVRRATAGVYRTVKQRRRQERRAAKTAHDKAVTEATATGSAQRIDDETEGILPSSVTDEGQIAGILQRPRSCYICKSRYTEVDYFYHQLCQGCAAENRARRDARADLTGKRALLTGGRAKIGMYIALRLLRDGAHTTITTRFPNDAIRRFKAMPDSDEWIGRLKIVGIDLRDPAQVVALADSVAAAGPLDILINNAAQTVRRSPQAYSELLGAESGPLPAGELPPAEIIGTFGSGAVAALPVAGGGALTAQDVTDLALISGSASLERIAAGTAIDAGGLVPDLHDTNSWIQSVEEVTPVELLEVQLCNSTAPFILISRLRAAMAAAQAKRTYIVNVSAMEGVFNRGYKGAGHPHTNMAKAALNMLTRTSAQEMFEKDGILMTAVDTGWITDERPHPDKMRLADAGFHAPLDLIDGAARVYDPIVRGEQGEDLYGVFMKDYAPGKW

SEQ ID NO: 14787 - protein, 103 aa, Streptomyces avermitilis
VTWRPPGTRALSRAVQGVPMASPHDTDPHRVDMDPRSVDDPRNVCPSDADFYASDRPAHPLLPEDRPRGGGPATPLRHRGTWETVALVAAVILVIMVGIALFP

SEQ ID NO: 14788 - protein, 268 aa, Streptomyces avermitilis
MTSPYGLEGRVAVVTGASRGIGRAVAEAFAAAGAHVCVTARDADGVRRAAEELGGVGLAGSVADPAHPRELTELALAAFGRLDVVVNNAATNEPYGPLMDADPDRWREAFTINVEAPLRLVQCAWRAWMGEHGGAVVNICTEGAGHVGPNVGAYGTTKAALLHLTRQLAGELAPKVRVNSVSPGLVRTELARFVWEHGEDELAAGLPLGRIGHPADIARAVVWLASDAAEWITGADLLVDGGTRVRTAYSADGYAVQERLRSYAPPHS

SEQ ID NO: 14789 - protein, 182 aa, Streptomyces avermitilis
MELRSVEELMDLLHACRGARATSGLPRSRPGSGGGPPVGDPVDPHEHALQTAALLRRSRPADKELQVAGLVHDIGQLLDPGDEAGHADRAADAIRALLGDRVSRLVRLRAAAWADDSLDDDLAALRQADESGRVPGLDAGVLEDWRTVLELVAARNSRPGTAGPPRLDAAGPPTRPQPGAVG

SEQ ID NO: 14790 - protein, 160 aa, Streptomyces avermitilis
MLIREAAADDWPRIWPFWHRIVAAGETYAWDPATSEEQARALWMAPGKRVYVVEDETGAVVGSAYVTPNYGGPAARVANAGFMVDPDHAGRGIGRALADHVLATAKADGYRAMVFNAVVETNPAVQLWTSLGFTVLGTVPDAYEHPRHGRVGLHIMYRAL

SEQ ID NO: 14791 - protein, 664 aa, Streptomyces avermitilis
MKPSRLMLLTAVALLAPMAPALSAAAAPGDGATPAANTASAARAQLTLDDPGFENGGTGWTFGAGTGVGTGNSHGGARFLYLDSGAGKSAKLTLVAPRNGSYDFSAWVGSAGTGGTYTVRRNDETVETITLPERRAYARYTISRVELKTGDRLEIAFGSGSSWVNADDLMISPAAPADPKVTSSDPEVVEMFGWAKKKANSWVQLPGTTGPVNVDEYQTGGTGTAPYAAGYWAGYANRSAYYSRDMTHQLAGAHIIGLDAENETMLRSYASSATAAHKYFPVWSLNFDAKTYLSIDYKSPDNFVREVPAVFELVEKAAQAYLWTGDRRYVDDPALWDFYRHSTEEFIDLHNSAKPNGKVKVAEGTGNGIFSGAASYNEQDGDGLAEAGDGIASQYQAYLAMATLARGKGDTALAKAYDRRAADLKAYYNDDWSGGGSGADMVRAYTTSGTPVTGWGKENSVFVPMKQIIDPGPRNDAYLDYIEAQELGPQGSPNIESTTYLPDMFFKNNRNDTAWTWMKKIYGQRELQHVNSSQGPNGDYPEVSFTLVSQTVEGLMGIAPDAANHKVTTQSRLPSGMKWLQTADVPIGTSTITVRHDGATKTTLTNNARKGAYHWEARFQGVHKKITVNGVPQRARTRTVDGVTYTYATPTVRAGATAVVRVAG

SEQ ID NO: 14792 - protein, 463 aa, Streptomyces avermitilis
MDASPLNQPPPDEPPRNGLNRRRLLALSGSLLAAGAGTSLLGACSVTGATKAGSLGDPDRAAITVWSWQGPAAAMKALVPAFEARHPGIDVTVQDIGNPAIWDKITTALAAGGQGLADVLHIGVDYLPAYTEKFPEGLADLGPLGADRYRDAFADGMWQTVTRKGKVNALPWEANSAGFYYRADLFEAAGVDGEALATWDDAIDAGKKIKKRTGVHLLGIDKPASQPDAANFFQMLLQLQGTFYFDAEGRITLSSPEAATAMTLIKEMNDAGLVSDLAGGWTALESSIKSGTAAVLPWPTWFGSIIEGLVPKESGQWKVRLPPAVKPGGTTAATVNSTHLAVAGSSMHQAAAWAFVEYVLTRPASQEAIYRSKGIAPALLQAYEAPVFHEPSTFFSGQHKGEIFLDALKARSPAVNYSADYARALKTVADAQTQVLLKGADPGRALHNAADQLARQTGRELAS

SEQ ID NO: 14793 - protein, 313 aa, Streptomyces avermitilis
MTTTTTAEGVLKTAGAARPAAASRPTARILRRRAVPYLFILPALVLFAVFKLYPIGSSFLMSLYENVNGTQEFVGAGNYTRAMDDPLLWTALKNTAIILVVQVPVMLALAVGIAVALNSTLLRGRAFFRLGFFLPTVTGLVAYGIVFAVLLNTQYGLVNWLLGLVGVGEVPWLTDPLWARISLGLALTWHYTGYNAVIFLARLQSLPTELYDAAAVDGASARQSFRHVTLPGLRPALLLTTVLSTIGTLQLFDEPYVLTGGGPDNATLTIGVYLYQNAFKYFDFGYASAVAYILTVLIGILGVVQFRLLGEKS

SEQ ID NO: 14794 - protein, 291 aa, Streptomyces avermitilis
VTLTATRPRPGRTPRTPRSRTRTRSILLTSSLTIAVAAVLLPFYWLIIAATHSSKEIFDSPPPLLPGGHLRENLSTLESSARFSDVIVNSLLITVIYTIAAGAICTLAGYGFAKFRFRGSGALFGLLMLGLVIPTQVTLIPLFKMMVDLEWLGTYQAVIMPNLALPFGIFLMRQSMAALPDELIDSARMDGCGEFRLFLKVVLPPMKPALAALAIFLFLFQWNDFIWPLVVLRDAGEFTIPVALASLQGLDQTDYGALLAGTALAAIPMALVFLALQRHFVSGLLAGAVKE

SEQ ID NO: 14795 - protein, 610 aa, Streptomyces avermitilis
MIPAMTLSTTRPVTTAELPSARYEPLVDGVRIAVLTHAPGVGARWTVCELGDGLALLEIRTDGGPAPTEVRMSVPLGDAAGYWHPGAGWERTLVADWAGRSRVSLVDGTAAGCLYDHDGRTRLTFAVADPVPETDVVFGVSEENDTHVVHLHLAPAPDGGPRRVLLARSAPTVATALRGLRQWFAAQPQCAPMPVPDSAQAPVYSTWYAFNQRVDAASVEAEARVAASLGCEVLILDDGWQKYGSGRGYAGCGDWRPDPTTFPDFAAHVSAVRAQGLRYLAWVAPLLLGPDADCAERLTPYAPAPAGVPGAQVLDPRRPEVRDHVISLCTRLVADHGLDGLKIDFLDEAMAYRGDGAYAHHEGTDIDDVGRAMTVLLTDLRTALEELRPDGGLLLELRQPYVGPGMAPFGNMLRSFDCPGDATGNRVRTLDTALLAVGGAVHGDMLLWDRDAPAHAVARQLIGSLHCVPQISVRLTELSGEHRETLAFWLAEWRRLRPVLLHGDVESGRPDELYTLVTAARGRACVTTVHSDRIVPVDTTAYDDITLVNGTASDRVVIEVTGGQRPLRMTVRDERGRIIDDCERSPAPGLHIVSVPRSGLVALRVTEGTV

SEQ ID NO: 14796 - protein, 332 aa, Streptomyces avermitilis
MKVGITEVADRAQVSEATVSRVINRRQGVSRKTREAVEQAMADLGYERQTRGQLIAVITEYVSNPFFADVCERIESTLAPHGLKTVLCPCFPGGVQELDFVTSLADRGVAAVVFLSSSNTIEGADPEAYELLRSRRIPFVGVNGQFEGVSEAPVFSTDDLLAAELAVDHLYRLGHRRIGMASGPVGNRPADRRVSGFVSSLARRGVEDPEQWVVRQSYTVEGGQSAAISLLGRGATAIVAASDYMALGAIRGARRQGYDVPGDVSVVGYDGAMIMDFVDPPLTTVRQPADRLASEVARSILALVGNRDVPVGELLFDPELVIRASTAAPRAE

SEQ ID NO: 14797 - protein, 625 aa, Streptomyces avermitilis
VAHGCSGGAMSRFVFLGVALALLGGATSPAAAAPRVTPVVVDVDDYGADPTGRTDSTPAVAAALRHAKSVDRPVRIVFSKGTYQLYPERAETRELYMSNTVGADQRYRDKKIGLLVEDMHDVTVDGGGAKLVHHGLQTAFASIRSTDVTFQNFSFDYAAPEVIDATVATTGVTDGHAYRVLKIPAGSPYRVNGTHITWLGETSPATGQPYWSGVDGLQYTQIHDPEAQRTWRGDNPLFNDVAAVTDLGGRRIRIDYTTAARPADAGLVYQMRLIERTEPGAFIWESKNVTMRSMNAYYLQSFGVVGQFSENISIDKVNFAPDPRSGRSTASFADFVQMSGVKGKVSITRSLFDGPHDDPINIHGTYLEVVGKPGPSTLTLAYKHPQTAGFPQFAPGDEVEFATKRTMTPLADAHAQVTAVDGPSGMDHTKPLTTMTVTFDRPVPAGVETGGTVVENITATPSVVISGNVFRNVPTRGILVTTRKPVLITGNRFDGMSMASIYVSADAYQWYESGPVADLTIRGNSFTRPSGPVIFVEPTNQVIDPATPVHHNISVEHNSFDIGDVTVVNAKSVGGFAFTGNTVRRLDGADHPPYTSPLFVFHGSSGIRIARNHYDKGLNTSVVTD

SEQ ID NO: 14798 - protein, 454 aa, Streptomyces avermitilis
VTSWVGLSAAEIAAAVREKRATPREVVAEHLARIDRLDARVGAFRRVRADAALAEADEVASRTDLAELPLAGVPVAVKDNLAVRGESTRHGSAATPDTPADHDHVTVARLRAAGAVVVGVTNVPELCVFGTTDGVHGTARNPWDTSRTAGGSSGGSAAAVAAGMVPIALGNDGMGSLRIPAANCGLVGLKPGYGTVPAGIGNGDWFGMSENGPLATTVEDARLMFAVLAGTVTAVAETEAIRPSGPGTRTIALSVRSPLAGVAVGRPYASAAREAAELLAGAGHQVRRADPPYPLWLSTTSLAHWTAGTAVDAEDLDVRRLTRRTRVHAAVGRRFVRSVRGGARREQLRERLTPFFEEHDVLLTPALARRGPAAAAWHERGWLRNLLVNTTYSPLTPPWNLTGWPALSVPFGTLPSGAPGAVQLVGRPGSELDLLALAGQLEELHPWRRTAPLG

SEQ ID NO: 14799 - protein, 347 aa, Streptomyces avermitilis
LSAKRSPARRPTMKDIAQRAGVSESAVSFALNGRPGVSEVTRDRVRRVAEQLGWRPSTAARQLSGEGSATVGLVVARPADTLGVDSFFLQLISGIQEVLAERHLGLLFQVVEDVADECAVYRRWWAEHRVDGVLVVDPRTDDPRPGLLDELGLPAVVIGGVPDALHPGLSTVWADDAGAMASVVDQLHTLGHRRIVHIAGLPGLAHTERRIRTLRAEAGRRGLAEVRSVPTDYSDAEGAAVTRRVLESGTPPTALVYDNDVMALAGVAAATELGFSVPADVSVVSWEDSALCRMVKPWLSALSRDTVEFGRTAATELTALLDGGPARTVQVPVPRLIERDSTGPCGA

SEQ ID NO: 14800 - protein, 430 aa, Streptomyces avermitilis
VRISRRTFAAAAAVAVVLPLSACGSGDDGGGSTDASGKVEGTITFQTWNLRANFKSYFEGVVSDFEKKYPDTQVKWVDQPAEGYADKISADAAGGTLPDVVNVSPDLVAPLAKAGLALDLDKAAAKYRKEYLPGAWASHRIPGMTGTYAFPWYLNTGPLFYNKSLFKDAGLDASKPPKTYDELFADALRLAKKSKGEVATLANVPTIEDFGRYGVELMNKEGTAFAFNDTKGVELLTKYKELYDAKALDPQVLTATPESSGKKFLTGAVAMNPGSALDLGNFKKQAPNLYKNIGITDQITSTGKVNMYVMGVMVNSRSQRKPAAVAFAHYVTDAQRQMSFAKKVAIFPSTAGSLDDPYFTKEDGTDETRVRIAAAASLKNAVNYTPVLFSEQMKTALRNEVAKALQGKESPKAALDNAVKACDRLLQQQG

SEQ ID NO: 14801 - protein, 297 aa, Streptomyces avermitilis
MASSTVSRVRRHLPTSPWLFAAPGLLVVGVFVLYPFVSTLVNAFTDRRTLIPGRFVGLANFRELLHDDMFWIGLRNSALYVLGVVPALVLLPLLLALLVQKNIPGIGFFRSAFYTPVVASIVVVGLIWVWLLDERGLVNSLLETIGVGRVGFLSDQWLLLLSAMAVTVWKGLGYYMIIYLAALANVPRELHEAAAVDGAGAVRRFLTVTVPAVRSTMVLVGALSSVAAFKVFSEVYLMAGPDGGPAGEDTTLVMLVQRTGTGLTGRVGYASAMSVVVFVVTVGLMLLVLRADRKEEA

SEQ ID NO: 14802 - protein, 301 aa, Streptomyces avermitilis
VSVLEKVRPVRTPAAAREPRATDEHGRRIRVWELALRYLLLLAVLALTVGPFLWQLSTSLKGPTEDIFSSPPKFLPGDPTLHNYQRVADTIPVWDYAFNSLKVAAANVVTNCVGSALAGYALARLRYRGRRVATLVFILAMLVPVEGIIIAQFTTMRELGLNNTLIGVVLPGCIGAMNVLLMRNAFLNLPHEIEEAAYVDGANAWQRFLRIALPSVKGTLAVVAIFAFMGAWDDFLWPLIVLSDPSKFTLTIGLNYLHGTFANDERVVAAGTVIAVAPLIALFACLQRYFFRGVGEGAVKG

SEQ ID NO: 14803 - protein, 410 aa, Streptomyces avermitilis
MPSAVRFGVNYTPSVGWFHHWLDFDLDSVRADLDSIAALGLDHIRVFPLWPYFQPNRTLIRPRAVEQLVALADAAAERGLDVNVDGLQGHLSSFDFLPAWTQTWHRRNIFTDPTVVEGEAEYLRTLAAALADRPNFIGMTIGNEVNQFAAGPHPDPDRITPEQAGAWLRRLLAACAQGAPGKLHLHASYDAAWYQDDQPFTPGHSARLGDMTAVHSWVFNGTAQRHGRTGTATEHHAAYLVELSKAWADDPRRPVWVQEVGAPAPLIHAEHAAAFTEATVAGVLDCTDVWGVTWWCSHDVARDLADFPELEYSLGLLTNDRQPKPAGRTLARIVKEQRPYAPAVRTTALVVDTTPGRSVCAPGGAVFEAFARLTADGARPTTVLASRADDKEHLAARGITAVVTPDQVTE

SEQ ID NO: 14804 - protein, 142 aa, Streptomyces avermitilis
VNLSRRTVLLAATGAAAGLVPGLSGTAGAATRNLQPYASYWYPDSLPSGTPGTGITWRSLKAWRAENDTDLAFNAAAVPLAARFTPTPANTTARSGQARIQSLVSFGPTSSNPAQGAPTADYYALTHWSYVDELVFWGGSSG

SEQ ID NO: 14805 - protein, 514 aa, Streptomyces avermitilis
VDAAHRHGVPVLGNIFLPPVAYGGQLQWTRDLVQKDATGHYPLAAQLVAVADAYGFDGWFVNAETSGGNTALATDMRGFLQELKALGTAKGQRVTWYDSMTATGSVSWQGALNSQNQAFFQAADSMFVDFRWSKSTLASSGTLAGQLGRSRYELWAGVDVESNGTSTSVNWDAIVPSASAHVVSLGFYRPEWTRNHLPANRTPGDFHAADDLFWTGASLDPAKPNTTASWRAPALRVADRSTVDSLPFATVFNTGHGLKWYEGGEVTSDTAWNHLGLQDRLPSRRWIVRTSGARPSVTFDFADAWRGGSSVLVAGTLGAPATLDLYETRLPVGSSETVVELTHRTDAGSAQIELAVATAEPSAPGQAPSYTYFPVSSGDGWGTSTVRLTGLSGTVRTLAVRLTGSGSPVRWRLGALAVKNAPAEPAAPTGLRVTDADGGSLRFSWQPAAGEVRHYELHRVLADGTRRFLGGTCQCAYYVAGLAAEQGESAARFELRAVGELYTESTATTTTHPW

SEQ ID NO: 14806 - protein, 1004 aa, Streptomyces avermitilis
MHDDRTLVEARLRRVLDERIRPAVYPESVPLEVAVWHAPDEPVPVAEGLAAPVGPIAAGARWGAPWGTSWFRVTGTVPEAWAGKTVEALLDLGFDENMPGFQCEGLVYRPDGTPVKGLNPRNQWVRIGAPVEGGEEVRLHIEAASNPVILDYHPFRPTQLGDKETAGSEPQYRLERMDLAVFDETVWQLVIDLEVLGELMAELPVESARRWDLLRAVERALDAVDLQNVNGTAAAARARLEGVLAEPAVPSAHHISAVGHAHIDSAWLWPLRETVRKVARTTSNMTALIEDEPDFVFAMSQAQQWAWVKEHRPEVWARVKKAVAEGRFVPAGGMWVESDTNMPGSEAMARQFVHGKRFFLDEFGIENDEAWLPDTFGFAAGLPQIIKAAGSKWLLTQKISWSQTNKFPHHTFRWEGIDGTRIFTHFPPVDTYNCSMKGSEIAHAARNFKDKGVARHSLAPTGWGDGGGGTTREMIAKAARLRDLEGSATVAWETPAKFFEQAEAEYPDPPVWVGELYLELHRATLTSQAKTKQGNRRSEHLLREAELWAATAAVRTGFPYPYEELDRIWKTVLLHQFHDILPGSSIAWVHREARKTYEKVAEELNGVIDAAQRALAGEGTTPLVFNSAPHTRDGVPAGGARTPAVGGECALVPRADGGYVMENGRLRVEIDAHGLVVSAFDLAADRETVAPGRPANLLQLHPDFPNMWDAWDVDEFYRNTVTDLVDADEIAPGEDGVSVRIVRTFGASRVTQVLSLAPGEWRLDIDTEVDWHETEKFLKLAFPLDVHAERYASETQFGHFFRPTHTNTSWEAAKFEACNHRFVHMEEPGWGVAVVNDSTYGHDVTRTVRDDGGTTTTVRVSLLRAPRFPDPETDQGVHRFRHALVPGAGIGDAVREGWRINVPERKVTGGREVTPLLAVTQDAVVVTAVKLADDGSGDVVVRFHESRGGRTRATLKAGFEVAAVSVTDLLERPLADAREPAVDGDRITLSLRPFELVTLRLRRA

SEQ ID NO: 14807 - protein, 233 aa, Streptomyces avermitilis
VDESAPQKGTVTQRAIERIKAMIGEGRLEPGQRLPTERDLAVQLGISRSSMREAIRALTVLGVLEARHGSGIYVTQLDAGDLLETFGVVADLSRGPQLVELLEVRRILESTATALAAARITPDQLAEVEKHLAAMNATDDPEEILAHDLAFHREIAAAAGNDTMAAILEGLSSRTFRARVWRGYQEEGAFARTRREHTAIHRALVAHDPEAARAAAAAHVGEVEEWLRTQIGP

SEQ ID NO: 14808 - protein, 348 aa, Streptomyces avermitilis
MAGRTLWKAAAAAACATLALSACGSTKDTAASGGAGGGTGKVGVILPLLTSPFWQSYNDYVPKMAKSEGVDTLKTVNSNSDPSQQITDINNQLNQGVKGLVVAPLDSAAIEAGLDQADRKGVPVVAVDVAPEKGKVAMVVRADNVAYGEKACQYLGEQVTSGKVVQIMGDLASVNGRDRSEAFRTCVRKNYPKLKVLEIPAKWESDTAASKLDTLLNANPDIKGIYMQAGGVYLAPTLQTLKSKGLLKKTGEKGHITIVSNDGIPQEFDAIRKGQIDATVSQPADAYAKYGMYYIKAAMQGKTFKPGPTDHDSTIVKLPSGILEDQLPAPLVTKDNVDDAKLWGNTVK

SEQ ID NO: 14809 - protein, 521 aa, Streptomyces avermitilis
MSTPPLVEARGIVKRYGPTVALQDGQLTVLPGESHALVGRNGAGKSTLVAVLTGLQVPDAGSVRFDGEPAPPLADRDAWRRKVACVYQKPTVVPDLTVAENLFVNRQPTGRGGFISWRRLRAEASEVLQTWDVRVDPDARTADLNVEDRQMVEIARALSFGARFIVLDEPTAQLDNREIERLFTRMRALQESGVTFLFISHHLQEVYEVCQTVTVLRDARWITTAPVGELPRAALVEAMAGEVLAARERAAVRDAVAPDAPVALEARGLTSPAYENVDLTVRHGEVVGLAGSSGSGKVQLAESFAGLHTPTGGSARLDGEQLVFGDVQAALRAGVGCVPRDRHEQGLVSGMSIGDNATMSVLGRLGRYGFVGTERKRGLAAQLIDRLDIHTEGPDQPVSDLSGGNAQKVVMARALASDPRLLVLINPTAGVDVKSKESLLARMDSAREDGTAVLVVSDELDDLRRCDRVLVLFHGRVVAEHAAGWHDHELIASIEGVDHGHGISPGDDPRTPGRSERGPGE

SEQ ID NO: 14810 - protein, 319 aa, Streptomyces avermitilis
VLLRRARELALVPALLLLLVLGAVVNDSFLTERNLISILGASAALAMVVLAESLVLITGKFDLSLESVVGIAPAVGALLVLPAAQSGWGTEFPAALALLAILVVGAVIGAFNGILVVKLKLNAFIVTLAMLIILRGLLVGATKGKTLFGMPDAFFTLATTTFLRVPMSVWLAAIAFGVTGLVLRYHRVGRALYAIGGNADAARAAGIRVERVMLGVFVVAGVLASVGGIMQTGYVGAISANQGNNMIFTVFAAAVIGGISLDGGKGTMFGALTGVLLLGVVQNLLTLAQVPSFWIQAIYGGIILVALMIARVTTGRAQD

SEQ ID NO: 14811 - protein, 446 aa, Streptomyces avermitilis
VSPTAARITAVDTHDIRFPTSRELDGSDAMNPDPDYSAAYVVLRTDAADGIEGHGFSFTIGRGNDVQVAAIDALRAHVVGRSVGELCADPGTLFRDLIGDSQLRWLGPEKGVMHMAIGAVVNAVWDLAAKRAAKPLWQFLADAEPAWLVDQIDFRYITDALTPEEALELLRRGRRGAAERAARLREKGFPAYTTSPGWLGYDDEKLTRLATQAVADGFTQIKLKVGADLADDTRRCRVARSAVGPGIRIAIDANQRWNVAEAITWTKALAEFDPYWIEEPTSPDDILGHAAVRRAVAPVKVATGEHVQNRIVFKQLLQAGAIDILQIDAARVGGVNENLAILLLAAKFGVPVCPHAGGVGLCELVQHLSMFDFVALSGTTDDRVIEYVDHLHDHFLDPVVIREGHYTAPAAPGFSATMRPESIARYTYPGGTFWAADLAQQKGEAA

SEQ ID NO: 14812 - protein, 251 aa, Streptomyces avermitilis
MTDFEGLKALVTGGASGIGRATAELLAARGAQVAVLDLDPSGVDKPLFGHRADVTDDSSVREAVAAAVSDLGGLDVLINNAGIGAQGTVEDNDDAQWHRVLDVNVLGIVRTTRAALPLLRASAHAAIVNTCSIAATAGLPQRALYSASKGAVLALTLAMAADHVREGIRVNCVNPGTVDTPWVGRLLDAAPDPAAERAALEARQPTGRLVSAAEVAGAIAYLAGPLSDATTGTALAVDGGMQGLRLRPVGQ

SEQ ID NO: 14813 - protein, 328 aa, Streptomyces avermitilis
VTTLGRSGVEVSELSFGAAGIGNLFTAVTDEQASQAVHAAWTSGIRYFDTAPHYGLGLSERRLGAALREHPRTAYTVSTKVGRRLEPTDAGGDDLADGFAVPATHHRVWDFSADGVRRALTASLERLGLDRVDVVYLHDPDDHAEQAFREGCPALEKLRSEGVVGAIGAGMNQTAMLTRFVRETDVDVVLCAGRYTLLDQRALADLLPAAADRGTSVVIGGAFNSGLLADPKPGATYNYAAAPPELLDRALRLKAVAERHGTTLRGAALAFCAAHPAVASVLVGARSPYEVRDCAEQFAAPVPADFWQELRAERLLPEDAPVPGEEGP

SEQ ID NO: 14814 - protein, 104 aa, Streptomyces avermitilis
MRIALHTKVRADRVAAYEAAHREVPEELTAAIRAADVTSWTIWRSGTDLFHVLECEDYGRVLAELEKLPVNIAWQARMAELLDVVHDYSGAGAEAGLPVVWELP

SEQ ID NO: 14815 - protein, 283 aa, Streptomyces avermitilis
MGAAVTVDAHHHVWDLSVRDQDWITGPELQPLRRNFTVADLEPEARAAGVDRTVLVQTVTVAEETPEFLALAAESELIGGVIGWTDLTRPDVADELARLAELPGGAYLRGIRHQVQGEPDPDWLLRPDVRRGLAAVAGAGLVHDLVVLPHQLPACVKSARDLPELIFVLDHLGKPPIASGAREPWATHVRALAALPNTVCKLSGMVTEAGPGTWTADALRPYADTVLDAFGPGRLMFGSDWPVCTLAASYGQVIDVANELTAALGADEREDLFSGTATRVYGL

SEQ ID NO: 14816 - protein, 475 aa, Streptomyces avermitilis
VEWFTATDYWWSRLVFQRALAVVYLVAFLGAALQFRALIGERGMLPVPRFVAQVPFRRAPSVFQLHYSDRFFAAWAGAGCAVSAALVAGLDSHLPLWGAMVLWLVPWVLYLSIVNVGQTWYGFGWESLLLEVGFLAVFLGNDEAGPPVVVLFLLRWVLFRVEFGAGLIKMRGDACWRKLTCLYYHHETQPMPGPLSCFFHHLPKPLHRAEVAANHVTQLVVPVLLFTPQPIATAAAALMILTQLWLVLSGNFAWLNWLTIVLALSAVAFPGTPPDVPGAPLWYEIVVLAVAAGLVGLSYRPARNMLSRRQVMNRSFDPLHLVNTYGAFGSVSRTRHEVVIEGTADDEPREDADWREYEFKGKPGDPRRWPRQFAPYHLRLDWMMWFAALSPAYAGSWFGGLVERLLENDRDTLRLLRRSPFPPDAPPRFVRARLYRYQYTTWRELRETGAYWQRTYVREYLPATRLATRVELRDP

SEQ ID NO: 14817 - protein, 690 aa, Streptomyces avermitilis
MVDRGASALSLPDDWTAHPDPILALNRMGSFDWDLDTGLMHMDAQAHEIFDVRPDEYEGRPETLSDRVPAPEARRLDALVSRALKDGSENYGAYFRLRRRDGSLRWTHTQGYIRRDEGGRPRRIVGIVRDATEELRESEARQEARGRDEVRRRQTNVVQAITAALAHARTVQDVIDVLKDTHGLTYLGATSLVMGLVEAGRIRLVAEGPAGSFVPGTLVTRIDEKYPMSEVVRTLRPIFIESPEEFADRYPILWPNIIDLNITSSAYLPLIVQARPIGAMGLLYNDRRGFTPEERNVLVALGSSIAQSLQRAMFYEQEKDLAQGLQQAMLPRSIPSVPGADVAVRYRSAKIGRDIGGDWYDLIPLPGGRVGAVIGDVQGHDTHAAAVMGQLRIVLRAYAAEGHTPATVMARASVFLHELDTDRFATCLYAEADLSTGVMQLVRAGHIDPLVRHMDGTCRRLPVQGGLPLGLSAEFGRLEYPVDTIELDPGETLLLCTDGLVEQPGADLDEGMQTLLELLRSGPDDVRDLADLLIDVAEERGGDDDVALLLMRRQGLGRQSGGRLQQHVAPGDPEALTEARHMIRAAVRAWGARERADEIELVADELITNALMHTEGSAIVTLRVLTGPDHRLRVEVEDSSSALPRRREAGECEVSGRGLLLVDRLADVWGVEARGSGKCVWCEFIVPERS

SEQ ID NO: 14818 - protein, 286 aa, Streptomyces avermitilis
MPELPEVEALKDFLADHVVGHEVVRVLPVAISVLKTYDPPVTALEGREITAVRRHGKFLDLEADGLHFVTHLARGGWLHWRDKLPDAPPRPGKGPLALRVALETGEGFDLTEAGTQKRLAVHVVRDPGDVPGVARLGPDPLADDFDEARFARLLEGERRRIKGALRDQSLIAGVGNAYSDEILHAAKMSPFKLTSALTAEEIRQLYAALRTTLTEAVERSRGLAAGRLKAEKKTGLRVHGRTGEPCPVCGDTIREVSFSDSSLQYCPTCQTGGRPLADRRMSRLLK

SEQ ID NO: 14819 - protein, 216 aa, Streptomyces avermitilis
MRSLERHRDVGAYALGVLDEAEAFRFEDHLMECPSCTAQVTEFRPAARQLMLYRRATPRAVHPFAAPGPRLMERLLGEVATRHRSGRRRWLYAVAAAVVFAVGGPVVAMVAGHGSASTELTATGAKTGVWAQVTTQERVWGSEIDVTVKDASGPHSCRLIAVGKDGSEQTVTTWMAPSHDGGPTTMQGGAALRPDEIEHYDIRTGNGQLLLTLRSH

SEQ ID NO: 14820 - protein, 171 aa, Streptomyces avermitilis
MLHRGQESTDGAGGGELTVPMAWLYAEYIADELLRTGDLMPPTSFEFRAGRDALALTIFLSDTSGELSGIRVVSQLETWLSLTAYDQPWQDWVCARMAALAAEAVESGGPSPDLDLASAAWRWLEETELLAPDLDAVPGGGSVLGEDDGPKVWTPAWQLGLPLGHLAIHLF

SEQ ID NO: 14821 - protein, 182 aa, Streptomyces avermitilis
MTAVTTTIGRGTTAEHELAQLQREHGRPLFALLLRLCDGDRQRAEDLVQETFVRAWQHPEALRAHDFTSVRPWLLTVARRLAIDARRARQARPAEVGDAVLENARVCADHAERSAATLDVRDAVKTLTPEHREVLVQVYFRGASVAEAAEALGIPPGTVKSRAYYALRALRRVLPGYAADLR

SEQ ID NO: 14822 - protein, 382 aa, Streptomyces avermitilis
MTPHARRAAAALTAALLTAGAACQAHDPSSRQAGGPAAAPATRGFTLVASGDVLPHAPVIEQAKADAGGIGYDFRPMLAAAEPVVSRADVAICHLETVFGEDGDYSGYSAFVSPPQVALGLAAIGYDGCSTASNHALDYDTAGIHSTLNALDRAGVQHTGSARLAPEAAAPAMFHADGAQVAHLAYTHDINGRPLPAGEPWAVNLIDRDRIVADARAARAAGADVVVVSLGWGTEWQDEPDAQQLRLSRELTASQTKGRPDIDLILGTRAHVPQPYEKVNGTWVVYGLGDQIAGEMANREGFRDPRGQESTIGRFTFAPPARAGERWQVTKAEFIPQRFDLGRVVDLNAAIAQGAGTAPVRDRIRDVVLRRGAAKDGLVMGS

SEQ ID NO: 14823 - protein, 472 aa, Streptomyces avermitilis
MAGIRMGEGVLRRKPIEQIEETEAGTQLERTLGLWQLTAIGVGGIIGAGIFTLAGTVANGTAGPAVLVSFLIAGFASAAAALSYAEFAGLIPKAGSAYTYGYAVLGELAGWFIGWDLLLEYTAIVAVVAIGISGYFGFLVGELGADLPAWMLGAPGTGGGHRVDLFAAILCLLIAYLLNLGIKSAARFETVVVALKVLVVLLVIGVGVFHIDTGNYHPFFPYGVGGAFTGAATVFFAVFGYDAMSTAAEESKDAQRHMPKAIIYSLAISMVLYVAACLVLTGMQNYKDIDKESGFSTAFKSVGLGGLADVIAVGAIIGILTVMFTFMLGVTRVWFSMSRDGLLPKWFAKTHPTRHVPTRVTWIVGFASAAIAGFLPIGQAAELTNIGILLAFVVVCVAVIVLRYRQPDLPRTFRTPWMPYVPALGVIFSIWLITFLQWRTWVRFGVWLVIGLVIYFGYSYKRSELAKGVNSP

SEQ ID NO: 14824 - protein, 153 aa, Streptomyces avermitilis
VTEQHSHQFERGTDGPKVILVGVDGSDSSLHAAAYAAGLARRQHALLAVVYVQPVMAAGAALGVPVADTTDEIAADLVQYIRDATERVKDIFEVRWEFHTFRGDPYNGLVTAADELKADAVVVGASEQAGHRIVGSVAVRLVKAGRWPVTVVP

SEQ ID NO: 14825 - protein, 1093 aa, Streptomyces avermitilis
MSATVEAAGPGHATGPTRPSWGGFLSKVPEGFATFFGALGLLCVLLAFIAPLRRLLGPFVRDLDRFVVPVSANLAYGVFLFLLAAATAARKKVTWWLVVVYLGLVTLDDLLGLALGHYAESVVSLIVCSLALALLIAARKEFYAASRRGAAWRALAVLFAGLGVAILVGWGLVELFPGTLPRDQRLLWAADRVCGGLVSGRRFDGRTPRPVSFLLGLFGALALLNAAATLFRSQRMESALHGDEEPRIRALLGAYGADDSLGYFATRRDKAVVFSPSGKAAVTYRVEAGVCLASGDPVGDREAWPHAIDAWLDVARRHAWAPAVMGASEEGAKAFARSGLGALQLGDEAILNTADFDLDGRDMRVTRQAVNRVRRTGATCRVRRHSTLSDEEMEEVVGRADAWRDTETERGFSMALDRLGDPADGDCLLVEALGEDGKLLALLSFVPWGGDGVSLDLMRRDRAAPNGVMEFMVAELCAVAGRTGIRRISLNFAVFRSVFEEGARIGAGPVLRLWRRLLLFFSRWWQLEALYRSNAKYHPQWYPRFICYGDTASLARIGLASGIAEGFVSVPSLRKLWGKGHSKGITEPTTTEGLPSLSALGLDKGDETGPGAPGLPEQVRVRLSKLDRLRADGTDPYPVGIPPRTHTLARARGSPAGEQVTVAGRVMLVRDFGGIVFAVLRDWSGDLQLALTRSGSGPALDRFGKDADIGDHITATGRTGTSDRGEPTVFVTDWQLTGKCLRPLPDKHRGLADPEAKVRRRYLDLVASPDARAVVRARSTAVQALRQGLLDRGYLEVETPMLQQIHGGANARPFTTHINAYDLDLYLRIAPELYLKRLCVGGLEKVFEMGRTFRNEGVSYKHNPEFTMLEAYQAFADYDVMLDLTRELIQGAATAAFGGPVARKNGTEHDISGPWPVKTVYGAISEALGEELDAGTSLEALHRHCDRAGVPYTADDGRGDVVLEMYERLVEERTGLPTFYKDFPTDVSPLTRQHRADPRLAERWDLVAFGTELGTAYSELTDPMEQRRRLTAQSLLAAGGDPEAMELDEDFLDALEYAMPPTGGLGIGVDRLVMFLTGLTIRETLPFPLVRRR

SEQ ID NO: 14826 - protein, 282 aa, Streptomyces avermitilis
MKKDQLLTRRRALLAGAAVLGAAGAAGTARLLTADEPAGSPVRNTAPVAGPPVRRALKPSAYRLRPLTGYGPPRSAPARTVVRHEPFLRISGRGRSMVLTFDDGPDPRYTPDILRTLREYDVRAMFFVCGEMAVDNKDLLSEMADDGHVVGNHTWTHPRLTELSRSGIRSEMERTSEVIEQAYGEPPQWFRAPYGVWNRAAFQLGADLGMEPLAWTVDSLDWTTPGTRTIVNRVEDGAAPGVVVLSHDAGGDRSQSVRALRDYLPALLDSGYHLTVPRRQFA

SEQ ID NO: 14827 - protein, 236 aa, Streptomyces avermitilis
MRDGHGDGHVERGLRMSVSELAEEEERRRKRAPWGVIALVLLTGLALIRNGSGEFDVGPPQPATAAAADSRSTPKPPTAKLPRPLPYSAARRVRIPAIQVDAPVTPVGLDMSGWVDAPSPDDPNLAGWFTGAVSPGENGTAVVVGHVDNMKGPAVFYGLGALKKGNRVEVERKDDKVAVFEIYGVEVFAKSSFPSDRVYASKGAPELRVITCGGGFTKQNGYDGNVVVFARLVEVR

SEQ ID NO: 14828 - protein, 406 aa, Streptomyces avermitilis
MRTSRALAAGAAVALAVGLAAPTAAALSDPSNIVALSRVIARGGQLTITVEGSRCQVNGSTVSSPVFPTTRLSPAGHNSASARVTIDRNARPGSYGITARCGNGTGVVNGANGGPGNGVGNGNGNGLGNGFGNGFGNGFGNGFGNGLGNGFGNGFGNGFGNGFGNGFGNGNGVGNCNGFGNCNGVGNGNGFGNANGNGLGNGNGHGNGFGNGNGFGNGNGNGIGNGNGFGNGNGLGNGNGHGNGLGNGNGFGNGNGNGLGNGFGNGNGLGNGNGNGFGNGNGLGNGFGNGNGLGNGNGLGNGNGLGNGNGNGHGNGLGNGNGLGNGNGLGNGHGTGLGNGNGNGNNAQSLTRPNAFTVIGGVRGGLGGSSSIGATPTDMAIGGGLVAAAVIAGGFFWMRRRTENKS

SEQ ID NO: 14829 - protein, 254 aa, Streptomyces avermitilis
LSEWLVLALAMAAACVVVVIVTLVRHRTAAEDDDPSETPDVIEYMTMMIGVVYAIVLGLAIAGVWEARSVAQDHVQTEAQALHEISERVRVYPPDVRDRIRDDVNAYVGQVVTTEWKTMADKGRVTARGAELFQRIRQDVTDYQPKTDFEAQAYQPLVDQVSAADTARASRADSTGATMPGVVWFGLITGAVVTIGMVFALQIRRTKRELVLAGLFSALIAFLLFLIWDFDAPYSRGVAASAEPFLALFPHLHG

SEQ ID NO: 14830 - protein, 206 aa, Streptomyces avermitilis
MISVVYGPERTRSAVAIRVLALVALVWILMGVPPETAVADACAYVSTGPDGIEVVAAAGDGLRCPVPSTPPPCPTPTPTLTPPPPPPPPPPPPAPTPTPTPSPTPTERPRPTPRPDPPPPRPAPPPPVAVAPRPTPTPTPTPTPTPTPTRTRAPRPSPPPEASPVSYPRYHASAHQRPPRGGPPLVTLALLITAPAVLAVAALRPR

SEQ ID NO: 14831 - protein, 317 aa, Streptomyces avermitilis
MKTSWRSASLVAAAAAVLALTTACGQESGTQSTGSQNVGAAAPAAGYTSSPGAAAGSGNGYGADSKEEQNSSSTESAGQLTVAENVKIGKVITDAAGFTLYRFDKDTAEPPKSSCDGDCAKAWPPVPAEGASAATGIDKALLGEVTRSDGTKQLTVAGWPMYRFAKDTKAGDTKGQGVGGTWYAAAPDGKKASATDLPGLSVRNDPKLGDIVVDKNGKTVYRFLKDQAWPTPKSACVGACLEKWPVVAPVAADDTKGVQKKGLMNFARPDGAKQQTINCWPIYTFSGDKAAGDTNGQGVGGTWYAVAPDGKPVGAPK

SEQ ID NO: 14832 - protein, 270 aa, Streptomyces avermitilis
MQRPAWAPRSIDISVPSVSRIYDYYLGGSHNFEVDREAARKAMEFMPGLPKIMQANRAFMRRAVRYAVDEGITQFLDIGSGIPTFGNVHEVAQAADPGARVVYVDHDPVAVAHSQAVLAGTEGADVVAGDLLKPREILASPEVEGLIDLNRPVALLLVAILHFVEDADDPYRAVAELRDALAPGSLLVVTHASYEGVPLPQERAEGAVDVYRNIRNPLIMRSREQVARFFEGYDMVEPGLVPMPNWRPDTAPEDEDPYAFSGFAGVGHAA

SEQ ID NO: 14833 - protein, 717 aa, Streptomyces avermitilis
VTPEPDGPEDRLRRFATIWSRAVFPVTSTPLTRPELENRLLPLARRLSEALRARAFDAAEAKAVGAALIDAHCTDPDALSATLDCVDAYLVLYCGTPDASPGDQEALRTRASRLQHAMAAGFAQALRERTLAEQEAISVAALQAQGVVGQALHASEARFRAVFEGAAIGIGIADLEGNILQINGALLRMFGGSEQAVRGRNVTDWTHPDDAPQVWRLYEELVRGEREHYHVEKAFYRPDGTVLWTNLTVSLLRDADGRPEYQLALMEDTTERRLLNLRLRYEATHDALTGLPNRTLFFERLEKALSAGGGQRFGLCYLDLDGFKTINDSLGHAAGDRLLVEVADRLQSCATAPGEMVARLGGDEFVALTTGPDTEREVDELAGRIMNALVTPISIDGRELAVRGSIGIVEGPAGERGPAEVLRSADITMYRAKSAGGNRFELADPEADARAITRHGLTTALPAALDRNEFFIEYQPLVHLGDGSVRGAEALVRWLHPQHGVLGPDRFIPLAEHTGLIVPLGRWVLEQSVRQAREWQERHCAEAAAPLRINVNLSPCQLTHPGLVSDTVDILERSGLEPGALCLEVTESALIGADDDLLKPLRRLAEMGVDIALDDFGTGYSNLANLRRLPVSILKLDRSFTQGMQQYPADPVDLKIVEGIVTLAHSLDLAVTVEGVETGAQAEQLRILGCDTAQGWYYARPGPPERLHELALVDATG

SEQ ID NO: 14834 - protein, 259 aa, Streptomyces avermitilis
MSKELEGRTAVVTGASKGIGLAVVQALAGAGAQVVAGSRTTSEGLDGLVEEGSVTWVPVDLAEPEGAGRLVGAAGGRIDILVNNVGSAPARTGGFLSVTDEDWHRTVDLNLLTAVRVTRAALPLMLEAGQGSVVTISSVNATLPDPLVIDYSASKAALVAFSKALSKEVGPKGIRVNTVSPGPVETELWLGGDGVAATVSAAAGITPDDVVARAAGATVTGRFSQSAEVADLVLFLAGDRARNITGSDLVIDGGYIPTW

SEQ ID NO: 14835 - protein, 297 aa, Streptomyces avermitilis
VGWVQFQQLQYFVAVAETRHFTRAADLVHVAQPSLSQQIKALEKELGADLFLRARGNITLTDAGEALLPLARRILADADTARHEVQELAQLRSGRVRLGATPSLCTGLLPDVLRAFHDRYPGIRLLIEEGGSHDLVRELARGALDLALVVLPLPTPSPALTTVELLREDLVVVSSPDAPAPGRGRRTVRIPDLEGERLVMFRHGYDLRELTVAACRAEGFEPDFAVEGGEMDAVLGFVRAGLGVAVVPRMVATRSGRGLRVTPLARPGLHRTIALAHRSDVAPPRAARELQRMLLER

SEQ ID NO: 14836 - protein, 235 aa, Streptomyces avermitilis
MALATRTDRRSSMARTVWDSSVGKKTVMAVSGLVMLLYLVVHMIGNLKIFFGSGEFNHYAHWLRTLGEPFLHYEWALWIIRVALVAAVVAHATAAYQLSRRDIRARPSKYVHRKARASYATRTMRWGGVILGLFIVWHILDLTTGSVHPGGFQSGHPYQNVVDTFSTWYGNIIYIVAMLALGLHIRHGFWSAAQTLGAGSRTRDRALKTVANVLALLLTAGFVAVPVGVMTGVVS

SEQ ID NO: 14837 - protein, 649 aa, Streptomyces avermitilis
MHSYADYATGEPVVDSKAPQGPINERWDTRRFEAKLVNPANRRKHTVIVVGTGLAGGSAGATLAEQGYHVVQFCYQDSPRRAHSIAAQGGINAAKNYRNDGDSVHRLFYDTVKGGDFRARESNVHRLAQISVEIIDQCVAQGVPFAREYGGLLDTRSFGGVQVSRTFYARGQTGQQLLLGAYQALSRQIAAGNIEMHPRTEMLDLIVVDGRARGIVARDLITGRIDTYFADAVVLASGGYGNVFYLSTNAMNSNATAVWRAHRRGAYFANPCFTQIHPTCIPRTGDHQSKLTLMSESLRNDGRIWVPKAKGDQRPANEIPEDERDYYLERIYPSFGNLVPRDIASRAAKNVCDEGRGVGPGGQGVYLDFADAIRRMGRAKVEEKYGNLFDMYARITAEDPYTVPMRIYPAVHYTMGGLWVDYDLQTTIPGLFAIGEANFSDHGANRLGASALMQGLADGYFVLPSTINDYLARNPHPEEVTAEHPVVQEMLADTEDRLRLLLAVDGDRTPDSFHRELGELMWEFCGMARTESGLRKALERIPQIREEFWRRIKVPGVGEEFNQSLEKANRIVDYLELAELMCLDALHRSESCGGHFREESQTPDGEAARRDEAFSYAAAWEFTDTGDAPVLHKEDLVFEYVHPTQRSYA

SEQ ID NO: 14838 - protein, 249 aa, Streptomyces avermitilis
MKLTLRVWRQQNADADGAMSTYEVDDISADMSFLEMLDTLNEELILKGEDPVAFDHDCREGICGACSLVINGDAHGPERTTTCQLHMRSFEDGDTIDIEPWRASAFPVVKDLVVDRSAFDRIIQAGGYITAPTGAAPEAHATAVPKPDADFAFEHAECIGCGACVAACPNGAAMLFTSAKINHLNVLPQGAPERETRVLDMVTQMDEEGFGGCTLAGECATACPKGIPLVSITGMNKEWLRATRKAAKR

SEQ ID NO: 14839 - protein, 256 aa, Streptomyces avermitilis
MTGVSTLDSPPQPTAPARYTVTLARDEADVRAAQRLRHDVFATEMGALLSTPQPGLDIDAFDAYCDHLLVRDTATGQVVGTYRLLPPERAAVAGRLYSESEFDLGPLAVVRSGLVEVGRSCVHPDHRDGAVIGLIWAGIARYMVDGGHEWLAGCCSVPLADGGALAAATWDRVEAKHLAPEEYRVRPRLPWNPEGVARPARTELPPLLRGYLRLGAWVCGRPAHDPDFGVADLYVLLPMRRVDPRYLRHFLSLVPA

SEQ ID NO: 14840 - protein, 299 aa, Streptomyces avermitilis
VPVPASASAARRPLPAGSAGGRSAARVSAWLPTAPCTARGCVESTAAWTAVPRAVLRLTALLLLVLAGVLLTPAVGRMRAAERDPLIRRWCRAVARAAGVRVRITGAAAPTGGLLVVANHISWLDIPLLAAVRPARMLAKAEVRAWPVAGAVAARGGTLFIERDRLRALPDTVGRIAAALRGGAAVVAFPEGSTWCGRAQGRFRRAVFQAALDAGVPVQPVRIHYRSAGGAASTTPAFVGDDPLLASLWRVASARGLVAEVEVLPMPAAGDRADRRALADAAQEALRRASTGPQSTSHP

SEQ ID NO: 14841 - protein, 975 aa, Streptomyces avermitilis
LVNEHDPVRADDNGLLNAPPGTTEFLHLVRALVPRPRRGERWLPALEIDGPHARAVYDVLNSRLVTAARPTPYCAVPSPETETRVGHGPEPTNGTARTGGTDGTGGTDGTDGTDDPASDTEVSGRRADRGGTALAEEADPAGHALDHQDVEALRVLLDEVCHGLARQRSGQPRLRFRHFSLVQWAMNTRLPAGARTDEYPAVLAADLRATRRGADRPAADLTGLGGALDPVLQFLWNVLTVAVPPAFFRVVAGGRVPGLGRTYRWFMRQPYLRPQLSGNFLGLAERLTAGYRADEPSEQVAKLLVHAFLEDLRRSLRRRPWRPGGWRHTAYPVVQIRSGESPTTSRTLLRLVEQVRDETGRLVPVLLVHVAGRQDGGPVPSAPAHALRMTDLHAIDRNQWAPVSYRSRLARRTSAPTARVRGRRRLWADGEVDAERVPASAVVAAPAPPWFSRPVVIVAACLLLFVPAAVWSGRYLGIPGCLHRPFAADVVVRDVGGECIGFSDGAALTFNNQPGQENLHYIQERIFAQNRDARRAWEESGRRRPYVTVVYLGTLTGRATQAGEEAYAAEREGLEGMAAAQYIGVRATVNTSSVPLLRIVIANAGFQMKHADLAVDMIARLARQPSDAPVIGVVGPVESRTASAVALRHLNRVGLPAIAPALSADHIDSNSNLYFQISPPNRDQVHLLSAYARRKGWKGLHIYVTFGEKSSRKDDLYVATLLDDLKKEFKGTSDLTSTKWHPGRSMQRECDYRGMLFFAGRWSEYGDFLAGLRQACQNNDWPRHLVADDSVNRYMANKTLRKTAPDNLTMLYVSKSGLATCSSLRRPDPDVGQFLAAVQSPDLLSPPRCVGGPGPQQWIGEQVGLAYDATMLFSQAVEQLAGRIRVWPQPWDGRMIDPAAVHTEILRGNAKGGWPGVTGHLSYDMGSGEPKNKPLSLLRVDDITDMDKLPTEVFVCNPRGAQGAAVCNSSTADRP

SEQ ID NO: 14842 - protein, 214 aa, Streptomyces avermitilis
VVLDLVVIGVAITLGPLHNTAFILLLSAPKGVRKGLAFILAWLACLVLLIAVVVLLTGGRPPPHKSAPSTAVLVLKLILGLGMVFYGERKRRRGSRPRQSPKWMARLDHVSVWAAAGFGVLLQPWGAVAAGAATVVEANMSSAATYFALTGYCLLATSSLLAMELHATFRPLTAQVRLRKLRAWIDGHQDQAIVSISLALGLWLMAKSIYQLVG

SEQ ID NO: 14843 - protein, 452 aa, Streptomyces avermitilis
VRSPHHSFPRRSLMHSAKPRPPRTTGRRGMLAAVTALLTALVVSAAAVAREDARQQPRATGGPVWTGAWGTAVQRPVEGSEDKGPNWSRQGFADQSVRQVVRVATGGSTVRIRLSHTYGTTPLRITAATVGRSAGDAQVWPGTARELRFGGSQGTTIAPGRDAVSDAEALSTSPLEKLTVTLYFAGRTGPATFHRFTTATSYRAAGRHLSDSGGDAFQDATNAWYFLSGVEVSGPATPRRGTVVVFGDSLVDGTGATPGADNRFTDKLAERLVADRRPLDVVNAGIGGNRILNDSPCYGDKAEDRFRRDVLDRPGLRTVIIHLGANDIGAPEMGDPCMGSAPRVTARQLIEGHKKLIRAAHARGVKAVGATILPMKGALFPVYSERGEKVRAAVNHWIRTSGAYDSVLDVDRALASPADPALPRPGYVVEDGLHPNEAGSHAIASAVDLNAL

SEQ ID NO: 14844 - protein, 76 aa, Streptomyces avermitilis
MQLPAEAVAATALIEVVRISALPAKRGAPYPGRTVAQCHEVLMHGTAVPPALGTQFFDADTPPAQALLALFRAAAP

SEQ ID NO: 14845 - protein, 214 aa, Streptomyces avermitilis
MNADGWLADTRSSYDTVAVSYADQLRGALAGTPYLRAALELFAGMIHTAGGGPVADVGCGPGHVTAHLHGLGVDAFGIDLSPAMIDVARRDHPDLRFEVGSMTDLNLADASVTALLAFWSLIHVPDDAIPAVFGHFRRVVRPGGPLLLGFHIGDESRLKTEGYGGHPMKVHVHHRQPVQVTAWLRDAGFTVEAQWLLGLDGHIPGAVLFAHRQS

SEQ ID NO: 14846 - protein, 267 aa, Streptomyces avermitilis
LINCSINRMIKKCTSVLPHPPASAASSVDRAVPPGLRSSCRRQSAYPGEPMKLPVTIHQARLGSAEFKVIRPARPLDRAVLIDHDRHLDAYLDQDAARRIGGLWELAASSPHALIHLPIRGNPAPSRDLPAAGTRQLDLVLLHHSRQFAPSRWKEVRGRLGRGRPQTVTLPGAGRGDGAVVDPGARHHRENRDLFHQHLHAETLFMTGSAKVFRETARHFLDVARNGPGYVPVHPSYPYFCTELHSNDGILGDAREIHIEYCDQWDS

SEQ ID NO: 14847 - protein, 335 aa, Streptomyces avermitilis
VSSVIAATRFSVLDRSRTREGHDGAAALRDTVGLARDLERLGYHRIWVSEHHGVPGVAGSAPTVLAAAVAAATRSIRVGTGGVMLPNHQPLVVAEQFGVLDALFPGRVDMGLGRSVGFTDGVRRALGRDKDDADDFAAQLDELLGWFLGTSPTGVHARPAEGRTVPPFVLAMGEGATIAARAGLPMVIGDLRNREKMRRGIDHYRETFRPSPWAREPYVVISGTIAVADTPQNARRLLVPEAWSMAYSRTHGTFPPLPPAERVESLRMTARERGFYESGLTGHIAGTEDQVAHELETVIKETGAQEVLVTTSTYDRDALLDSYRGLARLAGLTAL

SEQ ID NO: 14848 - protein, 250 aa, Streptomyces avermitilis
VRVQDDPRAAPAQTGCSGAELTDSQASLEAFIEAEAARIHDRHGHTPRRDVAASRALHDYAWSVGLLMSGVWYLEQRVPRIRPEDVRLDLASGTYTITAGSDLACLPDDPAAALPGALPLADEEALRAALRSAVADHMRPLLTALAPYVRRGPRTLWGMVGDDLVSGIWYLGRTLGREAAAIRAATALLPSPKAPFPGGADFRHLTGGDGRHHPTRTRIGCCLYYTIRPAEACATCPRTCDAERLRRLEA

SEQ ID NO: 14849 - protein, 390 aa, Streptomyces avermitilis
MRLYLLALNPTDSVTEGFLPAAARLGLDVTVLTDQPDPHRRAYPEVEVRECDVRDYRAVITRISAHHPPDAIFTNSDHLQTQAALAADYFGLPAKNWRAALRTKDKAEMRRHLAATGVDTVWSAELTEPVALDAPYPCVVKPREGVASEDVVLVDGPEELVARCADILTRRPGAALVVEEYLPGELYTLETLGDGRVRHVLGGFHTELSPLPYFIEERMAFVPAHPEAVRAQVLAQLDALEVGFGACHTEFVVHGGRARIIEVNYRAIGDQCDLLLAQLLEIPLFEHILRTHLGEPLPAELGARRDGAARLEYPCADRAGTLTAAPAATELAVDDVRLTYRPLRSIGERHELYGTNRDYLGVLRATGTDQQAVDKATAGFLAAQRWEIGP

SEQ ID NO: 14850 - protein, 587 aa, Streptomyces avermitilis
VTAPTATDPAEAELLTRVLSALLREDVVGLRTRSTLVHRADGPWLRLAHPGDALLLPVTEDGFQSRHAARLPLLVSETDGELRTVSTVLGALRTRAEPPDRDGFDAFAEECRQTLATLRLHSGTRQEIAQLLTARHGADPADWTGLAGGLAHDTLAARLDHPVYPTARGRSGLDARQLRAYAPEFHPRFALRWLAVPRRALTLSTGVLPDRWPTPAALGLPEAEHTHVALPVHPLTVGAPLDAALRATDLADSAILASRGHLDVVPTLSMRTVAVTADPSLHLKLPLPTATLGLRNRRTIKPGTLVDGAAGQRLLEAVTAREPRFRDTVLHADETGYAHAGHELLAVLCRRQPAGLDGSVVVPMAALLAEAPGGRLVVDHLADRFYGGDPLALLDALLTLLFDWQTTLFGYGIALESHQQNISLVLDRQADGRTRPRLLLKDNDGPRINAVRLRERLGDAAPGPADFDDARVFGDGDGPVADLFTTITLHLCAGAYAFGLARHGRARLPAVLGLVRDRLAEAVERLGTGVGEPGAVLRARVLDAPRLPVKAMVTAGTLLSKERSGAADINKHYTSGPNYLLRAGDPA

SEQ ID NO: 14851 - protein, 601 aa, Streptomyces avermitilis
MRPHPALSPPPLEPLMPALTDSLDAAPRRTAPVRPPTAEQAVTHTLLNCLLREVSGPERQTAVADGHLLLRLPRRGVLLRIALRRTSLVGAHRFSGPVCEDDDHGGWPEVDWQRLATYVHDELSLRTGVRNEEFLEQVDSSHRAVAAGLAARPADDTPAAMLATDALSAYVASEQSLVFGHRFHPTPKARTGSAGSWSSYAPEAGASFPLRHLAVRAHLIAEEMAEPAAAASLDRQRADVPHGHRLLPVHPWQYEMLREHPTLRAALDRGDIVDLGEGGRPFAATASVRTLYDGETFLKFSLNVRITNCLRKNASYELAGAVALTRALSPVLADLADRFPGSAVLREPAYRSLALPGPDGTPDRELLEGFGVIVREGLPGRLLPRITPLLAAAVADEYPTGPAHISRLLAAAGPGTVLDWWAAYLDLLVPPVLAAYFDHGLVLEPHLQNVLICVDGDGMPTQVLFRDLEGTKLVPERHAGTLAALPPDVAGAMTYDAQRGWDRVVYCLLVNHVAELLAALADLRPQTEAALWAQVRATLQAYADRYGCPPELAALLAGVPLPAKANLLTRWQRKADRDAGYVRLASPLAEDILRHTARSAR

SEQ ID NO: 14852 - protein, 408 aa, Streptomyces avermitilis
MTVPTPAVRDRIRTLAPGELPAYVYDLAELRAHAAGVRAALPERVELYYAAKANPEPEILAALAPYVDGYEVASGGELAHVAQAVPGRPLAFGGPGKTPDEVAAALAGGVQRFHVESEYELHMLAEQARRVTPGTRVAVLPRFNLPVRDGSLAGSALAMGGRPTPFGLDPAQAGTVLRLLTDGTYPHLELRGVHAHLASGLEAPEQLAVAETVVGWATDMAGEHGVGLGEVNVGGGMTVDYAAPERRFDWVTYGKGLARLAHAHPELTLRIEPGRALTAYCGWYATEVLDVKRSHGEEFAVVRGGTHHLRTPATKGHDQPCSVLPVDGWPHPWPRPAAEAERVTLTGQLCTPKDVLARQVPAGGLRAGDRVAFALAGAYAWNISHHDFLMHPRPGFHFLLPDRGDGEP

SEQ ID NO: 14853 - protein, 816 aa, Streptomyces avermitilis
MRRDSPRVDRNGGVRTAAELLRLRYGIILGHMERVAAAAIVDDHGVVTAWSEGARQLTGYGSEDVVGRAAADLLVEAALRETAAALTGVTVLTGVAVLRHRDGHPVEIALTACPVLGPDGGPHGYVITAERPGGPEPTPEGRAFQQASVPMCAFGTDLRFLRLNDSACRGMGGAEESLVGRFYGDTVPADKTSRGFLLNLRKVVETGTPLRYETYTSAPAGGPARAWSIEMWPVRGDTGAVDEVAMAAFDSSEQHEARQRLALLNEAAAAIGTTLDVVRTAEELVNIAVPRFADFVSVDLLDWVLGAEEPAGDHGPGVVLRRVAHGSVTEGTPEAAVRLGQTDTYPPFSPPARALTSGRAVRSRAGDPDFDRWVGERNARNVGTRASREGAHSLVTVPLLARGTTLGAAVFIRVKNQDAYAVDDASLAEELASRAAVCMDNARRFAREQSMALALQHSLLPRGLAAHAATEVAYRYLPTDSAAGVGGDWFDVIPLSGSRVALVVGDVVGHGIHSSATMGRLRTAVRTLADVDLPPDELLTHLDDLVIHLATEGSGEEVAELGATCLYAVYDPVSRRLVLASAGHPPPAVLLPDGTAQVVRVSAGPPLGVGGLPFEATARELPEGSLIALYTDGLIEGRGRDLDRGTAELCRALVLPGASLEALCDSVLKSVLPDSPSDDVALLLARTRALGADQVATWDISPEAACVSAARQSVLEQLTTWGLDEMAFVTELVVSELVTNAIRYGEPPVQLRLIRDRSLICEVSDGSATSPHLRRAHAYDEGGRGLLLVAQLTRRWGSRQNPPGKTIWAEQPLPPG

SEQ ID NO: 14854 - protein, 165 aa, Streptomyces avermitilis
MDSEGIQYALHAVPRRFRKKAVAMPTLPWTTVEEPAPGAEAFVMASRLEVRRFADVPRFFLRSLATWKQVKSAPGAFGASLVAEPLKRTFWTLSAWEDKEALYTYVKTEPHRTIMNGLRSTMSGSVFTFWRTPAGELPVDWADARRRLAEQERADLSNSGGPKAT

SEQ ID NO: 14855 - protein, 218 aa, Streptomyces avermitilis
VKVSNDQSGAVPMRMSELSRRSGVSVTTIKYYLREGLLPAGRRLSATQAGYDEDHLRRLRLIRALTGVRGLPVSAARDVLGALAEHAGDTHSLLGLTLGSIRLAEESADDSPEPAEVDSLIQELGWDVHKSAPARSALAETLTSLRTLGAPLDRRALLSYAHLAERTAVLDLDQLDGIEDPLEVAERALLLTVLLEPALLALRRLAQENESAQRHAES

SEQ ID NO: 14856 - protein, 165 aa, Streptomyces avermitilis
VVGVTQKSRPLAVFDLDNTLADTAHRQRFLERKPRDWEAFFAAAPKDPPLAAGVALARESAEECEVIYLTGRPERCRRDTLDWLAAQGLPEGRVFMRGNGDRRPARVTKLEILRRLARDREVRVLVDDDELVCVDAERAGFTVVRARWASSSEALKEAQEGEGRT

SEQ ID NO: 14857 - protein, 85 aa, Streptomyces avermitilis
VTRDTPVTAERSTRMSDHTYRVTEIVGTSTEGIDQAIRNGIARAAQTLRNLDWFEVTQTRGQIVNGQIEYYQVGLKVGFRLDDGD

SEQ ID NO: 14858 - protein, 416 aa, Streptomyces avermitilis
VRRRLLALLCVFASLLTACGALPGEGTGRRTVTVWLMKDSASKEFLARFTKEFERAHGDLRLDIRIQQWTGIGEKVQTALRRQGGDGPDVIEVGNTQVAQYVDGGGLLDLTLESLRDWGMNDWLPGLAEPGRFGSRQYGIPWYAANRVVIYRKDLFAAAGLAGPPKTRDQWLADTQKLNSHDVQGIYLAGQDWYTLAGFIWDEGGDLAEQPSSGTWEGSLDTSAALRGMDFYRRLQALGTGPADADEEHPPQAGVFARGRVAQIVAVPGLAQAVVRKNPDLRDKLGYFPVPGRTAARPGAVFTGGSDLVVPKNTDDRRGATAVVAALAGGKWQTDLARTMNYVPNKTTLADAVEGEEGVAAMAAGAAQGRATPSSPDWAAVEADNPVKDYMTKVLTGADPATEARRASRRITRTLS

SEQ ID NO: 14859 - protein, 702 aa, Streptomyces avermitilis
VVPVPHSDPGRRVDETTASMLEALFTQSPIGLHLLDTDLRVVRINTATPGMRGVPLDDLKGRPVRDVYNLVQGVDLEALLREVLDTGVPVVQRIVRARSNGDPPPERHFEITALRLENPRRSVLGVAVTAIDVTERERARTRTEVLDAVRRHVGRTLDPVVTGAELVPTVVPAFADIAIVEVVEAVIRGDDPPQAPPPASTPLMRTAFRSTRTRPPQAHPVGDVRRLPAPTPFTQALADLSPRVVALHPTAPWLSVDPPRAEAIHSSGAHSLLVVPLALRDAALGVVSLYRTGQSPPFDEGDRDLAVELATHTALCIDNARRYTREHTVAATVQRQLLPRSPETHASLDTAYLSVTGADPGVWYDTIALSSARTALVVGKVSGHGLNAAATMGQLRTAVRSLSAFDLSPDELLARLHYTAGQLAAERARLPLGDPLRRESLTADCVYAVHDPLTGTCAMAAAGPLVPLVVCPDRTVTVPGIPAGPRLGATEGAPFATVGVEVPHGSVLVFASDPLLTSYLAESSEPLSTAPDYHDRPLQDLCDALVYARPAGLGAGDAAVIVARTRAFPPDRFAAWPLDADPASVAVARRRTRGQLAAWDVDDETAFNTQLIVSELVTNAVRYGSAPFELRLIHDRTLTCEVRDAGSAAPHLRHAGTADEGGRGLFITAQLAQAWGTRYTPPGKTIWTEQALSPGTGPAESL

SEQ ID NO: 14860 - protein, 900 aa, Streptomyces avermitilis
VVVSAMAGLEENGSEPTAPRADPQGDPFLRTRFALPTRPGTFLRRERLVRHLDHALRTPLTMVNGAAGAGKTLLVADWAAGQDRSVAWLTTDAADQGCGTFWAYLLQALRACDVPLPAEVGFPADANRVDHTLLARLAADLSVRDRPVVVVLDEYDRVTDPEIADQLEFVLHHAGRGMRLIFVTRTEPLLPLHRYRAAGDMTEIRDAELAFTPEEAAALLELHGLRLSVHAARGLVERTRGWAAGLRLCALAAQERPDPETYLKEFEADRSTVADFLLAEVLKRQPPQTQDLLLRVSVLERFCPELANALTDRSDAEAILAGLHRENAFVEHLGHAWYRLHPLFGEILRAHLRVRLPGLEPELHRRAAQWLRRSGSLAETLGHGAAAGDWEFTAGALVDDLAIGQLFTGLRSDDLAELFSRMGPEATSPATELVRAARDLSRGDLDRGLTHLRHAEQSLAGERMPTGDDSAGLAAARLSCALLEALAARLTGSPGRAEAAAEAAGKLQEEVSSHLLDEHPELTALLLTHLGSARLWAGCFKDARAALTTVAACSGGASTALPREESLGHLALIDYLNGWLGRAERKALAALGETERFSLPQASGSGIGLLVLAAVAVDRNELGEAQALLDAAADTHRAMRDPVREAGRAIATARLLLARGNPHAAIEAAGPAVAADVVSPWAEGHTALVASAAHLAEGRPEAAAELLQAVPDDQPACAVGAARAQLAAGNPGAAIDLLDRLHPKGRIGPGVTVRASLVRAQAADAAGDSATSRRLVAQALQEARRERLRRPFLEAGPWIRPLLGTAPLRGLAAGWLAPGPPPHGGPRPVDQPPAPVVEELSGREREVLQRLAEMMSTEEIAADLYVSVNTVKTHLKSVYRKLAVNRRHDAVRRARELRLL

SEQ ID NO: 14861 - protein, 608 aa, Streptomyces avermitilis
VGAGPHDGPPRPPRLGRRLRGSSGSPVAGEAQGEFCGCDGGGGRARAGRCPAGRAGAPGRLGEVDIVTHWRALIVLGTAQFLMVLDTSVMNVSISQLVEDFDTEVTAIQAVITLYALVMAAFMIIGGRLGDIFGRRRLFLLGLVVYGAGSALTAAAPTLWVLVLGWSVIEGLGAAMVLPAMAALVAESYRGRDRAVAFGVIGGLAGAGIAVGPLLGGWVTTYLTWRLVFAGEVVVVLAVLCFHRVITESPRTGPRPRLDGVGAALSAAGLALGVLGVLQSGTWGWVEPRNPPFTVLGFAPTLFVIGAGVAVLAGFLRWERRRDALGAEPLVHLPLLGKPALRSGLLSLLCQNLILLGLFFTIPLYLQVVQGFDAFQTGLRLLPVSVTMLVTSMCAARLGRVAGPRRVVRLALVTLAASIMWLLATIDPVIDDAQFAGAMALLGVGMGLLASQLGNVVQSSVGEEERSEVGGLQFTAQNLGSALGTALIGSLLIGALANAFTTQVEDNPSLSREARQQTGVALEAGISFVPTEQVRSAAERAGLPPSEADALAESYASAQLGGLRAAILATGGITLAGFLVTPHLPSRPAGRPKRPDSGAPADAIDRTR

SEQ ID NO: 14862 - protein, 143 aa, Streptomyces avermitilis
MLAASVVVGAGTLGSFPYVELVLLLLLTGVAFWIAHVHAQLFGARMAQQGLDRRIVLHVCRDEWPIVKAAVPPAAAVAVSPLLGLGVQGALWLALSVAVAGQVGWSAAAARRAGASWGLVAVSASVNLVLGLLIIALKISLTH

SEQ ID NO: 14863 - protein, 65 aa, Streptomyces avermitilis
MRYEIRVEGHMSETLTRAFPELDHVVMSGQTVLFGSVVDEAHLYGLLARCQSLGLRVLEMRQLPE

SEQ ID NO: 14864 - protein, 221 aa, Streptomyces avermitilis
MTVPRGPTPHTGPEQMSDRAAPGPSDGDPAEVLAALGRSWTWILGSAVATLVPGVLVLVWPDETLHILAVLIGLYLLVIGGFRFVAAFSRDEHGDRLPGVLLAVAFVLAGVLCLRNPLQTIAGLSLIVGIVWLVSGILTLYTAIAAKDLPHRGFVLGVAVIAIVAGIVVLALPTESARALTRLLGLWMVLLGLAEVALALAWRAALRRSRGAGPHGPGGTV

SEQ ID NO: 14865 - protein, 165 aa, Streptomyces avermitilis
MSGQMYLAYDYPLLSVFWSMLVFFLWIMWFILLFRIIVDIFRDDDMGGWAKAGWLVLVIVLPFLGVFIYVIARGKGMGRREVAQARAQQESFESYVRETAKGGGRSSSVDELAKLSEIRARGDITDEEFRKAKELVLSDYGPSAGAGAGAGTGTGANAGPSTSGR

SEQ ID NO: 14866 - protein, 148 aa, Streptomyces avermitilis
MTATHTAHGQTVDRPWAEGLTIFAAVMLMIAGILDVCRGIMALAEDDVFFRTRNYVFAFNLTGWGWIHLILGVVAVIVSFGLFQMALWARVAGVAIAALIIIANFLSLPYYPVWSVVMIAFSAFIIWALCVVRQDESADPFASPPHGM

SEQ ID NO: 14867 - protein, 333 aa, Streptomyces avermitilis
VSPFLLTRTLPEDTTDAALRADVLHGLAVPRGAGPARPGETAKPKTLPPKWFYDAHGSELFEKITELPEYYPTRAEREILIARAAEIAAATGARTLVELGSGSSEKTRHLLDELTGLHTYVPVDVSESALTQAGQALIAERPNLNVHALIADFTGGLALPGTPGPRLVAFLGGTIGNLLPAERTAFLASVRTLLSPGDAFLLGTDLVKDESVLVAAYDDAAGVTAEFNKNVLTVVNRELGADFDPDAFDHVAVWDAEKEWIEMRLRSRTAQTVKIPALDLAVDFADGEELRTEVSAKFRKDGVRAELAAAGLDLTHWWTDEEGRFALSLSVVR

SEQ ID NO: 14868 - protein, 275 aa, Streptomyces avermitilis
MCRHLAYLGPAEPLGRLLVEPAHSLFRQSWAPRRQRYGTVNADGFGVGWYAEEDPVPARYRRAVPIWGDQSFADLARVVRTTALLAAVRDATVAGADGEAAAAPFAAGPWLFSHNGAVAGWPDSLAPLACSLPPTELLSLEARCDSALVWALVLNRLRGGDEEGQALADTVLEVAAAAPGSRLNLLLTSGETIAATAWGDTLWYLAEPGRRTVVASEPYDDDPHWQEVPDRTLLAASRTDVLLTPLKDPREQGGPPEHGEPHTHMASAPPKEPRT

SEQ ID NO: 14869 - protein, 440 aa, Streptomyces avermitilis
MTDPGSPTDPDTLRARALDALTTARERTALLTTCVDEPDLTAQHSPLMSPLVWDLAHIGNQEELWLLRAVAGRDAMRPEIDGLYDAFEHPRAERPSLPLLPPDEARRYASEVRGRALDVLESTAFRGTPLTEAGFAFGMIAQHEQQHDETMLITHQLRKGPAALTAPDPAPAPPFTGPAEVLVPGGPFTMGTSAEPWALDNERPAHERLVPSFYLDTTPVTNAAYQAFIEDGGYGDERWWTAEGWDHIRSHSIEAPLYWRREQGQWLRRRFGVTEPVPPNEPVLHVCWYEADAYARWAGRRLPTEAEWEKAARHDPVTGRSTRYPWGDADPTPEHANLGQRHLRPAPAGSYPAGASPLGVRQLIGDVWEWTSSDLEPYPGFTAFPYKEYSEVFFGPEHKVLRGGSFAVDPVACRGTFRNWDYPIRRQIFSGFRTARSGAS

SEQ ID NO: 14870 - protein, 424 aa, Streptomyces avermitilis
MSDSVSDCTEPRSAVTEADVEALVRGICFKTGPPRTLGVELEWIVHELRRPQLPVAPERLDAAYAALRTVPLRSALTVEPGGQLELSSAPAASLMECIGSVSADLDAVRALLREAGLGLRGYGHDPWSPPTRYLHEPRYDAMESYLDRAGPEGRAMMCSSASVQVCLDAGHEEPGPLGHGRRWWLAHQLGAVLVAAFAHSPMAHGRATGWRSTRQYLWAAMDPGRSSAPPLDGDPRRTWARHVLDAPVMCIRADSGPWQVPEAMSFREWTRSGTPPDRGDLDYHVSTLFPPVRPRGHLELRMIDAQPGDDGWIVPLAVTAALFDDPEAAEIAYRTVKPLAEHGRSLPAPCNPLWIEAARQGLADPELHEAAVICFAAAAEALPRLGATAEVQNAVAEFTDRYVARGRCPADDLLLQLHGKDLRT

SEQ ID NO: 14871 - protein, 327 aa, Streptomyces avermitilis
LCRGQGNSVAAYVQHRSPFVHEHDGGDRGRGNRRRGPHSVHGGGAVSARLRAIARETEEIVAAGRYHASDGRAVSIAAAVEAARAATRVYGPDPVEISQVGPVATLFEVTGESSLEAARRLTERAGDPVAVLNFASARNPGGGYLNGAQAQEEALCRASALYTCVLGARAFYEHHRAHRDPFYTDRVIHSPAVPVFRDDRGRLLDKPYPVGFLTAAAPNAGVVLRSAPERAPELPRALAARAERVLETAVTHGYRRLVLGAWGCGVFRNDPAQVAGAFHGLLGPGGRFAGHFEHVVFGVLDRTPGTATRGAFERAFDGEVRGAQRQP

SEQ ID NO: 14872 - protein, 151 aa, Streptomyces avermitilis
VTRVTAFTDEDIPGRHGPSATTEAEPRTVGRVRTEYSPAHDGDPDPGEIVWTWVPFEENDGRGKDRPVLVVAREAAGTLLAVQLSSKRHDGDREWVPIGSGPWDRSGRDSWVAVDRVLRLHESGMRREACALDRMRFNLVVHRLRERYGWR

SEQ ID NO: 14873 - protein, 493 aa, Streptomyces avermitilis
MIVGVVAGAAVLALIFIVVVFKLMWRVAEPNEALIISGSKHRTEGLEEGMGFRIVTGRGTLVLPGVQAVRKMSLDLNETELSVDCVTTQGIPLKVRGVVIFKVGDDFVSIANAGRRFLDQQKLMAERVHNVFAGHLRSIVGGLTVEDMIRDREKLTGQTRAACGTEMEKLGLIVDSLQIHEIEDPTGYIKNLAMPHAAAVQRDARIAQAEANRLATEAEQLAASRMSEATRDSEILQAGYQAERDKAAAKAKQAGPLADAAARQDVVVQETRVAELEAHRREQQLQADVRKPADAKAYETRARAEADRDARISAAQAKAKETELAAAAEATRVKTAASAEAEATKARGAASATATRATGEAEAAAAQAKGLAVAEATRAKGLAEAEAIKARAAALAENQEAVVAQQLAENWPEIVQAGASAFNNVEHMVLLNGADGMGDMFAKALTMGGTGLGLARQLLASMNQNGTAGGGAAGLNGFVPARTEKVPVEKDEG

SEQ ID NO: 14874 - protein, 504 aa, Streptomyces avermitilis
VSRMAAERADTPPERAEGLARCARALADGEVTSRELVERTLARIEATQPSLNAFRLVRAEASLAEAQAADRELAAGARRPLLGVPVAVKDDMDVAGEPTAFGCRGEFPPRAEDSEAVRRLRAAGAVIVGKTNTCELGQWPFTEGPAFGATRNPWHPDHTPGGSSGGSAAAVAAGLVPAALGSDGAGSVRIPASWTHLVGIKPQRGRISTWPRPESFQGITVNGTLARTVADAALLLDAASGNHAGDLHRPPATGVLEAVGREPGRLRIALSLKPPFTALPARLDPRVRARVLELAERLAALGHVVEEAEPRYGRIGLTFVPRATAGLAEWVRDAPFPDLLDRRTRDAARLGRLLGGAPLRLARAAEARLHRRVGALFDVYDVLLAPTTAAPPPHIGSMVNLNGFGTDRAMIAACPYAWPWNVLGWPGVNVPAGFVDGGPSPAEGGRDGGLLPVGAQLLGPAHSEPLLVSLAAQLEADRRWHEQWPPASTDADSAATRRSSGRTL

SEQ ID NO: 14875 - protein, 344 aa, Streptomyces avermitilis
MVHIPNEPVPSPSAPRSVPTSADVARLAGVSRATVSYVLNNTSAVRISEPTRRRVHEAAKELGYVPHAAARSLRAGHSRMVLIPTPNVPVGPLYNQFFNELQWALSRLEYTVVQYGDLSPHGDEAARAWAELRPVAVLVPGGGLGPQGLAVLKRSGARAVVTLGAERVEGAHAVLLDHEGVGHSAGRHLLARGRRAVGVVVPEEPGLEMFSKPRLEGVRRALQGTGATVTELPLAYEEEAAARLAARWRPLGLDAVFAYNDEYAMLLMRALQDEGIAIPRETAVIGADDLMLGRLLRPRLSTVHIELPSGRDLAELVDRAVRDPGVAPEVHEVLGTRVVQRESS

SEQ ID NO: 14876 - protein, 129 aa, Streptomyces avermitilis
MSSTVELTKENFDQTVTDNEFVLIDFWASWCGPCRQFAPVYEKAAEANPDLVFAKVDTEAQPELAAAFDIQSIPTLMIVRDQVAVFAQPGALPEAALEDVIGQARKLDMDEVRKAVAAQQAQAQAQQGE

SEQ ID NO: 14877 - protein, 477 aa, Streptomyces avermitilis
MTETESIAYDVVVLGAGPVGENVADRTRAAGLSTAVVESELVGGECSYWACMPSKALLRPVIARADARRVPGVSHLAQGHLDTAAVLAHRDYEVSHWKDDGQVGWLDGIGADLYRGHGRLSGPREVTVTGPDGDRRVLTARHAVAVCTGSRALLPDLPGLDQVEPWTSREATSAQAAPGRLIVVGGGVVAVEMATAWRALGSEVTVLVRGKGLLPRMEPFAGELVAEALKEAGADVRTGTSVSAVTREGPTVVVLTDTGDRIEADEILFATGRAPRTDDLGLDTVGLEPGSWLSVDDSLRVTGSDWLYAVGDVNHRALLTHQGKYQARIAGAAIAARASGVPLLESDPWGAHAATADHAAVPQVVFTDPEAAAVGLSLAEAERAGHHVRAVDVEFSSVAGAGLYADGYRGRARMVVDVNRETLLGVTFVGPGVGELIHSATIAVAGEVPIGRLWHAVPSYPTISEVWLRLLEAYRDA

SEQ ID NO: 14878 - protein, 224 aa, Streptomyces avermitilis
MASESDRTVPDTRSASRPLADRVEELLATGGPLPIVAAGDPVLRRGAEPYDGQLGPGLLARFVEALRLTMHAAPGVGLAAPQVGVGLRIAVIEDPAPVPEEVGAVRGRVPQPFRVLVNPSYEAVGSDRAAFFEGCLSVPGWQAVVARPARVRLTALDEHGRAVDEEFTGWPARIVQHETDHLDGMLYLDRAELRSLSSNEAMALRWSQPTPERAAAALGFALPD

SEQ ID NO: 14879 - protein, 470 aa, Streptomyces avermitilis
MTTAPSAPDAPSTTTDEPPQSGTPGPARWAPLRPLVLRLHFYAGLLVAPFLLVAALTGFLYAASYQAEKIVYAHELTVPVGDTELPISQQVAAARKAHPEGTLTAVRPSPEADATTRVLLSGVKGVDEGHTLAVFVDPYTGKVRGSLEQYGSTGALPLRTWIDEFHRDLQLGENGRLYSELAASWLWVIAGGGLVLWFGRRRAQRKVRGTSGRRRTLGLHGTVGVWAAAGFFFLSATGLTWSTYAGANIDELRTSLGQATPSVSAAAAGEHAGHDAAAGTGGTEHGVGLDKILAAARAKGLGDPVEIVPPADASSTYVVKQVQRSWPEKQDSVAVDPATGEVTDTLRFADYPLLAKLTRWGIDAHTGVLFGLVNQIALMALALSLVLLIVWGYRMWWQRGRASAFGRPIPRGAWQQVPPQILVPCMAVIAVLGYFVPLLGIPLAVFIAVDVVLGEIAHRRGQRTYGRQVA

SEQ ID NO: 14880 - protein, 137 aa, Streptomyces avermitilis
MAQREANSPHRGSRRRGQGELEVQVLGALREADGPVTASWVQEHLGGDLAYTTVVTILTRLLAKDVVSRERQGRSFAWTPTADVARLAALKMRRLLDGERDREAVLASFVTALPPDDEQVLRTLLDAADTADGGTEG

SEQ ID NO: 14881 - protein, 115 aa, Streptomyces avermitilis
VETTYYDQGTAAERWERAQMFFDAKDYAVAARILDGLVDEVPEQTGPRLLLARSYYHSAQLGRAEAELRILVERDPVEHYARLMLGRTLQRQGRDDEADSQLRIASALAGDFEAR

SEQ ID NO: 14882 - protein, 154 aa, Streptomyces avermitilis
VTTTNPTTNLTTNPTVNGQVIGLAHYAGRGLLETVLARTGTTFEESVALHAAAAAGGTVARDRLVDRLTGALKTGETPARQAVDELIAAKLLDEPAPGQVSLTDSGRELFESIQAGGKEIATRLYAGIPAQDLETAGRVLTLVTERANAELAAL

SEQ ID NO: 14883 - protein, 175 aa, Streptomyces avermitilis
MSNTVSDTAPEGATPGFLVWRLSMKWRVAVDRAVAPLGLTHAQYSLVATLVGMHRTGLRPNQRQLADHTGLEALYVSKLARALESGGLVDRTRDPADPRAIQLSLTPRGHEVAQQAIKVVHRLLEQLLQPLGGLDSPRTTRFTHELRTLLDAPLDASIEPGTSTELGTPAAEEQS

SEQ ID NO: 14884 - protein, 321 aa, Streptomyces avermitilis
MSNLDREAVPTLCGGRGFVVAEPVRELLSPRKVKLGESTEVRRLLPNLGRRMVGAWCFVDHYGPDDIADEPGMQVPPHPHMGLQTVSWLHEGEVLHRDSTGSLQTIRPRELGLMTSGRAISHSEESPKSHARFLHGAQLWVALPDSHRHTDPRFEHHAELPVVTAPGLQATLILGEVDGATSPGTTFTPIVGADLSLASGADVRLPLEPDFEYAVLSMSGEAHVDGVPVLPGSMLYLGCGRSELPLRAESDAGLMLLGGEPFEEELVMWWNFIGRSNEDIAQARSDWMAGSRFGEVVGYDGAPLRAPELPPVPLKPRGRVR

SEQ ID NO: 14885 - protein, 587 aa, Streptomyces avermitilis
MTDDPTPTTPPGSLSALIGYARPHWRVLLLSLVLTLLASVSGLVQPKFAQAILDRLDDGAGVVAPVALLAVFLVAGALLTGLNAWLQQRTSERVVRQVRRGLVHRLIRLRVAELDRRAPGDLIARVTSDSTLLKSAATEGLIMTVNGVLTFAGALFMMAALDARLLGVTLLVLTLVGVVITVILPRIKAAVARSQSSVGAVGAVLDRTLGAARTVKANGAEGRETLAAEDAVDEAYAAGLVGARYSALVTMVGGAAIQTAFLVVLGVGGTFVANRTMSVSELIAFLLYVFFLASPVSQLVGGAAQLQQGLGAVGRIQEAAGLPVEDDIDAPPAAAPAHAAPPAVELTGVEFAYPGRAPALRGVGFTVPGGTQTALVGLSGAGKTTLFSLLQRFYEPTAGTIRIGGQDISALPRAEVRRRIAYVEQDSPVMAGSLRENLLYAAPSATPEELAEALAVTRLDALVARLPQGLDTPVGPRGVTLSGGERQRLAIARALLRRPQVLLLDEATAQLDARNEQALSELVARAAGRCTVLLIAHRLSTVTDADQIVVLEHGGVRAVGTHHSLVDDDDLYRELAATQLLAAEPPA

SEQ ID NO: 14886 - protein, 397 aa, Streptomyces avermitilis
MGRFLFVVPPLVGHVNPAVGTAAALAARGHDIAWAGHPELVRGLAGADAVVFPCALPEDGLSRPAGLKGPAAFQFLWESFLVPLADAMAPGVRAAIEAYDPDVVVCDQQAVAGALVAESLGRPWVTSATTSAELVDPLAGMPKVAAWLDGLLGELRRRITGGAGAADPRFSPHGVLAYTTRALLGPVELPDRVWLVGPSVAARPAGPDDFPWEWLEASALPTVLVSLGTANNDAGARFLNAAAEALGGIADRVRAVLVDPGGVVEHPVPDTVLVRRYVPQLALLERLDAVVCHAGHNTVCEALWHGVPLVVAPIRDDQPIVAAQVVDAGAGVRLRFGRADAARIGAAVEAVLDPAQGHRKAAEAVGESFRAAGGSESAADRLETLTAESAVPGVRGS

SEQ ID NO: 14887 - protein, 267 aa, Streptomyces avermitilis
VATLRVNGIDVHVQRMGGPGDVPRPVVVLIHGMLIDSLASYYFSLAPQLAEDGMDVVMYDLRGHGKTSRPPTGYRMEDFVRDLDALLDALAVNRPVHLVGNSFGGAIAYAMAAAHPERVASVIAIEAEPPGRAWAQSMYEGLVGEEGGLVVREVKEWLRENPGERNARPFRAAGRVLDETALAQEIPLSSLLDDDLSAIRCPVFAVFGGASKLAAQTGMLEASLARCRTVVLPGLGHSVLVEATKETYALVRDWLLGQEALALREAR

SEQ ID NO: 14888 - protein, 91 aa, Streptomyces avermitilis
VLADLSAILRTVLEEYGLDDSEITLDTSFHDDLELESIDLVTLSAQLREFYGERVNFAAFMADRGLEEIIALTVGDLVGYVVGSLAVAEVG

SEQ ID NO: 14889 - protein, 1523 aa, Streptomyces avermitilis
MTTPGRAEPIAIVGMSVLFPGAPDLATYWHNLVSGVDAITDVPPGRWDADEHYAPGAEPRADRVYCRRGGFVDELAEVDVTEFGIMPAAVPATEPDQLIALRVAAQALADAGGADRLPADRHRVGVVLGRGGYLTPGLVRLDQRVRTASQLVRTLGELLPDLGADRLEAVRQAFTDRLGPEAPESSIGLVPNLAASRLAGRLDLRGPAYTVDAACASSLIAVDHAVRELADGRCDVMLAGGVHHCHDITFWSVFSQLGALSPSERIRPFHKGADGVLIGEGTGVVVLKRLADAERAGDRIYAAITGTGVASDGRTTSLMAPDSGGQVRAVRQAWQAAGLDPAAPGSIGLLEAHGTATPAGDGAELATLAEVFGPPPKDATADEPGAVIGSVKSMIGHTMPAAGIAGLIKAALAVHHGVLPPTLHCDEPHPALARTRFAPISAARPWPADDRQPVRRAAVNAFGFGGINAHVVLEQVAVTRAAQVYEPERVLRLTAPTPEAMAALLDRDDSAILAAGLDERAPAPAADPVRLAVVGPTAKRLALARKAVAKGDGWRGRGDVWFVPSPLLGPGGGKLAFVFPGLEAEFVPNSEDVARHFGLPWSRAVADATVGDVGRQGTGVFELGRLLDAALRRLGVAPDALAGHSLGEWTAMAAAEIHAPDEVDAFLAGFDPDALSVPGLAFAAIGAPAEQVLTELAGRTDVVLSHDNAPNQSMICGPEPAVAALVDVFRSRALISQILPFRSGFHTPMLEPYLGPIRKAAETYTLHPAALPLWSATTVAPYPEEPAAIRDLFVRHLLEPVRFRPLVDTMYAAGFRAFVQLGAGHLGSLIGDTLHGRAHLVVAAHSPNRSGLPQLHRVASALWADGAASDLSPLLGRAAAAPARTGRRPVRLDLGGANVSLDAETRHRVSAALAPRRAPATPPPRDVGDHGDHGTLGEQGLLGAELSALLRDATALASDVVSAGRRRPGAAAATHHTRATPGSRTTAVPGPRTTEPPAPRPLDTTLHVSVDTMPYLLDHCFFKQPDRADPADSWPVVPGTTVIAHLMDFAERAAPGRRAVAVHDVRLHQWVTATPAVDIPVRIVPESPDRVTASLGSYAQAVVELAADQGRSAPATPWAFPAPAEPWTFPAAAEEKPELTAAELYSRRWMFHGPRFQGVRELTAVGERHVRGVLVCPPAPGALLDNVGQLLGYWIMSRLPVRTTVFPVGMKEIRFHGPHPAPGERLECLIRITSVTDATLEADMQLVYRGRVWAEFTGWQDRRFDSNPRIRAVDREPERHTLSRMQPGGWALVHEEWPDLATRELIMRNILAGEERERYAAHAPRGRRQWLLGRIAVKDAVRHLMWDGGAGPVFPAEVRVGNDPTGRPFVTGGYGRTLPALHVSIAHRGESAVAMARTEGPCGIDIEEVTDRPEGTLAVALAPPERELLRALAQAPRGAPERLWFTRFWAAKEAVAKARGTGLGGAPKQFEITAADGAVVSVRVAGEEYRVRHSSLTIPRPSGQPGKEYVVAWTAVNDSGERR

SEQ ID NO: 14890 - protein, 2365 aa, Streptomyces avermitilis
VPVSNFDTSGLFAVEDIVIAVSPLAVPSARVTAAAVRAGGLGVLDLTSGGRRAAAELALAEEWSAAGFGVRLSDNDAFPARDLPARVHTVLLTSDASCTPGDFPGHRVLVEVTGHEQALRALSAGAHGLIARGHEAGGPVGELGTFVLVQQLLADRELDLPVWACGGAGPHTAAAVVAGGGAGVVLDTQLALLTEAEAGLPAGTSVLLTGLDGSETTVENGRRVVRRRGAPDGAPAPEIGQDGFLAARFHERWGTVHAAVRGVRDAVLDALKSAGPALGPDSAGSRALGTELPVVQGPMTRVSDQAAFAAEVSGHGALPFIALALSGAEQTRTVLERTRDALGHAPWGVGVLGFADEEIKAAQLEVVREIRPSHAIIAGGRPAQAAALEAVGISTFLHVPSPGLLKQFLEAGARKFVFEGAECGGHVGPRGSFPLWEAQLCVLDDFLAGAKNGTAAELQLLFAGGVHDERSAAMVTALAAPLSARGAAVGVLMGTAYLFTEEAVSAGAVLPLFQRQVIAAERTDLLETAPGHATRCVRSPFTDEFAAVKEELAARDVPGREAWERLEQLNVGRLRLASKGLERAGGELHEVGEERQLAEGMFMAGEVAVLRSAITTVADLHASVTTGAAGFLAARLDALGIEEPAIAASPEPLDIAVVGMACMFPGAPDLAAFWANVLAGADAVTEVPATRWDADLYHDLNGAGEKTPSRWGGFLPEIPFEPLRYGIPPASLPAIEPVQLLALEAARRALEDSGYGSRSFDRARASVVFGAEAGSDLSNAMTLRSVLPAYLGTLPPALAEQLPRLTEDSFPGILANVIAGRIANRLDLGGANYTVDAACASSLTAVDVACKELSGGTSDLVLCGGADLHNGINDYLLFASAHALSPSGRSAPFDSAADGIALGEGVGCVVLKRLADAERDGDRIYAVIKGVGSASDGRALGLTAPRPEGQYNALTRAYRNAGVSPAEVGLVEAHGTGTVVGDRTELGSLTRVFEEAGAEPGRCALGSVKSQIGHTKCAAGLAGLIKASLALHTGVKPPTLHLAEPNPAWDAQSSPFAFHTEARPWPAAPAERVAGVSAFGFGGTNFHVVLRAYEDGPPPVTAAQQWPAELFTFRGADRAAAVRAATELLALVEADPGPHEPWRLRDFALGASRRAESAGTRGARTWIALVAESAEELAALLRRAVAGEHAPKEGLFTADDTETGEVALLFPGQGSQRPGMFAELFVAFPELQRHLRLDETTARVLFPPTAFDEASRKEQQERITDTTVAQPALGLTGLAAFQLLTRAGIRPAMAAGHSYGELAALAAAGALTPDALVRTSRGRAAAVLGAAGDGDPGTMAAVAAGEPEVAAALAAAGLDGSVVTANRNSPRQTVISGPTDDVLTAVERLRAQGLGAKRIPVACAFHSPLVAAAGEAFAKVLADVPVGATDFPVWSNRTAARYPESPEAIRAELAAQIGAPVRFADQIEAMYEAGARVFVEAGPGSVLTRLVGTVLGDRPHRTVALEKGRHTGLVGFLAALAQLAVAGVDVRTSWLFQGRGAVDAARAPRRVRAAWTVDGHLIRTADGAIPAAALHPAERVPEALVTHSTSAGPVAATGSEALISEFLRTSREMIAAQRDVMLGYLGADPAVRPPAPAAAPATYADAPVTYADAPVTVTAPPAAPAAVAAVAEPAGGSVLSVVLDVIGERTGYPVDMIEPDLDLEADLSVDSIKRAEIAGELAARLGLTTTADTDVEELAKARTAAAITALVERVTGPGAVPTPAPAAQAPAPAAGPAPTAESVLALVLDVIGERTGYPVDMIEPDLDLEADLSVDSIKRAEIAGELAARLGLTTTADTDVEELAKARTAASIAELVAGARGEAAEARAPEVTPAATPQSAPAGAEPLVVAPKRLVMREFDLAPAEPAPTGDRLTGRNFLLLGTGPVADALTARLTAHGAHALTADEPPADEKFDGLIHLVAPDAPPVLPDTFPVYRQVLAGNPRWVLASGTSAGLRGFFRSVAREYPDTVARVVEHAPGTAPEDIAAGLVAELTADDREPVVLRSPGTRRGLRMAEEGLGLLGGTGAGPAGDGAAEAAALGLDTDSVVLLVGGARGITARFAATLAAACRCRIELFGRTALPEGAEDPALAPAVTTGELRAALIAGGLRVPAEIERAIGRIQAEREVRGTLRRLAALGSEVRYRTVDALDGDAVRRAVKEIHAEHGRLDAVVYAAGVIEDKLIAEKSPRSYDRVFRTKADGARELLDAISELPDGPRFAVLFGSIAATLGNRGQSDYAAANDALETLGTRWADAGAGRRGLTVHWGPWAPTGDGNHGMVTPELMRHYAARGIRLIDPDEGTMSLLRELAWGPEGDTAVVYTASGW

SEQ ID NO: 14891 - protein, 492 aa, Streptomyces avermitilis
VRGRLEGGLAVFRGVPFAEPPVGDARFAAPRPVRAWDGTRDAFAFGPPPPQETGIQGRAALLDAPTGDDWLTVNVWTPDPDPGARRPVMVWIYGGAYKLGHSGSPGYDARRIARDGDVVVVTLNYRVGIEGFARVDGAPANRGLLDQVAALEWVRENITAFGGDPGRVTVFGESAGAGSIASLLAMPSASGLFRRAIAQSVPGTYFSDELAKDIAAAIAAEAGLRPTAADLSTVDPRQLPAAGEALAATMRQYEDRWGPVVHTLTPFSPVVDGEVLPTTPWQALAAGTARDVELIVGHNSEEFRLFVLLSGQLGKITDGEARAALRRFGPGPDAEQAYRTGFPDASPGELYERVMSDWLFHMPSLHLAEAQLTGGGRAHVYELTWPAPGNGGVLGACHGLDIPLLFGTFDADLGSLLFAGTEPSPEAEALSSRFRASWTAFARTGDPGWPTYDTERRLVQVLDAAPEVIPYPEETSRRLWERHTFPALPLIQ

SEQ ID NO: 14892 - protein, 204 aa, Streptomyces avermitilis
MDSEPGTGPARHYDPGRQLAQFTGRMLVVCPRCGGRALVVPRPGLPAPRYFSELLFQPRRLACGGCGTVADREPEMRGAGLVGAVPGGSEDPFFRRPLWLQTRCVGRILWAYNEEHVDELSAYVGARVRERGGVRPTRAMFARLPAWMKRADQRSEVLAGLETLRALAERSAPADRSDAAHERGDRPRPYGSLYFRGGPYEARS

SEQ ID NO: 14893 - protein, 613 aa, Streptomyces avermitilis
VASAFNSLTQRAHAELRDRGHTVAVELALPGGSLPEAVRRHAPQLILAPMLKTAIPREVWSAHTCLVVHPGPVGDRGPSSLDWAIHEGADQWGVTVLQADEEMDAGDVWASVPCLLPPVSKSDLYRGEVADAALAAVLLAVERFATGTFVPRKQADQAGQGGGQGGGEADQVGQSVARPEGAHPRTRPYLDQSVRRIDWAEDSTRTVVRKLRAADSQPGVLDVLLGDAWYLHGGHPESVLRGHPGELLATRAGAICRATKDGAVWIPELRPRRAPGQPPTFKLPAVQALGDRLPPLREHTVPLFPDARHPTWTDIRYREEGNAGFLSFSFPGGAMSTAQCRRLLDAYRDACTRPTSVLVLGGERDFFSNGIHLNVIEAADDPGAESWANINAIDDLVEAVLTTTDRLVVSAVAGNAAAGGVMLALAADEVWCRAGAVLNPHYRLMGLYGSEYWTYTLPRRVGPAAAERLMREALPVSAASARRTGLVDRVMECGPQEFAAEVGRLAARLAALPGTASRITAKKRELDRQESVIPPAAFREQELARMRRTFLDPDAPYHALRRAFVRKERPRRTPPHLSPAAVAPSGQIPSEAHVTGTAPHGVSPRPDGWYEES

SEQ ID NO: 14894 - protein, 362 aa, Streptomyces avermitilis
MTAATPDTVGAADAGGAPADETPTIHILWINAGLSCDGDSVALTAAMQPSIEEIVLGVLPGLPKIAVHWPLIDFECGPVGGSDTFIEWFFKGERGEIDPFVLVVEGSIPNESIKPEGYWCGFGDNPETGQPITTSEWIDRLAPKALAVVAIGTCATYGGIHAMAGNPTGAMGVPDYLGWDWKSQAGIPIVCVPGCPIQPDNFSETLTYLLYQAAGAAPMIPLDDKLRPTWLFGATVHEGCDRAGYYEQGQFALTYDSPKCLVKLGCWGPVVKCNVPKRGWMNGIGGCPNVGGICIACTMPGFPDKFMPFMDEPPGAKVSSSASGAYGAVVRKLRTLTARTVDKEPKWRHTGDRITTGYRPPW

SEQ ID NO: 14895 - protein, 594 aa, Streptomyces avermitilis
MASTTKAAGDGSGLVEMAWDPITRIVGSLGIHTKIDFKQKRVAECYSTSSVFRGYSVFMRGKDPRDAHFITSRICGICGDNHATCSVYAQNMAYGVKPPHLGEWIINLGESAEYMFDHNIFQENLVGVDYCEKMVKETNPGVLELAERTEAPHAGDHGYRTIADIMRSLNPIEGDFYREALQVSRYTREMFCLMEGRHVHPSTLYPGGVGTIASVQLFTDYLSRLMRYVEFMKRVVPLHDDLFDFFYEALPGYEEVGRRRVLLGCWGALNDPEYCDFTYANMTDWGRRMFVTPGIIVDGKLVTNDLTEINLGIRILLGSSYYEDWQGQEQFVTHDPLGNPVDPRHPWNQHTIPAPQKRNFDDKYSWVMSPRWFDGKDHLALDTGGGPIARLWSTALSGLVDTGYVKATGHSVVINLPRTMTKPETTFEWKIPRWSNALERNRARTYFQAYTAAVALHFAEKGLEEVRAGRTQTWEKFEVPDESIGVGFTEAVRGVLSHHMVIRDGKIANYHPYPPTPWNASTRDSFGTPGPYEDAVQNTPIFEENTPENFKGIDIMRAVRSFDPCLPCGVHMYVGGGKTVQKMHVPTGLSGLGG

SEQ ID NO: 14896 - protein, 196 aa, Streptomyces avermitilis
MSAVSATNRVTAEQTGRRIEDVLDRLAATGDPAAGAAAEELVRTLMEFYGSGLARILHLLSSAPGGPRPPGDPLAALLGDELVASLLVLHDLHPEDRDVRIARALDSVRDQALEVVAFDETSGTLRLRTRAGAGCGCAGTGTAAVQAAEDALACFAPEVTAVEMQPAAAPGEPALLQIGTGPNSGAVARPAAAKTA

SEQ ID NO: 14897 - protein, 222 aa, Streptomyces avermitilis
MSGTRTPARAPGPGPRAPGLRRFLTERPPRQERCELCAVAVAEADHRHLVDIEKRALVCACVSCALLMEQPGAAAGRFRAVPNRYLTDPDHRLDDGAWEALQIPVGVAFFFRNAALDRLVALYPSPAGATESELEPSAWTTVLGDSRLAVLLEPDVEALLLRRTDGRCECYLVPIDICYELVGRMRLLWQGFDGGAEARAALETFFEHVVRRAKPVREVGRP

SEQ ID NO: 14898 - protein, 230 aa, Streptomyces avermitilis
VTEFSFECTGVRADRYAAGPTLLFRLRVTAADNARVHALALRCQIRIEPARRGYESAEADGLADLFGERSRWGNTLQPVQFAQVSLMVPGFTGETEVDLVVPCTYDMDIAATRYLAALKGGEVPLLMLFSGTAFTGAAGFRVEPVPWDREAAFRMPVSAWREMVEQHFPGCGWIRLPRDTMDALLAYRSQRALPSWEATVRALLEEKGTTDPPRKDPYLALTRTTGGTDL

SEQ ID NO: 14899 - protein, 478 aa, Streptomyces avermitilis
VTVTAFAAQTEARFALARQVADAVLFEGYVLYPYRASAAKNRLRWQFGVLVPPEWGADCEEHDFQHTECLMEPKAGATLSVELRFLRARRRTVQRIRPDGGFDTVPELRLDDRVLVPWDEGAEERVEVVAAVDELLGDGVTVPFTRPALEEDEPVLDATGRPVGRLVRRCEEISGAVRLSARELDGPYRTLRLTAVVENTSTWTPPQGRSADRDAALPHSLVATHLLMALSAGSFLSMTDPPEWAKGAIATCRNLHTWPVLAGEPGRADLVLSSPIILEDHPAIAPESPGALYDATEIDEILALRTAALTDEEKREARGTDERAAAVIDLADSMPAEVLERLHGAVRSLREVTAPPSAAGPAAGGFPDEYGVRRPDTPWWDPASEAGFDPQHDRVVVDGRSLGAGSRVLLRPGLRRTDAQDLFLQGRSAQVEAVLHDVDGGVHLAVTVEGDPGADIRREQGRFLYFQPDEVTPLEDDA

SEQ ID NO: 14900 - protein, 183 aa, Streptomyces avermitilis
MSGPREVPPRTLVAGIGNIFLGDDGFGVETARRLAERQLPAHIEVVDIGVRGVHLAYQLLDGYDTLILVDATARGEAPGTLYLIEHDSPGGGEPEGAPVLDGHRMTPDTVLALLDTLCAGTGGQPPRRTLIVGCEPASVEEGIGLSPPVSDAVPEAVRLIDELLRADEPGESAPRATADGAAK

SEQ ID NO: 14901 - protein, 131 aa, Streptomyces avermitilis
MHEMSVALAVIDQVEQAAQQAGDVTAVRSVRLQVGELAGVVPDSLSFCFELACAGTVLEGADLVTEEVPGRARCAPCAREWSVGMPPRLSCPECGGARVDLLSGRELQIVSVHWEDGRTHAQTREPISEER

SEQ ID NO: 14902 - protein, 275 aa, Streptomyces avermitilis
MCRVVDLHQAVLAKNDASAHTLRAELAARGTAVVNLLSSPGSGKTALLERELLLARERSVPVAALTADLATENDARRLARSGVPVKQVLTDGLCHLEAGMLSRHLDGWLPDNTRLLFVENVGNLVCPASYDLGETLRVVLASVTEGEDKPLKYPTAFGLAHLVVVTKTDIAEAVDFDEAAFRAHVEQVNPGVEVLLTSARRGRAIGALLDRALAAADGAPLHRPVMARRTDVLGPAGPAHDHGHGDGHEHAHTGPAHDHGHAHPDGTGAMAQTRS

SEQ ID NO: 14903 - protein, 788 aa, Streptomyces avermitilis
MPRRRRVTVRGVVQGVGFRPYLYGLATELALAGHVTNTPEGVVVEVEGTPSAVDRFCDRIAAQAPPLARVESVHHQDLPATGGGAFTILASRADGPVRTLVSPDMATCADCLDELADSADRRYRHPFVNCTHCGPRFTIVTGVPYDRAHTTMAGFAMCPDCAREYADPADRRFHAQPVACPACGPSLRLLVGRQPLDGRPQSVAGADPVTEARTLLARGAILAVKGLGGYHLACDASDPAAVALLRRRKARGDKPFAVMARSADDIEHLVRLGPEERSLLEGGTRPVVLLRRRTDPSYPAGAPRPAEAVAPGSPDLGVMLPYTPLHHLLLGLPGDAEGPRLLVMTSGNVAGEPIVTDDAEALERLAPLADAWLTHDRPIQVPCDDSVVRVSDGKPLMIRRARGYAPLPVPLPLSVRPALAVGGDLKNAFCLGEDRRAWLSAHIGDMDDLGTQRAFGRATAQLESVTGVRPSMLVADRHPGYRSARWADRNAAGRPVVRVQHHHAHVAAAMAEHGLEGTRPVIGVAFDGTGHGDDGAVWGGEILLADYDGFTRFGHLRYVPLPGGDAAVRRPYRMALAHLRAAGIGWSDDLACVAACPPDERRVLERQLERDLNCVPTSSMGRLFDAVSSLAGVCHRAGYEAQAAVELEAAALNAPVEDVTAYAFALRASEPDGGGAVRADPAPVLAAIVGDLRAGTEPALVAARFHRAVTGLVHRICVRARERHGLDTVALTGGVFANTLLSSACATALREDGFTVLRHHLVPPGDGGLALGQLMVAARDTARTATTG

SEQ ID NO: 14904 - protein, 106 aa, Streptomyces avermitilis
MCLAVPGRVLDIEERDGTRMATVDFGGVVKEVCLEYLPDLQVGEYAIVHVGFALQRLDEESAKQTLELFAQLGMLQEEFGDPWEQAAEAGGATPPVGDAVIEEVRK

SEQ ID NO: 14905 - protein, 374 aa, Streptomyces avermitilis
VKYIDEFQDPELARRLLDDIHSTVTRPWALMEVCGGQTHTIIRHGIDQLLPEQVELIHGPGCPVCVTPLEVIDKALEIASRPEVIFCSFGDMLRVPGTGRDLFQVRSEGGDVRVVYSPLDALRIARQNPDREVVFFGIGFETTAPPNAMTVHQARRLGIPNFSLLVSHVRVPPAIEAIMSAPNCRVQAFLAAGHVCSVMGVGEYPELAERFRVPIVVTGFEPLDILEGVRRTVLQLERGEHTVDNAYARAVRPEGNPAAQAMLEDVFEVTDRAWRGIGVIPDSGWRLSPKYRDHDAEYRFSVDGIQTREPAECRSGEVLQGMLKPHECEAFGTVCTPRTPLGATMVSSEGACAAYYLYRRLDITTAAREASPVV

SEQ ID NO: 14906 - protein, 358 aa, Streptomyces avermitilis
LSETTDLRGPATLEAWTCPAPLRDRPRVVMGHGGGGALSAELVQHVFAPAFGGEVLAQMGDAAALSLGGVRLAFSTDSFVVRPLFFPGGSIGDLAVNGTVNDLAMSGARAAYLSCGFILEEGVEVEVVARVAEALGAAARTAGVEVATGDTKVVEAGHGDGIFINTAGIGLIPAGVDLRPQRVVPGDVVIVSGAIGVHGVAIMSVREGLEFGVEIESDCAALGGLVDAMLAVTPDLHVLRDPTRGGLAAALNEIAAASGAGVVVRERDVPVPPAVANACAILGLDPLYVANEGKLVAFVPREHADAVLGAMRAHPLGADARIIGEAVEAHPGMVVARTGLGGTRVVDLPIGEQLPRIC

SEQ ID NO: 14907 - protein, 128 aa, Streptomyces avermitilis
MPKKSHSSEPSHGEGPSRHRGTGQHGWSPDVDETRQQDNPSAHRSFHPAEHAGDRGRGRTKSAEETKSVPGETAKSGSARGEEYAEESEEGRQDTGRRGRSQRPSGSKDASSYTGVDPKDPPSRHRPG

SEQ ID NO: 14908 - protein, 106 aa, Streptomyces avermitilis
MFAAFVGGLVIVGALVWAVRFGTKVRRREPGPPRREEQPTLPESGPVHETRQRREPDEVPRAANESERLTPHDLHASGSKPSENQQRPRWDEGAGGSFGSGGPGRS

SEQ ID NO: 14909 - protein, 175 aa, Streptomyces avermitilis
MGSQNGDDLMGDEVYQPEGPEDREDEGILDPEDTLGDRGSDPYDEGWSPPERPLGVEHEGTTAREQREGESLDHRLAEERPDPALEEFGDPADADDPGDLRDGEGEPLDDEVGDEPAGRLVALDEGVREEAEKDLLAEDDAEKDLLAEDVGIDGGAASAEEAAVHRVPDEDDYPL

SEQ ID NO: 14910 - protein, 212 aa, Streptomyces avermitilis
VAPVRRCSMDSHTEPGVAAPDPHRSEVTLRVNGKLYTLTVDHRSVLLDVLREDLDLTGAKKGCDHGQCGACTVLVDGRRVNSCLLPAVAQDGRDITTIEGLAGTGEVVGEEGLAGGDGLVEGGGAGLHPLQRAFLERDAFQCGYCTPGQICSALGALAEAEAGHPSRVTDPARPSGQPVPLGRDEIRERLSGNLCRCGAYTHIVEAVEDVIR

SEQ ID NO: 14911 - protein, 330 aa, Streptomyces avermitilis
MKPFAYVRAGSVQEAADAHASRPGARYLAGGTNLVDLMKLGVEQPAALIDVSRLPLDTVEELADGSLRIGATVRNSDLAAHPLVRDRHPVLSQALLAGASGQLRNVATTGGNLLQRTRCPYFQDVTKPCNKRAPGTGCGARDGVHRDHAVLGHSEHCIATNPSDMAVALAALDARVELYGADGERSVPAAEFHRLPGDRPERDTELRPGELITGVVLPAASAGLPSLYRKARDRASYAFALASVAAVLQVRDGVVEHVGITFGGLAHRPWRARRAEEALLGAAPTRAAFEHAVDLELDAARPLRDNAYKVDLARNLAVDVLARLTPPGGA

SEQ ID NO: 14912 - protein, 706 aa, Streptomyces avermitilis
MADAPTALGAPVERREGRDKVTGTARYAAEYPLPGRAHGWPVPAAIGRGAVRAIDARAALDLPGVLAVLTHENAPRLAEPEDPTLAVLQNPRVPHRGWFVALVVAETLEEARAGAAAVRVDYAAEDHDVTLTETHPEAYTPDTANGGYPAHREHGDPEWAFTSAPVRVDVGYRLPPLHNHPMEPHAATASWQGGRLVVHDSSQGATTVRTVLAGLFELPEDRVTVVAEHVGGGFGCKGTPRPHVVLAAMAARETGRPVTVALPRRFLPAVVGHRAPTLHRVRLGAAADGTLAAVLHEVTTHTSRIKEFVEQAATPARVMYAAANILTSHRVVPLDVPSPSWMRAPGEAPGMFALESAMDELAVELGMDPVELRIANEPDAEPDSGRPFSSRHLVECLREGARRFDWAARPAAPRARTAGPLLMGTGVAAATYPVLVSPATATAQALPGGDFVVRINATDIGTGARTVMAQIAAHALGVPVDRVRSEVGSSDLPSAPLAGGSSGTASWGWAVHEACTRLRARLAEGTGPVPDQGIVTNADTAGHADAESAYARHAFGAHFAEVAVDTVTGEVRVSRLLGVYAAGRILNARTARSQFIGGMTMGLGMALTEGSTMDPAFGDFTESDLAAYHVPAHADVRDIEAYWVDEDDPHLNPMGSKGIGEIGIVGTAAAIGNAVHHATGVRFRELPLTPDRVLGGLATPGSVSGG

SEQ ID NO: 14913 - protein, 58 aa, Streptomyces avermitilis
VTAQTNRKSVVSRPRTGWAKARHLRGDGVRTCVSARDDGERSCSPEQGAEENIVRGED

SEQ ID NO: 14914 - protein, 76 aa, Streptomyces avermitilis
MDLRISTKSQTAVLAGGPADGLRMRVADRPSVLQVTYPCPLDAPAEGVRVEALYIYRRALGSQDEPLTYGYDPASP

SEQ ID NO: 14915 - protein, 191 aa, Streptomyces avermitilis
VGVTLAKGGNVSLSKEAPGLTAVTVGLGWDVRTTTGAAYDLDASALLCSGSGRVVSDLHFVFYNNLTSPDGSVQHTGDNLTGEGEGDDESINVELAQVPAEVTKIVFPVSIHEAQSRGQSFGQVSNAFIRVVNRANNVELARYDLSEDASTETAMVFGELYRHGGEWKFRAVGQGYASGLAGIASDYGVNV

SEQ ID NO: 14916 - protein, 225 aa, Streptomyces avermitilis
VSGFPGVLRMAKRKVRRQARRLLGEDPVALVWCEVHRRIPRPPEEVHRAAGKGRLKPGHHWLLYVGAVLFFFVVVPMMLIDRLGGRLDRAQAPPRRQGPTPGGGRDRDPGREAANGVFDGDWSLTAGQLLLRWYGRSPNPKRLVLLTRDRVCLAASPRRRLSPTRAGDFRIVAEFPAREVSVEGEAGQPRGFATFRLCFSDGSWLEVGRLGEPEDADHFLRTIDD

SEQ ID NO: 14917 - protein, 413 aa, Streptomyces avermitilis
VHSAVLLIEFGAIILSLGLLGRAAARLRFSPIPLYLLAGLAFGEGGLLPLGASEEFVATGAEIGVILLLLMLGLEYTAGDLVSNLKAHYPAGLVDFTCNALPGAAAALLLGWGPVAAVVLAGVTWISSSGVIAKVLGDLGRVGNRETPVILSILVLEDLAMAVYLPIVTALVAGAGLAAGSVTLAVALAAAGLVLFVALRFGRLISRFVSSDDPEKLLLVVLGLTILVAGIAQQLQVSAAVGAFLVGIALSGEVAEGAHTLLSPLRDLFAAVFFVFFGLHTDPASIPPVLLPALALAAVTAVTKIATGYWAARRAGISVKGRWRAGGALVARGEFSIVIAGLAVTAGIEPSLGPLATAYVLLLVVLGPLTARYTEPLIARLNARSGRVRPEHRDAPVPTEPEGDTRAQTTVGD

SEQ ID NO: 14918 - protein, 141 aa, Streptomyces avermitilis
MTREHRHLSVVAHRDGARTVSVYRADDPDSCAQSLRLTSSEAGSLIDALKPSHHSASLLYTTDLGLVAERVEVAAASRWNGRVLGETRMRTETGASVVAVLRRAEAIPSPAPDFRLTGGDTLIVIGTREGVDAAAAILGRE

SEQ ID NO: 14919 - protein, 388 aa, Streptomyces avermitilis
MGVMTDGRGRRRAERLVGAAAWPRSGKEGTPREHRGTPTGGDGKRSVSLFRRIFLLNAVGLTVATALLLGPVTVSTPVLPGEALVVLAGLAVMLVVNAVVLWIGLAPLQRLGRAMATADLLHPGARAVVTGPAEMADLISTYNTMLDRLETERATSAARALSAQERERHRVSQELHDEVGQTLTAVLLQLRRVADRAPEGLRAEVRQAQEATRGSLDEIRRIARRLRPGVLEELGLLSALRALTTEFTAHGLSVRHHFDGELPQLSEETELVVYRVAQEGLTNTARHAGADRAELRLHRVADGVELLVRDNGTGAGRAPEGAGIRGMRERALLIGAGLAVEPGPDRGTDIRLRITSTTSTTSTTSVMNATSTGDRSGPRTGTPPHGAR

SEQ ID NO: 14920 - protein, 223 aa, Streptomyces avermitilis
MSLPPPAQRPTRVLLADDHALVRRGVRLILDGEPGLSVVAEAGDGAEAVALARTTDVDLAVLDVAMPRMTGLQAARELSRRLPELRILILTMYDNEQYFFEALKAGACGYVLKSVADRDLVEACRAAMRDEPFLYPGAETALVRTYLDRVHRGEGLPERTITEREEEILKLVAEGHTSKEIGELLFISAKTVERHRANLLQKLGLRDRLELTRYAIRAGLVEP

SEQ ID NO: 14921 - protein, 163 aa, Streptomyces avermitilis
MKTAAPCYYHLDVEVSPERIGHVRRILAAHLRYWNLETLVEPVCHCAEVLLHTIDEHAADKNTTLEMWWNGQHLITAVQDSDQDVRPHYAPRGCLTQIAAMSDGWGCCATNTGGKIIWFSRRALAADHAPLVPTAPWPTLREARPVPRALPEPLPRVPEPAVS

SEQ ID NO: 14922 - protein, 108 aa, Streptomyces avermitilis
VTGAMLLPARTEVARYLQRYRAWERLMLAAPDNLVVRGNFENTGYTLCVLMGERCAREAADAAEHFLRTGSAAAPHERRTRTGSPARTASGSPARTATGSPARTASNA

SEQ ID NO: 14923 - protein, 665 aa, Streptomyces avermitilis
MNRNPVIGRIPILDVHPLVEGGRRPAKAVEGETFQVTATVFREGHDAVAANVVLTDPQGRSGPWTPMRELDPGADRWGADVTPWTVGNWTYLVEAWSDPVTTWRHHAGIKIPAGIDTELVLAEGADLFERAAYGVPEGKGRKILLAAADALRDTERPATSRLAAALTVEADTVLARHPLRELLTSSEPLPLLVERERALFGSWYEFFPRSESGRVDPVHGTFATAAERLPAIAGMGFDVVYLPPIHPIGTAFRKGPNNTLSASRRDVGSPWAIGSPEGGHDAVHPELGTIEDFDAFVRRAAALGLEIALDFALQCSPDHPWVEKHPEWFHHRPDGTIAYAENPPKKYQDIYPIAFDRDMPGLIAETVRVLRFWMGHGVRIFRVDNPHTKPVVFWERVIGEVGRTDPDVIFLAEAFTRPAMMRALAAVGFQQSYTYFTWRNSKRELTEYLTELSGEAAAVMRPNFFVNTPDILHEFLQRGGRPAFEVRAVLAATLSPSWGVYSGYELCENTPVRAGSEEYLDSEKYQLRPRDWAAAEREGRSIAPLITSLNRIRREHSALRRLRNVHFHHADNDAVIAYSKRSGRDTVVVVANLDPHHTQEATVSLDMPQLGLDWAAFVPVRDELTGESYHWGRANYVRLEPGHRPAHVLTVLRPSSPQIGGSPTR

SEQ ID NO: 14924 - protein, 583 aa, Streptomyces avermitilis
MIVNEPVPDTFEDTPAKDRDPEWFKRAVFYEVLVRSFQDSNGDGVGDLKGLTAKLDYLQWLGVDCLWLPPFFKSPLRDGGYDVSDYTAVLPEFGDLADFVEFVDAAHQRGMRVIIDFVMNHTSDLHPWFQESRSNPDGPYGDYYVWADDDKQYQDARIIFVDTEASNWTYDPVRKQYYWHRFFSHQPDLNYESAAVQEEILAALRFWLDLGIDGFRLDAVPYLYNEEGTNCENLPATHEFLKRVRKEIDTHYPDTVLLAEANQWPEDVVDYFGDFPSGGDECHMAFHFPVMPRIFMAVRRESRYPVSEILAKTPAIPSSCQWGIFLRNHDELTLEMVTDEERDYMWAEYAKDPRMRANIGIRRRLAPLLDNDRNQIELFTALLLSLPGSPILYYGDEIGMGDNIWLGDRDAVRTPMQWTPDRNAGFSSCDPGRLYLPTIMDPVYGYQVTNVEASMSSPSSLLHWTRRMIEIRKQNPAFGLGSYTELQSSNPAVLAFLREAPSTGGNGDDLVLCVHNFSRFAQPTELDLRAFSGRHPVELIGGVRFPAIGELPYLLTLAGHGFYWFRLRKDVTQVTKVSLFVSS

SEQ ID NO: 14925 - protein, 464 aa, Streptomyces avermitilis
MPKTAPLRPSRLSPGPLLTSLAGLLREWLPTQRWFAGKGRPVMDLALLSVTELHPGCLHLLLQAGHAEQAAGSGSDEHSVHDCYQLFLGVGETVPAQPARAVIGRADEGPLAGLMVYDALQDRRSTALLLERLRTPGVVGPLRFERDLGVTLPAGLEPRLLDAEQSNSSLVYGDRYILKVFRRVQPGINPDLEVPWALARQGCDRVPAPVAWIRTSLPWGATLGVLQPFLPDAADGWTRALQALDSGRDFIDEAHELGRATAEVHLALAAAFPLEFQQRHHNGRLAAGMTRRLEAVARSVPELLPHAPALRSAFDALAAVDTPRPAQRIHGDLHLGQVLRTGRRWHLIDFEGEPARPLPERRRAQSPVRDVAGMLRSFDYAAHARHPWRPDWARRCRDAYCGGYADEAGWDPREEPELLRAYETDRAVYEVLYEARHRPEWLPVPMAAIARLADRQPLGARRPQ

SEQ ID NO: 14926 - protein, 141 aa, Streptomyces avermitilis
VNAHAVPPISTPAPPSGARPAPVAPGDRDRLLSGTHHDPHSVLGAHPVPGGVAFRVLRPYALSVTVVTDDLRTELHDDGAGFFTGLLPLRAVPDYRLHVAYEGTVHETETPTASCPRSASWTCTSSTRAGTRSCGRRSAPG

SEQ ID NO: 14927 - protein, 592 aa, Streptomyces avermitilis
VMTHAGVLGTRFTVWAPNARGVRVCGNFCRWDGAAFPMRSLGSSGVWELFVPGIGEGELYKFEITRPDGTHTVRADPMARRAEVPPATASIVTESSYAWADGAWMAARGERPVHESPFSVYEVHLPSWRPGLTYRQLAEQLPAYVADLGFTHVELLPVAEHPFGGSWGYQVTGFYAPTARLGTPDDFKYLVDALHRAGVGVLMDWVPAHFPRDDWALAEFDGRPLYEPEDPQRAAHPDWGTLEFDYGRKEVRNFLVANAVYWCEEFHIDGLRVDAVASMLYLDYSREEGQWSPNEFGGRDNPDAVAFLQEMNATLYRRVPGVITIAEESTAWDGVTRATHDNGLGFGLKWNMGWMHDSLGYVQHEPVHRKYHHHEMTFSMVYAYSENYVLPISHDEVVHGKQALVSKMPGDWWQRRANHRAYLGFMWAHPGKQLLFMGQEFAQGAEWSPEHGPEWWLLDDEYHSAGDHRGMRDLVRDLNTLYRAEPALWERDTDPSGFAWVVGDAAEDNVFAFLRHAADGTPLLAVSNFSPVVRHDYRLGVPDDIPAWQEALNTDAARYGGSDLICPDPVKPESGEIRLTLPPLATVWLRPA

SEQ ID NO: 14928 - protein, 264 aa, Streptomyces avermitilis
MRTTTGTKQHPHDDAPDTAADFERLFGLPDGRERQALRDEIVRAWLPMAERIAWRYRGRGESTEDLCQVAAVGLVKAVDRYDPARGNAFESYAVPTITGEIKRHFRDHMWVLHVPRRVQDLRNRVRVAAKELSQTVPGHEPTVTEIAEHAQLSEDDVQIGLEAMDTFTALSLDAELPGSDDGYALSDALGGPDSGYDLVVDREAVKPSLRALPERERTILYLRYFRGMTQSSIAEQLGISQMHVSRLISGCCARMREETLADVA

SEQ ID NO: 14929 - protein, 129 aa, Streptomyces avermitilis
VTPAEGTMISKPRSGPDEPHATAAEPDRIVELEEEIGQLKEAVTSHAVVDQAIGVLVALGRVTPDQGWAVLREVSQHTNIKLRCVAEMILIWGHSGDDLPPDVRATLEDTLDRCGPTQLPGAPPVPPAD

SEQ ID NO: 14930 - protein, 203 aa, Streptomyces avermitilis
LTSESIYTTLEVEAHMGVGDAMAGRSLVVEWTGARYADGPTVEVPVWIDAPPQRVWELVSDIALMPRTSPELQSVEWLDGRRGPALGARFVGRSSHEALGEWATTSHVVRYEPPRVFAWAVEDPELPSSVWRFELEERDGGTLLREWMQLGPGRSGLSYAIDRMPDKEQKIVFVRMREFETNMGATLDVIKKLAEGGRDEVEA

SEQ ID NO: 14931 - protein, 349 aa, Streptomyces avermitilis
VMRTSTTIEASGGTWRETVDYVTEAEKLGLDICWVAEAWGSEAPSPLGYLAARTQRMLLGSGIIQLGTRTPMAIARAAITLSNISEGRFLLGLGPSGPQVIEGLHGVPFARPLARMRETVEILRCAATGEKVSYAGREFTLPLPGGEARPMRLSMRAEHDIPVYLATLSPKMLELTGRIADGWLGTSFVPEGAKEAYFDHLDKGLAAAGRTRADLDICQGAEVAFAADEEALRVMIAGRKKELAFSLGGMGSAGTNFYNQAYSRQGWAAIAAEVGERWQAGDRAAAAALITDEMVLATTLIGTEDMVRERLRVWRNAGVDTVRLYPAGDTLDARLTTLGRALDLVRATD

SEQ ID NO: 14932 - protein, 436 aa, Streptomyces avermitilis
VFALAVRSVRQRPGRFLATLLSAFLGAAIIMTFNSMYDTAGQRGVDPVSAESLTTSASVVGGYGTLLVFFAVASTLTVNVRQRGAEIDLLRCSRATPAQIKRMVVGESVVVALVGAVLAIGPAMLGGRALLSVFQDSGQVAGSVDHSFGPVALMSGIDITVLAAAGAAFLAVRRATRRREPRAGARKFFAYAALAAGGAAVCSTFAFSAKDAALMAPPAYGAILISVGLALFSPRLLKGLLDRLSPAGASGWLAVRTLRERTAEASAVLMPLVLFTAVATATLCMQAAENDAIKASGVPKSIDAKNLETLNLVVVGIIVVFACVMLINSLYAATTYRGREFGQQRLAGATPGQVLGTVGVESVILTVTGVLLGSVAGLAGIVPFTVVRTDSPWPHQGLGIWLTIASVAAAVTLGTSLATARRTLRTPAVESVTLAA

SEQ ID NO: 14933 - protein, 261 aa, Streptomyces avermitilis
VMTMFRRKDTGSAPSAEALRLVKVTRTYGSDDSAVTALDGVSLSLARGTFTAVMGPSGSGKSTLLQCAAGLDRPDSGIVRVDGTELTGGSEAALTRFRRGRVGFVFQQYNLLPTLTVAQNTILPLKLAGRRVDRQRARETLTAVGLGDRLGHRPDQLSGGQRQRVAIARALVTEPRVIFADEPTGALDTRSAREVLRLLQQAVRVHGRTVVMVTHDPVAASYADSVVFLADGRLAGELHGPTVDAVAERLAHLGDDVTAGV

SEQ ID NO: 14934 - protein, 250 aa, Streptomyces avermitilis
VYPATPRTGHQNEPTPAPARCNGRVTAPPDDCLARNEWICGEYLSSRRQILLDAVVQHLQLTAVSVLVGLVIALPLAVLARRWGWAAGPVLAVTTILYTIPSLAMFSLLLPVYGLSAALVVAGLVLYSLTLLVRNILAGLRAVPEETRQAARGMGYGPVRLLLTVELPLALPAAMAGLRIATVSAVSLVTVGAIVGFGGLGNLIYAGMNTYFKAQVLTASVLCVVIAVAADLLLLGVQWLITPWTRAQRG

SEQ ID NO: 14935 - protein, 223 aa, Streptomyces avermitilis
MNTLTGAWDWLTDPANWAGADGIWHRLVQHLVLTVVCLVISCLIALPVALVLGHLGKGGALAVNISNVGRAVPTFAVLVLLLLTPLGKWGEGPTVVALVLFAVPPLLTNAYVGMREVDRSVVRAARGMGMTGRQMLFRVELPLSLPLVMNGVRIAAVQLVATATIAALAGGGGLGRIITAGFNLASTPQVVAGAVLVAVFALIVEGVFEAAERLAPYWARGPR

SEQ ID NO: 14936 - protein, 311 aa, Streptomyces avermitilis
VTWRPALAGLLLLTGCTTGPSLENRDEVTAPPGDSRHLTIGSAGFTESDLLAQMYALLLERAGYKTSMLTVANRELYEPALESGQIDVVPEYAATFADWLNAKTHGTDAPAVGSPDQNATMSALRKLAAPRGLTVLDAGRAVDQNAFAVTKAYARQHHLKTLSDLGGSGLKVRLAAGDECVQRPYCEPGLKKTYGIDITAVDPKGVGTTQAKRAVQSGQDQMVLTTTTDATLDEFGLVLLADDRHLQNADSIVPVVNRAQAGSERVTGALDRLNDVLTTGDLAAMNQQVDSWRRLPKDVARSYLTEKGLLK

SEQ ID NO: 14937 - protein, 384 aa, Streptomyces avermitilis
MIRFEQVTKRYPDGTTAVDGLSFEVAEGELVTLVGPSGCGKTTTMMMVNRLIEPTSGRIFVNGEDIAAVDPVRLRRRIGYVIQQVGLFPHRTILDNTATVPSLIGWKKPKARARAAELLGLVGLDPKTYGARYPDQLSGGQRQRVGVARALAADPPVLLMDEPFGAVDPVVREQLQDEFLRMQEAVRKTVLLVTHDIEEAVRLGDRIAVYGQGRIEQFDTPGAVLGTPATPYVAEFVGADRGLKRLSVTEIEADDLEQPPIARLDEAAERTAARLNAEGARWAVVLDAGGDLHGWVGVDELGAGGAVRDLAHRMNSWVPVGAPLKEAFGVMLQHDAGWVAVLDGARFLGVLTPAKLHEALRRSVDADALGVPRGQVSFDSVADA

SEQ ID NO: 14938 - protein, 231 aa, Streptomyces avermitilis
VAAYARWKGREVSSRDVILGRVRRALADVSDDTPYEQAVDRSYLREHGARSVAETVDLLAENLADYRAIVHRCTADGLPAVIAGLLADRGSTSVLVPPGLDGEWLAATGVPRVPDRADSTAHELDRVDSVVTACTVAIAETGTLVLDGGPEQGRRRVTLVPDHHICVVRVPDQVVSSVPQALLRLDPTRPLTWISGPSATSDIELDRVEGVHGPRILEVVLVSGRPGAVTA

SEQ ID NO: 14939 - protein, 491 aa, Streptomyces avermitilis
MSGTFVGMPAFPEAAHDAVNNRTLRGNLRHATHTIRAKRAKAVAEVSDWAALREAGKQIKDHTLRHLDRYLVQLEESVTAAGGTVHWAADADEANRIVTRLVKETGETEVVKVKSMATQEIALNEALEAEGIRAYETDLAELIVQLGKDRPSHILVPAIHRNRGEIRDIFRSEMGAWGRPAPEGLTDTPAELADAARLHLREKFLRAKVGVSGANFMVAETGTLVVVESEGNGRMCLTLPETLISVVGIEKIVPTWQDLEVFLQTLPRSSTAERMNPYTSTWTGTTDGDGPRTFHLVLLDNGRTDTLADEVGRQALRCIRCSACLNVCPVYERAGGHAYGSVYPGPIGAILSPQLRGTASEIDASLPYASSLCGACYEVCPVAIDIPEVLVHLRERIVEGGPVTREGAKVVLKPAKGHAAERAAMRGARWAFSHPGALRAGQRLASRTRRFHPRTLPGPGKAWSASRDLPEVPAEPFRDWWQRTHGGKDAK

SEQ ID NO: 14940 - protein, 251 aa, Streptomyces avermitilis
MRVALFLTCVNDTLYPDTGRAVLKLLTRLGVDVDFPMDQTCCGQAHYNTGYRHQAEPLARHFSDVFGEYEAIVTPSGSCGAMVRELYPRMGERARAEGRGDTLAKTLAPVVPKTYELTEFLVDVLGVTDVGAYYPHTVTYHPTCHGLRSLGLGDRPRRLLQAVKGLELRELPGADECCGFGGTFAVKNPDVSAAMGTDKVRSAESTGAEVLCAADNSCLMHIGGTMARLSTAMRPVHIAEILASTEEEPSA

SEQ ID NO: 14941 - protein, 481 aa, Streptomyces avermitilis
VTAVHTYAAVDLGASSGRVMVGRVGPGSLDLTEAHRFPNRPVRVPEGLRWDILALYAGVLDGLRAAGRVDSVGIDSWAVDHGLLDADGALLGNPVHYRDARTEGIAEQVWANVPAAELYAATGLQYAPFNTLYQLTAARSSAQLAHAERLLLVPDLLTYWLTGEAGTELTNASTTQLIDPRTRDWSYDIARRLGIDLGLFAPLRRPGDPAGVLRPEVLAETGLTGPVPVTTVGSHDTASAVAAVPAVRERFAYICTGTWSLAGLELDAPVLTEASRLANFTNELGLDDTVRYLRNIMGLWLLQECVREWGDPDLPQLLSAAAEQPPLRSVVDAGDAAFLAPGRMPQRIADACRASDQPVPDSPAGITRCILDSLALAHRRAVAEAQSLADHPVDVVHIVGGGTRNALLCQLTADACGLPVVAGPAEAAALGNVLVQARAGGLVGDRAAMRELVARTQPLARYEPRGDPARWQAAEARLTGR

SEQ ID NO: 14942 - protein, 679 aa, Streptomyces avermitilis
MAPHPEAAALLARSHRLGADPRNTNYAGGNASAKGTATDPVTGGDVELMWVKGSGGDLGTLTEAGLAVLRLDRLHALKGVYPGVEREDEMVAAFDYCLHGKGGAAPSIDTAMHGLVDAAHVDHLHPDSGIALACAADGEKLTAECFGDSVAWVPWRRPGFQLGLDIAAVKEANPQTIGCVLGGHGITAWGATAEECERNSLHIIRTAEAFLAERGKAEPFGPVIEGYAALGAPERRERAAALAPYVRAVAAQDRPQVGHFTDSEVVLDFLASAGHPRLAALGTSCPDHFLRTKVRPLVLDLPPTADLDTAVARLTELHAEYRAEYAAYYQRHALPDSPAMRGADPAIVLVPGVGMFSFGKDKQTARVAGEFYVNAINVMRGAEAVSTYAPIEESEKFRIEYWALEEAKLQRLPKPKPLATRVALVTGAGSGIGKAIAERLVAEGACVVVADLNAENAADVASALGGPDKAVAVTVDVTSEEQIAEAFKAAVLAFGGVDLVVNNAGISISKPLLETTAKDWDLQHDIMARGSFLVSREAARVMTQQKLGGDIVYIASKNAVFAGPDNIAYSATKADQAHQVRLLAAELGEHGIRVNGVNPDGVVRGSGIFAGGWGAQRAATYGIEEEKLGEFYAQRTILKREVLPEHVANAVFALTGGDLTHTTGLHVPVDAGVAAAFLR

SEQ ID NO: 14943 - protein, 386 aa, Streptomyces avermitilis
VTELAAVKAALKTQAVETPSWAYGNSGTRFKVFAQPGVPRTPQEKLDDAAQVHAYTGAAPTVALHIPWDRVEDYAKLAEYAEERGLKLGTINSNTFQDDAYKLGSICHPEAAVRRKALDHLLECVDIMDATGSKDLKLWFADGTNYPGQDDVRERQDRLTEGLATVYERLGDDQRMLLEYKFFEPAFYTTDVPDWGTAYAHCLKLGDRAQVVVDTGHHAPGTNIEFIVATLLREGKLGGFDFNSRFYADDDLMVGAADPFQLFRIMYEVIRGGGLTSDVAFMLDQCHNIEAKIPAIIRSVMNVQEATAKALLVDREALRSAQRSGDVLEANAVLMDAYNTDVRPLLAELREETGLDPDPVAAYRRSGWASKIAEERVGGQQAGWGA

SEQ ID NO: 14944 - protein, 505 aa, Streptomyces avermitilis
MTHPSDTGPAPVLALEDISKSFGAVRALRDVSLELFPGEVHALAGENGAGKSTLIKTLAGVHRPDAGQVLLDGRPTVFHGPADARDAGIAVIYQEPTLFPDLSIAENIYMGRRPRRSFGRIDHKATRAATAALMRRLGVELDPERPARGLSIADQQIVEIAKALSFDARVLIMDEPTAALTGSEVARLFGVVRTLREQGAAVLFISHRLEEIFQICQRVTTLRDGALISSEPLDGMTEDDLVRRMVGRDLDELYPKQEVRAGEVAMSVRRLTREGVFTDVSFDVRRGEIVGLAGLVGAGRTEVARAVFGIDRWDAGEVEVEGRRLTNGAPSTAMAAGLALVPEDRRAQGLVMNMSIERNIGLTGLRTTVRAGLVDRGAERSRSLDWAAKLQVKYARIADAVSTLSGGNQQKVVLAKWLATGPRVLIVDEPTRGIDVGTKAEVHRLLSALAADGVAVLMISSDLPEILGMADRVLVMHEGRVTAEIPRSEATEESVMAAATGRAAA

SEQ ID NO: 14945 - protein, 346 aa, Streptomyces avermitilis
MTVTAPNPAPAAEVPESSGTRLVDRVFKMRELAILAVFLVMIALTQAGNSEFLSEQGIKDLLLNATILVLVATGQSLVVITRNVDLSVGSTLGISAFAAGTYLQGGGNPVVAIVLAVLLGVGFGLLNGLLVSLGQVPALVVTLGTLYIIRGIDSIWVGSRQITAADLPGGFVDFGSGGISAVPWLALIALAVLIATAYYLKHFGSGRELYALGSNPEAARLAGMPVRKRILAAYTFCGGLAGLAGALYLARFGNVDSGTGNGYELTVVSAVVVGGIVFTGGSGSVYGAALGALLLTSVNSVLPALGVSSVWVLAINGILLILAIAVDRIVALRVAAALKKRNARHG

SEQ ID NO: 14946 - protein, 332 aa, Streptomyces avermitilis
MADSNWTRAIRWDTVVGALLVVVLLLSFGFVDGFGNGLNLSFLIGNTLPIALIALPMTLLVVAGEIDLSVASTAGLSGSVLGALWNQGMAIETIIPLCLLLGVVCGLVNGLLVTRLGLPSLAVTIGTLAAYRGIAQIVLGSDAVTDFPTQYLDFAAGRIGDTFLPYAFLPFLVLLAIAVVALHATPFGRSLFAIGASEEAARFAGLRVKRQKLILFTLTGLMASLTGVLWALHYASARYDNATGLELSVVAAVLLGGIDFDGGKGTLGGAIAGVFLLGALQNVMSLVNVSAQSQIVVTGVLLVVSVLGPRVARQISVARAGRRAPSTPTPTP

SEQ ID NO: 14947 - protein, 360 aa, Streptomyces avermitilis
MRKSSLRRTCAALAAVTSLALAATACGGTTKDDVKDDSGSAATAGKADPNAATKKGLTVGFLPKAVNNPYFTSADKGGEKALEELGSSYKEVGPSSATDTSGQVSYVNTLTQQQVDAMAVSAQDPGALCTALKQAMKNGIEVVTYDSDTKTGCRNAFVSQASAEDLGRTEVQLLAEQIGYKGEIAILSAAQTATNQNTWIGFMKDELKDPKYKNVKLVKVAYGNDDAQQSFQQTQGLLQEHPKLAGIISPTTVGIKAAAQYLSGSKYKGKVKLTGLGTPNDMRKYVKNGTVEGFELWDPAKLGELAARTAVALSSGQISGKEGETFKAGDMGSYTIGKDGVISLGKPTVFDAKNVDQFNF

SEQ ID NO: 14948 - protein, 103 aa, Streptomyces avermitilis
VCFLLKVRADRLDEYRERHAAVWPEMLDALSATGWRNYSLFLREDGLLVGYVETEDFAAARAGMEATGVNARWQAEMAPFFESLDGAGPDEAMKPLTEVFHLA

SEQ ID NO: 14949 - protein, 470 aa, Streptomyces avermitilis
MDMRRRTLLATALLGAVAAPGTARAADPGPSVTLTGSTLLDARAVYFVSYDGLVNNNAFQKNGLLTYKGHQYAAWYTADRSAVVARRTLGASNWSTLTLAHRLKSDDSHNVISMGVSKTDGRLHLNMDSHSDGFFYVKSAAGLLDNAPAWTSAAFGSVGTTLDGLALTSQFTYPQFIATPEGRLQLSYRAGISGNGRNALAEYDGSSWTALGEWSGSTGTYTSEHGSSTARNMYLHGIDYDTNGRLHSFFTWREQSASVMCDSGGITNHDTGYVYSTDRGRTWRNDAGTLVGTTGGSDRVAVTDTGLVIDPLNPDHSLMNQESQATDSTGLPHAIISYVPGRFGQCTTNYVTDRTANGRAFHLRKNASGGWTKTEIPIALNSSQRTKLALDRYDNAYAIMPFGRIAAASKSSGYTDWKLLYDGGGLNAFGEVVIDETRAGQDGVLSVMYQEKSSGTTPSALHVLDFGLPA

SEQ ID NO: 14950 - protein, 341 aa, Streptomyces avermitilis
MAQSVGIKDVARAAGVSVGTVSNVINRPDSVASETRARVLSAIDRLGYVRSESARQLRAGRSRIMGLLVLDMGNPFFVDVARGAERAARKAGLGVMVCNSAQSAGEESDYLSLFAEQRVRGVLLTPADATGRNIQAFRRHGIPFVLVDRVAEGTTECSVSVDDVAGGALAVRHLVDAGHRSIAYVSGPPGLNQVSDRRTGALNALAEAGLGPDCLRELPTERLDVAAGRDAGARILGLADRPTAVFCANDLLALGVLQAMYAAGVGVPDDLAIVGYDDIEFAAAAAVPLTSVRQPAVTMGALAAELLLEETEAETAPTPHEHRRVVLQPELVVRRSSLSAR

SEQ ID NO: 14951 - protein, 450 aa, Streptomyces avermitilis
VFNWDAAWNPYVSGALLTVTYRQPGVVLTDHHFTVPLDHDDPAGESIELFAREVVASDKAHQDGLPWLVYLQGGPGFGANRFVGTQAWLGRAVKEFRVLLLDQRGTGHSTPANRQTLPLRGGPREQADYLTHFRADSIVRDCEAIRPRLTGGAPWTVLGQSFGGFCTVHYLSTAPEGLRAALITGGLPSLDAHADDVYRAAYPRIERKVAAHYARYPQDVERARQIAEYVLRHEPVLNGGYRLTVEAFQSLGILLGGGEGSHRLHYLLENAFVRTPQGPALSDAFQEDVQSLLSYAGHPLYALVHEACYAQDDRPTAWSAERVRAEFPRFDAGKTLTEDGPLLFTGESVHPWMFDADPALRPLRETAEELASRTDWQPLYDPARLAANEVPVAAAVYHDDMYVDTEHSLRTARAIRGLRTWVTDEFEHDGVRAGGPRVLDRLLALTRDEV

SEQ ID NO: 14952 - protein, 322 aa, Streptomyces avermitilis
LIITALNRRPERGRAPRTSGGAMGDGGTMSESDLLAGRFEEHRRHLRAVAYRMLGSLSEADDAVQETWLKLSHADVSEVRNLAGWLTTVVSRVCLNMLRSRASRREEPMDTFVPDPVVSSLERIDPEQEVLLADSVGLALLVVLETLEPAERLAFVLHDMFAVPFDDIAPIVDRSSAATRQLASRARRRVQGSAPAPDPDLGRQKQVLDAFLAASRGGDFEALLSVLDPDVVLRADAGALAGGVAVSKLVRGAAAVAEQALMFRQLAQFSRLVLVNGAVGVVTVLDGQPMGVMGVTVADGRIVDICILSDPDRLARLDLPAG

SEQ ID NO: 14953 - protein, 276 aa, Streptomyces avermitilis
MRDTPVDLSELRADCAQCFGLCCVALPFAASADFAIDKDAGKPCRNLQGDFRCGIHLELRPRGFSGCTVYDCFGAGQKVSQITFGGQDWRSGTREHARQMVDVFPVVRQLQELLWYLAEALTLPAARPVHADVRRALEATERLTRQTPEELEQLDVGAHRQEVNVLLLRTSELVRAGGGRRKKDRRGADLVGARLKGADLRAASLRGACLIAADLTGADLRGADLIGADLRDTDLTDADLTGAFFLTQPQLNAAKGSAGTKIPASLTRPGHWTAGT

SEQ ID NO: 14954 - protein, 504 aa, Streptomyces avermitilis
MAQSTRTVIPKGFRSAELGWPELHRIPHPPHRLPVVGDVLGVNVRTPVQDSLRIGRRLGPVFRRKAFGKEIVFVGGADLAAELADESRFAKHVGLGVANLRPVAGDGLFTAYNHEPNWQLGHDVLAPGFSREAMAGYHPMMLAVTERLIDHWDREQTAGRAVDVPGDMTKLTLETIARTGFGHDFGSFERARPHPFVTAMVGTLTYAQRRNVVPEPLAPLLLRTATRRNAADLAYLNRTVDALVRARRTTSGEGDLLDRMLDTARPGTGERLAPENIRRQVITFLVAGHETTSGALSFALHYLSRHPDVAARARAEVDRVWGGTARPGYDQVAKLRYVRRVLDESLRLWPTAPAFAREARRDTVLGGVHPMREGAWALVLTAMLHRDPGVWGADAERFDPDRFDAQAVRSRAAHTFKPFGTGARACIGRQFALHEATLVLGLLLRRYELRAEPGYRLRVAERLTLMPEGLRLRLDRRVPAVEDVPVANPEVSSGPRCPVTGAGE

SEQ ID NO: 14955 - protein, 202 aa, Streptomyces avermitilis
MAANQGERTRRRLSTEERREQLLSVGARLFSESPYDEVWIEQVAEIAGVSRGLLYHYFPTKRDFFAAVVERESGRMLRMTAAVPGIPVREQLGAGLDVFLEYVEAHAHGFRAFHRADAAGDQAVRTVYRQALAAQERQILAALAADPEIGRSPEEEPELRIAVRGWLAFTTAVCLEWLRGAELTREQVRDLCARALLGVIAL

SEQ ID NO: 14956 - protein, 242 aa, Streptomyces avermitilis
MGDRHTWTAAPAAAERARSVLAAAWSCAVTAEGGREEFVGTHTVAADGVVLLPVPEDSALRVAAICAPRGEPSAVLEFADVAPVPVRNRIRARLWMAGWFALEEGHLAFRPTRVVLRGRPAGAVVVDLDEFAAAEPDPLAAAEAGLLTHLADAHPDAVERLTRLVEHDSLHGAVRVQPLAVDRHGLTLRVERARGDVDVRLPFHRPADDVGQLTERMHVLLAQAAQAARPRALQRQRADGDG

SEQ ID NO: 14957 - protein, 408 aa, Streptomyces avermitilis
MSSGAEPTRGPRSGGWSRRRFLGAVTAATAVTTIPAPVAPGDSPRTTPPGSPAPAPTPETTESQPSGPRPLYLGTYTSVDGGGAGIGLATYDPKTGKITGTGTVTQVGDPSYLAVHPDGRTLYAVNERQDGGVSAVRLADKKVLGARGTGGAAPCHLSVHPGGRWLLSANYSSGSVAVHPIGSSGALGERMDLVTHSGPPPGPGQEGPHAHQFLTSPDGGHVLAVDLGTDTVYSYRLDLSKGTLTEASQAHTRPGAGPRHLTFHPRGRFAYLANEVDNTVAVCAYDPATGRLTPGDPQSTGTGAGTSYPAQILVTSDGSYAYLANRGHNSLTRYAVEADGARLRLLDTVPVGGDFPRHIAFSPDGGLLFAANQRSSTVSVFHVDRESGELRLAGEPFASPVAVCALPL

SEQ ID NO: 14958 - protein, 352 aa, Streptomyces avermitilis
MTEGTVRIDGNTLRLPGGVQVRFIRTLRLPETGTHELPPGLGEFPVRRVEDYPDTVPAAWRSRGGVMLPVYLREAMWLSFAGTSEPAALQVGVGKVCAVSGKPWSSRLTRDPQNYVVLPRQPWLDGINSGKGTVRQFVAVPLGLGATVEGQVTGEEVWGGVQLQSFPLNDGELAAWRDAERRKAQARREMPPAPGGYGTAMPMAAPAAPGAAPAPAGAPSRRSRGAAAMGLGVGGSMRQEVYRDDRPLGAWAEKPAGRVFVHLVTPPEWRRITGEAPPPSPVDRAAYTRAGLPWFDYYDQDAADLAPTDTLGKVRPVGDWLGDDHEPWQEPSPHQVKPLGDAPGKPVGDGDW

SEQ ID NO: 14959 - protein, 417 aa, Streptomyces avermitilis
MRDVRDAWAAATAQVGKWRQPVVVQSVRSTAAATVAYVIALHLSPEPAPLTAPLTALLVVQVTLYATLTTSWRRVNSVVTGVVIAIGFSVLVGLTWWSLGLIILASLAVGHLVRVSEFVPEVAISAMLVLGVTRVGDTAWARVVETLIGAVVGLGTNVLFAPPVWVSEAAESIEDLARRIRQLMLRIGEEAAGRAPIEEATARLYEARRLDHDIVQVDAALRQAEDSLKLNPRVREGLLYRIVLRTGLDTLEICTVVLRVLARTLADFAKARDLQRWLEPETGAVLEQLLSEIGNAIVSFAVLVTTDVSRSAENAESRLAAELTTAAATRDKLAQLLLEEIQRDASQWQLRGAILTEVNRILDELDIEHRSRRLFEELDRSTREQRERRSRLTRLRQRMGVVRLPRRNHRASSGRST

SEQ ID NO: 14960 - protein, 135 aa, Streptomyces avermitilis
VRIPAQKGEQRLGPAGTFGHLAHGSEHPVRVAKMIRETLRGGPDAVGHLLVQRHVQARRHGDVPGVHAGVHGGWSSGPSGVGTCSASAGSAVYTSATRRSTASSSARASPDSASAGAKESDSGRPSPVTAAPYAC

SEQ ID NO: 14961 - protein, 481 aa, Streptomyces avermitilis
MLAVAEAGLSLCRRVFPTPGGRPAGWSGPGPGREPWIMKRHRTGLALALLLTLGTVAAGVAPAASATTSGPVVHALESGAHPLRTVEPQGDTSDLRPLDGMIGGARVVGLGEATHSSHDFFALKHRVFRHLVEEKGFRTFALEGSWSTGQRLDDYVLHGKGDPRRIMREEFQRDYLWWNNTDYLALVEWMRAYNLRHPHDPVRFMGDDIGWVGPELYDAVTDYVARTRPELTARFDELYRGLRPTVATGTYMEQYLNKPYAERREMADRTGQALELLKRQSPGADRAAYERAVQNATALDQVARQYAFDFTDPRQIAASMRYRDSAMAANVLWWQRHTGTKVLLAAHDAHVGYRTYDPANYPKMQGAFLHDRLGSGYVSVGLTFDRGSFNATGQDGAIHRWTLGPAGPGTNERTLDRVRYRDYVLDLRRVAAPAREWLDRARPTRSIGTDYPDGPHDIALASTHDILIHLHRVEAARLRDQ

SEQ ID NO: 14962 - protein, 162 aa, Streptomyces avermitilis
MRALTEQDIRDSFVNCSKGEAKRLAIPRDLDERPWDDLDFLGWRDPGAPDRSYLVTERADGLVGVTLRFPSSRRGFLHRSMCSLCVTTHPGNGVSLMTARKTGAAGREGNSVGVYMCADLACSLYVRGRKVPESGTRFEESLTVEEQIARMVGNLSAFLDKL

SEQ ID NO: 14963 - protein, 87 aa, Streptomyces avermitilis
VHPPPTGAPVGGATGRQARQTGGRQAAGSFRAARAARETGLTTDGVTCHLRRLSERWSAANRTELVARAYALGVLSSGVWPPEAVTD

SEQ ID NO: 14964 - protein, 429 aa, Streptomyces avermitilis
MAARNGRTVRDLRRGNRTAVLQRLYFEGPMSRFELGPATGLSSGSISNVVAELVADGLVEEAGSVDSDGGRPRILLRVAPGSGHMIGVDVGETRVRVELFDLTLTELARTERPLERGCYDVEVVVGHIRDGVDEVLTAADIAPERLLGVGVGVPGIVERTPGQGAVVHGQTIGWNAVPLESLLRSTGRLPDTVPYFTDNGAKTLGQAEMWFGAGRGARSAVVVLFGSGVGACLVTEEVDSGRALEWGHLTVRVRGRRCRCGALGCLEAYAGAEALLDRWREEGGRPPEHTDEETALTAMLAAAYPPGGADPDPAALAVLEETAEYLGAGLSDLINLFQPERILIGGWAGLQLGSRFLPAVRRHATSYALRHPAERVSIDLGRLGPDAVTAGAAILPLADFFARGGRRAEPASEGPSPAWRTALEERPPR

SEQ ID NO: 14965 - protein, 111 aa, Streptomyces avermitilis
VPEVLARRPGGPASSARGPPPSRRMEHAVTEHRQEAPGENGDPIPRDLPDQQARESEDPWDAAPAGSGKDDLDDEPDLDVPDTDEAGTGRQGAPHAAAVNPEHPVPDEPAD

SEQ ID NO: 14966 - protein, 322 aa, Streptomyces avermitilis
MNTAQHKIGSGFGATSTAVDVLHGIDLSGQLAIVTGGYSGLGLETTRALTGAGARVVVPARRPDVAREAVAGIDGVEVDELDLGDLESVRGFAERFLASGRTIDIVINNAGIMACPETRVGPGWEAQFATNHLGHFALVNRLWPAVEPGGARVVSVSSGGHHLSGIRWDDVHWTHDYDKWEAYGQAKTANVLFAVHLDRLGRESGVRAFSLHPGGILTPLQRHLAKEEMVERGWIDENGDLVHPDAFKTPEQGAATQVWAATSPQLAGMGGVYCEDCDIAEPASADGERGGVKDWATDPEQAARLWDLSAELTGVNAFASRA

SEQ ID NO: 14967 - protein, 221 aa, Streptomyces avermitilis
MERAAVFDVDGTLVDTNHLHVTTWWEAFRQAGHQVPMHDIHRSVGLGSQDLIAHLLGEDRDQDEVDALSAAHKTLYGTYFDRLHPLKDAGRLLKRLDDDGWTVVLATSAGGSELSALRRAIDADDAIKATASADDVSAGKPAPEPVEHALGLVGIPPEHAVFVGDTVWDMRAGSRAGVTCVGVLCGGIPRADLVEAGADAIYRDPEHLLALLPDSALAPKA

SEQ ID NO: 14968 - protein, 347 aa, Streptomyces avermitilis
VVMDPLEALDRIAFLLERGQAPTYRVRAFRTAAAVLAARPADEVAELVRTGSLESLKGIGPKTAQVVREALAGQVPGYLEKLEREAGAPLAQGGEELRALLRGDCHLHSDWSDGGSPIEDMGRTAARLGHEWAVLTDHSPRLTVARGLSPERLREQLAVVATLNERWAPFRLLTGIECDILDDGSLDQEPELLARLDVVVVSVHSKLRMDARSMTRRMVAAVRDPLSDVLGHCTGRLLTGRGRPESEFDADEVFAACAESGTAVEINSRPERLDPPRRLLRRAVAAGVLFSVDTDAHAPGQLDWQIHGCARAEECGVPAERVITTWTMEELLAWARDRETPAGVDPV

SEQ ID NO: 14969 - protein, 78 aa, Streptomyces avermitilis
MTEIACPYVTHPRIMVLGVQPGKPPFRIVEIDGEVVAEARAITDVLTVAAEAGITVHDLDDPDVVRWVGGDKHHWTLR

SEQ ID NO: 14970 - protein, 420 aa, Streptomyces avermitilis
VDSPRLLRRCLFAALSAALIASAAIGPADAADAAPKAASSEKVAAAAATFSDTFDGAAGSAVDSSKWQVETGDNVNNHERQYYTSGNNNAALDGQGHLVITARKDNPGNYQCWYGRCEYTSARLNTSGKFSAAYGRVEARMKIPRGQGMWPAFWMLGTDIGQVGWPNSGEIDVMENVGFEPSTIHGTIHGPGYSGTGGIGAAYSLPGGQAFADAFHTFAVDWAPDSITWSVDGTVYQRRTPADLGGKTWAFNKPFFLILNLAVGGYWPGDPNSSTAFPQQLVVDDVKVTTGDSSSGAPITGLAGKCVDVAGSSSANGAPVQLYDCNGTTAQKWTVASDGTLRALGKCLDVTENGTADGSTVQLWDCGGSANQKWVVTAAGDIVNPQANKCLDVTGNNSANGTRLQIWSCSGAANQKWKVG

SEQ ID NO: 14971 - protein, 196 aa, Streptomyces avermitilis
LNLEGWMARTELRTGTSKFGLGRRRTSTAPPPEHRPLPLPVRLLAMVLAFATMVAFAAVLARLTLEPSPASEALTHNNLHPGRSLHAYLSRPELRDAVKQIGGNLLLGVPFGVLLPMVAPRTRGLVRVGVLTALVMLLVELVQGALITGRAFDIDDVILNTTGALLGYLLLGRRLGRAVHPRRRRRQDTSGGKGKS

SEQ ID NO: 14972 - protein, 194 aa, Streptomyces avermitilis
VGRPRPPLAGVHQRGRHTGADRGGLGLVRRSGRGARSAAGDERAVNGWTVAATVTIAGGVGATVWGVATGPLSRRVVAQNLSCALACPGLLLLAQGYERPAYVDLALVLALLGPVGTLVFARLLADDLAQDPPRARAVTVAVACFGGVVVLVLCAAAGPGRAMMKLLVTGALLIGGNLLASRALSGGFSGGRRG

SEQ ID NO: 14973 - protein, 91 aa, Streptomyces avermitilis
VDDPLIFVALLLVAASATAAVAVRDPVRQALVLSVLGITLAVLFTVMQAPDVALSQLAVGAALTPLLLLLSVRKVGRRARQGNRKGKGKAR

SEQ ID NO: 14974 - protein, 246 aa, Streptomyces avermitilis
VTRRVRLIVLAVGGAGLAALLVAACLRLPGFGGTRHPYGDRVVRASLARHTANTIASVNFDQRAFDTLGEMGILFASVLGTVVLLRQTRDERSARPEPEDVALPVRRYALVVLPVALLTGLYVIAHGQLSPGGGFQGGVIAATALHLLYLGADYRALERIRPVGLYEIGDALGACAYLVLGLTGVVAGTSFLANTLLPYGTFNTLSSGGTVPLLNAAIGVEVACAVVVLLARFLDQAVEIEEGSGK

SEQ ID NO: 14975 - protein, 116 aa, Streptomyces avermitilis
VMSVLPYLVAVWIFLTGCYGLATSRNLIHAVGCLAVCQSATYVLLLTVGYRDGATAPVYSDIKPGSRPVVDPVVQALALTDVVVGATVTALLLALVLQVSKRHGTVDPDELRELRG

SEQ ID NO: 14976 - protein, 585 aa, Streptomyces avermitilis
MNHLLPLLVALPLLGAALLVMAGRRLPRVAAESVGCAVSAGTAALAVVLLLNSSPPLVEWVGGWLPRDGESVGIVLVGNGAGLGMAALASLLTVSALAYSWRYFEEPPHHAGSFPALMLLFQGGMCGFAIAGDLFDAFVFFELMSVVAYALTGHRVEEAKAVQGALTFGVVNSLGAYAMLMGIALLYARTGELGLTQIGRKLDAHGGPDALTLAAFVLVLTALLVKAAAVPFHFWLPDAHAVAPTPVCMLLSGVMVELGAYGVWRVYGTVFAGPGGIPAADLERALLVLGVLTSVVGAVLCWYQRHVKRLLAYSTVAHMGLFLIGIGTLTPEADDGVALYVLGHAGVKAALFACTGILLDRYGSVDEHALHGRARELRGVAVLFLIGALGLAGLPPFGTALGKAITEEAVGGPLTVLFVAVSAVTAGAVLRVVARVFYGLGPKPRKESSYETTGTGEEPETRHRLRRIPDTMTTVPAVLLAAALAVGAVPGFAGVVARAVNEAGSGGAVTSPHWTLAGVVLGLTSTAVAVGLAALAVTRPKLLGEQRWTEPLRHLQSGYIGDYVAWLLAGATLLGALALPGVLGG

SEQ ID NO: 14977 - protein, 227 aa, Streptomyces avermitilis
MTTSIKQTPGSTSSERKRMPGWLKAVTALVLVLVVLFAGLRLSVLPGLRDLFGEDTHDRSGPTLLKSIQDMSRYDAASGNFQVVVDLEKDAKLLPDAIRGTRTLYVGAGTVDAYVNLGGLGKDDVKVNGDRTSATIRLPHAVLGKPALDADRSYAVSKQRGLLDRLGDLFSDNPNSERAVQKLAVKHIGEAAKDSELAERAEENTTSMLDGLLRSLGFKEVHVTYGA

SEQ ID NO: 14978 - protein, 133 aa, Streptomyces avermitilis
VPRHDLATRPTSGDRNAPIPRNPGAIDRLGSIDAGDTRTDDGEIERRRGITIRSAVAAFTAGAVQINPIDTPKHPDFIAEAERALEVLDGAVLPLSAVEGFPRRAGPGDSATGRVRRGVPGDDGRAHGLADHR

SEQ ID NO: 14979 - protein, 317 aa, Streptomyces avermitilis
VRDIAVFSGSAHPELVAEVCAHLGVPLSPSRVSRFANDCLEVQLQANCRERDVFLVQPLVAPVQEHLVELLLMCDAARGASAGRITVVMPHYSYARSDKKDAPRISIGGRLVADLLVAAGASRVLAMTLHSPQVHGFFSVPVDHLHALRELAAHFRGHDLSRTTVVSPDLGNAKEAAAFARMIGAQVAAGAKQRFADDRVSISAVIGDVVDRDVIVLDDEIAKGSTVLELLDRLRELGPRSIRVACTHGLFAAGALKRLSEQPDVLEIVCTNTVPVAALERTGKLRVLSIAPALAEAVRRIHNGESVSALFDAPQGE

SEQ ID NO: 14980 - protein, 135 aa, Streptomyces avermitilis
VEPVGGDAVMPQDPAPRTRHLHVHRVRGHTVLEFRGEIDIAAALEIIPVLDSVTGRPAARVVIDLGPVEFFDCSGLRLLYRARSRVLGRGGQLRLVCTHALTLRILRLTGLRTLLPPAASLDEALRQAEATSGSW

SEQ ID NO: 14981 - protein, 315 aa, Streptomyces avermitilis
MSTVNTMRAISQDVLGGPEVLKEVETERPAPRPNEVLVRVRAAGVNPTDWKHRATGGFLGEPPFVLGWDVSGVVEATGIGVARFKPGDEVFGMLSYPFGHGSHAEYVTAPARAFAHKPSGVDHIQAGALPLVSLTAWQALVETADVRPGQRVLIHAAAGGVGHVAVQIAKARGAYVIGTASAGKHDFLRGLGVDETIDYRETDFAEAVRDVDIVLDTIGGDHSLRSLRVLRPGGIVVSILPVGSDDFYEEAERLGVRALRMLVDASHTGMKAIAELVEAGKLRATIAETFPLADAAKAHALGDTGRTTGKLVLTM

SEQ ID NO: 14982 - protein, 315 aa, Streptomyces avermitilis
MRHVERVVVLALDGVYPFELGIPSRIFGAADGRYEVVTCTVDGKPVRSNADFSVMVERGPEVLRTADTVVIPPVTPASVTAELPAEVTAALAQIRPGTRIVSICTGAFVLAAAGLLEGRRATTHWQLADHFRRMFPHVALDPDVLFVDDDPILTSAGAASGVDACLHIVRKDHGSALANSVARRCVVPPWRDGGQAQYIEHPVPGPTTTGTAATRQWALERLGEPLALADLAGHARMSLRTFARRFGDEVGMSPGRWLIQQRVARARQLLESSDLPVDQIAGEVGFATGASLRQHLHAAIGVSPQAYRRTFQTAR

SEQ ID NO: 14983 - protein, 234 aa, Streptomyces avermitilis
MTQFVLVAGAWLGSWAWDEVVPHLRAAGHGAHPLTLSGLADKQGVPAGQQTHVRDIVDEVERLDLREVVLVGHSYAGIPVGQAAERIGDRLTRVVFVDSNVPAVDESFVSTWWEGPAKFEAVLAANGDVWPPLTAPDFEGQGLTEEQIARFVGRATPHPGATLSEPAVLTRPLGELPATYIKCLLDGPEPTDDVAELLKSEHWRLVELDTGHWPMLSRPTELARILLDADGSAG

SEQ ID NO: 14984 - protein, 301 aa, Streptomyces avermitilis
VRRRRDGYGVRRTGAGMRKGIAAVAVLVAMTASAGCDDGSGADLVVTGTPPATPYSGPLKVPSKNLDEDSARAVRLVAGAAGRALECDGEIYTGASDGSWSRDDGGATPEEGLQAYFDLEQAEDPHYGYRVEREERDRVLYSFDVHGRTKVAVVVAKDQKGRPGWGPESSASCDPAELPASFTDSKPYEIWTDRDGRRVATTVVSSNDGPEHCGWQSAVFLYTGRGEGVRHYVRDPHGVLGRQLLTSAYDGHVRMPADAHDTGYRLNDRELWFTGDRSKAYVRTSDGVELWPATKESVGCK

SEQ ID NO: 14985 - protein, 187 aa, Streptomyces avermitilis
VSPVPWEDPRAARTRAKLREALLHECAAHPLEEVSVAALVRRAGVGRATFYVHYADLEALAVDACADVVRDAVDALHAWRGRPDPVRAPEALRAFLAGLAPHTALYRALLSPGGGGPLGRVLHRDLRARSLSERTLAGAADAPLVASAVAATFAGVLADWLHGLLDATADDIADQAWQLLVALHRSR

SEQ ID NO: 14986 - protein, 120 aa, Streptomyces avermitilis
MEILANVLVGLVAALHAYILVMEMFLWEKKPGRGLHGFDPEMARATAPLAANQGLYNGFLAAGLVWGLIAGDPTGFRVQVFFLVCVVIAGVYGGLTANRRILFAQALPGALALAAVLIAH

SEQ ID NO: 14987 - protein, 511 aa, Streptomyces avermitilis
VAVFCLGEGGVDVSGSIAPVGWSESERGMWAAFRRGEWYADGGEVRASAVRRLLLAPPQAEPGHPARLRLRDVLVTGRLDLEEAVVAAALRLRNCRFEHAPRLDGASLGALELRDCTLPGLSAVGVTIGWKCEIRGCRVQGALDMHGASIGGTLHLEDSRLTGGADLRDSSVGGSVILRRAALLNPRGTALHANRLHIGGDLDCRGGLVAEGTVDVCDARVGGGVRFEGASLTAEHGPALRAHGIDVGAEFKCCEGFVAHGRLSMSSITVRSQLCFKNGSIDVPAGQPALVSRRSTASDLDLSFSGPVHGTVDLSHTRLTLLTGAPGEWPLALRMEGVVYDSLLPQLPAAERLPLLARDPEGFTPQPYEQLAAVYRLHGRDAEARTVLLAKQRRLRTTLPWPGRVWGGLQDLTVGYGYRPMRAVWWLFAIMLSGTLLFTAWPPQAVEPGKPPHFQAAIYTFDLLLPLVDFGQEQAFSPRGGLQWAAVLLICLGWLLATTAATGANRMLRRA

SEQ ID NO: 14988 - protein, 154 aa, Streptomyces avermitilis
MTTPPARTAKQRIQDTLNRLELDVDAWVSTAGADGGAPYLVPLSYLWDGETFLVATPAASPTGRNLSETGRVRLGIGPTRDLVLVEGTALPLEPAGLPDGVGDTFAEKTGFDPRRLTTSYLYFRISPRRVQAWREANELSGRELMRDGEWLVTD

SEQ ID NO: 14989 - protein, 130 aa, Streptomyces avermitilis
MALVVAGVVVLDCAEPEKLAAFYRELLDAEETDATANRVEIRGADGMRMAFRRDVMATPPSWPRPENSLQAHLDFHVEDLDAAERKVVGLGGRPLDTKDAQGPFEERGYADPAGHSFTLRCARPTAPKQG

SEQ ID NO: 14990 - protein, 102 aa, Streptomyces avermitilis
MARNKQKKMKLPLVYKPLGFALSWASGALAGLAFQQAWKAIRHEDNAPDALDQDRGWGEILFAAAVQGAIFAVVRSAVDRTGAKAVERSTGVWPDGNKGGRD

SEQ ID NO: 14991 - protein, 338 aa, Streptomyces avermitilis
MSEGNGNSAYGRKAFKRSRSHFTDRITADGRDGRPVEAGRYRLIASRACPWASRALVSRRLLGLEDALSLGVVDPVQDDRSWRFTLDPDGRDPVLGIRYLSEAYDARQPEYPGGVSVPAIVDVPSGKLVTNDYQQLTLDLATEWKALHRQGAPDLYPAGLRDEIDEVMADIYEDVNNGVYRAGFATGQKEYEAACAGVFHRLELLGQRLADRRHLVGDSITEADIRLFTTLVRFDAVYHGHFKCNRWKLTEHPVLWAYARDLYQTPGFGDTVDFDHIKRHYYQVHTGINPTGIVPLGPDLAGWLTPHHRERLGGRPFGDGTPPGPVREDEEIPAQGRP

SEQ ID NO: 14992 - protein, 356 aa, Streptomyces avermitilis
VSRTSSSDSSNHASSTPADSSADSSEDPSADSSADASDRKTRITVLVALGANLVIAVAKAVGGLLAGSPALLSEAAHSVADSLNEVFLLAALRRSRRPADQRHPFGYGKERFFWSLLAAVGIFVMGGCFSFFQGIEALRSGAEESHSGYVAGLIVLGVALLAEGASLLRALHQVRGQRGSAAEGLRDPALRTVVAEDGTAVLGVTLAMIGMALHMVTGQVVWEAAASMGIGALLVYVAYRLGRDARDQLIGQAADPELSGRIRALLEAQPEIDSVESLLTMQLGLHSTLVAARVDLVPGLDSEEVEDVAVRIKRSVAHLIPEADQIFLDVTDARALAADRAGETESPAATGERGGA

SEQ ID NO: 14993 - protein, 147 aa, Streptomyces avermitilis
MPLEGEYEPSPTQWVRDQVELYESSGGTKGTTLMDTGLPVIILTTLGAKSGKIRKTPLMRVEHDGKYAAVASLGGAPKHPVWYYNVLGTPAVELQDGAVRKEFTAREVTGEEKAQWWERAVAAYPPYAEYQEKTDREIPVFVLEPAG

SEQ ID NO: 14994 - protein, 210 aa, Streptomyces avermitilis
VTAALVAGLLAGYGIAVPVGAVATYLVSLTARTSLRTGVCAALGVATADGLYALVAALGGSALAAALQPVLVPLRWASGLVLIALAVRGATAAVRHYRSPRHAAAARRTPPSPARAYLGLLGITLLNPTTVIYFAALVLGSRAAQAVLPLEQGVFVLAAFVASASWQVLLAGGGALLGRALTGRRGRLVTALLSSAVILGLAVRMLMSPA

SEQ ID NO: 14995 - protein, 169 aa, Streptomyces avermitilis
LWTRPGWPSSTPAPAATGLLSDWTDSAGVRRFAHDALGHPGIRAVIVLTGINDILGGENDAGRPLTARDLVDGYRSLIREAHESGVRVIGGTLLPSRTLTDAQNALREEANEWIRTGRHFDGVADFERVMADPDDPRALAPGYDSGDGLHPNDAGMAALAGAVDPTTLT

SEQ ID NO: 14996 - protein, 228 aa, Streptomyces avermitilis
VFAPSVIESPKATRVPSTSSVVTVSPARKYQEVSVAVNPSRPSSAVRSPERGAETYVVSKASRWWVEGPVEPGRYTLTSRFCPRSTSTGSTSVSSSRPRPITAFVAPSKETGRGGRPSGATLTAPTVSSAGPWRFDSRRRARVPPALGRTTIRTVWSRKDRPKGTMLGAHTATVCCMPVMVTLLPGRRVRTAGASGFTAVDDGCLPASVRRGSASSGIPWTWPKFEWH

SEQ ID NO: 14997 - protein, 416 aa, Streptomyces avermitilis
MEIGKSKSSPARSFMTEPGTSVSAPVAFPQDRTCPYDPPTAYDPLREGRPLSRVSLYDGRSVWVVTGHAAARALLSDQRLSSDRTLPRFPATTERFEAVRTRRVALLGVDDPEHRTQRRMLVPSFTLKRAAALRPRIQETVDGLLDAMEAQGPPAELVSAFALPLPSMVICALLGVPYADHDFFESQSRRLLRGPGIAEVQDARAQLDDYLYALIDRKRKEPGDGLLDDLIQEQLNRGTVDRAELVSLATLLLIAGHETTANMISLGTFTLLRHPEQLAELRAEPGLMPAAVEELLRFLSIADGLLRVATEDIEVAGTTIRADEGVVFATSVINRDAAGFAEPDALDWHRSARHHVAFGFGIHQCLGQNLARAEMEIALGTLFERLPGLRLAAPADEIPFKPGDTIQGMLELPVTW

SEQ ID NO: 14998 - protein, 94 aa, Streptomyces avermitilis
MHNDSNNSNGNNSHSNGNVNSNGSNSDDNVIVIDRDLCIGAGQCALTAPGVFTQDDDGFSELLPGREDGAGDPMVREAARSCPVGAITVPRSAS

SEQ ID NO: 14999 - protein, 184 aa, Streptomyces avermitilis
MEIAVAREQALDAAEKLFYGRGIQSVGMDDIRGASGVSLKRLYQLFPAKEQLVEAYLERRDIHWRERLAAHVDHHRDAGERILAVFDWLRQWFAESDFRGCAWINSYGELGAVSPRVAAQVRAHKQAFRGYLAGLVSDAGLPASLADQLYLLAEGAMVTAGINGTTDPADQAKQAARVLLEACR

SEQ ID NO: 15000 - protein, 153 aa, Streptomyces avermitilis
MTDDRPPLPPFTRATAAQKVQAAEDAWNTRDPHKVSLAYSPDSVWRNRDTFVTGRAAIVELLTAKWAREREYALRKDLWAFDGNRIAVRFQYECQDADGQWWRSYGNELWEFDEHGLMTRREAGIHDVRIEERERRILGPRPEAERGRSFPVQ

SEQ ID NO: 15001 - protein, 176 aa, Streptomyces avermitilis
VTEQAEKPFLYLVVCAAGIAADVGELITAAQERHWQVGVIATPLATGFFDTAAVEARTGRPLRSAWRSPGDPRPFPAPDAVVVAPATFNTVNKWAAGISDTLALGTLCEAYGLGVPIAVLPCVSAALTAHPAYRASLERLRGMGVRFGDPYSGDVGEDGRRPEFRWERALDLLDGR

SEQ ID NO: 15002 - protein, 268 aa, Streptomyces avermitilis
MALTALVGCGADGGPTDASPKPKPDATATAPTSVRLPPLHAGFDYQIGGAYRPPSGVRVVSRDRAASPAPGLYNVCYVNAFQAQPSERGKWPADLLLRDARGKVVIDRDWDEPLLDIGTAAKRERVAARVNRWIDGCAAKGFDAVEPDNYDSYTRSRHLLTAQDATAFVRLLSAHAHARHLAIAQKNTVELAGVRKKAGLDFAVAEECGAYDECGAYAKAFDDRVLVIEYTDSGLRKARSGYGGRLSIVRRDVLVSTPGSTDYIRRTR

SEQ ID NO: 15003 - protein, 295 aa, Streptomyces avermitilis
MTGDRIALAVHDHGGDGSPLLLLHGARRTLADWAAVAPLLVPRHRVLSVDLRGHGLSPSGPWSLPEVLGDIEAVMEEYGIPGALPVGHSLGGMIAVLYALEHPEVTPGAVNLDGYGWGRPDQYVGLDAEFVAEHRRRLPKLAAATWGQPLLAGGLKDLLARERATSDRLGIPYELLEAGVLRSVRERPGGGLEVRPERRHALEMLDFIESLDLFALFRRMTRPLLLGCALRPAASVPGLKWFDDLMAAYARGLARDLAELAAQRPDVTLAQIDSTHDMLLENPRAVADAILDFAS

SEQ ID NO: 15004 - protein, 955 aa, Streptomyces avermitilis
LIFPLRVYGVPVRRPLRKSRPGRVFGMSDPHKDAASVLPVGQCVQWSGLFPAELWRKVDVNDGVRSNSPDPAASHEVTDEQLAAELKKFAGKRTVHYPVSELLARHWEEAFSYARLCTDGAHPAGMLTTAAFTRLFEEAARQGGPTAAWRPQLLVAIRRIAAEWDSDHRRPLLHPELRSDPGATGRAAARLLPPENRRLVSRAFQRLAEPARCLLWHTQVEGEAIDIPAALLGLDADGAAVRLERAREQLREGCLDVHREFAAGDECRRYARLLDVSLRRGDDALDPDLSDHMAGCAHCRCAAEQLNRFYDRLPVLLAEGVLGWGAREYLDSRGERAPGTVEKAAGRPTAAAPPAVVADARMDFTADTGPDPTAGMPKDFAAHAAPRFPAGRTSAGFGPDAPRDFQAGTGQGPTAGTGQSPTVGTGPGPTVGTGPGIQAGAGPGIQAGARPGLTADTPDFESDRPDFAAATGPDGTEGTAETADTAQDFTAGMPEDFAAHATREFPAAGTSPGFGTDVPPDVVADAAQDFAVAADARLDFAAGPDEGLPHAPRENRSPHRSADPHAPGHGGTARYPADANAGAGPATDTGSARHASDAGAGARPSTDTGGSARHAAGPGDGSRSARAVPPAGPRSAHKARRRALRRRRHVALAVLTVSACVFVPLALWSGSWSGGGGTAAGRSSGEPGTGTESGSSGSLPWVGAAAAAPSGTVQGRIRNADSGLCIGIGKNKAVAGAEAVLVDCTSSATQRWEYETDGLLRSLAAPELCLDSHLGYSVQLAACAGESQPGTKNVRYDFTLQGSLVPRWNQDLALTSASGGRGAALVLKPRTDSESQRWLADTSNDLEMQSVNWGIGSESTAPTTRSAKSSATPTPAGTPTTGTPKSSRTPSTGSVTSGGASGGWCYYPYCSSNGQGGWPTSGGSGDSGGGYGGGGGYGDSGGSGTGNGGGGGGRG

SEQ ID NO: 15005 - protein, 447 aa, Streptomyces avermitilis
MGRPRRWWFVAYLVRWGGKADCVREDRDLNTPFAETLSIGLLVAVLVCAVVRPFNWPEAVVAVPAAGIAMATGAISWDHVREEAEHLGPVIGFLAAVLVLARCCDDEGLFRACGAWMARWAAGRPGRLLTAVFALASAITAVLSLDATIVLLTPVVFATAARMGARPKPHVYACTHLSNTASLLLPVSNLTNLLAFSAAGLSFTHFGALMALPWLVAIGAEYVVFRRFFRRDLGTAASSAAVDEAPPAMPLFALVTVVCTLAGFVVASALGIDPAWSALAGALVLAGRALVRRRATPLTVVRAAAPGFLAFVLALGIVVRAVVDNGLSDALGRLLPDGTGLPALLAIAALAAVLANLINNLPAVLVLLPLTAPAGSGPVLAMLLGVNIGPNLTYAGSLATLLWRRILHQHDHGVDLREFTRLGLIAVPAALVPAVTALWLSLQLFGA

SEQ ID NO: 15006 - protein, 812 aa, Streptomyces avermitilis
VTRLFTESVRKGVATMSPDLPSGGEAATARAVIDESGVLVDWNEGARRLLGYTPEEVEGRPVADLLVLGGAGHPPRPSGDRWSGTLELRHRDGRTLSVWLLAHHRQRAPANGAGDWLLVTPLGGLGPRPQDDPLMRSALTMSPCATAVYDTDLRLHGINDAMADMIGLPEDRIRGLRLSEIGGKPENEEMERHLREVLASGERRDVQTYMRSGGEERAHAWLARLAPLTDDAGRVHGACVTAHDFSDQYLARERLQLVNEASVRIGSTLDVTRTAQELADVCVPALADFVSVDLLDPSQDGAEPYPRSLTAPVSLRRAAHQSVNPGSPEAVVRPGQVDVYPASSPQADSLVAGRTIVAPDDRATLAEWLGWDRRREQRIHEYGIHSSMSVPIQARGATLGVAVLTRFRRPDPFTADDVLLAEEVTARAAVCIDNARRFSRERETALALQRSLLPRTLPLTAALEAASRYLPAARAGVGGDWFDVIPLSGMRVAMVVGDVVGHGIQASATMGRLRTAVRTLADIDLAPDELLTHLDDLVVRLSAEAGQDGTTGEVGATCLYAVYDPISRRCTIARAGHPPPVMMTPGARPRQIKLPAGPPLGLGGLPFESAVVDLPEGTVLGLYTDGLIESRERDVGASHQLLCDALSGSRGSSLNEACDRILHALLPACGVADDVALLLARTYGLPASQVTTWDIPADPALVAAIRKQVVGQLDTWHLSEAAFTVELVVSELVTNAIRYGDHPIRLRLIHDATTLICEVSDASHTAPHLRRARTFDEGGRGLLLVAQLTQRWGSRHTPDGKTIWAELPLTYE

SEQ ID NO: 15007 - protein, 1030 aa, Streptomyces avermitilis
MTVTRRSVLIAGTAAPAAGALTGIGGAPAVASAGAPGRHTVALRDGWRFALVNPGGITDPTGAYADAADPGHDDSGWREVAVPHDWSIEQTPTTQYGTTSGTGFLPGGLGWYRTAFTLPSALAGKRISVEFDGVYMDSYVYCNGTEVGRHPYGYTGFAFDLTDLLHTDGTTENVIAVKVQNRLPSSRWYSGSGIYREARLVVTEPVHVRRWGTYVTTPDITEERAVVRVRTTVVDASGAGSEVQVVSRIVGPDGRTAARTTSTVTVADQGTQTHELTVKKPQLWDFAHPHRYTLETELRVGGKRTDTHRTTFGIRRVTVDPDEGFHLNGTHAKIRGVDLHHDQGALGAAISIDAVRRQMTIMKSMGVNAFRTSHNPPSPQMIEVCEELGIVMVVEAFDCWRTGKTRYDYGRFFDEWCEKDATEMVLAARNSPAVVLWSIGNEIPDSTSTAGLAMADRIIGAIKAADDTRPLVIGSDKYRNVPAKGSAADLMLAKLDGLGLNYNTAKSVDALHAAYPHLFLFESESSSETSTRGTYQEPEHLNTGENHTPGKRATSSYDNNLASWTMSGEYGHKKDRDRKWFAGQFLWSGIDYIGEPTPYDVFPVKASFFGAVDTAGFPKDMYHLFRSQWTSEPMVHLLPMSWNHQAGDTVEVWAYANVDTVELFLNGKSLGTRTFDTKKTTDGRTYLETTEATGDDKTVTDGPHPGSYTSPNGSAGKLHLVWKVPYEPGELKAVARRNGRAVATDVLRTAGAPHAVRLTPDRSALAADGRALCFVTAEIVDARGVVVPDAEHLLSFAVSGGSLAGVDNGREESAERYQASTRTAFHGKALAIVRSGTKAGTLKVTARSEGLRTATATVRTTPARSTATTPAAEFRPDHPAAPDSPSADASYSGRPDTLPAAMLDGDPTTGWSNAFAKSATALLPAFSGARPEDWVSVTWARARAFDRVEVSFTVDATHTRPASVEVQVGDGDRYTPVSGATVDWATGSDAPTVVTFDAARGARLRLVLTSAHPGAADGAVRISRLEVPPS

SEQ ID NO: 15008 - protein, 625 aa, Streptomyces avermitilis
VPSCAVEGNPSVHTPHPPRPLYPPRPAMPPGESDESLGGQLRGRPEGAAPHPVALLMARHWESTYDYAVICLASSANVASIVTAGAFQQVVGRLMRSGSAAAVRPALLVAVRDTVREWSAEERISGVLPELRKPAGGRGMRAAKSLTPENRVLAERSFLTLPGLSRCLLWHTEVEAESISVPAGLSGIGTDTATAALEQAREQFREGCVRAHRELAPTKECRLYNRLLDVPIRRGGALLPDVQRHLLGCRFCRNAAEQLSHFEGALGGLLAEAVLGWGARRYLESRPGRTPYGGRARGVSGSGGRPGSGGRHRLLAQIPAPGRRTPVGERGARAVLTGVGIASAAVLATFLVTGLWSNDDGNVDPTASTSASGGRTTVLPTPGSQIPPTVSSPPDSAGLPTTPRQTRLRNLAADLCLDVRGEAKAGAGTKLAVCSSAWTQQWTYEKDGLLRSVADPELCLDSGAVDGVAELGRCVAESSAHGGDVRYDLTVQGEVLSRRKGSLAVTPGNTDPDADIVVKVRDGSDKQRWLTDSPSDQPESLSIAGTTPPSATPATDAPAATPAPTPVPASPGTRLTDAPVASSAPPSENYGERRSLTVTDTSTPEPVLPLTVHLPDLLGEIGVGL

SEQ ID NO: 15009 - protein, 325 aa, Streptomyces avermitilis
MTVTKNVLAVVPPHVGGRGAGAALASVFPGQARVTVVEATDEDPAALREAHVIITGLGPVTAEHIAAAPELQLIQCASHGFDYVDLDAARARGLPVCNIGSSGAEQQNVAEQTFALMLALAKQLVPAHTALVDADWALPRLQRSITELSGKTLGIVGLGHIGEEVARRAVAFDMRIVYAGRERVGAEREARLGGARHVGLDELLRTADYVTLHAPLTEATRHLLDADRLALLKPTAFVINTARGALIDQDALADALEKGALAGAGIDVFDPEPPTSALRLLRAPNVVLSPHVAGVTRETLVRIALAAVQNAADFVAGETPRDLVS

SEQ ID NO: 15010 - protein, 389 aa, Streptomyces avermitilis
MAKHWADFQYEIYLNGMTGAVPRLPTDLTRLEELTEQRLGPGPVGYVAGGAGNGSTARANRSALDRRRIVPRMLRDVHERDLSVEVLGRTLPAPLALAPVGVLSIMHPDAESAAARAAAAQGVPYILSSASSTPMERVAEAMGDAERWFQLYWAKDREVTRSFLNRAKAAGYTALFVTLDTPLLAWRPRDLDQAYLPFLHGVGTANYFTDPAFRAGLAKPVHEDPNAAVMHFVSMFADPGKTWPDLEFLRENWDGPIVLKGILHPDDARRAASAGMDGVVVSNHGGRQVAGSVAAADALPRVVEAAGDRLTVLFDSGIRTGDDIFKALALGARAVLVGRPYAYGLGLDGQAGVEHVVRCLLAEFDLTLALSGHAGPGTLSPDDLIEETV

SEQ ID NO: 15011 - protein, 153 aa, Streptomyces avermitilis
VPDMDEDEARRRFMAARVARLATVDTEGRPHLVPVVFARHGAEVVTAVDWKPKRSPRLKRLRNIAAHPAVCLLVDAYDEDWDRLWWVRADGRARILPPDAPEPRVREEYAAVLAVLREKYAPYRQRPPGGPVIAITVHRWHGWRAAPGADPTG

SEQ ID NO: 15012 - protein, 275 aa, Streptomyces avermitilis
MKFGVSTFLTDEGIGPAALGPALEERGFDALLLAEHSHIPVKRETPYPGGGELPRVYYRTLDPFVALGAVASVTSELLLGTGIALVVQRDPIHTAKEVASLDLVSGGRAVFGVGAGWNREEMRNHRTDPTERGRLMDERIRAIIELWTKDEAEFHGDFVDFAPVYSWPKPVQRPHPPIWVGGGSERTFARVAEYGAAWMPSGVPPKELGAQIERMRKTAGDRPAVVVYAAQHDRESLDTYAELGVERVLLYLPTQPEDETLRTLDELAEAVSAYR

SEQ ID NO: 15013 - protein, 158 aa, Streptomyces avermitilis
VAVDREEITVVGRIPEPRLTDGASAAEKEAAVQSRVQEFRERTRDERVAVAREAEHRFRRKVSWGVECGGERALFTQVAAPVMTRLRQPERQVLDTLIAAGVARSRSDALAWCVRLVQRHTDDWLAELRDSLEHVQRVRAQGPDADPQDSADSPAAEE

SEQ ID NO: 15014 - protein, 144 aa, Streptomyces avermitilis
MPNTARWAVTLTLTATAVCGPLAGASLATPNAAASGLYAPSALVLTTGHGQSAATATPERAVTLNCAPTASGTHPAAVSACAELRATGGDFDALSARSDAMCTRQYDPVVVTVEGVWQGKRVAYERTFANECVKNSYGTTVFTF

SEQ ID NO: 15015 - protein, 76 aa, Streptomyces avermitilis
MAVGTRRSGSGGTYVKFVLEVDLENAAWGEETATELGRILRYWGGNLHHYEMKPGDGSAVYDSGYREVGRWSLTSD

SEQ ID NO: 15016 - protein, 194 aa, Streptomyces avermitilis
VMAVAGAEAPALNAYDVQVHECSIRAATPGDLDGARAVMLDTVYRDFGTGYVPRWHGDIIDLAGAYLASPRHTLLVALDGSDGEVAATAALDSRGPAHPPNPRPLARRYPSGETAQLRRVYVRPGHRRRGLARRLVGELLAFAAADGGYRSVYLHTDPGIPGAEAFWRSLGKAVWDEREEPGGSGVVHFEVPFA

SEQ ID NO: 15017 - protein, 525 aa, Streptomyces avermitilis
MRFLGELDQRLFTRVAAARLSGADPALIRLSRAADHGRLWFAAAAVLATADGRTARRAAVRGVGSLALASLTVNTVAKWATRRPRPLLDLVPQIRHLTRQPHTTSFPSGHSASAAAFATGVALESTGYGALVAPLAAAVAFSRVYVGVHYPGDVLAGMAIGAGAAALTCRWWPPRQGVPERVRPTTHAPALPGGEDLVVLVDGRAGTGLPGAVLPAVERLRVLLPRAELVEFGPDDDFAALLAGAAGRAARRGGALGVCGGDGSVDAAARAAARHGLALAVFPGGTLNHFALDVGVPDFDDTAVAVARGEAVAVDLGVAAPKEGHDVLFLNAFSIGPYPELLRLRERLEGRWGKWSAEAVALARVLRTATPVELRIDGRPRRLWLLFAGNGHHVPDGFAPAFRPRLDDGLLDLRLIDGDRRYARTRVIAAALAGTLGRSRVYSAAPVSRVRLEGLGGTRNLAYDGEVTCAPDQLTLEKRGRGLAVYRPAVPCAEPARRARLATAMAHHRKRKRGRRLPADGGPSV

SEQ ID NO: 15018 - protein, 500 aa, Streptomyces avermitilis
MSQKTLTESTRTGAAQAPPAASSRRWWILAVVAIAQLMVVLDATIVNIALPSAQADLGFSDGNRQWVVTAYALAFASLLLLGGRIADLFGRKPAFLAGVTGFALASALGGAATSFEMLVTARALQGVFGALLAPAALSLLNTTFTDARERAKAFSVYGAIAGAGGAVGLLLGGILTDAFDWRWTLYVNVAIAVVAFAGGWLSLSNHRDATNSKLDVPGTVLVAGGLFALVYGFSNAETHDWGSPRTWGFLIAGGVLLTAFAWWQTRAAHPLLPLRILLDRSRGASYLAVLITGAGMFGVFLFLTYYLQLNLGFSPTRTGVAFLPMVGALMVTAQLGTTVLLPRIGPKAVIPLGFAIATVGMAWLTGIGTGSHYATAVLPQLIVIGVGLGMVMPPAMQLATGGVGPEDAGVASATVNAMQQVGGSIGTALLNTLAASAATGYLSGKDATSKLVRAQATIESYTTAFWWSAVFFVAGAVIAFLLYRPGKPEQAADAAPVVHM

SEQ ID NO: 15019 - protein, 188 aa, Streptomyces avermitilis
VSRDAPPPKDRGTMSTELTGTHLTLPDGRPAVRFSRVYDHPADRVWQFVTDPDELARWFPSRAEIELRPGGTITFSGDPNMENSTGRVIAVDVPGHLSFEWGGDELHFDLEPLDGKRTRCTLTNVLADAKAAARNAAGWEVCLAALDARARGERLEGPHAGATAPWKEIYRGYVEAGFPSGAPVPGLD

SEQ ID NO: 15020 - protein, 938 aa, Streptomyces avermitilis
MTAVHEGDLVLGALGSMGTPYDCSGLGRLDLEGPQVLWLVAAGAMDLFAVDAVQQGQWHHLGRLEAGSLLLGPVAGPQHTLVARPLRECVMRRISLRELYESGGTQTWSYDEYGNAQYVPPTTSPLEYALALGVGRGLSILFQAPMATERAAAPTDDDVFWMQVPPGSVQYGSLYGEEAAADLLMDPGVWQGMVDQQYRLLATLDRWIEQLERSHEHRTAAGIKAGEAVRVQADRTLLASIGKSSAKRTTAADADATYAACKLVAGAAGIALAEPAQSGTESDRLDPVERVAIASRVRTRAVRLDGRWWRDNTGPLVGHRALSGAPVALLWRRGGYVAVQPSSGRETPIEKANAEEFEPRAVMFYRPLPERGLGPLRLMRFSMRGTGGDLRNLLASGLVTVAVGALVPIATGKVLGEYVPKAQHGLIVQVCLAIMITSVVSAAFMLLQNLTLLRMEGRIEATLQPAVWDRLLRLPTKFFTSRSTGELASAAMGISSIRRLLAGVGPTVAQSVTVGAMNLGLLFWYSAPMALAAIGMLVVIAGVFLGLGLWQVRWQRRLVVLSNKLNNQAFQTLRGLPKLRVAAAENYAYAAWAGEFARSRELQQKVGRIKNLTTVLGAVYLPLCSLLMFMLLAGPARGAMSAAAFLTFNTSVTMLLTSVTQLTGAFVSAVAALPMFEEIKPVLDATPEVRTASTRPGVLSGGIEARRLSFRYADDGPLVLDDVSFEIKPGEFVAIVGPSGCGKSTLLRLLIGFDKPVSGSVLYDGQDLGALDQSAVRRQCGVVLQHAQPFTGSILDCICGTEPYTPEEAMAAAEMAGLAEDIKRMPMGLHTIVQGSGAISGGQRQRLMIAQALIRRPRILFFDEATSALDNETQRTVIESTKALNATRVVIAHRLSTVMDADRVIVMEDGRVAQQGPPAQLLADTGGRLHELVRRQLA

SEQ ID NO: 15021 - protein, 749 aa, Streptomyces avermitilis
LAAPVTAPQDTLPPSARGRRRAAPPKRTVPKSRQKTVRTPTVLQMEAVECGAASLAMVLGHYGRHIPLEELRIACGVSRDGSRASNLLKAARSYGLTAKGMQMDTAALAEVKAPAILFWEFNHYVVYDGMGRRFGRRGVHINDPGKGRRFVPMEDFDTSFTGVVLVMEPGPDFEKGGRRPGVLGAMPARLRGTSGTMPAAVLASLLLVAVGAAMPALSRTYIDMFLIGGQTSLLGVLFASMGTCVALTIALTWLQQANLLHGRVISSTLSSARFLRHLLRLPVTFFSQRSPADLVQRLQSNDAVAETLARDLAAAGVDAIVVVLYAVLLYTYDPQLTAVGIGVALLNVVAMRVVIRLRATRTAKLRADSARLTNTAYTGLQLIETMKATGGEDGYFRKWAGQHATTLEEQQRLGVPSAWLGVVAPTLATLNSALILWIGGLRAVEGGISVGLLVAFQALVTRFTAPITRLNGVAGRIQDFAADVARLKDVENFQADPLYARPGGGESTRRLQGHVELENITFGYSPLDQPLLSGFSLTVGPGQQVALVGGSGSGKSTVSRLISGLYAPWEGVIRIDGQRLADIPRGALAASVSFVDQDVFLFEGTVRDNVALWDPSIPDDAVVAALQDADLYDVVTRRPGGIHSRVEQDGRNFSGGQRQRLEIARALVRNPSILVLDEVTSALDAETEQTVIDNLRKRGCACVVIAHRLSTVRDSDEIVVLQHGTIVERGRHDALVTAGGAYAQLVRER

SEQ ID NO: 15022 - protein, 268 aa, Streptomyces avermitilis
VQFRQQALAKLQSPEELDLPVRFARPQGWLVLSVTVVVMAAASVWAVTGSVASTVGAPAVLTHGEGSYVLQSPVAGQVTAVLAKEGERLPANSPVLKVRTDDGDTLVRTVAAGRITALAATIGAIIQTGANVAAVEKVAHASDPLYATVYVPAENASSIPANAAVDLTVQSVPTQQYGVLHGHVKSVDRTVQTRQQIAAFLGDSQLGEQFTKKGRPVAVLVRLDRSSGTKSGYQWSSADGPPYTLASMTLATGSIRLADQRPVDWLLP

SEQ ID NO: 15023 - protein, 71 aa, Streptomyces avermitilis
MNSTPQVVTAEISDADLDAVSGGLSLNAVGTVTGLVDGVAPVSAVVGTAVGTVEGVTGLNTAPVTNLVAGL

SEQ ID NO: 15024 - protein, 146 aa, Streptomyces avermitilis
VWAGGHHHAMTVTPAQAGKILADNFAPWVLDLGLSVEEVDDRRVVLRLPWSARLAREGGALSGQALLAAADTATVIAVSAARGGFVPMTTVQQSTSFQRAVTEADVLVEAVLTRLGRRMAFADITMTAEGRDEIAARASTVYALLD

SEQ ID NO: 15025 - protein, 452 aa, Streptomyces avermitilis
LSHKRIPKRKAAIAAGSVAALGAAALLLPNANASQTDSGDSTPRTFKSADVSDLASQLASQLGDAFAGSYYNADKQQLVINVVGDDSNVINQIRKAGAVPNQVQNSTSTLQAAAKTLKTDATIPGTAWAVDPKTNEIRVTADSTVKGAKWDTLTATVKSLGSGVATVKKSAGTFKTFVSGGDAIFGGGARCSLGFNVTAGDGSPAFLTAGHCGVAAAAWSDSQNGQPIATVDQATFPGEGDFSLVKYDDPNTQAPSEVNVGNGQTVQISQAAEATVGQQVLRMGSTTGLNDGNVTGLDATVNYPEGTVTGLIQTDVCAEPGDSGGSLFTQDGSAIGLTSGGSGDCTVGGETFFQPVTTALEAVGATLGAGGAAGAGDESAAPGDEATDPAGEATDPAGEATDPAGEATDPAGEATDPADQSGNDGAEQSGNDGADQSGNDGADDGSGLVSSN

SEQ ID NO: 15026 - protein, 712 aa, Streptomyces avermitilis
VSDGQASRREPSALAPVGGPLLSLALAALMEDVHAHSGAVYLLAPDEPVLEMAVMAGLPRAFAAPWERVGLSAPLPVAEAVRERRLVWVNGEEQMAGRYPRVAVVLPYSFALAALPLACADTVYGALFVTWPDSHPPELSSRERDQLGVACDRLATRLAHAVEKGHPVGPEPDLPTPGATAAMAGTLGAGEAVRMAARLPYGLCALDLHGRVGYANAAACELLGMPVGDLLGAQLWASLPWLNDPAYEDCYRAALISQHVTSFVALRPPGDWLSFRLYPSTNGLSVRISRARAVSAMARAEPRHGEATTRLVTISHVLSLAGALTEAVGVQDVVQLIASEFAPTVGSQALILLGSRGGRLRVLGHRGYPDAAIAERFDGEPLTAQIPGAHVLTSGVPAFFESRRQLEHLYPARRTTPDGMAAWAFLPLIASGRPVGTCVLAYAEPHAFPADERAILTSLSGLIALALERALLYDAKHQLAHGLQAALLPHSLPSLPGIEAAARYLPATQGMEIGGDFYDLVATVGRAAAVIGDVQGHNVTAAGLMGQIRTAVRAYTTVGQAPGQVMRSTNRLMIDLGTDLFASCVYLRLDPARQRVVMARAGHPPPLLRKPDGQVRVLDLAGGPLLGIDADATYTTTEFALAPGSVLALYTDGLIESPGIDIEDALAELGERLAESGDEPLDELADRLVRHTATAEERLDDIALLLLRARAS

SEQ ID NO: 15027 - protein, 223 aa, Streptomyces avermitilis
MGTRSGRVERLTADGELRADVIRVLLVHDACLVRSVLAEWLRREPDLGVYDTTWRGAPGRVRSVRPDVCAVDLDCADSHGVPPLADVCGRGAGSLTAPRLLVLAHANRPGLLKRAAEAGALGYVDKEGSPERLVSGIRRVAEGERFVDDSLGFGFLKAAEMPLTRRELSVLSLAAGGASVAEIAGSLHLSHGTVRNYMSAITRKTGARNRIDAIRISQGEGWV

SEQ ID NO: 15028 - protein, 631 aa, Streptomyces avermitilis
VKELTLLLRERWRVVVRLAAWSVLETGQTFLLGYALARALDEGFLSGRAGVGLGWLGIAGAAVLVGAFGTGRVYGGVAALVEPLRDRLVRRVVDRGVREADGGALSGLTQQVEIARDTFAGLVMVSRSFVFTTVGALVGLFSLAPLLLLVVAPPLAAGVALFVATLRPLARRQEEFLVADERLAAHLGAVCPGLRDITAGGAEEHVAADAGQRIDAEVRAARSLAHRGVLRVAALAVGGQLPIVLLLATAPWLLARGVSAGALVGALAYVTQSLLPALQNLVHGLGTSGSRLAVVLRRLGPGIAAPPPATGGIRVPPAAVPSDTPALVLSSLTFAYGPASDPVIKDLDLTVPRGTRLAVVGPSGIGKSTLTGLIAGLLEPRRGTVRLCGHPVPGHTASALRVLIPQEAYVFGGTFEENLTQLRPDPVPGAELLAAAEAVGLAPLLERLGGPFARLDPAALSAGERQLIALTRAYLSYASVVLLDEATCHLDPAAEERAERAFAERAGTTLVVVAHRISSALRADRVLVMDGRRTEYGDHDELLRRSALYRDLVGTWSPTVPASSGAASVPVPAPARRPASDPALPLRDPDGVDPVACPGLARDGGHVVAHGAVGQMETSGDLRDGGAPGGE

SEQ ID NO: 15029 - protein, 595 aa, Streptomyces avermitilis
MRGHSRMKTPSGHGAAPDGTGAADEAAARTLLRSAARHSRSRCVALCLTTAAASGASLLLPAALGRALDLLLTRPGDAAGTHWVLWCTGLVLLIALLDACHTVLAGTTDARATAWLRQRLVGHVLAVGPRAGERFGPGELVARLVGNAAQAGTAPATAATLLAALAGPVGAVVALGLIDPLLAAVFLGGAPVLTLLLRAFARDSSQCVARYQDVQGRIAGALAEAIGGARTIAAGGTADKEVARILRPLPELSREGRRMWRVQGRAAAQAVAVAPLLQLGVVAVGGVLLVHHRLSVGELLAASRYAVLATGVGVLVGQLSGLIRARAAARRLGEVLTEPAPVYGTRQLPPGEGRLELRSVTVRRGGRTVLDGVDLVVPAGRTVAVVGRSGSGKSLLAALAGRLADPDDGHVLLDGVPLRDLDRTALRRAVGHAFERPALLGDTIEDTIAFGIPSPPPDRVRQAAATARADSFVRRLPDGYATPCAEAPLSGGECQRLGLARAFAHDSRLLVLDDALSSLDTVTERHITEALLRHTPGSSRLIIAHRVSTAARADAVVWLAAGRVRAVGTHAELWRSAAYREVFGSSGTERNGGAG

SEQ ID NO: 15030 - protein, 38 aa, Streptomyces avermitilis
MALLDLQTMESDEHTGGGGASTVSLLSCVSAASVLLCL

SEQ ID NO: 15031 - protein, 882 aa, Streptomyces avermitilis
MDKRYEVYALADRHFYETPDRLSVGASGAAPLYGPACREVPDGWRSARIGDWLTFTPVDDAGTALPGPAQGWKIHASATRANAERIATDVWEYCVPRRIPFKFVPGPHLLHLRNAKYAGRDTSGKFVTIYPADEEQLHLVLRELGERLDGCEGPYILTDLRWNDGPLYVRYGAFARSFVVDERGSLVPAVRDGEGTLVPDRRQPSFQVPEWVTLPAFLEPQLAARNTTTVGDLPYRIEKALHFSNGGGVYAGTDTRDGRKVVLKEGRPHAGLASDGADAIARLEREKYALEQVSGLGVVPEVRDWFTLGDHRFLVMDFLEGRPLNSFFAERHPLLTPDPEPDAVAAYTAWALRIHRAVEQAVHAVHARGIVFNDLHVFNIMVAPDEESVSLLDFEAAAPIEENGRQVVAHPGFFAPPDRTGPDVDRYALACLRLALFLPVTTLFVVDRAKAAHLAEVVAGQFPDVPREFLDEAVAEITGRRQAPDPEGDKVSPSATSRPSPVRPTTSYTAPVDPGDWPYSRDSMVKAILASATPERDDRLFPGDVAQFSDGGGLGLAHGAAGVLYVLEQTGADRYEEGERWLLDHTDPAPVGTPLGLYDGLAGVAYVLDLLGHRQRALDLVDGILRERWQNLSSDLHGGLAGLGLVLGRLAHTTGETQLRERAAEAARLLVRRLAEPRPAPPRRRAGLLRGASGIALFLLREYEETGAPELRDAAAEALRQDLECCVVQKGGGLEVDEGWRTLPYLGDGSVGLGMVVDDFLALGGDDGHGTFEGARSGILTAATSRFYAQPGLFQGRAGMILHLSRTSAPGATPERLAEQVAGLGWFAMSYQGQLAFPGHQMMRLSMDLGTGTAGCLLALGAALDGQTRARLPFLPPLRGAH

SEQ ID NO: 15032 - protein, 847 aa, Streptomyces avermitilis
MPEWSQGLRPRPGSAVIADVASERVAGRGARTSRAELALKSLGPDLEPRERLHRILEQVLVFAGAMVAAAYTHSEDGDQLCLAESAGVPRSLYGLRDSYPLTGGTPAADVHRSGQPLWLTPEDLGRCADARRLPNGDFSLAVLPLGDGGCLAAVSERAGGFDADDRECLRLLAGSVACPAPAAPALTGSTDSGEPADSSFSLAMDSGRITVDDEVLELFGIGPDEFDGKVETLLALTVPEDLPSLMSVVEPGHMSIGDRELEFRILQPSGGPRWLRLRGRLLPAEQGRPALLVGSVADASRMRAGVSDVTRVQRLAAALATAGTVREVGRAVVTALRKPLQADRIALAELEGDRLVVTVLDPPEPDSWPELWRSEWRSEWPDAPVRAMPTLASALSEGRAAIWPAGTPLEPAVADVGPGGLAVLPLAAGGRMAGICLIGWDAPHDFGPDERALLTAAANLAGQALMRAHAFDAEHELVGMLQRSLLPRRLPRLPGAVAVARYLPTTAGLELGGDWYDVIPLPDNHVALVIGDVQGHNAQAATLMGQMRTALRAYAVEGHPPDVVVSRANRLLMDLETDLFATCCYVDVDMEEGSAWCVRAGHLPPVLRHPDGSTEVVESEGGPPLGVVAQADFPMSPLRLQPGTLLALTTDGLVESAELDIEVGLARMAAELAASDPAHLGLVADALLAGANRSDDVALLLMRYEGMALRPLRESWTVWRVPEAVRHARRFTRRTLRSWGVAEEADAALLAVSELVTNALVHTDGRVRLDLTLINHRLRIAVADSSPRTPIKPTSIGWEATGGRGILLVEAMSAAWGSVPVSGGKQVWAEIVLESAPRVRDATGAAP

SEQ ID NO: 15033 - protein, 167 aa, Streptomyces avermitilis
VRLLLMSDTHLPRRAKELPARLLAELPRADAVIHAGDWVDAATLDLLESRSTRLIGVYGNNDGPDLRARLPEVARAELDGLRLGVVHETGAAQGRERRCADRFPDLDVLVFGHSHIPWDTTTDTGLRLLNPGSPTDRRRQPYCTYMTAAVTGGRLTDVQLHRLPPRS

SEQ ID NO: 15034 - protein, 368 aa, Streptomyces avermitilis
MRDILPALSRWYAAKSPFGLATVVAVGRSAPRDPGAAMAVGPDDEVVGSVSGGCVEGAVFELAQEVVDSGAARLETFGYSDEDAFAVGLTCGGEITLLVRRVTPDEDPSFGALAESVAAGRPATVATVTDGPAPRGASLTVWPEGVAGSLGSTGLDVAVTADARGELALGATGLRHYGPNGERREDSVTVFLHSFAPPPRMLVFGAIDYAAAVARIGDFLGYRVTVCDARPVFATPKRFPAGVEVVVDWPQRFLRGTTTDARTVICVLTHDLKFDVPLLEEALRRPAAYIGAMGSRRTHDDRMKRLTDAGLSRHELSRLRSPVGLDLGARTPEEVAVSVAAEIVALRWGGSGTPLTATGGAIHPPKPR

SEQ ID NO: 15035 - protein, 663 aa, Streptomyces avermitilis
VHTLNLGILAHVDAGKTSLTERLLHTVGVIDEIGSVDEGNTQTDSLALERQRGITIKSAVVSFAINDTTVNLIDTPGHPDFIAEVERVLSVLDGAVLVVSAVEGVQAQTRVLLRTLQRLRIPTLLFVNKIDRGGAGEERVLRAIAARLTPAIVPMGRAAGPGSRDARFIPYEAHDPGFGARLLDVLTEHDEELLAAYVKDTVSYGRLRTALVEQTRQALVHPVFFGSATTGAGVPELIAGIKELLPAAEGDPDGPVSGTVFKVERGPAGEKIAYARLFSGTVRTRDRLLFRDGEEGKVTAISVFDQGSAVREASVAAGRIGKLWGLAEIRIGDTFGEVPKAAEPSRHFSPPTLETVVVPGGRSDGGALHLALTQLAEQDPLINMRQDEIRREISLSLYGEVQKEVIQATLADAFGLDVTFRETTPICVERPVGTGAAVEFNGKGPHPFLATVGLRVEAAPVGSGVEFRLEVELGAMPYAFFKAVEDTVRETLGQGIHGWRVTDCTVTMTHSGYSPRQSHAHQGFDKSMSSTGADFRGLTPLVLMDALRQAGTRVHEPLHRFGLEAPADTLGAVLPVLAGLRAVVRTTRMREAVCVLEGLVPAAHVHELGQVLPGLTRGEGELETAFDHYAPVAGGTVPNRPRTDHNPLDRKEYLLNVTRRVGT

SEQ ID NO: 15036 - protein, 647 aa, Streptomyces avermitilis
VRKNAKLTHESEVLTFHRSARTVVDMSKLRARLLGVLVSLTGLLGATGAQPAAADSLPDSLWFDASASAAFTVQNGRFSDGLGREVVLRGYNVSGETKLEENSGLPFASVADARKSATALRTLGGGNSVRFLLSWAHAEPVRGQVDTAYLAAATAQMRAFLDAGIRVFPDFHQDLYSRYLFNSGSWYTGDGAPEWAVDAGDYPAESCGICLFWGQNITQNGAVTQASHDFWHNAYGVQDAFLATAQATMAYIQQNLSADEFNGVVGFDPYNEPHAGTYDSGETSRTWEQNVLWPFYKKFRARMDAAGWQTKPAFIEPNLFWNANIDFQKQEGGLLDAGTLGPRYVLNTHFYDQKAISGVLMWGKAADGQYATDFGKVRDRAAGAGTAAVVSEFGHPLSGSVSDKAPTVVKAMYQALDSRLPGSTWWSDPTGSGPVLSGAQWQWDIYNGRHHELENGNPDKVLTSGDAWNDEDLSAVSLNDSGTAVLRQDARLLDRLYPSATAGATVAFTYEDRSRDGSTTLTWNPVPSSLPNVSRLVGSGQYGLLVWRSNGSTAPTELHLPASFPAASTTVVSDLGTTSGLPAYTRTTPVGHAAEPGGTGSHRLLLTAADSGTVHYALVTNGATAPSAGLLSAARAELSSWAATKVG

SEQ ID NO: 15037 - protein, 416 aa, Streptomyces avermitilis
MSVLRSRHLLAIAAALALTVGAGATTASAQDSAAALREVMFVGNNWDGTADVIKSTGDLAKIGRINVVPDKEQRLAQINADPIKWIYFMAIRNGVGEGHDQLVDDMYSTPDGRSMVVSRPSFADVVSIDLATGKVNWRFPVSGYRSDHMAVSPDGTRVAVSASTANTVHVLDIDTGKQLGSFATGDKPHENIFTKDGKYIWNMAIGDVNTSLDAPWQDWTKGDRRITVVDATTFQQVKVVDMRQRLDAIGLTDYSDAVRPAVFSPDESKLYFQVSFFNGFLEYDVASDRITRVKTLPKNPATSEDRTTWVNDSRHHGISMNPSGTKLCVAGTMDDYTSVVDRSTLQEGPLVPASKPYWATVSGDGKDCVVSESGADQVTAIDFATGQKTVSVPVGDHPQRVRLAHVPADWTGPSAS

SEQ ID NO: 15038 - protein, 219 aa, Streptomyces avermitilis
VTGRLRQPTGRYGGKSAEERQAERRGRFLDAALQLFGDTPGFRATTVAALSEAAGLSTRQFYEEFRTLEDVLAALHLQVNDWAETAALAALADARHLPLAERADAIFRAYAANVTADPRRIRITFVEIIGVSPRLEEQRLQRRSRWVDLICAEAAAAAACGEAAPRDYRLAAAAFIGSVNGLLHDWRAGWVDATLDEVVDELVRQLLGILRPAGWQPDA

SEQ ID NO: 15039 - protein, 92 aa, Streptomyces avermitilis
VHKWLLAHPRFRLHFTPTYSSWISQVERWFAELERRCLERGVFCSLDSLKAALEEWIKVWNEEARPFKWTKTADQILDRICRYCSRISEPAH

SEQ ID NO: 15040 - protein, 366 aa, Streptomyces avermitilis
VTVTSMPQPTLPAQRVPAPAKEAEDVILGVDTHKDVHVAAVITTLGASLAQQEFPATAIGYRQLLTWARSFGVLRRAGVECTGSFGAALTKMLRGQSIDVIEVNQPDRATRRKRGKTDAIDADAAARAVLSGRATTVPKSADGPVEDMRVLRLAKESAVKARTQALNQLKAVLMSIDPDLRELLTRLSNPALVATCAALDADYRGEAVFTMRLLARRVQHLSDEVKELTRRTTRAVRACRPQMLDLVGVGPDSAAVLLIAAGDNPDRLVDEASFAALCGVSPVEQSSGKTQRRRLNRGGHRQANAALYRIVQTRIRWDERTQAYLRRRTAEGMSKREIIRCLKRYVARELYRHIQPRATNQVPSAA

SEQ ID NO: 15041 - protein, 304 aa, Streptomyces avermitilis
VGMGDSRLAPLVLSDAERRMLQGWARRRTTAQGLALRARIVLACADGGSNTAVAARMGVNRGTVTKWRARFLRDRLDGLADEPRPGVPRTITDAQVEEVVVRTLEETPEGATHWSKRELARAVGISPASVLRIWHAFGLQPWRTETFKISPDPLLTDKIRDVVGLYLAPPANAAVFAVDEKPQIQALERTAPVLPMLPGVPERRSFDYVRHGTVDLFAALNTATGRVITKLSAQHRAVDFRDFLDEIDRQTEPGLGVHVICDNCEDHGVPQGGPEPDPCDNWPQLPWSGTVGPGLLRCVLPPAR

SEQ ID NO: 15042 - protein, 236 aa, Streptomyces avermitilis
VRAVRTAHPDALPPRRARPSCAEGWITANPTQARLGRFASDAQPKHGKDYDDHACQRPDHPTHTLRESPAMRRSTETDSRIPFPCSPTPTACRATPQLFAHDIGDSDTARAEQAKAACQACPIATACLKWALANPQLTTEGIWAATPPRQRTALRHQLADRLGSDWAAVVADHDRRLRERREAARHTPLTVRQDRIVRMDRDLNGPMPRPRRSLTPIQQHRDVAPPPGRRRLVSWF

SEQ ID NO: 15043 - protein, 256 aa, Streptomyces avermitilis
MITARGAPHGLHSSGCASLDSAPRGENRRTMMPATTALRQRSRTLIVAATVPLALAALLADDVRVRRQLDAARKDPLTGLPGRDVLMDRTARLARTHREHLHVLVADADGLKSINDTLGHAAGDTLIAAIGHRIGAWAAVRGGLAARLGGDEFAAALFLPPAATVREIAVLRELLAQPVDHDGQTLRPAVSIGAARAVDLPDTASASRLLRGADMAMYRVKTREKPSGYVATRQDAYTPTVHGRRPGRPGTHLTVG

SEQ ID NO: 15044 - protein, 153 aa, Streptomyces avermitilis
MTTVVPASLTDKNLDAACAAVAGEIGRTDSKASLLLAFNGAVLAGLASVADKDLPQPTKTFGALAVLTLGIAAALLLLVVRPRLRGDDRASFPYWARLDEDEIRACMEGDRRASSVRVLSSLAVRKYRHLRRAVDLSLTAMALLAVAAAGAAL

SEQ ID NO: 15045 - protein, 173 aa, Streptomyces avermitilis
VRSRDRDDHLMMRGAFDDVPVTALFPLLEAADVDSLNQAAGTVDTARAGRDTADWEWALEHAGFPGTQLGTPVVLGLDVIEHAEGGDQLEFLLQVVWTDLGRLAVDTAVNVACWCETDHATHDIDALRLVVGEETSLPEAFRAGAERLTGWLADPHDADHWRAKAGLPPRWVP

SEQ ID NO: 15046 - protein, 181 aa, Streptomyces avermitilis
MSTRLPSLGRPDPTTAAPSAAPPLSLEERLTLVNAAMTARLDEAAIAYEVNTAHIETKPIDLTDVVTGPLNTGPAPLPDLYPTPVAALLQRAHQRLVSGGWCKDALVDADGARCMLGAIRIEAGGDRHLEADAATVLLDAIRRQFGDDVDSVPGFNDAWGTGRVPMRMLEQAASLADARGL

SEQ ID NO: 15047 - protein, 62 aa, Streptomyces avermitilis
VAFSVSAAVLLAVIVAVLMKGGYVRFGSMLACTLLGFTLAATGLAPLINSALTSLAGLISSL

SEQ ID NO: 15048 - protein, 811 aa, Streptomyces avermitilis
VMRRMPTRAKTELAAYGASTAALAVLPSMELLPAHASVAAISGVSTWWLYQRVKAGDFRKAIRSGQRLLGPLTGSAVYTAAAVAPGNSWWEIPLALGWGALMSAWLPASRSTWTPPGDLTTVYPSGFAGLVMRLWDQHEVAPQTRLENVQQIVSASHPDFSCDIVAPQGKPVGRIEADAIAACFGVPTLAVSLRETEHGPGRIRLTVAPTQEGGRSIDDLWSALISRPGGAIPGSTIVRVERQPARGQLPARGMILAQVEPGEVARVNYDQLCSAFGVKAEEMRLVTESRGNEVLVTLYEAAPLRVARRATRALLTLDAYGRYTIGTAHDGTDAKVHMRSASGTFHGFLVGVTGSGKTVSLALMCAAWALAGMASWVTSARPDAQMSAVGRHVDRQGSGAIFTWWLLKAAVALMDIRGQMNEEAGHDYSPHSPYPALTLVLDEFNSLVGDDLFGDDIAQMTDVLAREGRKFGIGVIFAGQSLNLDKLGGSSSLRDQVQGGIGVVLRITGGIAARQATGGLAADTDLPPIPDRLGAHMSLMDRMLGTATDVPGETTQGMGHTVTGSDATMMRTLYVHLPDDGSPDGLDEIFPESGAINTLTDREIEALSALGLWHEWTMPPPTGKEDDDADGGGAAFIGSFTPPPPAARKPKKTTVKDKILAVVDREMTAKEVRDQVDAAAGTIRNVLSDLVADGRLKQVDHGLYAPAATDVTAAPDRDSPDSEQLPEGVDGELLMLAADLVVTTRFGSQSMLQRKLRVGFALAGVLLDALEERGLVGPADGSKAREVLVPVGADEDVLRELRADLGPVLQD

SEQ ID NO: 15049 - protein, 134 aa, Streptomyces avermitilis
MGEIAPAVAADGAANGYLSIVTKFTALQKAAAGLFEHAEQLAQRMRVNADSAVVVAELCASAEADARHVAAVAEVGEAFGQVVGGCKRLLSSAEQTHQAAIEVKAAHQAEYGPIHAAATASRARQAKPGFYRPI

SEQ ID NO: 15050 - protein, 716 aa, Streptomyces avermitilis
VRGAPSPSPAVTVRGGPVSDDEPPDNLRHLPRIGSPPPPPVPPAPTLGGTDEDSVTDPGPVRISAFDAPEVPHAPPPTAGAALRSEGLNEGEQPPDAGAPRAGALSLAAILAIALAAFEGLQTWIQESGPRRAEAAAHQREMELLAAKAGADATRHGAEADAARAKAHRGGGVQSSRDYGRSALGRGSGGPARGGGVGPGGSRGGGRGLFNGSPQGSSGRFGQGRSGAGLFGVGSRNGAHRGRSDGTAGRGSGGGRAGAGLFGGGGRGPGAGGGRGNANGKGSGKGQGSPGPGGTSGGTGGSKGGGGAGRRSPRQAVADWWGKGKHPRPAGAGGGSQQKGAAHDRAAAIQNALKKTRSGKGGGATAPTFWEAAGDRLQDRWKNRQARNPASTDAAGKTGNGGAAGTKGGNDGWSPNGRVTFRSAVFEAVNERWAKRRDRWKAQAGPRTGRRRSPNANGPTSPPSPPGSGNGGGPSGTSGPGAGKGPGPRYAGPRSSPFDTSSGPEITITVEQVDPPGTHARRWEPDAIAPPRRQLPAQGPPALSRAPQRPAGTRPGTTRRKDPIPMPPSASSSAPVIQVTPPPANAMVGRHATEISLDGAVKALTLLTTAGMETYDDCQNLARQARRLFAELEVMANDLANNHNITGARTVRAMGVLMESVGMLAVNANRMAKAALNAAELAEAEETAMERDYRPTQTAALDAGLAAPSARIHNEN

SEQ ID NO: 15051 - protein, 73 aa, Streptomyces avermitilis
MAGPPLSPRKAAHWNSRFEQARAQGERGPEEFFRVWLDLVKVSAIQKARRTGDHGVFNALSAELERIYRDHCQ

SEQ ID NO: 15052 - protein, 168 aa, Streptomyces avermitilis
MSKDIASRVTTGVQALAVPGQREGWQAQHRGSLLSDAQAYDALADAVQADLKGRRLDGDLPWGLSAASRARKRVKPLRDTARAMRRAAKAINSVVAAYEETQPDVVLRRREDKALKKAQRKQNVQVTAYNSANQTLQRLAPGTEEGEPAGQARLLGDFFGPGQQRRGA

SEQ ID NO: 15053 - protein, 557 aa, Streptomyces avermitilis
VTITEVPQRAAPDTPVSRPPTAVSDAPPTVSGAASNVSRTQKRNAIKPAHDRLMTVLSVAAAIGGPLIGAIGFAMSYSTLAKKALTWGFSADLAPWFPVGVDASIIVFLALDLYLIRKDTPWPLLRMAAHGMTFATIWFNASSQGHIAGDPVRAASHGVMPLLFVIGVEAARRLFIKKTQLEAGTAADRIPLHRWILAPVATPRFYRRMRLHGIRSYPEMIRRQQDLTAYEQWLKRKHGDLSKASEDELLPMTMAAHGYTVAQALALPEQQEREAEARAEEAERRRLDAQTRRELAQKQAEARRLEADGELETVRARVEGTTAQARAHARAQASAAERAAELEEQALETAVIAEARAREAAAERQASQEREAKAAADARAAELERQAAEKRKLAAEADRVAVAEAQAVETVEIAEARQRAAEADRAAAETERAAAETRRRATEAERLAAQETERRAVADANTQAARRREAETELAAAETRLAAAEIERRAVEIEDAAKLTPRQRAVRKVARMILAVDGMADRLPLAEIQRELVVTSPGTASEYRQEAAELVAGGYRP

SEQ ID NO: 15054 - protein, 266 aa, Streptomyces avermitilis
MVHTIPLAHALDDSHLSPAAPAPVAPAPVDAAALLAAGTARYHHPHYLRVEQNGPDQVRFLFREFTGRESEPSSPLEMYRDPALTSEQRTMIGHQYTAARVLWSKRRMREQAAPLLETAALRWSAWTIAHDTMMSRFAEFATLPDDRWRSQVLRLLDAHRVARQMAADWDDIAEQLSVVVDDQHSAVDDWSDEVDLAVVAAELGVDIQGWLVDHVSAYRATPYYQHDTPLVARLVKTIDEQRARLAAVAHLTADHDTGRQLAPNRF

SEQ ID NO: 15055 - protein, 58 aa, Streptomyces avermitilis
MPDDLYRRYQDAHTTHRQHARTCTACTDTSRCPTGQRLYESFTRLQDAYLNGQRQQRR

SEQ ID NO: 15056 - protein, 244 aa, Streptomyces avermitilis
VPRGPADHAPPQALNRPGRTTTAPAISQRGGRGRGYSYDNPHRPEQLRYSLRCASHTAPPSRQERRTAECAGRTPRPTGGAKMRRTPREAPLGVLCRRSLAKGLTCMPSMTALITPAESTSRPPLPRRPIPHERTPDRPTPSGGRPHPRTAQTTGDPVIVEALRRVVDDQIGPRRAGAIYQNTDGAFEVLAVIRDPERARGLLHRRCAQWALIVRDVLRPDGEPFAIGSVWTASDHLVREAVTR

SEQ ID NO: 15057 - protein, 186 aa, Streptomyces avermitilis
MTITSAMPTAKERPRRTRTKRASSRPALKLSQLLPSHIDLREPLKAVLVCEDCKTWVPVTGMQSKVQKLVPHHIGKAEEADAIRCRSSNRRIEWDMTIPEWRQALADAVTEASSRQSTTVLPKAFSPQTDRTLRARAERTLAGRVADWDAVLPRVAATDKNRWATPAGDAPTECPAVPLTTLHPKR

SEQ ID NO: 15058 - protein, 109 aa, Streptomyces avermitilis
VSTGFALTVRFSLRDTEAAQQFDALVARTAEGIRTEPGTLVYVAHTPVDEPLVRVFYELYADRDAFQAHEEQAHTRHFLETREQFLTSTDVVFLNELEELSKRPGTEGP

SEQ ID NO: 15059 - protein, 417 aa, Streptomyces avermitilis
MKPTGKDVDPQDRVFGQRVQKLRKEQRRTQAEFAAALGKTSSWMSQVERGIQPVQRMDLLQQIADELGVSVQQLRPSVADGSGPSQHPAPLSLSNDLDETRRLISGHPALRALLASPGTEGARSVEALRKDVDDLWELTHAARMAQVSVLAVELLPELERTARMAPDETRSELFLLLSRTYQALSAAFVRQDEADAAWVAADRAIFAAERSGDPLHVCAGVFRMTQAFVRLRSLGQAEHAARTAIDALEEQGGRSPQALSVLGSLHLALALVHARASARAEAKEEIAKARAIAAQLGENRNDFNLEFGPVNVEIQAVSTAVDLGDAGEALDIGLAIDAEGLSPERQGRLLMDLGRAHAQRRHGGEALDCLLRAEAVAPETIQTHQAARAAIRELVLVAGANASRDLLELAERADALD

SEQ ID NO: 15060 - protein, 355 aa, Streptomyces avermitilis
MGFRASAIGSGIMATTEASGVGKHLGWRPERLREQREAHGLTLEQAGEQLRALAEQAKLKGIPAANPQTLWQHEQGEVYPGPHYRRAYCLLYRATDPELGFRNALPGEDTQFKLTPMDDQRNGSHVLAVERALLQIGGTAEADPLRLQQRILDAWKRRHTGGDPHRPSVVLVGGFAGSGKTEFARFLTQLTGWPLLDKDPLTRPLVEQLLVALGGDANDRHTDLYRERVRPVEYDCLMQAAYANINCGISTVLTAPFIGEMTSEAWMNRLINKCNALGVDVSPVWVQCDAESMREYIGFRSAARDAWKLQRWDEYMATVNLELRPVVPHLVVDNRLGTAISLADQARHALRAVHG

SEQ ID NO: 15061 - protein, 190 aa, Streptomyces avermitilis
MSSKKLGVILYGPPASGKDTVAQALSELDARYGQFARLKVGSGRTTRYRMGTAEQLHDLEAAGAAIYTNSRYGNTYVIDRPGMDSAFEAGVPVVHLGQIDGIRALVDGYTADWAVVLLWCSQEVTAQRSAGRGDSDTTARLAAWQATREDLDAHPDMRWDLTVDTEATAAEESARLIDQLLHARAGVTTA

SEQ ID NO: 15062 - protein, 280 aa, Streptomyces avermitilis
VDQPTVGILHPGSMGAAVAACAATNAATVLWCPAGRSPASIVRAERHGLQPVATLPELLDQADTVISLCPPAAAEDLAAEVASHGFGGWYVDANAINPERMLRIKALLTPSAKAVIDGGVVGSPPVGGKSPTLYLSGPAAAIERVEALFTGTAVRTKTLGSEIGQASALKLAYASFQKTSRVLVALATGLARQHGVDQELITIASQRSDSYLAETEYIAKTAARAWRWGPELEEAADMLEAAGLPPEMLRAAAATLARWDDAKDDGELTLTDALNRLAQP

SEQ ID NO: 15063 - protein, 215 aa, Streptomyces avermitilis
MRLALFDLDGTLVDRHSAFGDAVAALSRSHGLGPDVEHWLLTELADRASAEDFARVREIFNIDESAGELWRAYVDRMAAAVTCRPAVLGSLARLKAASWSIGVATNGASDIQRAKIRATGLADLIDGIAASGDIDVRKPDPRLFELAAARCGTQISRGDWMIGDNPENDIVGGHKAGLMTVWVRGRPWPESLSVPHHSVDDVTDAIDYLLTHPPE

SEQ ID NO: 15064 - protein, 945 aa, Streptomyces avermitilis
VMPVASISAPPALRWPARACRRSCPPRFQPAASGSNLVLPEPEAPQGDFVVPTFREGGRRYSARRLGLSPAHLCLFHAHLRTCDVPSHAISQPDSFGMPHCSGRSPGTPCHVVATGSWSGPRRQHAASGSVPGDPVSGVAAAAVVMPRVPGPRHRVLRSVPEQPGLVPVRGPGRPLALGRDARGRLGGAVRALLEAPGLEGAKDPVRLAVIVLAARTPSATGVVEIRTGELGRWLGLSTSHVASEVLPALRQSGVVSIDTAEGEYGQDDGLTCRVLPMWDAQNKVGHPLSLKKPELATLLRLMEALMAPGWVHRDGRVTPAGLLGARARHGAATDRLALLLLVLEAAETGRVRLCGGRVEKRYGRPVATLARLLRCSLSRSERVLARLEGFGLVERPRRQTVSGLRQVSRLVVPAVAAAHAEGRAASGSGGRQGSTDATSADVADPAGTAWRGKDSLLPEKQQVKGSLECCGADGGDLAPTASLHTDHSSVFTPGGSAELSGGFSGEGRGEDPGRPDHVCAHEDRAPEAVVADQLQLIDGKGGPLHGEKQSKSPDGAGWSAARTAGPSRLTVVDDGRGLQQGRGVADLPDLGLRAGLAPIADLWARLSRGQQAVTRRAALQSLEALSGIVDEQVAPQLLAGRLADRLAEVGGEALVREPMGWLLGRGLVQRPACPDLRCDDGIRLDTGADCPTCENIVHIRRTLRTRVSARVEAEMPHSDSATRRAELERRLREETAIEEQRAQIRRARASREAEQRQQAIERRRALEEEADLARRQASCADCGLPECAGLCPACSYRRRTEELVREAVDLAVAVRADLSDAAAVAELTQRCETDTRALLASACERACGPDADPALVAFYAPQVAQQIRDERRAAALRRLLGAEDVVVEADAAYEACLRHRGRGAEEAADAAGRRTVEFLLRWRLGELHAVRLRPAAGGVSVDAA

SEQ ID NO: 15065 - protein, 331 aa, Streptomyces avermitilis
VNTAATPGAQPNPTRARRKLASPTVAMLPRIADSLSFLYLDIVRIHQDDTGVCAEVTSERRGTEKVYVPTAALGCVLLGPGTSITARALATFARHGTTVLITGAGGVRCYAAALPDSLTTTWLERQTRAWADDTRRLAVATAMYEKRFGEATVPPGTTLAQLRGFEGQHVKAHYRVLAQQYKIGRFRRAYDPASWDTQDPVNLALSAANTCLYGIVHAAILALGCSAALGFVHNGNQQAFVYDIADLYKADLTIPLAFSLHASTNPEAEARRSFRDGLRLFKLLPRIVGDIQELLGLGSAYDIPDPEEQLVDLWDPISGPVPGGMNHGTDT

SEQ ID NO: 15066 - protein, 222 aa, Streptomyces avermitilis
LSVWLTRIVPDPRSRDARRDLGGNDSAMGLHRRLMSLYPCDAGPDPRARFGVLFRIEDTPAGAHILLQSAHEPDLTRLPDGYGQAITRPLDPLLDALKPGLTIRYRCTASPVRKPGANTRALYNLPAVVPLNGAAADEWWTRQADAAGLKPLALHPHPLDAAQGVRAGNGDKQRIRHNRIRFDGSATITDPDLLRQKITEGIGRGKAYGCGLLSIAPTREAQ

SEQ ID NO: 15067 - protein, 278 aa, Streptomyces avermitilis
VSDTTKAGLLLRLSGPLQSWGERSHFNERDTARFPTRSGVIGLLAAALGRRRGENIDDLARLSLTVRADRPGVLLRDLHTVGGGLPPKATVTTAEGKKRSGDTTTLLTHRTYLADAVFTIALTAIPDNTGLLTRTATALSSPQWPPYLGRRSCPPEGPLLLGRFDDALHHLVHLPIAAPPPQHGPHGIEFLSDHPLDHLPTPEDTCPPDAETGSHPSGEVNDQPLNFHPRQRAYRARPLYRRTLHLPADQFTGLGTDHLTSLATYLHEHLNHPEGSHR

SEQ ID NO: 15068 - protein, 392 aa, Streptomyces avermitilis
VLTPARFIDIHVLQSVPFANLNRDDTNSVKTVQYGNTLRTRVSSQSWKRAIRSVFEDRIGQAALRTRRIGERVTRELEQRGWPAELAQRAGGHTAAASGIKFELAKSSGDAKQTVPNKVLTNAMVYVPEAAVAELADLAEQHREELQQAKDIKKPADKSILPVSTVEAVLRSRNGVINLFGRMLAEINDAGVDGAVQVAHALTTHETDVELDYFSAVDDVTAVWNDATGSGHMGHAEFSAGTFYRYATLDLRNLVANIGDDPQAARELTTVFLASFITSLPQAKKNSTAPHTIPDLVHLSVRTDRPLSYAAAFEKPVQASPQGGFADVSRTQLAAYAQAANTLLGTTGILTSGWASLETKDLTGLGERRDSFDDLITTALDTALTHTAEANA

SEQ ID NO: 15069 - protein, 228 aa, Streptomyces avermitilis
MTTQSVTENPTTARRQRLVAYTCWIEQICRDDPGARTALRSGLRRTLDDVPRMHRFVAPWLPHDRQAPESEQRAYYAVAAMIAAQPRTTHTSPEAALEADGASQSPQPAPAPPYGTSLGLAFALAVTASPGREREMRESTAESRLNLLTRQSANGLHRHLPAAVGYLRELGVPIDWAQLLADLIAWPLHSGRISRRWLQDYYRQRSQTLHEQADRADQDETEHPSTSA

SEQ ID NO: 15070 - protein, 523 aa, Streptomyces avermitilis
MPASTYNLFDEPWIPVRWTHAAPLPHPERVGLRDLLLRSGDIATLTIADPPAHSALLRILYALTARVTGLDESGPGDWGERRLNILDAGQLPPEGITAYAGRYRQRFFLYDRDGGRPWMQDARLTGQCDGGNTAGVNKLIVTRPAGNAHAWFRHGSDARPDLPSAAEAVLSLLVWHYYGPSGRCSAREVNGVKTASATAGPLRTALSYHPEGDTLFETLLAGLVPPEVTVRRSFDLCPWEREELPDPEAAPPLPCGPCSRLTACSQHALLLVPDENSPGLVRDAYITWAYRTGRIPRDDNYLIWQISQQGNRYPRPADSRRALWRDLDALLLHEPPGTAQPQRPKVFDYASEVSEDLRVRALGFEQEGQAKDTQFVDADTPPVMGFTEQKAPATAPAVGRMRQLGEMYGRRLERAVKRAWAEYMNDPKANGDTWAAEAAARYWPGAEAEFWDRFRHLDNTGHTLGAGFDPAAARTAFLRLATDAYDTVTASVTRTQRGAKAVAHARIDLYGGVRKKATSTPAA

SEQ ID NO: 15071 - protein, 981 aa, Streptomyces avermitilis
LGSVLVSVQVRMRCQWGLLCMAVMMKRESVSPGHVPVDTRFWGKEHGLPRPYPVLCHLLDTAGVFGALWDVLLSDQMREKVARALGLTVAEARRVLAFWAGLHDLGKITPPFQAQVPEAFAAVRNDPAYVFAPGAERERAFRHEMATHWALVQLLGEAGYPGGGRVMRSAVSHQVAQLLGGHHGCFGVVLKAKEVAHASAYQPGLGGDGWAVQRRAHFGELRRVTGGWAVPERGLPAELAVIVAGLVVVADWLASQEEAIIPLLPPKGWRATPEEVDMHWERTQKAAPGLVAGAQLGRARFDAEGFEEMFSFAPNALQADLVARLPRMVEEKGPGLLLVTAPTGDGKTEAALYAASVLGHAAGARGLFFALPTMATADAMYPRVSAFTERALSGERALTLLHSMAWLSPAYAGAGQSAGPPPAAGDVSADPATVTEAGVWLRGHRRGLLAPLGAGTIDQALSAVLPLTHNALRLFGLSDKVLVVDEAHAYGPWMHQLLSRLLEWLGAFGAPVVLLSATLSGRTASSLVDAYRRGAGFLEPSAVEPCYPGWMFTGAATGEVCVPRETDSERRRTLDVRMLPVVWDTAPAAGSPVCAGGRRQALREALEPVVAQSGTALVCCTTVAEAQQTFRDLRAAFPELSTGEGGLRLLHSRYPANTRQHITSACERAYGKPRSPQDVALPRPASVLVATQVVEQSLDLDFDLIVTDLAPLAQLLQRAGRGRRHARGASGRPPWALPEDAPRLVVLEPVGESGATQVPRTWGSVYDAGLLQRTAHLLRERAASGIAVPGDVQELIDAVYAEDFVDRLEGAVQRELARMDSARQADEAAEAHLADMVAICAPADVAGDLQRLSRREAGVTEELLTTRLGADSGRVLCLYEQQDNTLTLDEGGTLPLPTGNQNGLLHAELRQVMAHMAPVPGAWLRGAEGHPAPPGWGKHPVLRDLVLLRMQPAGQDGAAAVWSCRHGTRTIRISGVGLETS

SEQ ID NO: 15072 - protein, 282 aa, Streptomyces avermitilis
VRAGSPPLARRARRRRRGRPGRRRFTSARAESTASRWRWGRRHTVHLRSRGEHPKMSPRRLPNCGSPPLARRARVDTDARVRADRFTSARAESTIHPHIVYTALAVHLRSRGEHVLMKRQHPTLRGSPPLARRALVEGVGAGLAERFTSARAESTTTSTGMPTNTQVHLRSRGEHEGTSFLERVVDGSPPLARRAREDDLDVGPARRFTSARAESTRTRRTSVVRAAVHLRSRGEHVWGGLKAAVSFGSPPLARRAHGLLGHLVVVLRFTSARAESTARHPR

SEQ ID NO: 15073 - protein, 544 aa, Streptomyces avermitilis; identical to SEQ ID NO: 7814

SEQ ID NO: 15074 - protein, 269 aa, Streptomyces avermitilis
VMSTKNGTNQARTSRDVGSELIYLTKALKAPALRDAAARLAERARDEGWSHEEYLAACLQREVAARDSHGAEGRIRAARFPSRKSLEDFDFDHQRSVKREVIAHLGTLDFVAGKENVIFLGPPGTGKTHLATGLGIRACQAGHRVAFGTAAQWVARLAEAHQAGRLSDELTRLGRIPLIVVDEVGYIPFEPEAANLFFQFISGRYERASVIVTSNKPFGRWGEVFGDDTVAAAMIDRLVHHAEVISLKGDSYRMRGRDLGRVPAANTGE

SEQ ID NO: 15075 - protein, 413 aa, Streptomyces avermitilis
VEDWAEIRRLHRAEQMPVRAIARKLGIARNTVRRAIADDAPPKYQRAPKGSIVDAVEPQIRELLEQWPEMPATVIAERIGWDRGLTVLKDRVRDLRPAYRPADPASRTVYEPGEIGQCDLWFPPADIPLGFGQVGRPPVLVMVAGYSRWITARMLPSRSAADLIAGHWRLLTELGAVPRVLVWDNEGAVGSWRSGGPQLTDEFAAFAGLLGIKFLLCKPRDPESKGLVERANGYLETSFLPGRVFTSPADFNIQLADWLTRANRRIHRTLQARPADRLEADRSRMLALPPIAPPGWWKASLRLPRDHYVRLDTCDYSVHPLAVGRRIEVAAGLDQVLVTCDGVEVARHARSWARHQTITDPDHAAAAAVARKAAAGTKPAPVDVTEVEERSLDTYDRIFGVIDGGLSTGEGAA

SEQ ID NO: 15076 - protein, 544 aa, Streptomyces avermitilis; identical to SEQ ID NO: 7814

SEQ ID NO: 15077 - protein, 102 aa, Streptomyces avermitilis
MVVFETPYAWAKAAWLVVLVAYRFGAAATASTAMVARTEPNVITLCFLAGRFISARAESTTGSRPAPRCPPVHLRSRGEHWSSITRSVSPSGSPPLARRARR

SEQ ID NO: 15078 - protein, 60 aa, Streptomyces avermitilis
LGPASPSRRPEVGRHLRELREDVRRAGGARAAADAVERLLTRRQAGEAQPLGGVQDPPTA

SEQ ID NO: 15079 - protein, 52 aa, Streptomyces avermitilis
MEMPDPTLLYSSGLTGLPLADLFLTTVNPGRLSRPSRVYSVDYQRPRKTTWP

SEQ ID NO: 15080 - protein, 198 aa, Streptomyces avermitilis
VIHRTGRVFGMTITPKQRAALTDAVRGGTESLFRRAATAAFLWALVFTAFHFYWFAGGRFGLGDGPKMIPETGTTKDLIWAFVITSMFVVGIFLPVALTRPWGRRIPRWITVCCLWIGSALLVVRGGAGLLDTALRETGLADRGLTGLTYQQITGDAHPSLNTKVSGICIDAYFILGGLLYGRTVLLHRRLVRGADEG

SEQ ID NO: 15081 - protein, 160 aa, Streptomyces avermitilis
MGRGTWSWIVPDGLWEIAKPLIPPSKVRPQGGGTQDTPDETLFAAIIYVLVSGCAWRALPPCFGISKSTAHRRFLIWSRAGVWGRLHEAVLHRLDDAGLIDVSRVVLDSAHVRAKKGANTQVRAPWTEVSRVPRCTSCRTRTDCPWSSASPPPTSTTARA

SEQ ID NO: 15082 - protein, 147 aa, Streptomyces avermitilis
VDRGKPGSKMHVLSDANGLPLVVGVSAANVHDSEGLKPMVAGHQTRHDPHRGRCFKPQRLHADKAYDIPHLRKWLRGKRIGVRIARKGIESSERLGRRRWVIERTISWLSGYRRISPRYERNPRNYLAFLGLAAALCCYKRLVRLTT

SEQ ID NO: 15083 - protein, 261 aa, Streptomyces avermitilis
VCFRYGRGMTGVFDVAQALDGGITDMERAWAFVRGFAAAWDEPLTEDDGTPASELARAEATLGCSLPAVLREFYTLLGTRSGLLANQDPLLPPAEMFVHDECGGVLVFRSENQGCAFWGVRLRDLDQDDPPVLVQARHGWVPFLDRVSLACVELVLSEALFGGGGQLYNACELPADLLGAVPARFQRVALPDYPMWTGPEDFPVRWFSAPGQLLRQDGLGAHSWLHVRGRTRADLEAICETVPGRWALGYTESLDAEPLPF

SEQ ID NO: 15084 - protein, 133 aa, Streptomyces avermitilis
VSTRPWIVDDDLWALIEPLLPPWPEKSPGPRPVADRHCLQGILYVLYNDIAWQLLPLELGFGSGQTCWRRLERWQQAGVFDQLHRILLAELNAAGRLDWSRACVDGSHIRAKKGAPRLVRRRSTGGRRAANTT

SEQ ID NO: 15085 - protein, 81 aa, Streptomyces avermitilis
MASISYCDEPKRDSCHIGGMLSPPAGAVHIVPGFKHSSPVASSTLKYVSHTQARAKGLTPSGRCEPGPKPVAISERFQRGH

SEQ ID NO: 15086 - protein, 254 aa, Streptomyces avermitilis
MLVYPSGIDLSTSTLRYLSDLLRARRRERGTRWRRLTTDRQALLALAHLRCGHTYAQLAAGFGIGLATVYRYIVEAVEVLAALAPTLQQAMTFAANKAFVILDGTLLHIDRIAADRPYYSGKHKRHGMNVQVIADAFGRLLWASPALPGAVHDIKAARIHGIIEALTQAGIRTWADKGYQGAQGTIRVPYRGRWSTLPAGKRAVNSSHAKIRAVGEQANATLKSWRLLRKLRCSTTRITDIVKAVLALHLATAA

SEQ ID NO: 15087 - protein, 81 aa, Streptomyces avermitilis
MTDVRVTYDKTVNAAYVYLTEPQARVKSARMYPCDPVDVDGMINLDFDEQGRLIGIEVLAASSKLPEYLLQSAERLDTEGA

SEQ ID NO: 15088 - protein, 112 aa, Streptomyces avermitilis
VAVRPAAGRTQLMSAQPDHAPVTPYAPPGAPAELLAQLRADRRAAQWVPVFEREWAAALEESRRTFSLAGLYEVVQVWQARVVSAPAVDEFLASGRDETGVVDLEEIRSRRR

SEQ ID NO: 15089 - protein, 993 aa, Streptomyces avermitilis
VGARRLLSFSDALALLGSDPPAVAALDRALGGVLNIATGGVADGLVRIADARGSVLTLGRGAVRGIGRRLGLADGRAERTELLHAAHTVIVVLAWFQALEAQHLPVHLEDLELTRHEQLALAGAPHVAERGAAFARSLAASDAPSPAPHRPFEVVTDELQRWYEGLSTRFLDFVEGLRVWNTQTETSRGEARRIIRTELPREAVRQYESLYAQLAQEAPEFGFWTTQIEHRATRAEVRRSLGGISELLAGLARTVRPPVDVAAALARSSEAMLTRTVLDASSGPEGIRVPTLREMYLDPDFRVREVSGSNGPATESWWEEAQVRRDLTGYLAGTLTFAGPADAPLLVLGQPGAGKSVLTRVLAARLPSAGFLPVRVPLRDVHAEDDLQTQIEQAVRTATGERASWPELVRSAGTAVPVLLLDGFDELLQTTGVHHSDFLTRVARFQQREAEQGRPIRALVTSRIAVADRARYPEGLVALRLEPFRPEQIRSWLAVWNEANADSFAARGLRPLSWEAVERHLALAEQPLLLTMLALYDAADNALRRDSDGPFDQAELYEELLTAFARREIDKDGPAPAAPDDETRARGERELQRLSLVAFALHNRRRQWVSAAELDEDLTALLGRASAEASGFRTPLGAAEVALGRFFFVQRAQSVRDGRALATYEFLHATFGEYLVVRLALHVLTSLLTHRPSLSAAKSSVDDDLAYTLLSYAPLSSRQMLRFAGSMVRRIPAAERDQLARLLIGVLEQHGQRTHEPHPAYRPTRFPASPGLRTSARHGIYGANLVLVILLLKGRVSAGELFPSWNDHASAWHRHVLLWRASFDEEQWTDFAVSLSARRTWSDQGRELEIILQSGAVESPDPLDMNWLYRYPRGNDGPGWSRTYWEEVQHKLDVSGGTNDGVVRHVMDPVFTWLGPSVTTFLTSAGGPATSLAHDVLKLLLGGADLPPGEEDTVRARVLRGLDNVPREVRERIRRLVAEHPAPSSGTGSTSGF

SEQ ID NO: 15090 - protein, 121 aa, Streptomyces avermitilis
VPDRCGVRGRESDPHTQVKHLVYRHYLQCWMGKILQKFPEATIVDAFAGPGIYTDGPPGSPIVVAKTFLEHTAYRNFGRLNLVCLEERPDRVEELQRQFAKLPRSPQLNISVPPGRRAKVC

SEQ ID NO: 15091 - protein, 219 aa, Streptomyces avermitilis
LLAGSKGETRSDGDGADGLCGGGRYVRAGACGRCPCNRRLPRGHFGGQGHGEDAGERAAVSTLAYLPHPWRKCSMFRSVTRGARLLVAAAAAAATLGIAASPATATDDWLSPGDLQNEATLKCLDGSSRGIRLLKCNDSKYQRWQASPEDYSFRNVATLTCLDGSSRGLRLVKCNGSRYQAWVWRGDELHNAVLGTCLDGSSRGVRLVKCNDSKYQHWY

SEQ ID NO: 15092 - protein, 176 aa, Streptomyces avermitilis
MASTAGLNQREAAARRSLWHREKQQLRRAGRLTDSIQALVTGAVTQEVIKRGWKRTWPDIPHQAYGRWPGSPEGAWPEALTVDLPADLVQAVRAACWHTCRKEIGLLYGWRERHPDARPRCPTRPGCDAAALAEYQELAAKVITPGEVWRAAVARGIHDASPRDSPARERRRRHRH

SEQ ID NO: 15093 - protein, 47 aa, Streptomyces avermitilis
VQAVLDRRGGCVRVGRDLYKPAHRHYPSLLAANVRTAGTLVRPDTAR

SEQ ID NO: 15094 - protein, 136 aa, Streptomyces avermitilis
MPTLSINFDPAVIAHLMKASGDDTVQVTLTLGTGGKPSSPRQVVPHGPLADLMQADLLKAGTVLTFHQRRANRSGRAVVTPDGQLVVDGHATPYPSPSKAAEAVTGNVINGWTLWHVEDGRTLDVLRRELESRNPQ

SEQ ID NO: 15095 - protein, 752 aa, Streptomyces avermitilis
LVRRCSMSELFDAVDALVASRATLPPPAERKRLRAAHGLTIDEVAGALKVRRATVSGWESGKTEPRPPERDAYARLLDQLAELYPAPSALEEPDAPAVPTTFTAAPAPAEARTLSTGPAPEAADMTATENTQTSPAPVAAALEAAPRPAGTSRSTSTSRRPAVRKAAPAGTPAGGTDPRFENGPLAVIDVEDGQVLAYCTGGLVLDVPAKSIPALVDWTLREAKLGQPKLSGPGKDADPLIVLTEAALERYGLPVALTDEERLAGRIPEGHKVIKQLVRAEWKLTKRGFGPWARIYRPAQGSERACVQLCIPSWNALDTRHWGEAGQLPPAELARVLGVYASRVMTPRGSTAVTGLELMTALHPPTRASEPDESGKRHSEHNPGSLGKDPVDCAPCEAPDGHPLLKDLPRFHVRGPAEKLFEEAYDWARPMTDAECTLRHLVGIDVNMAFAAGANGLAVGLGAPTHVTAPVFDAKLPGSWLVDLSHVDLSRVKVGKDKWVDLDASLLPSPFTPKGDRPEGPAWYATPTVAYAAELGYDVTPVEAYVRYENGRYLDGWYNRLRDAYLATMADLGVHADLSPADFLAAMDGYKERDPELAIVVSAIKATVKGGLGKLRERPRGEGWRPGEPWRALSRPTWRPDIRAAVISRTRINLHRKIVKHAAFTGQYPVAILSDCVVYAAGGEGPLDFLPYRDGKPLPGGFKLGINPGLVKHEGTQSVLWGEEVRERFDAPELNLARYIKDGTVTDADNGE

SEQ ID NO: 15096 - protein, 185 aa, Streptomyces avermitilis
MSMFGDGLEAAVHKAFTRPAPKSAGTQMRYLVKQYKGTKAVAQLLRISQRTVERYVKDQIKKPRPDLAARLEREVKKRWQPQIRAKARQQAATTGGIVIDTRARLGYTAPIGSTDQDRIRHLTIALPPRYAAQLFEAQEQGASDQQLQEIAAEALKEVYFQDGGRRAGSLEEVRFTDIEHLEFDL

SEQ ID NO: 15097 - protein, 185 aa, Streptomyces avermitilis; identical to SEQ ID NO: 8284

SEQ ID NO: 15098 - protein, 179 aa, Streptomyces avermitilis
MRYADGGGLTAERRAAREGIRLEAGVRFARGDRTSDIAKDLRVSERSVEQWRRNWREGGIEGLKSKGPAKLPKLSDERFALLEKELAKGPAAHGWEDQRWTLERVRTLIGRQFQVSCSIAGVWRLLHRHGWSWQSPARRALERDEHAVELWKKDVWPQVEVPRRRSGPTSSSRTRPGSR

SEQ ID NO: 15099 - protein, 835 aa, Streptomyces avermitilis
MAVKELRPHQREAVDAVLRALELPARSTVPERGLRTQVVMATGAGKTLVATRSAEELRAGRVLVLVPSLDLLAQTETAWREGGRRGPMIGVSSLRGEEAGFPNTTDVQELVDWVRPFDKVTVFATYASLGLGTLERAHAAGLPGWDLIVVDEAHRVSGRIGKPWAVVHDNTRIPALRRLYMTATPRLWQLDEDFEPGAPGELVASMEDDPDGPFGSRCFTLTLSEAIDRRICAPYQVVCVDITDTQLQAAQLLGAEARSEQVRGARLAALQTALVKASAEEGFRRTLVFHHVVKEAEAFAAGLPDIAAQLHAADPELYPRAVWVNWLCGEHKPLHRRRVLTEFADGIATDGTVVEKSYLGSVKVLGEGVDTKNCDSVYFADVRGSMPDLVQAVGRALRMQPGEGKTASLVVPVLLGPGETADNMLTSRAFGGLAKLLEALRAHDARVVEQLAEQQAPSRSKGVQTREISKEQGGSGDGSSVSVSAKALLKFSTPRDPAALAAFINLRVLNPEHQHWRRGIEAAVIYAREHGDLKVPFTFHVPGHTGQETQAKGWPASLAAFPLGQWIADARRFYARGDMDADRVEQLEKLGMVWSHFDVAWEEGLAAARGWAAEHGHLLAPLDATYQGAKVGIWLKNARTAARKAAEIERRRAEGLPVESSAGALSDERREQLEEIDASWCPSWPVTWQRCFHLVRMHLDAGEALPTTAGEVLGQGEDLGRWVRSVRLGWDKLTTVQQWMCEHVLGITPATEDEKPKPRRTQADKWAMNYEAAKQFYEREGHLQVPRKHIERTVGEDQEEREHKLGAWIGNQRSRAATLTPERMEKLSAIGMRWT

SEQ ID NO: 15100 - protein, 64 aa, Streptomyces avermitilis
MTHKTENEKGNRFCKACGTPAEDGKLCNHCSTVLDLPDDAGLTEDQGAAVRRNFEGRTEQQKQK

SEQ ID NO: 15101 - protein, 136 aa, Streptomyces avermitilis
VQQYDATSKDAPSSKSKSERNGRDKPNPLNSMHGGTRASMATKTDRIMSLRAVRQLRHVRAFYAAGVLLWAAAAIWTGWTHPASRQMWVSVLLLAVFTSLLFTTSLWLWRLQAGTAGRPAHHAAPRQVVARRRANA

SEQ ID NO: 15102 - DNA, 125746 bp, Streptomyces avermitilis
agggtctctactccgtgggggtccatcccctctgatgtctagactataccatatcgttgaccttcgggcgcgggggtgcactccctttttgtcgagtcgaaacgatcccggtcagtaaatgttttcagggccgggtgcgggcggctcgcgaactgcttccgccgtgctgggcgacatggtcgctgtgtgtcgcaacaagctcagcggcacgaccgggcccggcgagtccgcgtacgccgccctgcccgtgtcgcccatgggcgaggtcgtcacgcgctaccacatcagccttgacgtggccgacaaaccgggtgttctcgcccaggttgccaccgtcttcgccgagcacggggtgtcgatcgataccgtgcgtcagcagggcaaggacggcgaggcctccctcgtcgtcgtcacccaccgtgcgtccgacgcgtccctgagcgggaccgtcgaggcactgcgcagcctcgacaccgtgcggggtgtcgccagcatcatgcgggttgaaggagagtaacgagcaatgacccaccagtggcgcggaatcatcgaggagtaccgggaccggctgcccgtctccgacagtacgccggtcgtgacgctccgtgagggcgggacgccgctcgtgcccgcgcaggtgctctccgagcgcacgggctgcgaggtccacctcaaggtggagggcgccaaccccaccgggtccttcaaggaccgcggcatgaccatggccatcacgcgggccaaggaggagggcgcgaaggcggtcatctgcgcctccaccggcaacacgtcggcctccgccgccgcgtacgccgtacgcgcgggcatggtctgcgccgtgctcgtcccgcagggcaagatcgccctcggcaagatgggccaggccctcgtgcacggcgcgaagatcctccaggtcgatggcaacttcgacgactgcctcaccctcgcgcgcaacctgtccgacaactacccggtggcgctggtcaattcggtcaacccggtgcgtatcgaggggcagaagaccgcggcgttcgagatcgtcgacatgctcggtgacgcgcccgacatccacgtcctcccggtcggcaacgcgggcaacatcaccgcgtactggaagggctatcaggagtacgccgccgacggcatcgcccgccacaagccccgtatgtggggcttccaggcatccggctccgccccgatcgtgcgtggcgaggtcgtcaaggacccgtcgaccatcgccaccgcgatccgtatcggcaacccggcgtcctggaagttcgcgctggcggcgaaggacgaatccggcggtttcatcgacgaggtgacggaccgtgagattctgcgcgcctaccggctgttggccgcgcaggagggcgtcttcgtcgagcccgcgtccgccgcgtccgtcgccggtctgctgaaggccgccgagcagggcaaggtcgacccgggccagaccatcgtctgcacggtcaccggcaacggcctcaaggaccccgactgggccgtcgcgggcgctccgcagccggtcacggtcccggtcgacgcggccacggcggccgagcggctcgggctcgcgtaaacggttcgcccgggcggttcgagcggttcaggcggctcgaacggttcgcccgggcggtaggggtgggcggtacaggcaggggttttggggggtaacccccggtaaccccatgctgcaccccatgaggggtgcacggggggcttacgacacgcatcgtgcgcctcccgtgcgccctatgtcgccacagaaccttccttcgataggctgtactgaacccgcccgccgcatatgccgcggtgccgcgccgtcattgcggcctcagggtctccgtgtacgtatccaatgtcgtagcgaatgtcattcgacaatcccgcagctcaaggagagtcatcgagcgatggccggtccagcgttccgtgccgccgccgtccgggtgcgcgtccccgccaccagcgccaacctcggtccgggcttcgacgccctgggcctgtcgctgggtctgtacgacgacgtggtcgtccgggtggccgactccgggctgcacatcgacatcgcgggtgagggcagcgagacgctcccgcgcgacgagaggcatctcctcgcccgctccctgcgcaccgccttcgatctgctgggcggccagccgcgcggccttgagatcgtttgcgccaaccgcattccacacggccgtggcctcggctcctcgtcggccgccatctgcgccggcatcgtcgccgcgcgagccgtgaccataggcggggacgggaagttggacgacaccgccctgctcgagctcgccaccgagatcgagggacaccccgacaatgtcgcggcctgtctcctcggtggtttcacgctctcctggatggagggcggcgccgcgcgcgccatcaggatggagcctgccgattccatcgttccggtggttttcgtgcccggaaaggcggtcctgaccgagaccgcgcgcggactgctcccgcgcagcgtcccgcatgtcgacgccgccgccaacgcgggccgtgccgcactgctcgtcgaggccctgaccaggcgccccgagctgctgctgcccgccacggaggaccggctgcaccaggagtaccgcgccccggccatgccggagagcatggcgctggtggagcggctgcgggccgacggcatccccgcggtgatctccggggccggacccacggtcctggcgctggccgacgaggcgtcggccgacaaggtcgcccgtctggcgggcgagggctgggccgccaaccggctgagcctcgacgcccggggagcgagcgtgctgccgcttgccgcctagagacctgccgaactgcatacggttgccgggtttggagagggggaatgtttgttggatccggtagtgttaacctcaagtctgcacccgaccccgccatggcgaggtgcttcgtgtccccgtccgggacaaccattcttccgggagcctcccaagccgcattgtgttccgtacgtcatcgcgtacgtcgtacgcggacgctgagcggtttgtcgagcacgctccggaatcggcgtgacccagccgcgtgacaccgacactccagtgccacggcccgggaaagcgccatcaccagaaattctcttccgccactttggcggtccaccgccccggcacggtccacacagacaggaccaaagccggacagcacaaccggtcgccgagccagacaggccgacgtccgctccagggaaggacccttcgtgagcgacaccaccgatctgatgggcgcacgtgtcgaggagaccgctgccgcgcccgccacggacgcctccgcgcctgccaccggtgccggctcccggcggcgccgcggtaccggcctcgagggcatggtgctggccgagctgcagcaggtcgcatccggcctcggcatcaggggcaccgcgcggatgcgcaagagccagctgatcgaggtcatcaaggaggcgcaggcgggcggcggcgccccggccaaggcggcagcgtccgccgcggacgccaccgagaccaagcccaagcgccgtgccacctccaaggctcgtacgggcgacgacgccgcccccgccgagaaggcggagcgggccgcgaagcccgccgccgagaaggccgtggcgcagcagcagatcgagatccccggccagcccgccagcgaggacgccccggccgagcgccgccggcgccgtgccaccgccgaggccggcagccccgagacggtcgccgccgaggcgaagagcgagccgaaggccgagacgcccgccggcgaggccaagggcgacgccgccgacggcggcgagggccgtcagggccgccgcgaccgccgtgaccgtggcgaccgcggagaccgtggagagcggggcgaccgtggagaccgtggagagcggggcgaccgcggggaccgcggccgggaccgcgaccgccgtggcaacaagggcgacgagcagcagggccagggcggccagcagcgcggcggcggccagcagcaggccaccggccgccaggaccgccaggaccgtcagcgtgacaacggcccgcaggacgacgacgacttcgagggtggccgccgcggtcgccgcggtcgttaccgggaccgccgtggccgccgtggccgcgacgagttcggcgccaacgagccgcaggtcgccgacgacgacgtcctgatccccgtcgcgggcatcctggacatcctcgacaactacgcgttcatccggacgtccggctacctgccgggtccgaacgacgtgtacgtctccctcgcccaggtccgcaagaacggcctgcgcaagggcgaccacgtcaccggcgcggtccgtcagcccaaggacggcgagcggcgcgagaagttcaacgcgctcgtccgcctcgactcggtcaacggcatggcgcccgaatccgggcgcgggcgaccggagttcaacaagctgacgcccctttacccgcaggaccggctccgcctggagaccgacccgggcgtgctgacgacccgcatcatcgacctcgtcgcgccgatcggtaagggccagcgcggtctgatcgtggccccgccgaagaccggcaagaccatgatcatgcaggcgatcgccaacgcgatcacgaccaacaaccccgagtgccacctgatggtcgtcctggtcgacgagcgtccggaagaggtcaccgacatgcagcggtcggtgaagggcgaggtcatctcctcgaccttcgaccgcccggccgaggaccacaccacggtcgccgagctcgccatcgagcgcgccaagcggctggtggagctgggccacgacgtggtcgtcctgctcgactcgatcacgcgtctgggccgtgcgtacaacctcgccgcgcccgcctccggccgcatcctgtccggtggtgtcgactcgaccgcgctgtacccgccgaagcgcttcttcggtgccgcgcgcaacatcgaggacggcggctcgctgaccatcctggccaccgcgctcgtcgacaccggctcgcgcatggacgaggtgatcttcgaggagttcaagggcaccggcaacgcggagctcaagctcgaccggaagctcgccgacaagcgcatcttcccggcggtggacgtcgatgcgtccggcacccgtaaggaagagatcctgctcggcagcgacgagctcgccatcacctggaagctgcgtcgcgtgctgcacgcgctcgaccagcagcaggcgatcgagctgctgctcgacaagatgaagcagacgaagtcgaacgccgagttcctgctccagattcagaagacgacgccgatgccgggcaacggcaacgactgacgcgtctgcttcagaggggccgcccccgacaccgaccgaccggtgccgggggcggcccttttccgttgcacgtgcgtacgtcccgcggagacctttgccacaggcggcccgtccgccggggccttcgcaccgctccgcaaactcccgcgaaaccgcaggtgagccccgtatcgccgactcgcacagtcactgggcgtcactaaatccgcacacactggacacactgcgttgtgcaaccctttcccgagtttccccgtctgaccgtacggagtgaccacgaagcggtacgcgtcacgacagaccgggcctggccctgaaagcaggggataaccgaccgacacaggactgaggagcacatgtctgccgagagcacgccggaacccggcataccggggagcaccggcaccgagggcccgcgccgccgcgccaaggggcgccgcagaaagccccccggcacgcgccgcaaggccctgctcatcacggcctgggcggccgcgggcgtcgtcgtcctcggggggaccggcgccggctacctctacttcaagctcaacggcaacatcaagagcgtcgacatcaaccaggccctcggcaccgaccggccgctgaaggtcgacgacggctccgagaacatcctggtcctcggctcggacacgcgctccggcagcaacaagaagctgggcggcggcaccgacgacggcagcgcccgctcggacaccgcgatgatcgtgcacatctaccggggtcacaagaaggccagcgtggtctccatcccgcgcgacaccctcgtcgagcgcccccggtgcaccggccgcaagggcaccgtgtacccgggctcgtcgagcgcgatgttcaactccgcgtactccaccggcggcgccgcctgcgcggtgaagaccgtcgagtcgatgaccggcatccgcatggaccactacctcgaggtcgacttctccggcttccaggacctcatcgacgacctcggtggcgtccgggtgaccaccaccaaggacatcgccgacaaggacagccacctcgacctgaaggccggcactcacacgctcgacggccggcaggcgctcggcctggtccgcacccggcacggcgtcggcgacggctccgacctcggccgcatccagctccagcaggcgttcatcaaggccctggtcaaccaggtcaagcacatcggcgtcctgaccagcccgacgaagctgtacgacctcgccgacaccgcgaccaagaccgtcaccaccgattccgaactggcctccgtcaaggacctcgcgtctttcgccggcggactcaagggcatcagctcgtcccacatgaacatggtgacgatgccggtccactacgacgcggcgaacgccaaccgcgtcctcgtcgataaggccaaggcccagctgatctggaaggcactcaaggacgaccgggccatcccgaaggcggccacccacggcacggccaccggctccgccaagggtgtcgtgacgtccggctgaccggtcgcacgaaaacccttgggaggccgcacgaaacccttgggaacaggccacgaaaagccctcgggaatagatcgtcccccaccccggttttgggggatgcgcccagtcctggcagactggtacgtcggctccggttcacgccccccgcatcccgcggcggcgacccggcgccctcccgaaactaggagacaccttgaagcgcgacatccaccccgagtacgtcgagacgcaggtcagctgcacctgtggcgcgtcgttcaccacccgtagcacgatctccagcggcaccgtccgcgccgaggtctgctccgagtgccacccgttctacacgggcaagcagaagatcctcgacaccggtggccgtgtggcccgcttcgaggcccgcttcggcaaggctgccgctgccaagaagtagcgagcccacagcgccggtctccggtgcctccgtaccgggggcatcgggaccggcgctttgcggtgcagccaccctcccccaggttctcgacttcgctcgagcggggggaacccccatgccgtacctacgtcccacgcccgtaccggagcgggggacagcccattggagccggagatgttcgaggcggtcgaggaactcatcggcgagcacgccgacctggagaagaagctcgctgacccgtcggtgcacgccgaccaggccaacgcgcgcaagctcaacaagcgctacgccgagctgaccccgatcgtcgcgacgtaccgctcctggaagcagaccggggacgacatcgagacggcgaaggagttcgtcgccgacgaccccgacttcgccgccgaggtcaaggacctggagaagcagcgcgaggagctcaccgagaagctccggctgctgctggtcccgcgtgaccccagcgacgacaaggacgtcatcctcgagatcaaggcgggcgcgggcggcgacgagtcggccctcttcgccggcgatctgctgcgcatgtacctgcgctacgccgagcgcgtcggctggaagaccgagatcatcgactccaccgagtccgagctcggcggctacaaggacgtccaggtcgccgtgaagaccaagggcggccagggtgccaccgagcccggccagggcgtgtgggcgcggatgaagtacgagggcggtgtgcaccgcgtgcagcgggtgccgtcgaccgagtcgcagggccgtatccacacctccgccgccggtgtgctggtcacgcccgaggccgaggaggtcgacgtcgagatccacgcgaacgacctgcggatcgacgtctaccgctcgtcgggccccggcggccagtccgtcaacaccaccgactccgcggtgcgcatcacgcacctgcccaccggtgtggtcgcctcctgccagaacgagaagagccagttgcagaacaaggagcaggcgatgcgtatcctgcgctccaggctcctcgcggcggcccaggaggaagcggagcgggaggccgcggacgcccgccgcagccaggtccgcaccgtcgaccgctccgagaagatccgtacgtacaacttcccggagaatcgcatctcggaccaccgcgtcggcttcaaggcgtacaacttggaccaggtgctcgacggggacctcgacgcgatgatccaggcctgcgtcgacgcggactcggccgcgaagctcgccgccgcgtaacagcggtacccagcacacgacaacagctcagccccggaggaccagcgtgcagcaacattttgggggtcgacccccaaacccccgcagcgtgctgctcgcggaagtggcccaggccacccagcggctggccgacgccggcgtgccctctccgcgcaatgacgcggaggagctcgccgccttcgtgcacggcgtcaagcggggccagctgcacctcgtcaaggacgcggacttcgacgcccgctactgggagatgatcgcgcgccgcgaggcccgcgagccgctccagcacatcaccgggctggcctacttccgctacctcgaactccaggtggggccgggggtgttcgtcccacgcccggagaccgaatccgtcgtcggctgggccatagacgccgtacgcgccatggatgtcgtcgagccgctgatcgtcgacctgtgtacgggctccggcgccatcgcgctcgccctcgcgcaggaggtgccgcgctcccgcgtgcacgccgtggagctgtccgaggacgccctccggtggacccgcaagaacgtcgaggggtccagggtcgacctgcgccagggagacgccctggaggccttccccgacctcgacggccaggtcgacctcgtcatctccaacccgccgtacatcccgctcaccgaatgggagtacgtcgcccccgaggcgcgggaccacgatcccgaactcgccctgttctccggagaggacgggctcgacctcatccgcggcatcgagcgcaccgcgcaccgactgctgcggcccggcggcgtcgtcgtcatcgagcacgccgacacgcagggcggccaggtgccgtggatcttcaccgaggagcggggctgggccgacgcggccgaccacccggacctcaacaaccggccgcgcttcgcgacggcccgcagggcgatgccgtgagcacgcccgacgtttcttcaagccggcagtacgtgtacgaggaggcccgctaatggctcggcgatacgacaccaacgacgcgaccgaccgcgcgaccggtctgcgcgaggccgcgtccgccgtccgccgtggcgagctcgtggtgctcccgacggacacggtgtacggcgtgggcgccgacgcgttctcgtcggaggccgtcgccgacctcctccagtccaagggccggggccgcaacatgcccacccccgtcctcatcggctccccgaacacgctgcacgggctcgtcacggacttctccgagatggcctgggagctggtcgacgccttctggccgggcgcgctcacgctcgtcgccaagcaccagccgtccctccagtgggatctgggggacacccgtggcacggttgccgtgcgcatgccgctgcaccccgtcgcgctcgaactgctgtcggaggtcggcccgatggcggtctcctccgcgaacctcacgggccaccccgcgccggaggactgtgacgccgcgcaggagatgctcggcgactccatctccgtctacctcgacggcggcccgacccccggcatcgttccctcctcgatcgtcgacgtgagcggcaagattccgctgctgctgcgcgagggggccctgtcggcggaggagctgcgcaaggtcgtacccgacctcgaggtggcgaattgacagcccctgacgcggggcgtggcataggcacgggaatcacaggggccgatgggttctctgggggttccttccgcatcctccacgtcagcaccggcaacgtgtgccgctcgccgatcaccgagcggctgacccgtcatgccctggcggaccggctcggggaccccctgtggggcgggctgatcgtggagagcgcggggacctggggccacgagggcgcgcccatggaggccaacgcggaggcggtcctcgcggacttcggcgcggacgcctccggcttcgtgggccgcgaactcctcgacgaccacgtcatcagggccgacctggtcctgacggcgacccgcgaccaccgcgcccaggtcatctccatgggccactcggcgggcctgcgcaccttcaccctgaaggagttcacccgcctggtccgggcgatcgatccggcgacgctgcctccgctggaggacggtgtggtggagcgcgcgcgggcgttggtgcgggccgcggcggcgttgcgggggtggttgctggcgccgacggcggaggcggacgaggtgtatgacccgtacggtgcgccgttgccgtttttccggtcggtgggggacgagatacatcaggcgctggatccggtggtgacggcgctgacgggggtgcccgcgcggatgtgacgggagcgtgcgcgggggcggcccggttctttcgggtgcgcccgcgtccgtcgggtgcgcccgtgcgggtgagacaccgggcgtaccccacaccccgggcctacattggacgtagctcacccccgctcaggcccggagcccaccatgtcggtcacgcatgtaccggaagccgtacggcccgccgtcgccggggccgacttcgaggcccttcgtcggcaggatcccgagctggccgagatcctcatcggggagctcgaccggcagtcgaccacgttgcagctgatcgccgccgagaacttcacctcgccggccgtgctcgccgccctcggctcaccgctcgccaacaagtacgccgaggggtaccccggtgcccggtaccacggcggctgcgagttcgtcgatgtcgccgagcgcctggccgtcgaccgggcgacggccctgttcggcgccgcgcacgccaatgtgcagtcgcactccggctcgtccgcggtgctcgccgcgtacgccgcgctgctgcggcccggggacaccgtcctcgcgatgggcctgccgttcggcggccatctcacgcacggctcgcccgccaacttctccggccgctggttcgacttcgtcggctacggggtggacgccgagaccgggctcatcgactacgagcaggtgcgcaccctcgcacggtcgcaccgcccgaaggccatcgtctgcggatccatctcctatccccggcacatcgactacgcggcgttccgcgagatcgccgatgaggtgggcgcccatctcatcgccgacgccgcccaccccatcgggctcgtcgccgggggagcggcgcccaatccggtgccgtacgccgatgtcgtctgcgccaccacccacaaggtgctgcgcggcccccgcggcggcatgatcctctgcggcggtgaactggccgagcgcatcgaccgggccgtcttcccgttcacgcagggcggcgcgcagatgcacaccatcgccgccaaggccgtcgcgttcggcgaggcggcgaccccggctttcgccgcgtacgcccgtcaggtggtcgccaacgcgcgcgtgctcgccgagaggctggccgccgaggggctcgcgatcaccaccggcggcacggacacccacctgctgaccgtcgatcccgcgccgctcggcgtggagggccgcaccgcccgcggccggttggccgccgcgggcatggtcctcgacacctgtgcccttcctcacggcgacgcccgcggtctgcgcctcggcacggccgcgctgaccacccaggggatgggcgagaccgagatggcccgcgtcgccaagctgttcgcgggcgtgctgcgggacgagaccgacagcaagacggcacgtgaagaagtgcgggagctggctggtggatttccgccgtatcccggccggtgaacggtggacgggacctggtacacagccactcgtgcaaccatcgtcgctacccggaagtcctcaaccatatgcacgcgaagctagggtgtggggctgaggatggccagcgagacctgtggggaagcctgtgcgtgaatacctgctgacgctctgcatcacggccgcggtgacgtatctgctgacagggccggtacggaagttcgcgatcgtggccggagccatgccggaaatccgggcgcgcgacgtgcaccgggaacccacgccccggctcggcgggatcgcgatgttcttcggtctgtgcgccggtctgctggtcgccgaccacctggagaacctcaacgaggtcttcgccgactcgaacgagccccgggcgctgctctccggagcggcgctgatctggctgatcggcgtcctggacgacaagttcgagatcgacgccctgatcaagctgggcggccagatgatcgccgccggcgtcatggtcatgcagggtctgacgatcctgtggctgcccatcccgggcttcgggctgttcgccctgacccagtggcagggcaccctgctgacggtggcgctcgtcgtgatcaccatcaacgccgtgaacttcgtcgacgggctcgacggcctcgccgccggcatggtgtgcatcgcgtccgccgcgttcttcatgtacgcctaccggatctggtacggctacggactggaggccgccgccccggcgaccctcttcgcggcgatcctgatgggcatgtgcctcggtttcctgccgcacaacatgcatcccgcgcggatcttcatgggtgactcgggctcgatgctgatcgggctcgtgctcgccgcgggcgccatctcgatcaccgggcagatcgaccccgacgcgatgaacctgttctccggttccgagcgcaacacggtccaccagaccgtccccgtctacatcccgctgctgctgccgctgacgatcatcgcggtgccggccgccgacctggtgtcggcgatcgtgcggcgcacctggcgcggtcagtcgccgttcgcggcggaccgcgggcatctgcaccaccggctgctggaaatcggccactcgcacagccgcgcggtgctgatcatgtacttctggtcggcgctgatcgccttcggggcgctcgcctactccgtcaactcggcgtccatgtggatcgtgctgggcatcgccgcgctcagcgccctcgggctcggtctgctcctgctgccgcggttcacgccgcgcgccccgcgctgggccgagcacgtcgtgccgccgcgctaccggcgccggagggcggcgaggacgggctccgcgccggccctcgacggccttcaggcttccgtcgacggcgatcacggcgaccgtgcggcgacggcgcctgccgctgccgccgaggcgcgcgagccgagcgccctcgggctgcacggcagcaccgcgctgtccgagctgtcgtcgagcccacggacccacgagcgcgagcgggcgcacgagcggacccacgagcgcgagcgggcgcacggcctgtcgggcggtacgggacgtaagtgaggggcggcccgagaggggcgtgcggctcctgcggggcgtgcggcctctgcggaggcgggcttgcggactccgaggggcgtgcggcccttgaggagcccgcgtcggagtcaggtggcgctggggcccgtcccccacgtcgagcgcagggcgtcgcagacctcgcccaccgtggccctggccgccagcgcctcccgcatggggtagagaacgttgtcgtcgccctgtgcggccttccgcagccgtagcagggcctcgtcgacggcgggctggacgcgccacgcgcgcagcttggccagccgctccgtctgccgggcctggaggtcgagggagtcctggtgcggcgggtgcggccggggcgtggcgggccggtcgccgtggggccggccgagcagttggccggccaggccgtgttcgaggaccgtgagcgtcccgccgagccgttcgatccggtccaccagagcggtcgccccggcctcgatgtcctccgtgcacgccagggtggccaagccgtcccggggggtccggacgtacaggcgcggtgcggtccggcccgaaccgaagcgctcgttcgccgtcctggtccacacccggcgcgtcgcccgtagcttggcccggttctcgcggccggtggtgccgccgacgaggcagagcgtcaggcgcggtgcgacggtccgcacgtccaggcccgccgtcacggccgcgcgcaggtactcgatgccgccggcgacggtgaaggcgacctccagcgccgggtccgcgccggtcccggccagatggtggccgcacacggacaggcactgccagcgcggcagctcggcctggcagtaggcgaacacgttcatggcaagacggagggacggccgcagcgggaagacgccgggcccgcgggcgaggaactccttgaagacgtcgccccggaccgcccccgccagccgctgggccggtgccccgtgctcctcggcgaccagctggtagaggacgaggaggggggccgccggggcgtcgacggccagcgacgggacgacccggtccaggcggagcccgccgaagagcacccgcatgtcgtcgatcgagtcgacggccaccccgcgccggccgaccagtccgcgcgccgccggcgcgtcggagtcgagtccggcgcgcgtcggcaggtcgaagacgaccggtacggcccgggtgccgctgccgaccagctgccggaaccgtgcgttggcgtccgcggcggtgctgtagccggtcatgcggtggggcggtcggtggcgcggtcggtgggccggccgccgggccggtcggcggaacggccggtgggcgcggagtgcttcgtacggtcgtacggcgacggggcgtgcggtgtgtcccggccggggccgtccaccacgaccgccgtgacgatgatcccgtgccggacgagccagcggccgtgaaggtcccgcagctccggctcggccgcgcgcagggcggtggggagcacccgtacgcggaaggtgctgctgacggggtcgaggtcgatcagggcctcctcgaagcccaggggccgcccggtcgccgggaaccacgccttgtagacgctctccttcgcgctgaacagcagctttccccagacgacaccggggtgccgggccgtgtgctccttgacctggaactgctccgcgggcagcgcgacggcctccaggactccctccggaagcggccggtcgggctccgcgtcgatgccgacggccctgatgccgggggcgcgggcgacggcggcggcgcggtacccggcgcagtgggtgatcgctccgcacacaccggcgggccagcggggtgcgcccctcggggtggcgagcagcgggccgggcgggacgccgagcgaggccagtgcccggcgtgcgcagtgccggccggtcgcgaactcccggcggcggctctccacggcgtcctggacgagggcggcctcccgggggtgcagcgaggagaccgggacgtcggcgaagacctcgtgcgcccgcacgcgcggcggcagcagctgctcgatcatggccgtcggtccgcgggtgacgcggtccggtggcccggcggtgccggtacgggtacgggcacgggtgccggtgccggtgccggtgccggtgtcaggatctggaccggccagtccgggcgccggccgtaccgctgccactcccgcgggtagccgagggacacctcgtggtgcggtacgtcgtcgcagcggatcgtccggggaatgtgcagatgcccgtggacgaccgcggccgcccggtaccggaggtgccagtccgccgtcgccgtggtgccgcaccacagggcgaactcggggtgccggaggacgcgggtgggctcccggaccagcgggaagtggttgaccaggacggtgggcaggtcgtccggcagggcgtcgagcctggcccgggtggccctcaccctggcccggcaccaggcctcacggctcgggtaggggtccgggtggagcaggaactcgtcggtgcagatcacgccggcgtcgtcggccaggcgcagcgcgtggctcttcgaccaggctcccgggggcaggaagctgtagtcgtagaggaggaagagcggtgcgacggccacgggaccgcccgcgccgtgccagacggggtaggggtcctctggggtgacgactcccagggcgcggcagaggtccaccaggtgccggtacttgcgctcgccgcgcagttcgtcggggtcgccgggcgcggtccacagctcgtggttgccgggcgcccagatcaccttggcgaaccggtcccggagcagggagagcgcccaggtgatgtcggccacgctctcggccacgtctccggcgacgatgagccagtcctcggcacagcccgggtgcaggtcctggacgatgtcccggttctgtcggtggcgtacgtggatgtcgctgacggccaggagccggccgccgtgggaggggccgccgagagcggcggtggagccgtcgtgcctgtcctggctcaccggtgccccctatgtccctgaccggacctgcgtaccccgcaccggacctgtgccggatgcgggccgccgggtcgcggcggccgtacccctcacagcctgatccaccgctgcgcccggtggaacccctaattcgccccccgactccgggccttgctgtccgttccccgaggaatgaggggattctggccatgttgttcatggataaaaggcggtaggggggatgcgcgttcgattaggggttgtggggggacccaggggccgcgaagcatggtgctgcgagacagcacggccgacgggtcacagcccatgggccacctgtagcacgaaaggttctatggtgagtgccaaccgcgttgacgggaacctgtgggtccgccagttccacccggcgccgaccgcggccacaaagctcgtctgcctcccacacgctggtggatccgcctcgtacttcctgcccgtttcgaaggcgctggctcccggcgtcgacgtactcgccatccagtacccggggcggcaggaccggcgccacgagaagtgcatcgacaacatcgccgagctggccgacgccgtgacggccgtactggagcccctggccgaccggccgctggtgctgttcggccacagcatgggggccaccctcgcgttcgaggtggccctgcggctggagcggaagggcatcgtgcccctcgcgctgttcgcctcgggccggcgggctccttcgcgccaccgtgacgagagcgtgcatctgcgcggcgacgacgagatcatcgccgagctgaagacgctgagcgggacgcggtccgaggtgctcggggacgaggagatcctgcgcatggtgctgcccgccatccgcagcgactacaaggcggccgagacctatcggtacgccggcggggcgcggctcacggcgccgatccacgcgcatttcggggtggaggatccgcgggtcagcctcgatgaggcgcaggcctgggcggaccacacgaccggtcacttcgagctccggagccatccgggcggccacttctacctcaatgaccaggctccacgcgtcatcgaggagatcgcccgggtcagttcgtccgtcgcttcgtagcactcgccgggtgcggctcgggccgcaccacggtctccgcgcagggcccggtccgggcccaggtggtccccgttcagtgtcgagcggcgggcggtgtgccgccggtgcgagccggcccggcacgagttgctcctgaatcggggaacggtacatccgggagtccggcgtcacgcccccgcgaggacgcggtggcgcgccccgtcacgtcgggcccatgcccgggcgccttttcgggattccacacgaccggccggccgagcgcgcattcggtgcgcttcctgtattccgtgcctttttgtttcctttcctttcgggcgggattccgggctcattgcggaacggtggcgcatcggtcgaaggctgtgacatttctcggtgaaccctgtgggccccgcacccgtccgcaccctcccgacctgcacaggtgtgggctccggcctgcgcggttgcggtgttggccgatttttgaccgttgagtggctgaattttttcacacattgacagtagttgctcactgatgtttgactcgttcaggttttgagtgtttggagggtgaaagcgggggagtggcaaatggtatttccggagcctttcggtgcctcccgtctcctgctgcacgctgcaacttctggttttaggtcggatcgatgcggggtgtttcgcgattcatggtgctgattgggcgaggtcaagaaatagatcgactgcgcgcggcctattcttcagttcgttccaccggtagatcacgggccgtactcgtcgagtcggcggccgggtgcggcaagagcgagatcctggaggatctcgtacggcatgtggaatcgctcggcctgatcgctctgcgcgccacggcgatcgccgaggaacgaaacaccccgctgagtgtgctccggagtctggtcaacggggctcctttcccggacgacctcgtgcggcgctttcacacgatgagcgacgcggcggcccggatgatttccacggagggccgggacaaggcacgccgcgacgccgcctggtacgaactgatgcggaccttctgtaccgaggtccgcgccctcgcccagcgggcgcccctggtggtggccgtcgacgacatccaccacggggacgccgactcccttcgccagctgctccatctggcccggcactgccgcaacgtgccggtgctgctgacgttcacgcagtcgctcgccggcggtccggcggaccggaccttcggcgcggaactgctgaggcagccgaacctcgaacacatacggctgccgaggttctgtcgtcaggacatcgccgacatgctggccgagcagggacgcgcggacgccggtcagggcacggtggagcgctacttcgcggtcagcggcggcaatccgctgctgctgcgagccctcctggaggacgcccgcctcgagcccgacgacaccgtcgacgcccaggacgtggggccccgggccgggcaggcgtacggccgcgcggtcctcgcctgtctggaccgcggcggagagaaggcacacgaggtcgccgccggactcgccgtgctgggcggggcgttcacccatgaactgctctcccgcttactcgacatctccgccgcggcgctcaccgagaacctgcgcgcgctgcgggccgccggcatcgtggtcggcacgtccttccagcacccggcggccaaggccgcggtcctggactccctggagccgtcgcaccgcctccggctgcaccagcggtccgcggcgttgctgcacgcctccggcgcaccggcggccctggcggccgaacacctccacgaggccggacaggccgacggcgcctgggcggtgggcgtgctccagcaggccgccgaacaggccctgctggcggacgaggcacggcgggccgtgtcgtacctcgaactcgcccacgccgcgagcgcggacccgcggggccgtaccgagatcaagatcaggctcggctccgtcacgcgccgggtcagcgcggccgacgccgaacgccatgtggacgacgcgctgcgggggttcggggccggcctgctcaccccgtcggacacgggcggcctcgccgcgctgctgctggcccacggacggctggaacaggcgcgctcggtgctggagcagggacggcggccgggcgacggcgacgccgaccgcacagccgcgcggcgacagctcgccgagatccgcgacagcgtgctgaaccggggcgcgtggtgcgcgggcacccgggccgcctggcacgagaaccccgccgggcggccgtcgacgggccgggcgggcaccggcctgcgcgcctggctcagtgggtcgcacgccgcgctgctggcccagcgcatcgcgggcaccgagggcctgctggagatcacacacctgaccgacgccacgttcgacctggtactcaacgcggtctggacgctgctcgcgctcggcgccgtcgagcgggccctgcactggtgcgacacgttcctgcgagaggcgaagcggcgcgacgcgccgggctgggaggcggtcttcgcggccgtacgcgccgagggggccctgcgcggcggcaatctggccgaggcggagcgggacgcccgccgctgtttcgcggtcctgccggaacggcaccggtcggccctggagggcagcgcggtctcgtacctggtgacggtccagatcgcgcggggcaagtacgaggacgcggcacggcagttgagccggcccatggcggactcgctgcccgacaccatccactggctcgactatctgcgggcccgcgggctctactacatggccacccggcagtaccactcggcgctgcgtgacttccacgaggtgggccgcctcgccgagcggtggggcacggactggcccgccctgctgccctggcgcacggacacggccgaggcgctgctgcgcctcggggagcgggagcaggggctgcggctggccaccgagcagctggccatggtgcaggacggcgccccgcgcatcaagggcatctcactgcgcctccaggggctcgcgtcggagcccgccgcccggctcgggctgctcaaccgggccgtcgtggagctgagccgcgcggacgaccggctggagctctcgcgcaccctgttcgacctggccgacgcccaccgggagacccggcagacccggcaggcggcgatggtcctgcgccgggcgcggcaactggcgaagagctgcggggcgcagccgccccgggaccggatcggttcgcccgacgccgcgggggcgtcgggggaactcttcggcgagggacccgaacggaacgccgactggggacatctcagcgagtccgaacgccgggtcgccggcctggccgccagcggatatacgaaccgtgagatctcggtaagactctacataaccatgagtacggtggagcaacaccttacccgagtttaccgaaagctaaagataaacggacgtgaggaattgctggccgaagcccgcgcgggtgtgcaggtctgaaaccgccgggggtgaggttaggggggtgggaaaacctaggggttggtccccggggtggcgccggatagtgtcgaaacggctgaaacagcattactggagcggttgagaaaagcaatcccagattctgtgccaacgcggggagaacgagtggaactggcggattccggcgaccttttggaaatattcgagcgtaccgaggaaatggcgcggctcgcgcatgtgctggcgagtgccggacagggcgaaggcggtgtggtcctcgtcaacgcggggccgggagtcggcagaacggcactgctcgacgcgttcctgcggaaggccaccgaatccggcgcccgggtgtgcgccgccgcgggctcgtccgccgagaccgaggccgagttcggcgtcgtcggccagcttttcccgccgaccggtccgctgggcgccggattccgattggcccgggcgatcgggagccgcgacgccggtcccgggctcgacgcggaccggctcttcgacgcgctgtgccaggagctccggcgccggccgacggtgatcgccgtcgacgacgcgcagctcgccgacgcggcctcgctgcggttcctgcggtacctcgtacgacggctgcggacggccccggtcatgatggtgctcaccgaacccaccgggcccgacgcgctgccgccgtccttccaggccgaactcctgcgccatccgcagtgccgccgcctcggactgctgcccctgtcccgggacggtgtcacccaggtggtctcggcccaggtgggcagcgaccgggtaccgcgcctcgcggcggacttccacgccatcagcgggggcaacccgctcctcgtccacgcgctgctggcggaccaccgggcagcgcaccggctctcacctgtcccctctgtccctactgtcccctctgtttcctctgcctcgtcagctgcgtctgcctcgtccgctgcgtccgctgcgtccgccgtgtccgccgcgcccgccgccagtgccgccttcgccaaggcggccctcgcctgggcctaccgcgacgagcccgtgctcttcgacgtcgcctgcggcttcgccgtactcggcgagtcggcgacccccgcccgggtggcctgtctggtcgaccggggggccgacgccgtcgaccaggtcatgacggcgctggacacggcgggcctgctggcgggcggcaccttccgcagcgccctcgtcggcaaggccctgctggagcacgtggacgtggagaccagggcggaactgcgccgccgcgccgcccggctgctccatggcgacggagcgccggcgaccgtcgtcgcgcggcatctcctcgccgccccggtcgccgagccctgggcgggccgcaccctgctcgccgccgcggagaaggccatgcaggaagggcgggaggaactcagcctcgactgcctgcgactggccggacagagcgcgacgaccgaacaggaacgcgccgccgtcgtcatggcccgggtgaagatcggctgggagatcgacccccggctggtgagcccgtggctcgacgaactcgtcgccgcgctcaggcggggcgacctcaggagcggggacgccgcctggatcgtcaagcacctcgcctggcaggaccgtttccctgaggccgtggagagcctctcgacgctggccgcggccggcgatgccggcgaacccggcgtggaggccgaactccacttcgtacggcactggttgcgccactcctgtccgccgttggaggcgagcgtcccgggcccctcgaaccccacgaggccgcgcacgccccgcctgcgccgggtgagcccggcctcctacgccggcgaggtgctcggcaaggtcctcaccgagggccccgacgaccacaccgtcgccatggcggaggagatcctgcggggctgccggtacagcgagacggtcgtcgaggccctggaggcggcgctcctggccctggtctacgcggggcgtccggaccgcgcggcgttctggtgcgacgggctgctccagcaggccggaacccgctcgacgggcacgtcggtggcgatcctctccggcatccgggcggagatcgcgctcaggcagggcgcgctgcccgccgtggaacagtacgcgcgcagcgccctctcggccatctcgctgcccggctggggggtggccgtcggctccccgctggccgcactggtgcactccaccacggcgtcggggatgagcggggtggccggggcctggctcaaccaggccgtccccgacggtatgttccgcacccgccacggactcctctacacccacgcccggggccactaccacctcgccgtcgaccgcccggccgccgccctcgacgacttcctgacctgtggcgggctcgcgaaggagtggggcatggacgtgcccacgttccttccgtggcggacctccgcggcgcaggcgcagctcgccctcggcaaccccggtcaggcgcgggcgctggtgcgggagcagctcgggcggccgggcggcagtacggcgagggcccgcggagtggccctgcgcctgctcgccgccacgggcgaacccggccggcgtcccgcgttgctgcgcgagtcggtcaacctgctggagagctgcggcgaccaggtggaactcctccgtgccctggccgatcgctgccaggcgttggaccacgtcggtgcgcccgcgaaggcacggatgacggcccggcacgccaggaacgtcgccgacgcctgcggcggggatgcgctgttccgcaagctcttccgggacgaggtgcccgaccgcgagggcgaccccgacgggctgacgggcgaggagcagggctccgcgagcctgacggcggcggagcggcgggtcaccgccctggccgcgctcggccactccaaccgcgagatcgggcgcaagctgttcatcaccaagagcaccgtcgagcagcacctcacccgcgtctaccggaagctcggggtgcgcaaccgggccgacctgggcgatctgctcgccgggacgaacctcggcgccgggacaccggccatggccatggcgtcctcggccgtcgcgggctgaggacgctgtcgcgggctgaggacgccctgtgtggcggcggtcgccctgtggggcggtggtgacccgtgtggcggctgtgaggggttgtttagtggttgaggctaggggcggcgcgctcggatattcggtgggaactgcggcccttccgtagcaccgaatgcgcgtcgtgcatttcgcgtcgtgcattcctgaattccgtcggccgaatcggcgccgacctccccggtgttcaccggtgtttcgccggtgttcgccggtgtccccggtgtacatgaaccggctcacggccgagaagcagcgggaaccggacgaggggctcatcagccacctgttgaccagcgtgaactgcccgccgacgaagtcgcgggcgccggcctgctgttgctgctcgccgggcacgagctcaccatcgtgcggaacggcgggggcgggtcgccctggaggacgtggaggtcggcgggcagacgatcagggcgggggagggcgtgctgtgcacgctgtccaccgccaaccgcgacgagggggcgttcaccgaccccgatgagctggacctgcggcgcgacgcccgcagccacctgagcttcgggttcgggatccatcagtgcatcggccagtcgctggcccgcgccgaaccgcagatcgccctggagacactgctgcgcaggctcccggggctgcgactggcggcctccttcgaggagttgcggttccgggacggggtcgggttctacggggtcaaggagctgccggacccctgtcccgcactgccgccggaccggccctaaggggtcgggtagtggttgaggctaggggcggtggactcggatattcgaaatgaactgcggccatcgcgccgcttgagcgcgcttcgcattttcctagtgaggtaagggaaacacatggcgggtgggtccgaggcagaggccgctgaattccgggcgcgatccattcagccgatagcggtggtgggaatggcgtgccggctgccgggtgcggcgggaccggccgagttcctggctctcctccgaaatggcgaggacgccgtcggtgccgctcccggggaccggcggtacgcgccacggcggggcggattcctcgactccgtcgacgagttcgacgccggcttcttcgggatctccccgcgcgaggccgcggcgatggacccgcagcagcggctggtccttgagctgagctgggaggcgctcgaggacgccgggatcccgcccgcccgcctcggcggcagcggcgccggggtcttcgtgggcgccatcgccgacgactacgccacgctgtcccgcgccgccggcgccgacgccgccaccccgcagacgacgaccggtctgaaccggggcatcatcgccaaccgcgtctcctacacgctgggcctgcgcggaccgagcttcaccgtggactcgggacagtcgtcgtcgctggtcgcggtgcatctggcggccgagagcctgcgccggggcgagtgctccgtggccctggcgggcggggtgaacctgatccttgccgaggactccaccgtcgccgtggaacggttcggggcgctctccccggacgggtactgctacaccttcgacgcgcgggccaacggctatgtgcgcggcgagggcggtggcgtcgtcgtactcaagccgctcgccgacgcgatcgccgacggcgacgacatccactgcatcctcgcgggcagcgcggtgaacaacgacggcggcggcgaggggctgaccgtcccggaccgcgccggccaggaagcggtgctgaccgccgcgtacgaacaggccggaatctccccggccgccgtcggctatgtggagctgcacggcaccggaacccccaccggcgatcccgtcgaggccgccgccgtcggggccgttctcggcgccgggcgtccggccgggcagccgctgctggtcggctccgtcaagacgaacatcggccacctcgaaggcgccgccggtatcgccggcctcctcaaggccgtactggccgtgcgccaccgggagatcccggcgaccctgcaccacgcgtccccgaacccggccatccccatggcggagctcggcatcggcgtcaacacggcactcacaccctggccggagcaggcagggccgctggtcgtgggcgtgagctccttcggcatgggcggcaccaactgccacgtggtgctcaccgaacccgcggggtacgacgccgccgctcggccggccacggccgggatcaggcccgccgggacaccggccccgctgctcgtctcgggccgcgacgaacaggcgctgcgcgcccaggcacgcaagctgcgggaccacctcgacacgcaccccggcctccccctgcgcgacgtcgcccacacgctggccgccgcccgtgccccgctcgcccggcgcgcggtactgctcgccgcggaccgggaggacgtgtccgccggtctcgcccggctcgccgacggcacacccggcgcggacctcgtgcgcggcacggtctccccgggcgcgctcgcgttcgtcttcaccgggcagggcagccagcgccccggcatgaccgccgagctgtaccggacgtccgcggagtacgccgccgccctggacgaggtgtgcgcgagcctggacccgtggctgcgacggccgctgcgggacgtgctgttcgcggcggaaggttccgacgaggcggcgctcctggaccgtaccgagttcacccagcccgccctgttcgccgtcgaggtcgccctcttccggtacgccgagcactgcggcctgacaccgcggttcctgctcggtcactcggtcggtgaactggcggccgcgcacgtcgccggagtcctctccctggcggacgcctgcacgctcgtcgccgcccgcggccggctgatgcaggaccggccggcgaccggcgcgatggtgtcggtccaggccaccgaggacgagctggcaccgttcgtctccgagtcggtgaccctggcggcgctgaacggccccgcctccacggtgatcgcgggtgacgaggacgccgtactggccgtcgccgcgcactgggcggcccggggacgcaagacgaaacgactgcgggtcagccacgcgttccactccccgcacatggacgggatgctcacggagttccgccggatcgccgccggactgaccttcggcgcgccccggatcccgatcgtctccaacgagacgggcaccctgctcaccgaggccgacgcccgctcaccggagtactgggtacggcacgcccgtgccgccgtgcgcttcctggacggggtgcgcctcctcgaggaccagggcgtgaccacgctgctcgaactgggccccgacggggtgctgtcggccatggcacgggactgcctgcgcgatgccgggaccgtgtgcgtgcccctgctgcgcggccgcgaccggaccgaaccggaggcgctgctcgccgcgctcgccggactgtacgtccgcggcgtaccgatggactgggagcggacggccaccgaggcgggcgcacggcgggtaccgctgcccacgtacgcgttccagcggaggcggcactggctgccggagccctcggcgagcgcgtcccggcccgtggtgaacggtggtgggcacgcggggcaggcggggcacgcggggcaggcggggcgcgcggggcaggcggggcacgccgggcacgatggcgagcccgcccccgcggtccgcgaccgtacgacaccggaactcgtccgcgaccgtacgacgctggaactcgtccgtgacgccacggcccaggtgctcggccacgcgtccccggacgacgtcgcgacgcacgaggcgttcagggaactgggcttcagctccctgatgctggccgaactcggtgaacgcctcaccgaggcgaccggccgcagggtgcccaccacgctgctgttcgaccacccgacgccggacgccctcgcgcgccggctcgaggccgacggggcggagcgcacggacgcaggcccggtgagcccgccggccgccgccgcgcacgacgacgaccccatcgtgatcgtcggtatgggctgccggctgcccggcggcgtccggtcgcccgaggacctctggcggttcgtggccgccgggggcgacgcgatctccgcgctgcccgtcgaccgcggctgggagttcgccgcggacttccccggcgagggcgggttcctcgcggacgtggccgagttcgacgccggattcttcgggatctctccgcgtgaggcgctggcgatggatccgcagcagcggttgttgctggagacgtcgtgggaggcgctggagcgggcgggcgtggacgcgctgaagctgcgcggcagccgcaccggcgtcttcgtcggcgccagcccctcggagtacgggccccggctgcacgagacctccgacgccgacgggcatgtgctgaccggtacggcgcccagcgtgctgtccgggcggatcgcctacgtgctggggctggagggcccggcgctgacggtggacacggcgtgctcgtcgtccctggtggcgctccatctggcggcccaggcactgcggggcggcgagtgcgatctcgccctggccggcggtgtcacggtgatggcgacctcgggcatgttcgccgagttcgcgcggcaggggggcctggccccggacggccggtgcaaggcgttcgccgacggagcggacggcacgggctggggcgagggtgtcgggatgctggccgtgcagcggctgtcggacgcggtgcgggacgggcgtccggtgctggcggtggtgcggggttcggcggtgaactcggacggtgcgtcgaacggtctgacggcgccgaacggtccgtcgcagcagcgggtgatccggcaggcgctcgcttcggccgggttgtcggcggcggacgtggacatggtggaggcgcacggcacggggacgtcgctcggcgacccgatcgaagcgcaggccctgcttgctacgtacggccaggaccgtccggacgaccgtccgctgtggctgggttcggtgaagtcgaacatcggtcatacgcaggcggccgcgggtgtggcgggtgtgatcaagtccgtactggccctgcggaacggactgctgcccaagaccctgcacgtggacgagccgacccccgaggtggactggtccgcgggcgcggtggagctgctgacggaggggcgggagtggccggagacggacgggccgcgtcgggcgggcgtgtcggcgttcgggatcagcggcacgaacgcgcacgtgattctggagcaggcgccgtcggtcgaggaaccggtgaccgcgcctgcggatgacgggttgttggtgccgtgggtggtgtcggcgcggtcggaggaggcgttgcgggcgcaggcccggcgcctggccgaccacgtacgggagagtggacttcggccggccgacgtgggtctgtcgctggcggtgacgcgtgccgggctggagcaccgggcggtgctggtcgcggaggacgaggccggattcctggcccacttggacgcgctggccgagggcaggaccccggccggtgtggtggtggagggcgggacggcgttcctgttctcggggcagggctcccagcgcgcgggcatgggccgtgagctgtactccgcccaccccgtgttcgcggccgccttcgacgaggtgtgcgccgccttcgacggtctgctgcccggggcgctgcgggaggtcgtgttcggcggtgcgggcctggaccggaccgagtgggcccaacccgcgttgttcgcgttggaggtggcgctgttcgagctggtgagttcgtggggtgtgcgcgcggatgtgctgttgggccattcgatcggcgagctggctgccgcgtatgtggcgggggtgtggtcgctggcggacgcgtgccggatcgtggcggcgcggggccggttgatgcaggcgctgccggagggcggtgcgatggtcgccgtcgaggcggccgaggacgagctgcccgaccttcccgggggtgtgtcggtggctgcggtgaacgggccccgttcgctggtgctgtccggcgatgaggagccggtgaccgcgctcgcgcaagcgtttgctgaacagggcaggcggaccaagcagttgacggtcagtcacgcgttccattcggcgcggatggagccgatgctggcggagttcgccgagacgctcgccgccgtggagttccgtccgccgcgcatccccgtcgtgtcgaatgtgacgggtgagatggcgggcgacgagttcaccacccccgcctactgggtgcggcacgtccgggaagccgtccgtttcgccgacggggtcggcgcggcccacgccgcaggcgtccggcggtacctcgaactcggtccggacggcaccctgaccacactcgcccacgacaccgcccacgacgccggccgcgacgtggccgccgtacccgcgctgcggggcgaccagcccgagacccggaccgtggtgaccgccgtcggccgcctgtacgccaccgggctgaccgtggactggcccgccttcttcgctccgtacggtgcccgcccaaccgagctgcccacctacgccttccagcaccgccgttactggctggagccggtcgcaccgtcgtccgcgcccccggcgaacccactgcgctaccgcaccgcgtgggcgtccgtgcccgacggcccccggccctcgctgagcggcacctgggccgtcgtcgtaccggcatccgggtcgtacgaggacatcgtggccggtgtgacggccgcactgcgtgaccatggcgcgcggcccgtcgtggtggaggtcgacccggccggacccgagcgcgccgacgtcgcggacaccctgcgcgcggcgctcggcgaggacgccgggggagtggtgtcgttgctcgggacggccggctcgctctcctcgggcgtggccgcgaccgccgtgctggtgcaggcgtggaccgatctcggcggcggcgcccggctgtggtgtctgacccggggcgcggtgtcggtgagcccctccgacccgctggccgcgccggcgcaggcgcagctgtgggggatgggccgggtcgcggcgctggaacacccggagcgctggggcgggctcgtcgacctgcccgccgtaccggacgaccgggcgtggacccggctgtgcgccgtactggcgggcggaagcggcgaggaccaggtcgccgtccgtgccgccggcctgttcgcgcggcggctgggccgggccggtacgcgggccgacgccgcccccgccgggccgagcccctggcgtacggacggcacggtgctcgtgaccggcggcacgggggcgctcggcgcgcacctcgcgcagtggctggcggcggccggagccgcgcatgtgctgctcaccagcaggcgtggccccgacgccgacggagccgcggaactgacggcgcggctgcgcgagacgggaaccgaggtgacggtcgccgcgtgcgacgtgaccgaccgggacgccctggcggagctgctctccgggctgcccgccgaccggccgctgaccggtgtcgtacacgccgcgggcgtcctggacgacggcgtgctcgactccctcacccccgaccggttcgccgccgtcgccggacccaaggtgaccggggcgtggcacctgcacgagctcacccgggacctggacctctcggcgttcgtgctgttctcgtccttcgcgggcaccgtgggcctggccgggcaggccaactacgccgccgcgaacgcgtacctggacgcgctggccgtccaccgggcccagctcggcctgcccgcgaccgcggtggcctggggctcctggtccggcgccggaatggccgccgacaccgaggccgcccggcgccaactggcccgcaccgggctcgtccccctcgccccggacgccgccctggccgcgctcgggcaggtcatggacgacggcgagaccgcggtgaccgtcgccgacgtcgactgggaccggttcgcggcgggcttcggacccggccggccgagcccgctgctcaccggcgtccccgaagtacggcgcatcgaggagcgggagaccggccgcgccggcgccccggcggagacggaccggctcggcgggctgaccggcgacgcgctgcgccaggcactcgccgacctggtgagcaccgaggtcgccgccgtcctcgggctgccgcccaccgaccgggtgcgggaggacacgaccttccgggcgctcgggttcgactcgctgatcggtgtcgagttccgcaaccggctcgccgcggccaccggcaggcggctgccgccgagccttatcttcgaccacccgacccccggcaggctcgtcgaacacctggcggcaggcctggacggaaccggcccgaacaccgccggggaggaacgggtcgcaccggcccgtacccacgacgacccggtcgtgatcgtgtcggccgcctgccggttccccggcggcgtcacgaccccggaggagctgtggcagctcgtcctcgacggcggcgacgccatcggccccttcccggccgaccggggctgggacctcgaccgcctgtacgacccggaccccggcaaccccggcaccagttatgtgcgtgagggcggcttcctgaccgacgtggcggacttcgacgccgcgttcttcgggatctcgccgcgcgaggcgctggccatggacccgcagcagcggctgctcctggagacctcgtgggaggcgctggagcgcgccggcatcgtgccggcctcgctcgccggcagccgtaccggcgtcttcgtcggctccaacggccaggactacgccaccctgctcggcgagtccgaggtcgaggggcatgtgctgaccggtacggcgtccagcgtgctctccggccgtatcgcctacaccctggggctcgaaggacccgcgctgaccgtcgacaccgcctgctcctcctcgctggtcgcactgcacctcgccgtccaggcgctgaacgcgggcgagtgcgacctcgcgctcgccgccggggtgaccgtgatgtccagcccggagatcttcgtggagttctcccggcagcgcggcctctccgcggacgggcgctgcaaggcgttcgggcccgacgcggacggcaccggctggggcgagggcgtgggcaccgtactcctggagcggctctccgacgcccgccggctgggacacgacgtgctgggcgtggtgcgcggcaccgcggtcaaccaggacggcgcgtccaacgggctcagcgcgcccaacgggcccgcgcagcagcgggtcatccgccaggcgctcgccgacgccggctgcgtgccctcggacgtggacgccgtggaggcgcacggtacggggacccggctgggcgacccgatcgaggcgcaggcgctgctggcgacgtacgggcgggaccggccggccgaccggccgctgtggctcggctccgtgaagtcgaacatcgggcacacccaggccgcggccgggatggccggagtgctgaagaccctgtccgcgatgcggcacggacagctgccgcgcaccctgcacgccgcccggccgaccccgaaggtcgactggaccgagggcgcggtcgaactgctcaccgagacccggccctggcccgccaccggcgcccggccgcgacgcgcgggcgtgtccgccttcggtgtcagcggcaccaacgcccatgtcatcctcgaacaggcacccgcaccgcagccggcccggcccgccgtactgccaccgctcctcaactccccctccgtgccctgggtgctgaccgccaagtccgaagaagcgctggccgcccaggcggaccggctgagcgcacggctgcccgaggcggcgcccgccgaggtcggccggtccctcgtgacgaccagggcgacctggccggagcgggccgtactcatcggtgacggctccccgcacttcgcggcggggctcggcgcgctggccggcggcgcgggggacccgcgggtggtgcgcggcaccgccgacacccgcggccgggtcgtcttcgtgttccccggccagggcgcccagtgggccggcatggccgcgcggctgtgggagtcgtcgccggtgttcgcccagtggatggaccgctgcgccgaggtgctggcgcggctgaccgactggtcgctgaccgaggtgatccatgagacgcaggacgcacccggactggaccgggtcgacgtggtgcagcccgcgtcctgggccgtgagcgtgtcactggccggcctgtggcgtgcctgcggtgtcgagccggccgccgtggtcggacactctcagggcgagatcgccgccgcctgcgtggcgggcggactgtccctggaggacggcgccgccctcgtgacgctgcgcagcaggctgatcgccgaggaactgtccgggcacggcggcatggtgtccgtggccctgtcccccgccgacacggccgaacgcatcgcccgctggaacggcgggatctgtgtcgcggcgaacaacagccgccgctccaccgtcgtgtccggcgaaccggaagcgctggccgaactgctcgccgagtgcgaggccgagggcgtacgggcccgccgcatccccgtggactacgcctcccactccgcccaggtggagcggatcgagcggcagctgaccgagctggcggccggtgtcgcaccgcgcccgggggacatccccttccactccacgacgaccggcggcccgctcgacaccacgggcctggacgccgactactggtaccgcaatctgcgccggcccgtgctgttcgggccggtcaccgaggaactcctcgcccagggccacgacgtgttcctggagatgagcccgcacccggtactcgtccccgcggtgcaggacgccgtcgacgcgaccggcacgaccgccgccgccgtgggcagcctgcgccgggacgacggcggccccgagcggttcacgctctccctggccgaggcgttcgtgcgcggcgcccccgtggactggacggccgtgctcggcaccagcggcgcccgccgggtcgagctgcccacctacccgttccagcgcggccggttctggccggagccccgcacggcggccgccacgaccggcggtgccgaggaggacgcgccgctgtggcgggccgtggaccgcggcgacctggccgccgtcgccgccgaactcgccctccccgacggggagtcgctgcacgacctgcacgacctggtgcccgccctgtccggctggcgccgcaggcgcaaggactcggcgctggtcgacagctggcgctaccgcgtctcctggaccccggtgaccgccccggtcctggccgccctgaccggcgactggctgctggtgaccgcggacccggacggcgaggccgcccggtgggcgcgtacggcgctcggcgcgagcgtcaccgcccagctcacctcgccggacggcccgataccggcgggcccgtggacaggcgtggtgtccctgctgggactggccgaccggccgcacccggaccatcccgtcgtaccggtgggcgtcgcggacaccgtggccctgctgtccgcgttgcgcgaggccgggatcgacgcgccgctgtggggtctgaccaggggcgccgtcggcaccggacgctccgaccaggtccgcgcgcccggccaggcccagctgtggggcctcggacgggtcgccggcctggagaaccccgccgcctggggcggactcgtcgacctgcccgccgaactggacgaccgcgccgccggactgctgcgggccgcgctcgccgcgggcgaggacgagcaggagtacgcgctgcgccccgccgggctgtatgtgcgcaggctggtccgtgctcccctggacgggacggcggcgcgacgctcctggcggccccggcccgacggcacggtcgtcgtcaccggcggcaccggcgcgctgggcgcccgggtcgcccgctggctcgcccacgcgggcgccggacacctcctgctgaccagcaggagcggtatggccgccgacggcgccgacgacctggtagcggaactgcgcgcgctgggcgcccgggtcacggtcgccgcctgcgacgtggccgaccgcgcccagctcgccgcggccctggacacggtgccggacgagttcccggtcgccgccgtggtccacaccgcgggcgtgaaccgcaccgccaccctcgaccggaccaccctcgccgagctggcggacgtcatgtcggcgaaggccgccggcgcccgcaacctggacgaactcctcgccggtcacgacctcgacgcgttcgtcctcttctcctccggcgccgcgatctggggcagcgcgggccagggcgcgtacgcggccgccaacgcgtacgccgacgcgctcgcggcggaccggcgcaggcgcggcctcaccgccacctccgtggcctggggcagctgggccggcggcgggatggtcgacgacgacctggcgcgggacctcgcccgcggcggggtgcgctcgatggacccggaccgggcgatcggcgcgctccagcaggccctcgaccacgacgagaccacgctgacggtcaccgacatggactgggagcgcttcgccgggacgttcaccgcggcccgcccgcgccccctcatcgacgccatcccggaggccgcccgcgccgccacgacggatccggccgccggagagtccgaactggccgccaggctggccgggtcgaccgacggcgaacgcgaacgcgaactcctcgacctggtcaggaccgccgccgccctcgcgctggggcaccggggcgccgaggccatcaccccgtcgaagcccttcaaggacctgggcttcgactccctgaccgccgtcgacctgcgcaaccggctcaccgccgcgaccggcgtacgtctgcccgccacgctcgtcttcgaccaccccacgccgctcgcggccgccgtcgagttgcggacgcggctgttcggcggcgacgcgctcccgacgtccgcggggtccgtggcgcccacggcggccgaggccgacgatccggtggtcatcgtcgccatggcctgccggttccccggtgaggcgacctcgccggagaagctctgggacctgatcgcggcgggcaaggacggaatcggggacttccccgccgaccgcggctggagcgtcgccgccgacgccgcgttctcccagaccggcgggttcctcccggacgtggccgagttcgacgccgggttcttcgggatctcgccgcgtgaggcgctggcgatggatccgcagcagcggttgttgctggagacgtcgtgggaggcgctggagcgggcgggcgtggacgcgctgaagctgcgcggcagccgcaccggcgtcttcgtcggcgcgggctcccacgactacggcaccctgctcacctcactcgaaggaggccaggactacgcgctcaccggagccgtcggcagcgtgctgtccgggcggatcgcctacgtcctggggctggagggcccggcgctgaccgtggacacggcgtgctcgtcgtccctggtggcgctccacctggcggcgcaggcactgcggggcggcgaatgcgacgtggccctcgcgggcggcgtggcggtcatggccacccccgacgccttcgacgcgttcgcgcggcaggggggcctggccccggacggccggtgcaaggcgttcgccgacggggcggacggcacgggctggggcgagggcgtcggcgtactcgtgctgacgcgcctgtccgaggcgcggcgtcgcggccatgacgtgctggcggtggtgcggggttcggcggtgaactcggacggtgcgtcgaacggtctgacggcgccgaacggtccgtcgcagcagcgggtgatccggcaggcgctcgcttcggccgggttgtcggcggcggacgtggacatggtggaggcgcacggcacggggacgtcgctcggcgacccgatcgaggcacaggcgttgctggcgacgtacggtcaggaccgtccggcggaccgtccgctgtggctgggttcggtgaagtcgaacatcggtcatacgcaggcggccgcgggtgtggcgggtgtgatcaagtccgtactggccctgcggaacggactgctgccggcgacgttgcatgtggatgagccgtcgcgggaggtggactggtccgcgggtgcggtggagctgttgacggaggggcgggagtggccggagacggacgggccgcgtcgggcgggcgtgtcggcgttcgggatcagcggcacgaacgcgcacgtgattttggagcaggcgccttcggtcgaggaaccggtgaccgcgcctgcggatgacgggttgttggtgccgtgggtggtgtcggcgcggtcggaggaggcgttgcgggcgcaggcccggcgacttgccgaccatgtggcagccacggatctcaccgtcgcggatgtcggctactccctggcggggacgcgtgcggggctggagcaccgggctgttctgacggggcgggagcgggaggacttcctggtccagttggccgcgttggcggagggtgcgagtgccgcggggatggtgcggggtgtggccggggagggcgggacggcgttcctgttcaccggtcagggtgcgcagcgtctgggtatggggcgtgagctgtacgagcgtttcccggtgttcgcggctgcgttcgacggggtgtgtgcgcagttggatctgttgctggagcggccggtgaaggaggtcgtcttcaccgacgcgccggcgttggaccgcacggtgttcacgcaggccgggttgttcgcgttggaggtggcgctgttcgagctggtgagctcgtggggtgtgcgcgcggatgtgctgctggggcattcgatcggcgagctggcggccgcgtatgtggcgggggtgtggtcgctggcggacgcgtgccggatcgtggcggcgcggggccggttgatgcaggcgctgccggagggcggtgcgatggtcgccgtcgaggcggccgaggacgagctgcccgaccttcccgagggtgtgtcggtggctgcggtgaacgggccccgttcgctggtgctgtccggtgatgaggagccggtgaccgcgctggcccggacgttcgccgaacagggcaggcggaccaagcagttggcggtcagtcacgccttccactccgcgcggatggagccgatgctggcggagttcgcggagacgctcgccgcggtggagttccgttcgccgcgtatcccggtggtgtcgaatgtgacgggtgggatggcgggcgcggagttcaccactcccgcctactgggtgcggcatgtgcgggaggccgttcgtttcgccgatggtgtggcgacggtgctggcgcggggtgtggacaggttcctcgagctgggtccgcggggtgcgctgaccgcgatggccgaggagaccctcgaccacaccggtgccgacgccgtgtgcgtgcccgtactgcaccccgaacgccccgaggacgccacgctgttgcacgcgctggccaccgcgtcggtgacgggtgcggccgtcgactggacgaccccgttcgcctgcgcccgcaccacggagctgccgacctacgccttccagcgcaggcgcttctggccgcggcccgccgcgagcgcgggcgccggcgacctggccgcggccggactggccgaggccggacacccactgctcacggcatggctcccgtcgcccgagggggacggggtgctgtgcaccggccggctgtccctcgcgacacatccgtggctcggcgaccacacggtcctcggcacggtgctcgtaccgggcaccgcgttcgtcgacctcgtcggctgggtgggcgaccgcgtcggctgcggcgggatacgggagctgaccctggccacgccactggcactcgccgaggacgcggcggtacggctgcgcgtggtgctcggtgcgcccgacgacaccggatgccgtccggtcgccgtgtacgcgcagccggacaccgaggacgagggaacggactggacccggcacgccgagggcctgctggccccggccgacgcgtcggacaccccggcggcaccccccggccccgccctcgacgcatggccggtgccgggcgccgaaccccttcccatggacgggttctacgaagggctcgccgacgccggtttcgcctacgggcccctcttccggggactgcgggcggcctggcggcgcggtgacgaggtcttcgccgaggtgagcctgcccgccgacgagagcggcgccgggttcggcgtgcaccccgccctgctggacgcggcgctgcacgcgctgggccccgccgcccaggcctcggacgagccaggatcggcccggctgccgttctcctggggcgaggtgcgggtgcacgccgtcggcgcggatctgctgcgggtccggctggtccgggccgcggacggcaccgtcaccctggacgccgccgacgccgcgggccggccggtggtctccatcggctcgctcgtcctgcgtccgctgtccccggaccgcctgcgcgccggtacccaggcacccgacgacgcgctgttcgccacccgctggataccgctggacgtcacgggcgacacgggcgacacggcgcgggacaccgtcgagtgcgtgctgctcggcgagccgtcggcgggcgcctggcgttcccaccccgacctcgcggcgtacgcggcggccctcgcggacggcaaggagacgccgggcccggtcctcgcccgctgcccgctgaccaccggggaccccgccgaggcggcccggcgttccgccgagtggaccctcgacctgctccagcagtggctggccgacgaccggttgaccgacagccacctcgtgatcggcacccggcacgcggcccccgtcgccaccccatacgcggcccccgtcgacgccacggacgcggacgcggcccccgtcgacgccgggcacgaagcccccgtcgacaccgccgctgccgcgctcgcccagtccaccctcgccggcctcgtccgttccgcccagaccgagaaccccgcccgcatcaccctcgtggacttcgacaccaccgccccggacccggcccacctcaccgcggccgtacgcctcggcgagccggaagtcgccgtccggcagggcacgttgtacgcccgcaggctcacccgtccggagaccggccgggccctgaccgtgccgcccggccccggcccgtggcggctggacagcaccggccgcggctcactggaccacctggcgctcgtgccgtgcccggacgccgcggcgcccctggccgagggcacggtgcggatcgccgtacacgccgccggggtgaacttccgggacgtcctgatcgccctcgacatgtatcccggccgggcggacctcggcaccgagtgcgccggcgtcgtcctggagacgggacccggtgtcaccgggctggcccccggggaccgggtgatgggcatggtcgccggggcgttcgggcccaccgcggtcgccgaccggcgcgtgctggcgcggataccggacggctggtccttcgagaccgccgccgccaccccggtcgccttcctgaccgcctactacggcctggtggacctggccgggctcggcgcgggcgaatcggtgctcgtgcacgccgccgccggcggggtcgggatggccgccgtgcagctggcccggcacctgggcgccgaggtgttcggcaccgcgagcgaaccgaagtggagcaccctgctcgacaccggtctcgaccgcgcgcacatcggctcctcacggacgctcgacttcgcggacctggtgcgcgagacgaccggcggcgcgggcgtcgacgtcgtactgaactcgctcgcgggcgagttcaccgacgcctcgctgcgcgcgatgccgcgcggcggccggttcgtcgagatgggcaagaccgacccccgcgaccccgaacgcgtcgccgccgaccaccccggcgtgcggtaccgctccttcgacctgggggaggcgggcccggaccgcatcgccgagatcctcgcccatctcgtcgagctgttcgagtccggcgcgctcaccccgctgcccgtcaccacctgggacatccgggacgcgacggacgccttccgtgtgctgagccaggccaccctcaccggcaaggcggtcctgaccgtccccgccgggtccgtcccgttcgaggccggtgagacggtcctgatcaccggcggcaccggcaccctgggcaccctgctggcccggcacctcgtcaccgagcacggactgcgtcatgtcaccctggccggacgccggggcacggacacgcccgaagtgcggcaactgcgcgccgacctcgccgagatgggcgcggaggtacgggtcgaggcctgcgacgccggcgacgaggacgccgtacgacggctcctggaaccgctcaccgcgcaccaccgcctggccggagtcgtccacgccgcgggcgtcaccgacgacggggtggtgtccgcgctcgaccggcggcggctgtccgccgtactgcaccccaaggtgcgcggcgcctggaacctgcaccggctcaccgcgcacctggcgccccggatgttcgtcctgttctcctccgcctcggccacactcggcgcggccggccagggcaactacgccgccgccaacgccttcctcgacgcgctcgccgagcaccggcacgcccggggcctgcccgcgagcagcctcgcctggggactgtgggaccaggccagcgggatgaccgggcgcctcgcggaacgcgaccggcagcggatgagccgggccggcgtcgcccccctcgactccgcacacggcctcgcgctgttcgacaccgcgctgctcaccggtatcccggcgctgacgcccgcccggctcgacctggccggactgcgggccagggccgcgcaccagccggtcccggccgtactgcgggaactcgtccgcgtgcggcgcgtggcggccaccggcacgacggccccgaccacggggacgcccggtgacgcgcggacgctgacggagcggctggccgcgctgtcccccgccgagcggcaccggctcgtactggatctggtgcgcgagcacaccgcgggcgtcctcggtcacggctcggccgacgacatcgaccccgaccaggcgttcaagacgctcggcttcgactcgctcaccgcggtcgaactccgcaaccggctgcggacggccacctccctgaccgtccccgcgaccctggtcttcgaccaccccaccccggcggcgctcaccgcgcatctgctggaactcgccgcgccgccggagcacgacccggtgctccaggtcctgggcgaactcgaacggctcgaagcgggcgtcgaggcgctcggccccgtcgacggcgcccacgacgaagtcgtcgcacgactgcgccggatcctgcgcaaggccgaggccggctccgcgccggacggcggcggcgaggactcctcgctccagacggcctccgcggcggaagtgctcgcgttcatcgacagcgaattcggcgatctcgcctagtacacatacggagttgatcgcagtggtggatgacgacaagctcgtcgactatctcaagcgggtcaccgcggacctgaagcggacccggcagcgggtgcaggaactggaggcgggcgccgccgaacccatcgccgtcgtctcgatgggctgccgcttcccgggcggcatcgcctccccggaggacctgtgggagtgcgtgcgcaccggcaccgacaccatctccgggttccccaccgaccgcggctggcgcaccggccacctgcgcggcgacttccgcctcgcgggcggcttcctcgccgacgcggccggtttcgacgccgggctgttcggcatctcgccgcgtgaggcgctggcgatggacccgcagcagcggctgctcctggagacctcctgggaggtcctggagcgggcgggcctcgaccccaccacggtgcgcggcgccgacggcggggtgttcgtcggcatggccgaccagaagtacggcccgcgcgacggtgaactcctcgaccaggtcaagggcctggtcctgaccggcaccaccagcagcgtcgcctccggccggatcgcctactcgctcggcctccaggggcccgcgatcaccatcgacaccgcctgctcctcctccctggtcgccctgcacctcgcggtacgggccctgcgctcgggggagtgctcgttcgcgctcgtcggcggtgccgcggtgatggcggaaccccagctgttcgccgagatggcggagcagggcgggatggcgggcgacggccgctgcaaggcgttcgccgcggcggccgacggcaccggctggggcgagggcgtcggcgtgctcctgctccagccgctgtccacggcccgggaacagggcctgcccgtcctggccaccgtccgcggcacggccgtcaaccaggacggcgcctccaacggactgaccgcgcccaacggtcccgcccagcgccgcgtcatccgcaaggccctcgccgacgcccagctcagcgtcggccaggtcgacgcggtcgaggcgcacggcaccggaacccggctcggcgaccccatcgaggcgggggccctgctggccacctacggccaggaccgggccggggacgagccgctgtggctcggctcggtcaagtcgaacatcggtcacacgcaggccgcggccggcatggccggagtcatcaagatggtgctggcgatgcggcacggactgctgccgcgcaccctgcacgtggacgaacccacaccccaggtcgactggtcggcgggcgccgtacggctgctgacggaggaacagacctggccgagcaccggccggccgcgccgctcggccgtctcctccttcggcatcagcggtaccaacgcccacgtcgtcctcgaacacgaccccgccgcgagcggcgcggacggcgcacccgagcccggccccgacacctcgcccgccgcccccgtcccgtggacgctgtccgccgcgagcgaggaggcgctgcgcgcccaggcacggcggctgcaccggtacgccgacggcgaccccggacggcgcccgctggacatcgcccgatccctggcccgtggccgcgcccggctcgcgcaccgcgccgtcgtgctcggcgccgaccgcaccgaactcctcacgtccctggccgccctcggcgcgggcgagcccgacccccgcgtcgtacgcggccggaccgtgccgagcggccccgtcgccttcctgttcaccggccagggctcgcagcgggcgggcatcgggcgggaactgtacgagaccttcccggtgttcgcccgcgccttcgacgaggtgcgcgaccggctcgacccgcaactcgcccacccgctcgacgacatcctcgacgggcgcgtcgtggacggactgccgctgatcgagcagaccgggtacgcgctcgccgcggtgttcgcgctggaggtcgcgctgttccggctggtcgaacacgccggtgtcgtccccgacttcgtcctcgggcactccaccggcgagctggccgccgcgcactgcgccggggtgctctcgctggacgacgcctgcaccctcgtcgcggcgcgcggccggttcgtgcagaccctgcgcaccgacggcgcgatggtcgccgtcgagacctccgagacggaactcgccgaactcatcgcgcgggccgacgtcggcgaccgggcgaccatcgccgtggtgaacggaccccggtccgtggtggtctccggtgacgcggacgccgtcgagcgggtgcgcgcccggtgcgaggagcgcgggcgcaagacgcgcaagctgcccatcagccacgccgcgcactccgtccacatggaaccgatgctggcgcggctgcgcgaggtcgccgagggcctcgaacaccgcccgccccgcatccccatggtctccaacctgaccggcgcacccgtcccgcccgaggcgaactggccggagtactgggtccgccaggtccgcgagacggtgcgcttccacgacggcatccgctggctcggcgcccagggcgtcaccgcctgcctcgaactggggcccggcggagcgctcatcgcgatggcgcgcgagagcctcggcgacccgggccgcgaggtggccctcgtccccaccctccagcacgaccggcccgagccggccacgttcctgtccgcgctggccgaactgcacgtgcacggcgtggccgtcgactgggacaccccgctcgccgcccgcggcgcgaccagcaccgacctgcccacctacgccttccagcgcgagcgctactggctgcccgccacccccgcggcaccacgcaccgccgaaccggccgaccggaccggacgcgtgcgctaccgggtcggctggacgccgtacccggacgtcgacaccgacgcgcggccgaccggcacctggctggtcgtcgcccccgacggcgacagcgacggtgacggtcacggcgacggagcgcgggtcgccgaggccctgggggagcgggcggtgctgctgaccgccgggcccggcctcgctcccgccctcgcgcggctgcccgaggaccggcccgtcgcgggcgtgctcgcgcttcccgcggagtccgcgacccgctggacccgcctggcccctcgttcagccctccgaggccggggtgcgcgccccgccagtgtacgccaccaggcgcccgtctccgtcgacaccgaggccgtgcccggtgccgccccagccctcctgtgggggctcggccgggtcccgcactccggcggcggcgtggtggacctgcccgccggcctcgacgcgcgctccctgcggctgctcgcggccgtcctcgccgcacccggcgaccaggacgaactcgccgtacggccgggcggcgtcttcgccaggaagctgctgcccgcccagcgcccccggcggcagcgtgcctggcgcaccggcggaaccgtcctgatcaccggggacatcgcgggcgtcacaccggaactcctccagtacctctccggcggcggcgctcgcacgctcctgctggcgcaccgccccggcacgcccctgcccgacgccgccgtcctcgccgcggcgggcggaccgtgcaccgtcaccgagtgggacctgggcccgctggagacggcgtcggtgaccgccgtcgtccacctcagcggcatcgacccggacggcccgtccacgccggacgccctcaccgccgccgggccggcccgcgccgtccaggaccggctgcgtaccgtcgtacggctcgaagagctgttccacgacgcggacctggacgccttcgtgctgctgtccaccgtcgccggcacctggggcggcgccgaggacctcgtgcacaccgtcgcgcacgccgccctggagtccctcgccgagcgccgcaccctcgacggccgccccggcacctgcgtcggctggggcccctgggagacaccggcggacacgggggcgtcaccggtccccggcctgctgccgctccccgccgacctcgccgtgtccgcgctggccgaggccctggacgccgacgaccccgtctgcgccgtcgtcgacgtcgactggagcctgttccaccccgtcctcaccgggcgcggcccccgcccgctcgtcgccgacctgcccgaggtccgcgccctgcccgcacccccgaccgccgaagtggtcctcgcgcccgccgccgaccgggaacaccaactcctcgaactggtccgggcgcaggccgccgccgtgctcggccacgcctccggcgccgccatcgatcccgtacgcccgttccgcgacctcggcttcgagtccctggcggccgtacggttccgcgaccgcgtcgccgccgagaccgggctgcggctgcccgccaccctcgtcttcgaccaccccaccgcgcaggcggtcgccgcacatctgctggccgaactgtccggcgtacgacagcacgaggacgaggtcgccccgacggccgaccacgacgacccgatcgccatcgtcggcatggcctgccgctaccccggcggcgtacgcggacccgaggacctgtgggacctcgtccactgcggacgcgacggcgtcggcgacttccccaccgaccgcggctgggacctgcccgccctgcgccgcctggcaccggacctcgccatgaagggcggattcctgcccgacgccgccgacttcgacgccgccttcttcggcatctccccgcgtgaggcgaccgcgatggacccccagcagcgactgctcctggaggtgtcctggcaggccctggagggcgcgggcctcgacccggcggccctgcgcggcagccgcaccggagtcttcgccggcgccgcgggctcggactacggcgtggtgctggaaggggccccggaggcggacggatacctgaccaccggcaccgccgcgagcgtcatctccggccggatcgcctacaccctcggcctgcacgggcccgcggtcaccgtggacacggcgtgctcctcctcactggtggccctgcacatggccgtgggcgccctgcaccagggtgagtgcgacctcgcgctcgccaccggcgtctccgtcatctccacgccgggcgcgttcgtcgacttcgcccggcagagcgggctcgccgccgacggccgctgcaaggcgttcgccgcgagtgccgacggcaccaactgggccgagggcgtgggcgtcctggtcgtggagcggctctccgacgcgcggcgcaacggacaccgcgtcctcgccacggtccggggcagcgccgtcaactccgacggcgcctccaacgggctctccgcgcccaacggcggagcacagcagcgggtgatccggcaggcgctggccgccgccggactgtccgccgacgacgtcgacgccgtcgaggcgcacggtacgggcacgacgctcggcgacccgatcgaggcgcaggcggtcctggccacctacgggcgggaccggccggccggacagccgctgtggctggggtcgctcaagtccaacatcgggcacagcggggccgcggccggggtcggcggcgtgatcaagatggtgcaggccctgcggcacggcgtactgccgcgaaccctgcacgtcgacgagccgacgcccgaggtggactggtcggcggggacggtgggactgctcaccgagaaccgagagtggccgcacaccgggaagccacgccgggtgggggtgtcggcgttcggagtcagcggcaccaacgcacatgtcgtactggaacaggggcccgaagaaacgcccgaggaagcgcccgaagaagcgccggaagaaacccccggagaggcgcccggggcgaccgccccaccgctcctcccgtgggtgctctccgcccgcacccccgaggcgctgcgcgcccaggccgcccgcctggccgcccgtcttgccgagcgggagctgcccgccgccgccgtcgggcacgccctgctgacctcccggtcggacttcgagcaccgggccgtcgcgctgggcgcgggacacggcgagctcaccgaggcgctgcgcgcgatcgccgccggggagcccgccggctccacggtcaccggcgtggcccgccgggccgccggacgcggcccggtcttcgtcttccccgggcagggcggacagtggcccggcatggccgccgaactcctcgacaccgcaccggagttcgccgcccgctgggccgagtgcgagcgcgccctcgcgccgtacacgggcttctccgtgaccgagctcgtgcgctcgggcacgcccctggagcgcgtggacgtcgtccagccggtgctgttcgcggtcatggtgtcgctggcggcgctgtggcgctcgtacggcgtggtgcccgccgcggtggccggacactcgcagggcgagatcgcggcggcctgcgtggccggggcgctgtccctggacgacgcggcgcgcgtggtcgcgctgcgcgcccaggcgctccgcgcgctcgtcggcgagggtggcatggtctccgtcggcatccccctcgccgaggccgagcggtggctgccgcgctgggacggacaggtctccgtcgcggccgtcaacggcccctccgcggtggtgttctccggcgcacccgccgccctggacgacctggtggcccacgcccgcgaccaggacgtccgggtccggcgcatcgacgtcgactacgcctcgcactccgcgcaggtggagcggatcgaggacgagatcatgaccgccctcggcccggtccggccggggccgggacagatcccgttcttctccaccgtgaccgccgactggcaggaccccaccggcctcgacgccgcctactggtaccgcaacctgcgcgaaccggtgctcctcgaaccgtccgtcaccgccctggccgagcagggctacgacgtcttcgtcgaggtcagcccgcacccggtgctcggcgccgcactcaccgagaccgccgaactggccggagcggaaccggtggtgacgggcaccctgcgccgcgacgagggcggtctgaagcgcgtacgcacggcactggccgaactgtggacgcacggcgtccccgtggactggacgcccgccttccccggccggcacggcacaccggtggaactgcccgcctaccccttccagcgcacccgctactggccggcggcccgcccggcggtggcccaggacccgcaggacgagcggttctggcaggccgtggaccaacaggacctgcccaccctggccggcacgctcggcctcgccgacgaacagccgctgcgcgagctcgtaccggccctgtccgcctggcggcgcgaccgcaaggagcgggccgccgtcgagtcctggcgctaccgcatcgagtggcgccggctgcccgagccggagcgccgtacgctgcccggcacctggctcctcgtggtgccgaccgggaccgggaccacggacgaaccgttgaccgggaccgggaccacggacgagccggtgaccggcgccaccaccggcggcaccgcggacgacccggtgaccgccgccgtcaccgccctcctgcgggaacgcgccgaacagctcgtggtgctcgccgtcgaccccggctccgaccccaccaccctggccaccgccctccgcggcgccctcggcggcacggagccggccggtgtggtctcgctgaccggcatcgacggttcgccgcacccggagcggcccgtcgtcccggcgggcgcggcgctcagcctcgccctgctgcgggcgctcgccgacgcccgggtcaccgcgcccctgtggtgcctgacccacggcgccgtcaccaccgacgacgacgccggaccggtccaccccgaacaggccgccgtatgggccctcggccgggtcgccgcgctcgagttcccgggcacctggggcggcctcgtcgatctgcccgaccccctcgacgaccgcacggcggaccgtctcgcggcggtgctcgcgggcctcgacggcgaggaccaggtggcgctgcgcccgtcgggcgtcttcggccgccgcctcgtacgcgccaccccgcgcgccacggccggcacgggctggcggccgcgcggcaccgtgctcgtgaccggtggcaccggagcgctcggccggcgggtcgcccgctggctggcccgcgagggcgcggaacacctcgtcctcaccagtcggcgcggcccgctcgcacccggcgccgacgcgctcgtcaccgaactcaccgggctcggcgtcaaggtcaccctgctctcttgcgacctcgccgatccggcccaggtgaccgcgatggtcgccgaggcgcagcgcgacggcgacccgatcggcgccgtggtgcacaccgcgggcggcggcgggctcggcccgctggccgaggccgggcccgacgacctggccgaggcgatggccgccaaggtgaccggcatcgcccacctggaagcggccctggaccccgaacagctcgacgccgtcgtctacttctcctccatcagcgcctcctggggcgccggcgaccacggcgtctacgccgccgccaacggcgtgctcgacgcccgtgccgaggcccgcagcgcggccggcgtgcacaccgtgtccctcgcctgggcgccctgggcgggcggcggcatggccgacgacccggtcttcgacaccctctcccgcaagggcctgcccctcatcgacccggacctcgccgtctccgcgctcgccgcggtgctcgcggagggcgagtcctcgctgctgctcgtcgacgtcgactgggagcggttcaccccgcagttcaccttcgagcggcccacccgcctcctgaccgaactgcccgaggcccgccccgaaccggccaccgacgacaccgcgcccgacaccgccgcctccccgctcgcccaacggctggccgcactgaccggaccccagcgcacggcggccctgcgcgacctggtgcgcgaacaggccgcggccgtactcggccacgccgacgcacggtccgtcgaccccgcccgcgcgctcaaggagctcggcttcgactcgctcaccgcggtcgaactgcgcaaccggctgagcaccgcgaccggcctcaggctgcccgccaccatggtcttcgaccacccgaccatcgccgaactggcggatttcctggcccgcggcctcacccccgaggccgccgtaccggccgaacccgccaccgtcgtacgcgtcgaccaggacgacccgatcgccatcgtcgcgatggcctgccgctaccccggcgacgtcgcctccgccgaggacctgtggcgcgccgtgcgcgacgaggccgacctgatcaccccgttccccaccgaccgcggctggccgctcggccgactcgtcgacgccgccgaccccgaccggccgggcaccagctacgtcggccacggcggattcctgcacggcgcgggcgacttcgacccgggcttcttcggcatctcgccgcgcgaggcccaggccatggacccgcagcaccggctgctgctcgaatcgtcctgggaggcgctggaacgcgcgggcatcgccccgaggtcgctgcgcggcagcaggaccggggtgtacgtcggtctgaccgaccaggcctacgggacccggctgcgcggctccaccgacggcatggagggctacctcgtcagcgcgtccgccaacgtcgcctccgggcggatctcgtactcgctcggcttccagggacccgcgctcaccgtggacacggcctgctcctcctcgctggtcgcgctgcacctggccgcgcaggcgctgcgggacggcgagtgcgacctggcgatcgcgggcggtgccaccgtcatgccggaccccacctccttcgtggcgttcagccggcagcgcggactggccgccgacggccgctgcaagccgttcgccgccgccgcggacgggttctcgctcggtgagggcgccggtgtgctgctcgtggagcggctgtccgacgcccgccggctcggacacccggtcctcgcggtggtccgcggctccgcggtgaaccaggacggcgcgtccaacggcctcaccgcgcccaacggccccgcccaggagcgggtcatccggcaggcgctggtcaacgcggcgctgcccgcctcggccgtggacgtggtcgaggcgcacggtacgggcacgacgctcggcgacccgatcgaggcacaggcgctgctcgccacctacggccaggaccgcccggccggccggccgctgcggctgggctcggtcaagtccaacatcgggcacagccaggccgccgcgggcgtcgccggagtcatcaagatggtgcaggcgatgcggcacggactgatgccccgcaccctgcacgtggacgccccgagtccgcacgtcgactggagttccggggcggtggaactgctcgaccgggcccaggagtggccacgggacggcgcaccgcgccgcgcgggcgtctcggcgttcgggatcagcggcacgaacgcgcacgtgatcctggaggaggcacccgacaccctggaggaggcacccgacgagcccgccggcgagtccaccgacgagcgggccgacgagcccaccgacgagcgggccgacacggacaccgggcgccccgcccccggcgtctccgtccccaccgccggccgccccgtccccgtcgtcgtctccgcccgcacccaggacgccctccgtgaccaggccgcccggctgaccgccctcctcgacgagggcgggcacggcgtcaccgatctcgcccactccctggccaccacccgcagcgtcctcgaccgggcggcggtgctcgtcgccgccgacccggacgaactgcgccgcggcctcacggacctgtccgcgggcgccgtcgccgaggagcgcgccgagggccggctcgccttcctcttcaccggccagggcgcccagcgcaccggcatgggccgcgccctgtacgcggccttcccggcgttcgcgtcggccttcgacgagctgtgcgccgccctcgaccgccatctgccgcgcccgctggcctcggtcgtgttcgccgagcccggctcgcccgaggccgcgctgatcgaccagaccctctacacacagccggccctgttcgccgtggaggtggcgctgttccggctgctggagcactggggcgtacggcccgacgccgtgctcggccactcgatcggcgagctcgccgccgcgcacgtggccggcgtctggtccaccgccgacgcggcccgggtggtcaccgcccgcgcccggctgatgcaggaactgcccgagggcggcgccatgctgtccgtcgccgcggccgaggacgtggtgtccgcgctgctcggcgacgcgttcgacgaggtgtccgtcgccgccgtcaacggcccggcctcgatggtgctgtccggcacggaggaggccgtcacggcggcgggtgcccggctcgccgaggcggggctgcgcaccaagcggctcaccgtgagccacgccttccactcgccgctgatggaaccgatgctcgccgcgtacgagcgcgaactggcccaggtgaccttcgccgagcccgaactgccggtcgtctccaacgtgaccggcaagccggccaccgccgagcagctgtgcgaccccgcctactgggcgcggcaggtgcgggggaccgtgcggttcgcggacggagtggacagcctgctcggcgaggaggtgaccaccttcctggagctgggcccggacggcgtgctgaccgccatggcgaaggagtcggccggggcgggcgccaccggcatcgccgtccagcgccgcgaccgcgacgaggtacggaccctgctcaccgcgctcggcaggctgcacgtgcgcaccggccgcgtcgactggcccgcgttcttccacggcaccggcgcccgccgggtggaactgcccacgtacgcgttccagcaccggcggtactggctggacgcgcccacgggcggcgtcgaggcgctggccggcgcgggcctggcgggcaccgggcacccgctgctcacggcggccgtgccgctgcccggtaccggcgggtcgctcttcagcggcagcctgcccggcatcgacgaagaacggccgccgtcccgcggcgacatcctcgatctggtgctgtgggcggccggcagcctcggctgcgaccggatcgccgaactcgacgtccccgccgcgctgcccggcggaccgcacgccccgctgcaactcgtggtggcggcgccggacgaggacggcgaccgggacttcaccctccacgtggggcccacggactccggtgacgccggggacgagtcctggacgcggatcgcgcacggcaccgtcggcggtgcggccgcccggcccgagcccgaccccgccgcctggccgcccgccgacgccgaacccgtcggcgcggacgcggtgtggcgccgggcggacgagctgttcgccgagctggtgctgaccgagcaggaggcgggcgacgccgaccgcttcggtctgcaccccgagctgctggcgggcctgacggacctgatcaccgaactcgccggcgagccggtccacttcgccggggtgacccggtacgccaccggcgccaccgagctgcgggtccggctgacccgctcgggcccgggcgccgtagccgtgctgctgtcggacgcggagggcgagccggtgctctcggtggaccgcgtcggcgtacggacgggcaccgcgcccgccacgacgcccgccggcgcccccaccggacctgactcgctctatcgcctgacctggacacccgtggcggccgtggctcccgaaccggccggcccttgggccgtcgtcggcgcggacggcctggccaaggcgctcgtcgccacccagggcgccgaagtcgaggcccacccggacctcgcgtccctcggccgctccacggagcacggcgccgcgcccgggctcgtcgtcctgtccgtggacacggaacccggcgcgaccgtcgagtccatgcggcacaccacccaccgcaccctggagctggtcaaggaactgctcgcggacggccgcctggccggggcccggttcgtcctcgtcacccgcgcggccgtgtccaccggggacggcaccccggtcgacccggcgcaggcggcggcccgcggactgctgctgtcggcgcaggcggagcacccggagcggttcgtcctggccgacctcggcggccgcgacgcggacgccgaactgctcgccgccgccgtgggaaccgcactgaccgaggccgaaccgcaactcgccgtccgggacggccaggtgctcgtgccccggctggcccaggtcaccgaacggcccaccgacggtccggcggaacgcggcccgggaggcgaacacggcacggtggtggtcaccggcgcgaccggcggcatcggcaccgagatcgtgcggcacctggcgaccgcgcacggcgtgcggcacctgctgctgctcagcaggcggggccccgacgacccgcgcgcggccgaactgggccgagtccttgccgaggcgggcgccgacgcgaccttcacggcctgcgacaccgccgaccgcgccgccctggccgacgcgctggcggacgtaccggccgagcaccccgtgaccgccgtcgtacacatcgccggagtcgtcgacgacggagtcctcaccaccctgacccccgaccggatcgacaccgtgctgcggcccaaggccgaggcggcgcagcatctgcacgagctgaccgcggacctcgggctgtcccacttcgtgctgttctcctcgggcgtcggcaccttcggcggcgcgggccaggccaactacgcggcggccaacgccttcctggacgcactcgcccaccgcaggcgcgcggccgacctgccggcgacctcgctcgcctggggcctgtgggagaccacggccggcatgtcggcgcacctctccgacgtggaccggcggcggatggcccaggccggcgtcctcgccttcaccccgcggcagggtctcgccctgttcgacgcggcgtggaactcggacgcgaccaccttggtacccatgcgcctcgacaaggccgtactgcgcgggaaggcggccgaggcgaccctgcccgcacccttccgcggcctggtccgcgcacccctgcgcagggcctcggcggccggtgcgcgggcggccgggcagtccttcgcgcagcagctggccgagcagtccgagagcgggcggcgacagctgctgctggatctgatccaccggcaggtggccgccgtactggactacgcggccgacgccccgctcgacgccaaactccccttccgggagctgggattcgactcgctcaccgcggtcgagctgcgcaacggcctgatcgccgcgaccggcgtccagctctccgccgcgctcgtcttcgactaccccacggcgaccgcgctcgccgagcacctggagagcaaggtcctgcggtcggtcgccggggctccgctgccggcgctcacccagctcgaccatctcgaagccgcgctcgccacctcgccaccggaccgggccacccgcgaacagctcgcggcccggctgcgccggctggcctccgcctggagcgcggacgaactcgaagccgacgacggcgacatcaccagcaagctcgattccgcctcggatgaagagctcttcgacttcatcaacgcggaattcggaaaggactgagtccgatggccaacgagcagcagcttcgtgactatctcaagcgggtcagcgcggatctgcaccggacgcgccagcgactgaccgagatcgagtcgcagggcaccgagccgatcgcgatcgtcgggatggcctgccgctaccccggcggggtgagttcgcccgaggacctgtggcggctggtcaccgacgagacggacgcgatcggccccttccccaccgaccgcggctgggacctggacggcctccaccaccccgaccccgaccacccgggcacctgctacgcggaggcgggcgggttcgtcgaggacatcgcctccttcgacgcggccttcttcggcatctccccgcgcgaggcgcagtccatggacccccagcagcgactgctcctggagacctcctgggaggcgctggaacacgccggcctcgacatccacgcgctgcgcggcagccgtacgggcgtcttcgccggactcaaccagcaggactacggcaccctgctggccgccgccccggacggtctggacagctacggctccaccggcacctccaacagcgtgctctccggccggatctcgtatgtgctgggtctggagggcccggccgtcaccgtggacaccgcctgctcctcctcgctggtgaccctgcacctcgccgcccaggcgctgcggagcggggagtgcgacctcgccctggccggcggcgcgacgacactgtccacctccgcggtccacgtggccctgtccgggcagcgcgcgctggcccccgacggccgctccaaggcgttctcggcggcggccgacggcgcgggctggagcgagggcgtcggcgtcctcgccgtcgagcggctctccgacgcccgccggctcggtcaccgggtgctcgcggtgctgcgcggcagcgccgtcaaccaggacggcgcgtccaacggtctcaccgcgcccaacgggccctcgcagcagcgggtgatccggcaggcgctggccaacgcgggtgtgtcgcccgccgaggtcgacgtggtcgaggcgcacggcaccggcaccagcctcggcgacccgatcgaggcggacgcgctgctggccacgtacgggcaggccaaaacggcggggcggccgctgtggctgggctccctgaagtcgaacatcgggcacagcggtgccgccgccggcgtcggcggtgtgatcaagatggtgcaggcgctgcggcacggcctgctgcccaggaccctgcacgccgaggagcccaccccgaacgtcgactggtcctcgggcgccgtcgaactcctcaccgaggcccgcccctggcccgcctccgacaccccccgcctggccgcggtgtcgtccttcggcatcagcggcaccaacgcgcacgtgatcctggagcaggctcccgaagaaacgcccgaagaagcaccggaggaaacccccggagaggcgcccggggcgaccgccccgccactcctcccgtgggtgctctccgcccgcggtgagcccgcgctgcgcgcgcaggcccgtgccctgcgcgagcacctgctggcccgtcccggcgcgagcgacgccgacgtggccctctccctcgccgtcacccgcaccggcctggagcaccgggccgccgtgctcgccgccgaccgggacggattcctcgacgcgctggacgcgctcgccacggaccgccccgccgaaggggtactgcgcggctcaccgcccgtcgacggcaaggtcgtcttcgtgttcccggggcagggctcgcagtgggccggcatggcccgcgaactcctcgacacctcaccggtgttcgcggcgaaggcggccgcgtgtgcggcggcgatcgaggagttcgtggactggaaggtcctcgacgtgctgcgcgagaagcccggcgccgcctcgatggaacgcatcgaggtcatccagcccgtgctcttcaccgtgatggtgtcgctggcggagctgtggcgttcctacggggtggagcccgacgccgtcgtcggcagctcgcagggcgagatcgcggccgcccatgtcgcgggcggactgacccttcaggacgcggcccgggtgatctgcctgcgcagcgcactcctggccgagaccctcgtcggcaagggcgccgtcgcctccgtcgccctgcccgccgacgaggtgcgcgagcgactgacccgctgggcggaccggctgtccgtggccggcgtcaacgggccccggatcgtcgcggtcgccggagacgacgacgccctcgccgagttcatcgccgagtgcgcccgcgacaacgtgcgcgccaggatcgtcgccgccaccgtgccgacgcactgcgccctggtcgaccccctgcgcgagcggctcctcgacctgctggcgccggtcgcgccgcgcaccgggaccgtacccctgtactcgacggtgaccggcggccggctggacaccgccgccatggacgccggctactggtacgacaacacgcgcgcgccggtgctcttcgaaccggtcgtgcgcgcgctgctcgccgaggggcacagcgcgttcgtcgagtccagcgcgcacccggtgctggcgatgggcgtcgaacagaccgtcgacgccgccggggcgtccggcgtcgtggtggagtccctgcgccgcgacgagggcggcctcggccggatgacggcctcgctggccaaggcgcacctcggcggggtccgcgtcgactggcccgcggtgttcgccggcaccggcgcccgcaccgtggaactgcccacctacgccttccagcgcacccgttactggaccgaggccggcgaccgcaccggtgacgtcggttcggtcggcctgtcctcggtcgaccacccgctgctcggagccctggtccggatggccgacggcgacggcgccgtgctcaccggccggctctccctgcgcgcccagacctggctggccgggcacggcgtctccgaccgggtgatcttcccgggcaccggcttcgtggagctggccgtgctcgcgggcgaccaggtcggctgcggccggatcgaggaactgaccctgcacaccccgctggtggtgcccgagagcggcgcggtcgtggtgcaggcacaggtcgaggcggccgacgagacgggggcccgcgcggtgagcgtgtactcccgtgccgacgacgcctcggcggacacggtctggacccggcacgcgtccggcgtcctcgtcgccgaacccggcgaggaacccgaggggatcaccgggacctggccgcccgagggcgccgaggccgtggacatctccgggatgtacgaccgcatggccgcggccggttaccagtacgggcccgagttccgcggcctgagccgggtctggcaccgcgacggcgaggtgtacgccgaagtggccctgcccgccgaccagcgctccgcggccgagcgcttcggcctgcacccggcgctcttcgacgcggccctgcacgccatgttcacctggggcgacgacgacggcggcgtgggcatgccgttctcctggaccggcgtacggctgcacgcgaccggctgctcgcggctgcgcgtacggctgtcccggcgcggcgagaacgggatcacgctgctgctcgccgacgaggccggcgcaccggtcgtctcggtcgacaccctcgtcgtacgccggatgaccgaggccgcgctgagcaccgtacgcgccgacgcgctgtaccggctcgactggaagaccgtccgggccgaggagcccgccccgcgctgcgtcgtgctgggggccgacccgctggggctgtgcgacgccctgcccggcaccccgctcgccgccgggaccgaggagctggccgcgctcgtcgccgcggacggcgccgccgtcaccgcgctgctcccggtcgccggcgacggctccaccgaccgggtcggcgaaccggtcgtcgacaccgtcgccctcctccaggagtggatcgccgacgggcggctcgacgacacccggctcgtcgtggtcacccgcggcgcggtggcggccacggccggcgaggacgtgaccgacctcgccgccgccggagtctggggactgctgcgctcggcgcagaacgaacaccccggacgcttcggcctcctcgacctcgacacggccgccgggtcccgagcggcgctcggcgcggcgctcgcgtccggcgaggaacaactcgccctgcgcgaaggccaggtacgcaccccgagcctggcccgctgggatcccgccggcaccatcctgcccccggccggggagcccgcctggcgcctggagaacaccaggcccggcaccatcgagggcctcacggcggtcccgtacccgcaggcactcgaaccgctcggaccccggcaggtgcggatcgccgtccgcgccgccggcatcaacttcaaggacgtcgtcgtcgccctcgacctggtgcccggcctgaccggactcggcggcgaagtcgccggtgtcgtcaccggcaccggcgccgaggtcacccaccaccgcgtcggcgaccgggtgttcggcctgtccaccgaggtcttcggcccggtgaccgtcgccgacgaacgcaccgtccaccgcatccccgacggctggaccttcgaggaggccgcctcggtctccgtcgcctacctgaccgcgtactacggactcgtcgacctcggcggactccggcccggccagtccgtgctgatccacgccgcggccggcggcgtcggcagcgcggccgtccagctcgcccgccacctcggcgccgaggtctacggcacggcgagccccggcaagtgggacacgctgcgcgcctgcgggctcgacgccgcgcacctcgcgaactcgcggaccctcgacttcgagcagtggttcctggagtccaccggcggccgcggcatggacgtcgtactcgactgcctggccggcgagttcgtcgacgcgggcctcaggctgctgccccggggcggccgcttcctggagatgggcaagaccgacaagcgcgacccggcacaggtcgccgaggcatacccgggcgtcgcctaccaggcgtacgaccttccggaagccgggctcgaccgcatccacgccatgctgggcatcctcgccgagctgttcgagagcggcgtccttgcgcctccgcacctcaacacctgggacatccgcgacacccgcgccgccttccgggcgctgagccaggccgcgctcatcggcaaggcggtgctcaccctccccggcgagcccttccccgcccacggcaccgtcctgatcaccggcggcaccggcatgctcggcgcgctgctcgcccgccacctggtcaccgagcacggggtgggcagcctgctgctgaccagccggcgcggcccggacgcccccggcgcgagcgaactcgccgcggaactgaccgcggccggtgcccaggtgaccgtcgcggcctgcgacatcgccgaccgcggccaactcgccgcgctgctcgcggacatccccgccgaacgccccctcaccgccgtactgcacaccgcggcggcgctggacgacggcctcgtcgagtccctcaccgccgaccgcacgagggccgtactgcggcccaaggtgaccggcgcactcaacctgcacgaactcaccaaggacctcgacctcggcgccttcgtgctgttctcgtccatggcgggcaccatgggcgcccccggccagggcaactacgccgccgccaacgtgatgctcgacgccctcgccgcccaccggcgggcccacgggcggcccggactctccctcgcctggggcttctgggcacagcgcagcgagatgtcgggccacctcgacgaccgcgacatgcggcgcctgagccgcggcggcatcgtgccgatgaccagcgacgaaggcctcgcggtgttcgacctggcctgccgcaccggcagcgcccagctggtgcccgcgaaactcaaccccgccgcgctcgccgggacgtcgggccgggtgccgcccatcatgcgggcgctggtgcccacgcccgcccgccgcgccggacgccggccggcggacaccggcggcggatccctgcgcgagcgcctgaccccgctcaccggcaccgaacgcatgcggatcctgctccagctggtccgctcccatgtcgccaccgtgctcgggcactccgaccccgacgcggtcggctcgacggcgccgttccgcgagctcggcttcgactcgttgaccgccgtggagttccgcaaccggctgaccggcgccgtcggcttccggctgccggtcaccgtcgtcttcgaccacccgacgccgagcgagctggccgacttcctggccgccgaactcctcggtgatctcgccgaacccgccgcccccgcggcccccgtgcccgcggtagcccgcaccgacgacgaacccctcgtcatcgtcggcatggcctgccgctacccgggcggcatcacctcgcccgagcagctgtgggacctcgtcatcggcgagcgggacgccgtctccggcttcccggaggaccgcggctggagcaccggggcacccgccgacggctccgtgccgcagcagggcggattcctcgaccgtgtcgcggagttcgacgccgcgttcttcgggatctccccgcgggaggcgctgaccatggacccgcagcagcggctgctcctcgagacgtcctgggaggccctcgaacgtgccgggatcgcgcccggcaccctgcgcggcagccgtaccggcgtcttcgtcggcgcggccacctccggatacacgagcctgttcccccgcggctcacaggcgctcgccgggtacggcgtgaccggcgcgtccaccagcgtggtgtccggacgcgtctcctacgtgctgggcctggaggggcccgcggtgacggtggacacggcgtgctcgtcctcgctggtcgccctgcacacggccgcccaggcgctgcggagcggcgactgcgacctcgccctcgccggcggcgtcgcggtgatgaccagcccgttcctcttcgacgacttcgccaagcagggcggcctgtcacccgacggccgctgcaaggccttcgccgccggtgccgacggcaccggctgggcggagggcgtcggcgtcctcgccgtcgagcggctctccgacgcccgccggctcggccaccgggtgctcgccgtgctgcgcggcagcgccgtcaaccaggacggcgcgtccaacggcctgaccgcgcccaacgggccgtcgcagcagcgggtgatccggcaggcgctggaacggtccgggctgaccgcccccgacgtcgacgccgtcgaggcacacggcaccggcaccaccctcggcgaccccatcgaggcccaggccatcctcgccacctacggccgggaccggaccgaggaccggccgctgctgctgggctccctgaagtccaatctcgggcacagccaggccgccgccggcgtcggcggagtgatcaagatggtgcaggccctgcaccacggcgtactgccgcgcaccctccacatcgacgaaccgaccccgcacgtcgactggaccgcgggcgccgtggacctgctcaccgagacccgcccgtggccggagaccggccgcccccgccgggccggcgtgtcctccttcggggtcagcggcaccaacgcccacgtcatcctcgaacaggccgcggagccggaccccgcccccgcggcggccaccgcgctgccgctcaccccgtggctgctgtccggccacgacgaacaggccctgcgcgcccaggcgaagaccctgctgacccatctgcgtcagcggacggaggactcggtcaccgacgtcgcccactccctggccacccggcgcaccgccctggaacaccgggccgcgctgcccgtcaccgaccgggacgacgcactcacccggctcgcggagttcgcggcggggcgcaccccggacggactgctgctcggcacggccggcgagggcggcctcgcgctgctcttccccggacagggcgcccaacgccccggcatgggccgggagttgtacgagacgttccccgcgttcgcccgggccttcgacgaggtctgcgcgcacatcgacccgctgctcggcaggccgctgcgcgagacggtgttcaccgccgaggccgccgaactcgaccggaccgcgctcacccagcccgcgctcttcgccctcgaagtggccctgttccggctgctcgcgtcgtggggcgtggtccccgactacctcctcgggcactccgtcggcgagatcgcggccgcccacgcggccggtgccctggacctcgccgacgccgcggggctcgtggtcgcccggggccgcctgatgcaggccctgccgccgggcggagccatgctcgcggtccaggccgacgagcgggaggccaccgaggccctcaccgccgtcctgggcgagcacgcggacaccgtggacatcgccgccgtcaacggcccccgctcggtggtgctctccggcgccgccgcgtccgtggacgcgctcaccgcgcacttcaccgagcggggccgccggatccgccgcctcggcgtcagccacgccttccactcgccgctgatggagccgatgctcgacgagttcgccgagctggtcgcaggcctgtccttcgctccaccccgcatccccgtcgtctccaacctcaccggagccgtcctcggcgccgacgagttcgccgacccgcgctactgggtgcggcacgcccggcacaccgtccgcttcgccgacggggtcgacgccctcgtcggcgcgggcgtcaccggcttcctggagctgggtcccgacgcgacgctcaccacgatggccgaggattgcctcgacaccgcccccaccggggtgtgcgccgcactgctgcggcgcgacgccacggaaccgacgaccctcctgaccgcactggcccgcgcccatgtgcacggcgtcaccgtggactgggacgcggtcttcgaaggcaccggcgcccggcgggcggacctgccgacctacgccttccagcgcacggcctactggcccgccgagtccaccgccgaccgcggtgacctctcctcggccggcctggacggcaccggacaccccctgctcggcgccatggtcggctcggcctccggcggcgacaccctgttcaccggcgaactctccctggccgcccagccctggctggccgaccaccggatcctggactccgtgctgttccccggcaccggcttcctcgtactcgccctgtgggcgggcagccgcctcgacgccggtgaggtcgaggaactcgtcgtccacagcccgctgatcctgcccgaacacggcggcgtcaccgtccaggtcgtcgtcggcgagaccacccgggaggaaagcaggccggtcgcggtctactcccgtgcagcctccggcaccgagtggaccaaacacgcggagggactgctcgccgccggcccgccccccgagcagccggccaccccgcccgccgtgtggccgcccgacggcgccgaacccgtacgcctcgaggacttctacgcggacctgaccaccaccggcaccgcctacggaccggtgttccagggcctgaccgcggcctggcgccacagcgacgggatctacgccgaggtcgccctgcccccgcagaccaccgacgacgccaaggccttcggcgtccaccccgcactgctggacgcggccctgcacaccctcgcgttcctgccctccgccgcccgcgacagcggcccgttcctgcccttctcctggcggaacgtgtccgcgcccgcccccggcgccaccgcctgccgcatcctcctcgcggcaggccccggcaccgacgaagtggccgccaccctctgggacggcgacggacagccgctcgtctccgtcggcggactgagcctgcgcaccgtctcccgcgcccagctgggcacgtcggtcgcggcctcgtcgctgttccgcatggactggacccccgccccggagcccgaggcggccggccaccccgcggtccgctgggccgtggtgggccccgccgtcaccgacgccccggacatcgacccctacccggacctcgacgccctgcgccggcacctcgccgaaggcggaccggcccccgaccacgtcctgttcccctgcgcccccggcacccccaccggcttcgacgcggacgcggcccgtacggccgtgcacgcggcgctcgacaccctccgcacctgggtggaggacgaacacttcgtcaagtcacggctggtgctgtgcacccggggcgccgtcgaggcccgacccggcgaaggcgtacgggacctggcgcagagcgcggtgtggggactggcccgcagcgcccagctggaacacccggaccggctgctcctggtcgacctcgacaccgacaccggcctcgcggacctcacccgggcccaggcgctcgtacaggcctccggttacggcaccgacgactccgacgacttcgacggcaccggcgactccggcgacaccgcggacgccgcgcagttcgcgatccgggccggcacgaccctcgtaccgaggctcgcccgccaccccgtcgacaccccgccgcagggccggccctggccggccgacggcaccaccctgatcaccggggccggcggcatgatcggtggcctgctcgcccggcacctggtccaggagcacggcgtacgccacctggtgctcgccggccgccgtggcgaggccgcgcccggcaccgccgaactccgccgggacctcgccgacgcgggagccgacgtacgcgtcgtcgcctgtgacgcggccgaccgggacgccctggccgccgtactcgacgcgatcccccaggaggcacccctggccgcagtggtgcacgcggcgggcgtcgtcgacgacggactgctcggcacactcaccggggaacaggtcgaccgcgtcctcaggccgaagatcgacgcggcggtgaacctgcacgacctcaccgcacacctcggcctgcgcgccttcgtcgtctgctcctccctcgccggcgccctcggcggcggcggacagtccgcctacgccgccgccaacgcctacctcgacgccctgtgccgacggcgacgggccgacggcctgcccgccctctccctcgcctggggcccctgggagagcagcgccggcatgaccgcccagctggccgccgccgacctgcggcgcatcgcccgcgcgggcatgctgccgctggcccccgacgacggcctggccctcttcgacgccgcccacgccaccggcgaaccggagctgctgcccttccgcttcgaacccggcggcctgtccaccgccgaccgggccgccctgcccggcgccctgcgcgccctggtcccggcgccacgacgccgcaccagcggactcgcccacggcccctccggcctgcgcgaccgactgcgccccctgccgcaggacgaccggaccaccaccctggagaacctcatccgcgccgaggtcgcctcggtgctcgccctgccgtcggcggacgccgtaccggtcaccaaggcgttcaagagcctcggcttcgactccctgatggccgtcgacctccgcaaccgcctcagcaccctcaccggcgtacggctctccgcgaccctcgtcttcgaccaccccaacacccgggtcctcgccgcccatctgctgaccggcatgcggctggacacggccggcgccaccgacccggccctgctcgccctgcgcggcctggagagcgccgtccggtcgatgaacccggacgccgacgaccgcggagcgatggcgacccggctacgggtgctcctggcgacgctggaagaggccggggacgaggaagcggcggacggttccgacctcgactcggtgagcgcggaggagctcgtgtccctgctcgacgacgagttcgggctgtcctgacggaggcctccgccgcgggccaccccacccagaacttaggggtgttcgcggtccagaactggggccgggatccagctcccggccccatagcctgcaaaagggcctgtccttgcgcgatgacgaaacacttgagtgggagttgagcatgaacagttccatgtcggaggtcgtcgacgcgctgcgggcctcgctgctggagaacgagcggcttcggcagcagaaccagcggctcaccacggcctccgcggaacctctcgccatcgtgggcatcggctgccgctacccgggcggtgtccgcgacaccgaggacctgtggcggctgatcacggaaggccgcgacgccatgtcgggcttccccaccgaccgcggctgggaccgctgggacatccccaccgcccgtacgggtgccttcctccacgacgccggcgacttcgaccccgccttcttccgcatctcgccgcgtgaggcgatggcgatggacccgcagcagcggctgctcctggaaacgtcgtgggaggcactggagcgggccggcatcgaccccgccacgctcaagggaagccgcaccggcgtgttcatcggcggagccccgcaggagtacggcgcgctggtgatgaactcggccgagggagcgggcggttacgcgctgacgggcgcccccggcagtgtgctgtccggccggatctcctacgtgctgggcctggagggtcccgcggtcacggtggacacggcgtgctcgtcctcgctggtcgccctgcacctcgccgtcaagtcgctgcgcaccggcgaatgcgatctcgcgctggccggcggcgtgctggtgctcgtcaccccgtcgatcttcgcggagttctcggcgaccggcggatcggcgggcgacggccgctgcaaggccttcgccgcgtccgccgacggcaccggctggggcgaaggggcgggcgtactcgccgtccagcgcctgaccgacgcgcgccgggacggtcaccccgtcctggcggtgatccgcgggtcggcggtgaaccaggacggcgcgtcgaacggtctgagcgcgccgaacggtccttcgcagcagcgggtgatccggcaggcgctggcgaacgccggtctgtcggccgccgacgtggacatggtggaggcgcacggcacggggacgacgctgggcgacccgatcgaggccgaagcgctgctcgcgacctacggccaggaccgcccggccgaccggccgctgtggctcggcaccctgaagtccaacatcggacacacccaggccgcggccggcgtctccggagtgatcaaggccgttctctcgctccagcacggcctgttgccgaagacgctgcatgtggacgagccgacgccgcaggtggactggtcggcgggtgcggtggagctgttgacgcaggcgcgggagtggccggagacggacggcccgcgacgggcgggtgtgtcctcgttcggcatcagtggcacgaacgcgcacgtgatcctggaacaggcgccggagccggagggcgcggaggtaccggagtccgcggaggcgccgggggcggaggggcgtccggcgttgagcgggccggtgccgtggctggtgtcggggcgtaccgaggcggcgttgcgggctcaggcggcacggctggccgagcacctggccgggcgtcccgaggcgaccccgctggatgtgggcttctcgctggcgcggacccgttcggccttcgaacagcgggcggtggtggtgagcgccgaccgcgacgaactgatcgccggactgcggtcggtcgccgacagcggggacggtgcgggcgtcgcgggtgtcgtggccggccgagccaccgccgacagcggcgtcgtgttcgtgttcccgggtcaggggtcgcagtgggtggggatggcggcggagctgctggactccgcaccggtgttccgcgcacggatggaggagtgcggggaggcactggccccgcacgtcgactggtcgctgctcgccgtggtgcggcaggaggagggcactccgtcctggtcccgggtggatgtggtgcagccggtgttgtgggcggtgatggtgtcgctggcggcggtgtggcgttcgttcggggtggagcctgccgctgtcgtggggcattcgcagggtgaggtcgctgcggcgtgtgtggcgggtgggctgtcgctggaggacggggcgcgggtggtggccgtgaggtcgcggctggtgctggagaagctgtccggcaagggcggcatggtgtccgttgcgctgccggtcggggaggtcgaggagcgtctcgcccggttcgagggccggatcggtgtcgcggccgtcaacgggcccggctccgtcgtcgtctccggtgagcccgacgcactggatgaactccttgcggaatgtgaggagtcaggggtacgggcccgtcgtatcgcggtggattacgcctcgcactccgcgcaggtggatgccctcaacgaggatctgttgagggagctcgcggacattcagccccggtcgtcgtcggtggcgttctactcgacggtgacgggtgagcggctggacacgtccggtctggacgcgcggtactgggtgacgaatctgcgggagcgggtgcggttcgagccggtggtgcggctgttggcggagaaggggagttcggtcttcgtcgagtcgagtccgcatccggtgttgacgatggcggtggccgagaccggtgaggtcgcggaccgggctgtggtgacagtggggtcgttgcggcgtgacgacggtggcgcggaccgcttcctgacgtcgctcgcggaggcctacgtggcgggcgctcccgtcgactggtcggtgctgttcgccgggatgccggtgcgccgggtcgatctgccgacctacgcgttccagcaccagcgctactggctcgacgacgttgcgctgcccggccagagcggtttctccgacgacccggcggatgccgcgttctggggtgcggtggagcgcgccgatgtgcagggcgtggccgcgctggtggacggtgcggagcctgaggtgtgggagccggtgctctcggcgttgtcggcttggcgccgggggcgtcaggagcggtcggtgctggattcgtggcggtatcggacggtgtggcgttcggtgacggtgccgtcggtgggccggttgtcggggacgtggctggtggtgacgccggggggcgcggggccggtcgaggaggtccggcgggcgctggaggcggtcggcgccgaggccgtcgtactggcgtgggaggcggaggagggccgtgaggctctggccgggcgccttaccggagccggtgaggtgtcgggtgtggtgtcgctgttgggctgggatgaggaggccgcgcctgtcgcgacggtgacgctcgtccaggctttggcggatgccggggtcgaggcgccgttgtgggtgttgacgcagggtgccgcgtcggtgggtgcggaggatgtggtgcacccggtgcagacgcaggtgtgggcgctgggtcaggtggccggtctggagcagccgggtagttggggtggtctggtcgatgtgccgggggtgtgggacgagcgggttgcttccgggctgactgccgtgttggcggcgggggagggtgaggatcaggtagcggtgcggtcgtcgggtgcgtatgcccgtcgtctggtgcgggctccgctgggtgcgaacccggcacccgtacgcgactggaacccccatggcacggtgctgatcacgggtggtaccggcggtattggtgcgcatctggcccgttggctggcgaaggagggcgccgagcgtctgctgctggtcagccgtagtggcgagcaggcagaaggtgctgccgaactggccacggagttgggcggcttgggcgcggaggtgacgttcgccgcgtgcgacgtgagcgaccgcgacgccctcgcccacgtgatcgccggcatcccggcggagcaccccctcaccgccgtcttccacaccgccggtatatccggttacgcggaactcgccaccgccacccccgagcacttcaccgacgtgctctccgcccgcgttctcggcgctcgtcatctggacgagttgaccgccgagctcggtgtggagttggaggcgttcgtggtgttctcctccggggctgcggtgtggggcagtggcagtaatggtgcgaatgcggccgcgggcggttatctggacggtctggtgcggcggcggcgggcgcgtggtgtggcggggacgtcggtgtcgtggggcggttggcaggcgacggcgatggcggtgggggacacggcggagcagttgtcgcgtcggggtgtgcggctgctggatccggtgctggcggtgcaggcgttgcggcaggtgctggagcaggacgaggtgtcggtgacggtgaccgacatggactgggcgctgttcactccgggatacgcgatggcccggcgccgcccgctcatcgaggacatccccgaagccggtgaggcactgagtggggcggccggggccggggagaccctggactcggcaggcgtgggtctgcgggagcggctcgccgcgatgacggagaccgagcggcaggccacgctgctggggctggtgcgcggcgaggcggcccaggtgctggcgcacgggtcgacggcggagatcacgccgaccaggccgttcaaggaactcggcttcgactcgctgaccgcgatggacctgcgcaaccggctgtccaaggccaccggactgcgactgccggccacgctcgtcttcgactatcccaacccggaacagctggcggccctgctgcgtaccgagctggtggacggtctgccggggacagccggacccgcggcaccggccgtccggccggtggacgacgaaccgctcgcgatcgtcggcatggcctgccgctaccccggtggcgtgcgcgacgccgacgacctgtggcggctgatcgtcgaaggccgcgacgaactgtccgacttccccaccgatcgcggctgggaccgctggggcgcacccgcggtcggccaggccggtttcctgcacgaggcaggggagttcgacgccgccttcttcgggatctcgccgcgtgaggcggcgtcgatggacccgcagcagcggctgctcctcgagacgtcgtgggaggcggtggagcaggccggtatcgatccgtggtcgctgcgaggcagctccaccggagtgttcgtcggcggcggcccgcaggactaccccgcggtgctgatgggctcggccgaggccggcggcggctacggcatgaccggtgcgctcggcagcgtgatgtcgggccgggtgtcgtacgtgctgggcctggagggtcccgcggtgacggtggacacggcgtgctcgtcctcgctggtcgccctgcacctagccgctcagtccctgaacaacggcgagtgcgagctggccctggccggcggtgtgaccatcatggccacgccgggcgcgttcgcggagttcgacaccttgggcggtatggcgggcgacggccgctgcaaggccttcgcggcatccgcggacggcaccggctggggcgagggcgtcggcatggtggtcgtcgagcggctctcggacgcgcgccgcaacggtcacgaagtgctcgccgtcatccgtggcwgcgcgatcaaccaggacggcgcgtcgaacggtctgagcgcgccgaacgggccttcgcagcagcgggtgatccggcaggcgctggcgaacgccggtctgtcggccgccgacgtggacatggtggaggcgcacggtacggggacgacgctgggcgacccgatcgaggcccaggcgctgctggccacctatgggcaggaccgtccggccgaccggccgctgtggctcggctccgtgaagtccaacttcgggcacacgggtgccgcggccggcgtggcgggcgtcatcaaggccgtactggccctgcgcaacggcctgttgccgaagacgctgcatgtggacgagccgacgccgcaggtggactggtcggcgggtgcggtggagctgttgacgcaggcgcgggagtggccggatgcggagcgtccgcgccgggcgggtgtgtcgtcgttcgggatcagtggcacgaacgcgcacgtgattctggagcaggcgccggagccggagggtgcggaggtgccggggtccgcggaggcgccgggggcggaggggcgtccggcgttgagcgggccggtgccgtggctggtgtcggggcgtaccgaggcggcgttgcgggctcaggcggcacggctggccgagcacctggccgggcgtcccgaggcggccccgctggatgtgggcttctcgctggcgacgacgcgagcgaacctggaacaccgtgcggtggtactcggcagcacctcggaggaactcacgcgcgggctgaacgccgtcgccgaagccgccatctccccggccgtgatccgtggcaacggcacggacaccggtgtggtgttcgtgttcccgggtcaggggtcgcagtgggtggggatggggcgggatttgtgggatgtctcgccggtgttcgccgagtcgatggtggcgtgtgagcgggcgttgtcgccgttggtggactggtcgttgagggatgtggtgttccgggacgcgggggatccgttgtggtctcgggtggatgtggtgcagccggtgttgtgggcggtgatggtgtcgctggcggcggtgtggcgttcgttcggggtggagccggctgcggtggtcgggcattcgcagggtgaggttgctgcggcgtgtgtggcgggtggtctgtcgctggaggacggggcgcgggtggtggccgtgcggtcgcggctggtgctggagaagctgtccggtaagggcgggatggtgtccgttgcgctgccggtggagggcgtcgaggagcgtctcgcccggttcgagggccggatcggtgtcgcggcggtgaacgggcccacctcggtggtggtctcgggggagcccgaggcactggatgagctccttgcggagtgtgaggggtcgggggtgcgggcccgtcgtatcgcggtggactacgcctcgcactccgcgcaggtggatgccctcaacgacgacctgctcgccgaactcgccggcatccggccgaagtcgtccacggtcgccttctattccacggtgaccggggggcggctggacacgtccggtctggacgcccggtactgggtgacgaatctgcgggagcgggtccggttcgagccggtggtgcggctgctcgccgaccaggcgcacggactcttcgtggaagccagtccgcaccccgtactcaacatggcggtggccgagaccggtgaggtcgcggaccgggctgtggtgacggtggggtcgctgcgccgtgacgacggtggcgcggaccgtctcctgacgtcactcgccgaggcacacgtcgccggtgctcccgtcgactggtcggtgctgttcgccggcaccggaacccgccggatcgggctgccgacgtacgccttccagcaccagcgctactggctcgaggacgcggccgcgcccggtacggacggcgtcgtcgacccggtggacgcggccttctggggtgcggtggagcgcgccgatgtgcagggcgtggccgcgctggtcgacggtgcggacccggaggcgtgggagccggtgctctcggcgttgtcggcttggcgcaaggggcgtcaggagcggtcggtgctggattcgtggcggtaccggacggtgtggcgttcggtgacggtgccgtcggcgggccggctgtcgggcacgtggctggtggtcgcccccggcgaaggtgctccggccgagcggatcgaggaggccctggtcggcgccggcgccgaggtcgtcgtactggcgtgggagacggaggagggccgcgaggcgctggccgggcgcctggccgaagccggtgaactgtccggtgtggtgtcgctgctgggctgggacgagaaggccgcacccgccgcgacagtgacgttggttcagggcttggcggatgccggggttgaggcgccgttgtgggtcctgacgcatggcgccgcctcggtggggtcgggcgatgtgatccgtccggtgcagacgcaggtgtgggcgctggggcagatcgtcggtctggagcagccgggtagttggggcggtctggtcgatgtgccggaggtgtgggacgagcgggttgcttccgggttcgctggtgtgttggcggcgggggagggtgaggatcaggtagcggtgcggtcgtcgggtgcgtatgcccgtcgtctggtgcgggctccgctgggcgcgaacccggcacccgtacgcgactggaaccctcatggcacggtgctgatcaccggcggcaccggtggcatcggtgcgcatctggcgcgctggctggcgaaggagggcgccgagcgtctgctgctcgtcagccgtagtggtgagcgggccgagggtgctgccgaactggccgcggaactgggcggcttgggcgcggaggtgacgttcgccgcgtgcgacgtgaccgaccgcgacgccctcgcccacgtgatcgccgagcacccgcccaccgccgtcttccacaccgccggagtcgccagctacggcaccgtacgggaactcgacctcgccgacctggacgcacagatggccgccaagaccctcggcgcccgtcacctggacgagctcaccaccgaacgcggcctcgaactggacgccttcgtggtgttctcctccggagccgcgatctggggcagcgccggcaacggcggctacgccgcggccaacgcgtacctggacggactcgcatgggaccgccgggcccgcggcctcgccgcgacctccgtgtcgtggggcggctggaaggccaccggcatggccaccgacgacaccgccgagcagctcgcgcgccgcggcgtccgtccgatggacccggcacgggccgtcgaggccctgcgacaggcgctggagcaggacgagaccgcgctgacggtcaccgacatggactgggaacgcttcacccccggctacacgatggcccggcgccgtcccctgatcgaggacatccccgaagtcgcccgcgtcctgagcgaggactccgccgacgtgctcggtgacgactcggcgggctcggccctccggacggagctcgcggcgctcggccaggccgagcagctcgatctgctgctggacctggtgcgcggcgaggcggcccgcatcctggcccactcctccacggccgagatcactccggagcggccgttcaaggaactcgggttcgactcgctgaccgcgatggaactgcgcaacctgctgaacaccgccaccggtctgcggctgcccgcgaccctcgtcttcgactaccccaacccgcggcagctcgccgcccacctgcgcaccgaactgatcggcgccgggccggacctcgtcccggccgccgacgtcgtacgggccgatgccgacgaacccctcgccatcgttggcatggcctgccgctactcgggcggagtctcctcgccggaggacctgtggcaggtcgtggtggagaacaaggacgggatgtccgacttcccctcctaccgcggctgggaccggtggaacctcgccagcctccgccgtgccggatttctgcacgaggcgggcgacttcgacgccggcttcttcgggatctcgccgcgtgaggcgatggcgatggacccgcagcagcggctgctcctcgaagcgtcgtgggaggccgtggagcgcaccggcatcgatccgcactcactgcggggcagcgacaccggcgtcttcgtcggcggtacggccgtcgagtacggcgcgctcctgatgaactcgccggccagccagggctacgccgtcaccggttcctccggcagcgtcatgtccgggcgcatctcctacaccctcggcctggaggggcccgcggtgacggtggacacggcgtgctcgtcctcgctggtcgccctgcacctcgccgcccaggcgctgcgcggcggtgagtgctcgctcgccctgaccggcggcgtcggtctgatggccaccccgggcgcgttcgcggagttcgacacgctgggcggactctcggtggacggccgcaccaaggccttcgcggccgccgccgacggcatcggctggggcgagggcgtcggcatggtggtcgtcgagcggctctcggacgcgcgccgcaacggtcatgaagtgctcgccgtcatccgtggcagcgcgatcaaccaggacggtgcgtcgaacggtctgagcgcgccgaacggtccctcgcagcagcgggtgatccggcaggcggtcgccaacgccggactggcgctggcggacgtggacatggtggaggcgcacggtacggggacgacgctgggcgacccgatcgaggcccaggcgctgctggccacgtacggtcaggagcgaccggccgaccggccgctgtggctcggctccgtgaagtccaacatcgggcacacgggtgccgcggccggtgtcgcgggcgtcatcaagtccgtactggccctgcgcaacggcctgttgcccaagaccctgaacgtggacgaaccgacccccaaggtggactggtccgccggtgcggtggagctgctgacccaggcgcgggagtggccgcagggggagcgtccgcgccgggcgggcgtgtcctcgttcggcatcagcggcacgaacgcccacgtgatcatcgaggaggcgcccgccgccgaggagacaccggccgcgcccgacgaggcggccccggcagcacccgcactggtgacgccggtcgtcccgtgggtgttctcgggccggtcgagcggcgccctgtgcggccaggccgggcgcctgggcggcctggtggagcgcgagccgggcctcgacgtcaccgacgtggcgttctcgctggcgacgacgcgagcgaacctggaacaccgtgcggtggtgctcggcggcgacgcggccggcctgctcgaccgtttgcgctcggtcgccgcgcgggagccggacgccggcgtcgtgtcgggcaccaccgccgccggtggccgggtggtgttcgtgttcccggggcaggggtcgcagtgggtggggatggggcgggatttgtgggatgtctcgccggtgttcgccgagtcgatggtggcgtgtgagcgggcgttgtcgccgttggtggactggtcgctgagggatgtggtgttccgggacgcgggggatccgttgtggtcccgggtggatgtggtgcagccggtgttgtgggcggtgatggtgtcgctggcggcggtgtggcgttcgttcggggtggacccggctgcggtggtcgggcattcgcagggtgaggtcgctgcggcgtgcgtggccggtggtctgtcgctggaggacggggcgcgggtggtggcggtgcggtcgcggctggtgctggagaagctgtccggcaagggcgggatggtgtccgttgcgctgccggtggagggcgtcgaggagcgtctcgcccggttcgagggccggatcggtgtcgcggcggtgaacgggcccacctcggtggtggtctcgggggagcccgacgccctcgacgaactcctcgcggagtgtgaggagtcgggggtgcgggcccgtcgtatcgcggtggactacgcctcccactccgcgcaggtcgacgccctcaacgacgacctgctcgccgaactcgccgacatccggcccaagtcgtccacggtcgccttctactccacggtgaccggcgaccggctggacacgtccggtctggacgcgcggtactgggtgacgaatctgcgggagcgggtgcggttcgagccggtggtgcggctgttggcggagaaggggagttcggtcttcgtcgagtcgagtccgcatccggtgttgacgatggcggtggccgagaccggtgaggtcgcggaccgggctgtggtgacggtggggtcgttgcggcgtgacgacggtggcgcggaccgtctcctgacctcgctcgccgaggcctacgtggcgggcgcgcccgtcgactggtcggtgctgttcgccggcaccggggcccgccgggtcgacctgccgacctacgccttccagcaccagcgctactggctcgaaggcgtctccgtcggaggcgagatccaggaggcctcggcggacgcgatggacgccgcgttctgggatgccgtggaacgtgaggatctcgccgatctcaccgaggtgctcgacacatccggcggcaccgggcccgacccggccgccgccgcggaggcctggctgcccgcgctgtcggcctggcgcaagggccgccggaagcagacgacactcgactcgtggcgctaccgcaccgaatggcgcacgaacgatcggcccctctcggcacggctgtcgggcacgtggctggtggtcgccccgagcgacggtgcgccgaccgagcggatggagcggaccctcgccggcgccggtgccgaggtcgtggtcctggcgatcgaggcggggacggaccgggcggagctggccgaacggctcgccgggactcccgaggcggcgggcgtggtctcgctgctcgcctgggacgaacacaccgcggtcgcctcgacactgacgctcatccaggcccatggcgacatcgagtcggcggcccctctgtgggtggtgacccgcggagccgcgtccgtggactcgggcgatgagatccgtccggtgcagacgcaggtgtgggcgctggggcagatcgtcggtctggagcagccgggcagttggggtggtctggtcgatgtgccggaggtgtgggacgagcgggtggcctctcaggttgctggtgtgttggcggcgggggagggtgaggatcaggtagcggtgcggtcgtcgggtgcgtatgcgcggcgtctggtgcgggctccgctgggtgcgaatccggcacccgtacgcgactggaacccccatggcacggtgctgatcaccggcggcaccggtggcatcggtgcgcatctggcgcgctggctggcgaaggagggcgccgagcgtctgctgctcgtcagccgtagtggtgagcgggccgagggtgctgccgaactggccgcggaactgggcgggttgggtgcggaggtgacgttcgccgcgtgcgacgtgaccgaccgcgacgccctcgcccacgtgatcgccggcatcccggcggagcaccccctcaccgccgtcttccacaccgccggagtcgccggtcacggaccgctggccgacctcgacgtgaccgacctcgacacgcagaccgccgccaggatcgcgggcgctcgtcatctggacgagttgaccgccgagctcggtgtggagttggaggcgttcgtggtgttctcctccggggctgcggtgtggggcagtggcagtaatggtgcgaatgcggccgcgggcggttatctggacggtctggtgcggttgcggcgggcgcgtggtgtggcggggacgtcggtgtcgtggggcggttggcaggcgacggcgatggcggtgggggacacggcggagcagttgtcgcgtcggggtgtgcggctgctggatccggtgctggcggtgcaggcgttgcggcaggcgctggagcaggacgaggtgtcggtgacggtgaccgacatggactgggcgctgttcactccgggatacgcgatggcccggcgccgcccgctcatcgaggacatccccgaggcggcacaggtactgcgtgacgccgaggagatcgaggacggcccggaggacggggcggccggcgcggatctgcgcaagcgtctggccgggctgaccgaccccgagcggcaggccacgctgctggggctggtgcgcggcgaggcggcccaggtgctggcgcacgggtcgacggcggagatcacgccgaccaggccgttcaaggaactcggcttcgactcgctgaccgcgatggacctgcgcaaccggctgtccaaggccaccggactgcggctgccggccacgctcgtcttcgaccaccccaacccgcagcgcatcgccgaacacctccgcgccgggctggcccaggacgggcagcagggcatcgccgacgtcctcgacatccggcgtgagctgacccggatcggcgaggcgctgaacagcgtcgcacccgatgcccgggcccgcgaggacatcgtcgaccatctccgcgacctcatcacccagctcggcaccggcaccggagccgccgagcaggacaccaccgatctcgaagccgcgacggacgacgagatcttcgacttcatcgaccgcgacctaggcgtgtcctgatcaggcggacgagcaggcatctgtcgggctttcaaccgctccagagtggggtttcacgatgaccgaggacaaactccgtacctatctgcgccgagtcacggccgaactgcaacagactcgacagcagctccaggacagccaggaccgggcgcgggaaccgctcgccgtcgtgggaatggcctgccggctgcccggcggcgtcgactcacctgagcagctgtggcagatggtgatggacggtgccgacggggtgagcggattccccgacgaccggggctgggacctctcctcgctcttcgacagcgaccccgaccggccggggacgacgtacacccgggaaggggcgttcctgcgcggcgcgggcgacttcgacgccggcttcttcgggatctcgccgcgtgaggcgctgaccatggacccgcagcagcggctgctcctggaaacgtcgtgggaggcgctggaacgggcgggcatcgacccgcacacgctgcggggcagccgaacgggggtgttcgtcggcggtacggccatcgagcacacggtcaagctgatgaactcgccgaccgaccagggatacgcgatcacgggcggctcggcgagcgtgatgtccggccgggtgtcctacgtactcggtctggagggccccgcactcacggtcgacacggcgtgctcgtcctcgctggtcgccctgcactccgccgctcagtcactccgccagggggactgctcactggcactggccggcggcgtcgcggtcatggccacctcctcggcgttcgtgaccttcgcccggcagcgcggcctggccgcggacggccggtgcaaggccttctccgacgacgcggacgggatcggctggggcgagggcgccgccgtcgtcctgctggaacgccttgcggacgcgcggcgcaacggtcaccccgtcctggcggtgatccgcgggtcggcggtgaaccaggacggcgcgtcgaacggtctgagcgcgccgaacggtccctcgcagcagcgggtgatccggcaggcggtcgccaacgccggactggcgctggcggacgtggacatggtggaggcgcacggcacggggacgtcgctcggcgacccgatcgaggcacaggcgctgctggccacgtacggccaggaccggcacgacggccggccgctctggctcggctcgctcaagtcgaacatcgcgcacacccaggccgtctccggtgtcgccggtgtgatcaagaccgtgctcgcgctgcggaacggcgtactgcccaagaccctgcacgtcgggaagcccagcacccaggtggactggtcggcgggtgcggtggagctgctgacggaggggcgggagtggcccgagacgggcggtccgcgccgggcgggcgtgtcctcgttcggtatcagcggcacgaacgcccacgtgatcctcgagcaggcccccgaggaggactccgccgagccgcagccggtcgacgcgccggagccgcccctcaccacgagccccgccaccgtgccgtggctgatctccgggcagacggaggcggccctgcgggcgcaggccggacgacttcaggcacacctcgacgcccaccccggcctcggaaccgcggacgtggcccactcactcctggcgagccggtcgaaactcgcgcatcgcgcggtgctgttcgccggacagggcgcacgtagcggagaccggcccaccggactcaccgccctcgcggacggactcgacgtgcccggcctggtccggggaaccggcgacgccggaaccggtgtggtgttcgtgttcccgggtcaggggtcgcagtgggtggggatggggcgggatttgtgggacgcctcgccggtgttccgtgcgcggatggaggagtgcggccaggcgctgagtccgtacgtcgactggtcgctgaggaatgtggtgttccgggacgcgggggatccgttgtggtcccgggtggatgtggtgcagccggtgctgtgggcggtgatggtgtcgctggcggcggtgtggcgttcgttcggggtggagccggccgcggtcgtggggcattcgcagggtgaggtcgctgcggcgtgtgtggcgggtggtctgtcgctggaggatggggcgcgggtggtggccgtgcggtcgcggctggtgctggagaagctgtccggcaagggcgggatggtgtccgttgcgctgccggtggagggcgtcgaggagcgtctcgcccggttcgagggccggatcggtgtcgcggccgtcaacgggcccggctccgccgtcgtctccggtgagcccgacgcactcgacgaactcctcgcggaatgtgaggagtcgggggtgcgggcccgtcgtatcgcggtggactacgcctcccactccgcgcaggtggatgccctcaacgacgacctgctcgccgaactcgccgacatccggcccaagtcgtccgccgtcgccttctactcgacggtgaccggggagcggctggacacctccgggctcgacgcgcggtactgggtgacgaatctgcgggagcgggtccggttcgagccggtggtgcggctgctcgccgaacaggaataccaggtcttcgtcgagtccagcccccaccccgtactgaccgtggcgatccaggaaacccaggaaggcgtgttcggcaccggtaccgctgtggggtcgctgcgccgtgacgagggcggtgcggaccgcttcctgacgtcgctcgcggaggcttacgtggcgggcgctcccgtcgactggtcggtgctgttcgccgggatgccggtgcgccgggtcgatctgccgacgtacgccttccagcacgagcgctactggatcgaggacgtggtggcgcccggtgcggacggcgtcgtcgatccggtggacgcggccttctggggcgcggtggagaacgcggacctccaaggcatggccgcgctcgtcgacggcgcggagcctgaggtgtgggagccggtggtcccggcgttgtcggcttggcgccgggggcgtcaggagcggtcggtgctggattcgtggcggtatcggacggtgtggcgttcggtgacggtgccgtcggtgggccggttgtcggggacgtggctggtggtgacgccgggtggcgcggggccggtcgaggaggtccggcgggcgctggaggcggccggcgccgaggtcgtcgtactggcgtgggaggcggaggagggccgtgaggctctggccgggcgccttaccggagccggtgaggtgtcgggtgtggtgtcgctgttgggttgggatgaggaggccgcgcctgtcgcgacggtgacgctcgtccaggctttggcggatgccggggtcgaggcgccgttgtgggtgttgacgcagggtgccgcgtcggtgggtgcggaggatgtggtgcacccggtgcagacgcaggtgtgggcgctgggtcaggtggccggtctggagcagccgggcagttggggtggtctggtcgatgtgccgggggtgtgggacgagcgggttgcttccgggctgactgccgtgttggcggcgggggagggtgaggatcaggtagcggtgcggtcgtcgggtgcgtatgcccggcgtctggtgcgggctccgctgggtgcgaacccggcacccgtacgcgactggaaccctcacggcacggtgctgatcaccggcggcaccggtggcatcggtgcgcatctggcccgttggctggcgaaggagggcgccgagcgtctgctgctggtcagccgtagtggcgagcaggcagaaggtgctgccgaactggccacggagttgggcggtttgggtgcggaggtgacgttcgccgcgtgcgacgtgagcgaccgcgacgccctcggccacgtgatcgccggcatcccggcggagcaccccctcaccgccgtcttccacaccgccggcgtatccggttacgcggaactcgccaccgccacccccgagcactacgagacggtcctttccgccaagacgcggggcgcccgcaacctcgacgccctgaccgcggagctgaccctggaggcgttcgtcctgttctcctccggcgccgccgtgtggggcagcgcgggaaccggtgcgtacgccgcggcgaacgcctatctggacgggctggcgtggaaccggcgggcgcgcggtctggtcgcgacgtccgtgtcgtggggcggctggaaagccaccggcatggcggccgacggcaccgaggagcagttggcgcgccgcggtgtgcgggcgatggaaccggcactggccatcaaggccctgcgacaggcgctggagcaggacgagacggcgctgaccgtcaccgacatggactgggcgcgcttcacccccggctacaccatcgcccggcgccgcccgctgatcgaggacatccccgaagtcgcccgcgcgctgagcgaggactccgagcccgcgcccgacgacggcaccgactccgccctgcgccagaccctggccgggctcaccgcccccgaacagcacgaccggctgctcgaactcgtccgctccgaagcggcgaccgtgctcacccaccggacgacggacgacatcacggccgggcggccgttccgggacctcggattcgactccctgaccgcgatggaactgcgcaaccggctgaacacggccaccggcctgcgcctgcccgccaccctcgtcttcgaccaccccacaccgcagcgtctcgccgggcacctgcacgagaagctcttcgacagcgccacggagacggcactgccggtcctgcggacgaccgacgacgacccgatcgtgatcgtgggcatggcctgccgcttccccggcggggtgcgcggtcccgaggacctctggcgtctgctcgtcgacagccgcgacgagatgacggacttccccgccgaccgaggctggcacggcctggccatgaacgccttcatcgaggagtccggcggagcccggcagggtgccttcctggccgaggccggcgacttcgacgcggcgttcttcgggatctcgccgcgtgaggcactggcgatggatccgcagcagcggttgttgctggagacctcgtgggaggcgctggaacgcgccgggttcgatccggtcggcctgcgcggcagccgcaccggcgtcttcgtcggcggcaccccgcaggagtacacgaccgtcctgatgaactcgtccgaggcaggcggcggttacgccctcaccggggcgtcgggcagcgtgatgtcgggccgggtcgcctatgccctgggcctggagggcccggccgtcacggtcgacaccgcgtgctcctcctcgctggtcagcctgcacctggcagggcaggcgctgcggggcggcgagtgcgacctggcgctggtcggcggtgtgaccgtcatggccacgccgggagccttcgtcgagttctcgcggcagggcggtctcgcgggagacggccggtgcaaggcgttcgccgccggtgccgacggcacgggctggggcgagggtgtcgggatgctggccgtgcagcggctttcggacgcggtgcgggacgggcgtccggtgctggcggtggtgcggggttcggcggtgaactcggacggtgcgtcgaacggtctgacggcgccgaacggtccgtcgcagcagcgggtgatccggcaggcgctcgcttcggccgggttgtcggcggcggacgtggacatggtggaggcgcacggcacggggacgtcgctcggcgacccgatcgaggcacaggcgttgctggcgacgtacggtcaggaccgtccggcggaccgtccgctgtggctgggttcggtgaagtcgaacatcggccacacccagtacgccgccggtgtcgccggtgtcatcaagtccgtactggccctgcgcaacggcctgttgcccaagaccctgcacgtggacgagccgacccccgaggtggactggtccgcgggcgcggtggagctgctgacggaggggcgggagtggccggagaccgacgggccgcgccgggcgggcgtgtcctcgttcgggatcagcggcacgaacgcgcacgtgattctggagcaggcgccgtcggtcgaggaacggacgccggtgtctgcggttgacgggttgctggtgccgtgggtggtgtcggcgcggtcggaggaggcgttgcgggcgcaggcccgacggcttgccgaccacgtacgggggagcgatctgcggccggccgacgtgggtctgtcgttggcggtgacgcgtgcgggtctggagcaccgggctgttctgacggggcgggatcgggaggacttcctggtccagttggccgcgttggcggagggtgcgggcgcggcggggatggtgcggggtgtggccggggagggcgggacggcgttcctgttcaccggtcagggtgcgcagcggcttggtatggggcgtgagctgtacgagcgtttcccggtgttcgcggctgcgttcgacggggtgtgtgcgcagttggatctgttgctggagcggccggtgaaggaggtcgtgttcaccgatgcgccggcgttggaccggacggtgttcacgcaggccggtttgttcgcgttggaggtggcgctgttcgagctggtgggttcgtggggtgtgcgggcggatgtgctgctggggcattcgatcggtgagctggcggcggcgtatgtggcgggggtgtggtcgctggcggatgcgtgccggatcgtggcggcgcggggccggttgatgcaggcgctgccggagggcggtgcgatggtcgctgtcgaggcggccgaggacgagctgccggtgcttcccgggggtgtgtcggtggctgcggtgaacgggccccgttcgctggtgctgtccggtgatgaggagccggtgaccgcgctcgcccaagcgtttgctgaacagggcaggcggaccaagcagttggcggtcagtcacgccttccactccgcgcggatggagccgatgctggcggagttcgcggagacgctcgccgcggtggagttccgtccgccgcgtatcccggtggtgtcgaatgtgacgggtgggatggcggacgccgagttcaccactcccgcctactgggtgcggcatgtgcgggaggccgttcgtttcgccgatggtgtggcgacggtgctggcgcggggtgtggacaggttcctcgagctgggtccgcggggtgcgctgaccgcgatggccgaggagaccctcgaccacaccggcgccgacgccgtgtgcgtgcccgtactgcaccccgaacgccccgaagcggactgcctgaccctcgcgctcggccggatccacgcgagcggtgccccggtcgactggtccgggctgttcgccggcaccggcgcccgcaccgtcggactgcccacctacgccttccagcacaagcgctactggctggactcgcgcacgaccggcagcggcgaccccgcgagcatcggactgacggcgaccggacacccgctgctcggcgccggagtggcgctgcccgactcggacggattcctgttcaccggcaggctctccctggccacgcagccctggatcaccgatcacgcgatgctgggcaccgcgctgctgccgggtaccgcgttcgtggaactcgcgctgcgcgccggcggacaggtgggctgcgagctgatcgaggaactcaccctggaggcaccactggtgctgggcgagcagggcggtcgcgccgtccaggtgctggtcggcggcctcgacgagaccggccggcgcgccatcaccctgcactcgaggcccgacggcgaaggcgacgaccagccctggctgaggcacgccagcggcgtactcgccgagaacacgggagcggaacccgacgcggagccgatgacggtatggccgcccgacggctccaccgccgtcgccgtcgaggacttctacccggacatggccgaggccggattcacctacggcccggtcttccagggcctgcgggcactgtggaccaaggacggagacctgtacgccgaggttcggctccccgaggaggcgggcgacgccgacagcggtttcggagtgcacccggccctgctggacgccgcactccagccactcgccctgggcgtcctcggcggcacccccgaccgggaggcggtcaagggaggcatgccgttcgcctggaccggagtacgactgcacgccacccacgccaccgtcgcccgcgtccacctcgctccggtgggccggggcgaagtgtccgtcctggtcaacgacgagtcaggactgccgatcgccacggtcgggtcgctcacgatgcgggaccccgcgctggaacagttcaccgcctccgcaccccgccaggacgcgctgttcgacctgaagtggaccccggtgcccctcggctcccgagaggtctccggcgaatgggcgatgctcggcttcgacccgctggagatccgcccgcggctcgtcgaagccggcctgaccgggacgccgtacctcgacccgcaatccctgatcgacaccgtggagtcgggcaagcccgccccctccgtggtggcgatgtcctgcttcggcggggaccagggcggcatcgtcgccgccacccatgacgccgtacaccgggtactggaggtcattcagcactggctcgccgacgaacgcctcacaggctccaagctgttgctgctgacccggggcgccgtcccggccgccggcacggaccgtaccgaggacgtggcggcctcggccgtgtggggcctggtgcggacggcacagtcggagcacccggaccggatcgtcctgatcgacctcgacgacgaccccgcctcctaccgggccctgcccaaggcgctcggcaccggtgaaccgcaactcgccctgcgcgccggctcgccctgcgtgccccggctggccaggcacaccggaccggcggacggcgcccctggcttcggccccgacggcaccgtgctggtcaccggcggcaccggagcgctcggcgcggtggtcgcgcgtcacctcgtgaccgcacacggcgtccggcatctggtgctggccggccgccgcggcgagcgcgcgcccggcgcggccgccctgctggccgaactcaccgaactcggcgccgacacccgcatcctggcctgcgacgtctcggaccgggacgcactcgccgtgctgctgcgggacatcccggccgaccggccgctgaccgcggtcgtgcacaccgcgggtgtgctggcggacggcacggtcgagtcgctcaccccggaccggttcgacaccgtcctgcgggccaaggccgacgcggcctggcatctgcacgagctgacccaggacgccccgctgcgggagttcgtgctcttctcctcggccgccggactgctcggcagccaggggcagggcaactacgcggcggcgaactcgttcctggacgccctcgccgcgcaccgccgcgaggccggactgcccggcaccgccctcgcctggggctggtgggagcagcccggcggcatgggcggcgacctcggccgggccgaacgcgcccggatggcccgcggcggggtcacccccttcaccgccgagtccggcatggaggccttcgaccgggccctcggcgccggccaggaagccctcctcgtaccgatgcggctgaacaccacggcggcgcgggcggcgagcgagcagcaggtacccccgctgctgcgcggcctggtgcgcgctccgcagcggcgggccgcccggtccgacgtacgggccacctcgcacctgcacgagcaactggccgcggcggaccaggcggaacggcaggccctgctggccgagctgatccgcggcgaggtcgcgcaggtgctcgggcactccggtgccgaggcgatcgaggacggccacggcttcgtggagctgggcttcgactcgctgacctcggtcgaactgcgcaaccggctcaacgagcgcaccgggctgcgcctcgcgtccacggtcgtcttcgaccatccgacgcccctcgcgctcgccgccgaactcagcgagcagctgggcaccccggcggcaccgatggccgccgctccggcggcggggcaggcggccgccgggccggccgaggacaccgggagcggccgtggcgcggacgcgctcggcgacctggcggtgatcaacggagtggaggcgctgtaccggcgctcgaacgagctgggccggctcgacctcggccacagcgtgctgcggaactcggtcgacctgcgggtgagcttctccgacccgcaggaggtcaagggcggcccgagcctcgtccggctcggtgagggggcgcagtacccgaagatcatcgggttcccctcacagtccgtgtgggcgagcaaccaggaactggtcagcatggccacgccgttgcgcggaacccgtgacgtgtggtcgctgatgctccccggcttcgtcaccgggcagccggtcgcggccgacgtggacgcggcggccgagtacgccctgcggctcatcgaggaactggtcgacggcgaaccgttcgtgctggccggccgctcctccggaggccggatcgcccacgaggtcacgtccaggctggaggaccggggactggcgccccggggcctggtcctgatcgacagctacatggccggctacgacgccacctcgtacatcgtgccggtgatggagtcgaaggccgtcgagctggagaaggacttcgggcagatgaccgggacgaggctcacggcgatggccgcgtacttcggcatgttcgagcactggcagcccaaggagatcgcgacgccgaccctgctcgtacgggcctcggagtgctacggcatcgagccgggcgaggtgcagccgccggccgagcagtggcaggccgcctggccgcttccccacgaagcgatcgacgtgccgggcaaccactacacgatgctggagggcaacggagacgtcacggcggccgccgtgcacgagtggctgacgcgccacgaggcgtaggcccctcctccggccgacgggccgtgctcyttcaccggagcacggcccgtcgcatacaccggtacgccggcacgcgggcatgccgggtgcccgcgctgagggggagcggggggcagggcgggagccgacggctcatgccctgcggctcgtgccctgcggctcgtgccctgcggctcggggccgccagctaccgacctgcggctcctgcccgccgactcctggccgccggctcgtgcccggcagggcgctggcctccgcccgacgactccaaccctggggccgctccagcccgttgacctctccaccggctcccgcccggcgacccccgcccggcggctcacgcccggcgactcctaccctgcggctcccgcccactgtcctctgtcctctgccggcaggcagaagtcagcgggcccagcaggttggtgaacctgctgggcccgctggtcgccgcggtgcggtgccggatgtcaccaggtgatgggcaggctctcgaggccgcggatgatcgacgcggacttgagccgcagctccgactccggcaccgcgagccgcacctggggcatccggtccaggatcgcgccgagcgcctcctggagctcgatgcgggcgagctgcgccccgaggcagtggtggataccggcgccgaaggccagatgcggattgttctcccgcgtcacgttcagccgctcgccgtcctcgaacacctcggggtcccggttcgcggtggcgaccgcgggcaggaccaccgcgccggcgggcagcacctggccgccgctcagctccacctccgccgtggtgagccggggaatgatgccgccggtcgtggtgagcggaacgaagcggagcagctcgtcgacggccttcgggatcgcctcgcggttgtcccgcagcttgtcgagctcctcgggattgtgcagcagcgtcaccaggaacatgctgatctggttggcggtcgtctcgtggcccgcgctgagaatgccgatgctcagcgcgatgatctcgcgctcggtgagcgtgctgtccccgtcgctgatcgcgatcagctcactgatcaggtcgtcggcgggattctcccgcttcaccgcgatgagttcgccgaagtagttcaccaacgagaccgtcgcggcctccttctccaccacctgctgccagtccccgagcagcgcgttcgaccaggcgtggaaggtgtcctggtccccggccggtacgccgaggagttcgcagatcacccggaccggcagcggcacggagaagttcttgaccaggtccaccgggcggggcagcgtctccagctcgtcgagcagctggccgaccaactccgtgatgcggggccgcagcgtctccacccgcctcgcggtgaacgccttggtcaccagcttgcgcagccgcgtgtgctccggcgcgtccatgccgacgagcgactcgttcatcagcttgccggtctcggtctccgacatcgcggcggccgcggtggccatcaccttgctgctgaaccgggagtcgaccagcaccttgcggacatcggcgtgcttggtcaccatccatccgctgatgccgtcggggaacttcacctccaccacggactggccgtcgcggatctccgccagctcgggaggcagctcgcagaccgacggcgggtcggggaacgggaacgcgatgggctcggaaggcgcttcggccatggaaagctctccagattcgtgagggttgtcagacgtggcgagggttatcagacgtggcgagggttgtcggacatggcgagggttgtcggacgtggcgagggttcacaggcctccgtgcgtgcaggctatgcacgccccgcccctagccccgtcccctatggggccccactcgcacaacgtgccggacgggcccggctattgagcggtggtgctcgcggtggagctcgcggtggtgctcctggccatggcgagcagcgcggccacgtccatggacttgatctcgtcgctgcggtcggccgcctccggctgcgccccgccgtcgtcggcgagggccagcagcgtgtcgagcagtccgtgctcgcgcagccgggcgagcgggatggacagcagggtgcggcgcacggccgcctcccggtcgtcctcgggccgcgcggccggttcggtgccgtccgggaccagcttccccgccagcaactccaccagttcgcccagcgtcggatagtcgaagaccaggctcacgggcagtcggagtccggtcgccgcgttcagccggttgcgcagctccaccgcggtcagtgaggtgaagccgaggtcgcggaacggccggtccgtctcgatccggtccgaggaggcgtgcccgagcacggcggcgatccggtcgcgtacgagggccagcagggtctcctgccgctcgaccggcatcagctccgcgagccgacgccgcagttgggcgcccgagtcctgaccgccggcctccgccgtccgccgggccgggccgcggaagagcccccggagcaccggcggcagggagccggcggcggcctgggcgcgcagcgcggccccgttgaggcgagcggggaacaccacgggctcggcgcagcgccagccgaggtcgaacagggcgaggccctcgtcggagggcagcgcggacaccccgcgcatgggagtgcccgccgaggccgcgtcggtcagaccgccgcccatgccgcgctcggccgcccacagcccccagcccagcgaggtggccggcagaccgcgcccgcgccggtgccgggcgagcgcgtccaggaacgtgttggcggccgcgtagttgccctgcccggtgccgccgagggtgcccgcgatcgaggagaacaggacgaaggcggacaggtccaggccctcggtcagctcgtgcagatgcaccgccgcgtccaccttggcgcggaagacccggtcgatcagctccggggtcagcgctgccagcagcgcgttctcggcggttccggcgcagtgcaccaccgcggtcagcggatgtgcggcgggaatcccggcgagtacggcggccagcgcctcgcggtccgcggcgtcgcaggcgaccagcgtcaccgtggcgcccagcttctccagccggccgaccagctcctcggcgccctccgcctccgggccgcgccggctcagcagcaacaggtggcgtacgccgtgccgttcggcgagatggccggcgaccagcgtgcccagaccgcccgtcgccccggtcacgagcaccgtgcgggacgggtcgagcgcgtcgagtcccgtaccgggcacgtcgagtcccgtaccgggcacgtcgtcgagtcccgtaccccccgtaccgggccgcgtaccgggcgtcgggtcggggagctcggtgaccgccatccggctcaaccgcgggaccagcgcggacccgccgcgcaacgcgatctcgggttctcccgacgcgaccgcgcccggcacggaccgtccggactcggggtcgccgtcggtgtccagcagcacgaaacgccccggattctccgactggaccgaccgcacgaggccccacagcggggcggagccgaggccggtcaccggatcgtccgccgaggtgcccaccgcgtccctggtgaccaccaccagcggcaccggggcgagccgttcgtcgaggtcctcggagacccacgcccgcgccgactccagcacccgcgcggcacgttcccgggcgacggcgggatgcccgtcgtcgtcgcggcccccggccgccggatccaggacgacgaagccgggcacggggtcacccgcggcgaccgacgccgcgagcgcgtccaggtcggcgtggcacacggcaccggagtccgggcccgcccacgacggccggtcccccagcaccgcccagggcacggcaccgacggcgggcaacggaaccggcgtccacgtcagggacagcagcgaggagtgcgcggcggccggcggccgggcccccggctccgtcacgtcgaccggccgcagcagcagcgaaccgaccgtgacgaccggggcaccggtgccgtcggcggcgtacagcgacacggcgttcgcccccgccggcgtcagggtcacccgcaaagcggtggcaccggtggcgtgcacggacacaccgttccaggcgaacgggcgcagcggctgcccgccggtgtccagcagttcgcccaggcccaccgcgtgcagcgccgcgtcgagcagcgccggatgcagcaggtactcacccgcctgctcgtgcagttcctgggggagccgtacctccgcgaagaccttccggtcccgggtccaggcagcccgcagcccatggaaggcgggcccgtaggcgaacggcccgtccgccaactgcccgtacaggtcgccgagttcgaccggctcggcaccgcgcggcggccagacggccggtgccgcctccggtacgggaccggccgggcacaggacgcccgtgccgtgccgcgtccaggcggccgccgcgatctcgtcgtccgcgcgggcgaagaacccgatctcgcgccgcccggtctcgtccggtgcgctcaccgtgagctggaggtccaggccaccggtctcgggcagcgtgaggggggcctgcatggtcagttcctcgatgtgcgggcactcgacgaggtcgcccgccgtcgcggccagctccacgaacgcggttcccggcagcgggaccgtgcccatgacccggtggtcggccagccaggggtgctcgcgcagggagacccggccggtcagtacgaggccgtcggactcggcgggctccacggcggccccgagcagcggatgtccgggggagcgcagaccgacggacgtcacgtcgccggacccggcggacggcaggcgcagccagtaccgctgccgctggaaggcgtacgtgggcaggtccaccggccgcgcgccggtgccgtcgaacacccgcgcccagtcgacgggcgcgcccgcgacgtacgcctcggccagcgaggtcagcagccggccgaggcctccctcgtcgcggcgcacggagccggacacctgggccatgacgcccgccgcgtcgatgacctcttgaacggccatggtcaccacgggatgggggctgatctccagcaggttccggtgcccctcgtcgagggtggcgcgcaccgcggcctcgaaggcgacggtctcccgcatgttgcgcagccagtagcgggcgtcgagcccggaggtgtccacctgctcgccggtcaccgtggagtggaaggcgacggtggacgacttgggccggatgtcggcgagttcggcgagcaggtcgtcgttgagggcgtcgacctgcgcggagtgggaggcgtagtccaccgcgatacgacgggcccgtacccccgactcctcacattccgcgaggagttcgtcgagtgcgtcgggctcaccggagacgacgacggaggtgggcccgttgacggccgcgacaccgatccggccctcgaaccgcgccagccgctcctcgacgtccccgaccggcagcgcaacggacaccatgccgcccttaccggacagcttctccagcaccagccgcgaccgcaccgccaccacccgggcgccatcctccagcgacagaccaccggccacgcacgccgcagcgacctcaccctgcgaatgccccacgacagcggccggctccaccccgaacgaacgccacaccgccgccagcgaaaccatcaccgcccacaacaccggctgcaccacatccacccgagaccacaacggatcccccgcgtcccggaacaccacatccctcaacgaccagtcgacgtacggactcagcgcctggccgcactcctccatccgcgcacggaacaccggcgaggcgtcccacaactcccgccccatccccacccactgcgacccctgacccgggaacacgaacaccacacctgactcggcggcacgccccgccaccacgccggcgccgacggcggccccctcggccaccgaccgcaaccccgcgaccagttccgtccggtcggctcccagcaccaccgcccgctgctcgaacgccgaccgcgtccgcgccagcgcgaggcccacgtccagcggctccaggtcaggacgctccgagagacggtccagcaaccgctgggcctgcgcacgcagcgcggcctcaccccgcccggagatcgcccaggggatcaacggcggcgtcacgaccgcaccgtgctcctccgacttcgactgcgactccgactccgtctccgagtccgttgccgagtccgtcgccccggccgcttcgggcgcctgctccaggatcagatgcgcgttggtgccgctgacgccgaaggaggacacggcggcccggcgggggcggccgtggccgggccacgggcggttctcggtcagcagtcgcaccgcacccgaggaccagtccacgtgcggcgtcggctcgtccacgtgcagggtcttcggcatgacgccgtgccgcagcgccatgaccgtcttgatcacgccgctgacgccggccgcgtactgggtgtggccgatgttggacttgatggagcccagccacaggggccggtcggccggccggtcctggccgtaggtggccagcagcgctcgtgcctcgatggggtcaccgagtttcgtaccggtgccgtgcgcctccaccacgtcgatgtccgcggtggccagcccggcgtcgtcgagggtgcgcaggatgaggcggcgctgcgcggggccgctgggcgcggtgaggccgttgctggccccgtcctggttgatgccggtctcccgtacgacggccagcaccgggtgtccggcgcgccgggcgtcggagagccgttcgaggacgaggacaccgaccccctcgccccagccggtgccgtcggcgtcggacgagaacgccttgcagcggccgtcggaggccagcccgccctggcgggagaactcggggaacgcgccgggcgtcgcgaggaccgagacaccgccggccagggccagcgagatctcgtccttgcgcagcgcctgcacggccagatgcatggagaccagcgaggacgagcaggccgtgtccaccgtgaccgcgggcccctccagaccgagcacgtacgagacccggccggagagcacgctgctggaggtgccggtcagcatgtagccgtccagtgcctgcggcgacgcggccagcagaccggcgaagtccccgcccgtaccgccgaagtacaccccggtgacgctgccgcgcagggatcgcgggtccaccccggcccgctccagcgcctcccacgaggtctccaggagcagccgctgctgggggtccgtcgcgatcgcctcgcgcggggagatcccgaagaagtccgcgtcgaactcgcccgcgccgtgcaggaatccgccctccagtgtggtggaggcgccggactcctcggcgtcggtgcggtacagccggtccaggtcccagccgcggtcgtcggggaagcccgagatcgcgtccacgccctcggacaccatgtgccacaggtcttccggggtctgggccccgccggggaaccggcacgccatgccgacgatcgcgatcggctcgcgcgccttgtcctcgacctcgcgcagccggcgctggagtccgcgtgcctcggtgacggcccgcttgaggtagtcgcggaacttctcctcgtcggacattcgctacagctccttggtgaggtgtgcccggccgatcgggactgatcggactgatccgggtcgatccggtccgatccggtctggttcggtccgggccggtcgaagggcagggtccggtccggtcgaaggaccgggtctgtgccgtcggtcagagaccgaacccctggtcgatcgcgtcgaagaggtcgtcggtgctggccgcgtcgaggtcgtcgagggcgtccgccgcggccggttcggcatcgcccgtgctccactgcgccagcagcccgcgcagccgccgggtgacccggtcgcggtccccgtcgtcagcggtgaccgccgcgagggcggcctccagggcgtcgacctgggagagggcggcctcggcgccggagagcccggccggggcgagctgcgtgagcagttccccggcgagcgcggccggcgtcggatgctcgaagacgagcgtggccggcagccgcagacccgtggccgcgccgagtcggttgcggaactccacggcggtcagcgagtcgaagccgagctcgctgaaggactgctccgccgcgatcgccccggccgaggcgtggccgagcacggtggccgcgttcgaacggaccaggtccagcagcctgcgaagctgctcggctggaggcagcccggtcagccgcgtccgcagctcggccccgtcgccgccggaccgcaccacccgccgcgaggtgccctgcaccagaccgcggaacagcggcggaacgctgtccgggtcggcccgcagcgccgacgccgtcagccgggtgatcacctggagcggtacgtcggccccgcacgccaggtcgaacagcgcgagcccctcctcgttgtccagcggccgcatgcccgcccgctccatccgttccacctcggcgtcgcccaagtggcccgtcatgtcgctgcgttggttccagaagccccaggcgagggaggtggcggggtgtccgtgggtgcggcggtggtgggcgagggcgtcgaggtaggtgttggcggcggcgtagttggcttgtcctgcggtgccgagttgtccggcggcggaggagtagaggacgaaggtggtgacggggtggtggagggtgaggtggtggaggtgggtggctgcgtcgatcttgggttggaggacggtgtggagttgggtgtccgtgagtgtggtggtggtggcgtcgtcgagggtgcctgcggtgtggatgacggtggtgagggggtgttcggtggggatggtggtgaggagggtggcgagttgttcggggtcggtggtgtcgcaggcggtgacggtgacgtgggcgccggctgcggtgagttcggctacgagttcggtggcgccgggggcgtggggtccgcgtcggctggtgagcagcaggctggtcaccccgtgccgggtgacgaggtggcgggcgaggagggcgccgagggtgccggtgccgccggtgatgagggcggtgccgtgcggatcgatcccccgcggcacggtgagcacggccttgccgaccagcttcgcctggctcaggtcccgcatcgcctcacgggcccggcgcaggtcgtacgtggtgaccggcggcggcaccagcaccccggcgcggtacagctccagcaccgcgaccagcatctcctggatccggtcggggcccgcctccatcaggtcgtacgcctggtaggccacgcccgggtacgcggcggcgacccgcgccgggtcgcgcttgtcggtcttgcccatctccaggaaccgtccgccgcgcggcagcagccgcagcccggcgtcgacgaactcaccggccagacagtccagtacgacgtccatgccgcagccgctgctgccctccatgaaccactgctcgaactccagggtccgtgagttggcgatgtgcccggcgtcgagcccgtggtcgcgcagcgtccgccacttgccggggctggcggtgccgtagacctcggcgcccagatgacgggccagctgcacggccgcgatgccgaccccgccggccgccgcgtgcaccagcaccgagtcgcccggctgcacgtccgccaggtccaccagaccgtagtaggccgtgagatgcgtgatgggaacggccgccgcctgctcgtacgaccagccgtccggcatcggggccagaaaacggtggtcgcacaccgcgaccggcccgaacgagtcggagcacagccccagcacccggtcacccaccgcgacgttgcccaccccggcaccggtctccaggaccgttccggcgacatcgccgccgatgccgttctgcccctcgaccatgccgagcgcgacgacgacgtcccggaagttcagcccgaccgcgtggacggcgatacggacctggccgggaccgagcgggtccaggacctcggggcaggggaccagcgccacgttctcgatcgtgccgcggccggtgctctccagccgccacggcgtcgggccgggcggcggcagcagcgccggatgcgcctgggcgcgggccagccggggcgccgtgaccgtgccgccgcggatcgcgagccggggctccgcgcaccccagcgccgccgcgaacacctcccgggactcggccgtgccgtccaggtcgaccagcgcgaaccggtccgggtgctcggacaccgccgaggtcaccaggccccaactcgccgcgttccccaggtcggtgacatcctcgtcgtcgcccgccgcgaccgcgcccgaggacacgaacaccagccgcgcggagccgaaccgctcgtcggccagccaggcacggacccggtcgagcgtctcctgggcggccgtgtgcgccgccgccgcgggatcgcccggcgcaccgggggcgaggcagtgcaccacgatgtccgggaccggcccgtcggccgcgcccagctcgtcgagatccgcccccacccgtacgccggcacggtcgcccgccagcccgaacaggtcggcgccgaccagcgcgtacgacggggccggctcgtcaaccgtgacggtcaggggggtccagtggaggtggagcagcgcctcctccagcgcgccgcccgtggaccggccgggggcggccagggcggcgggcctggtcaccagcgaccgtaccgagacgaccgggcggcccgtctcgtcggtgagcagcagcgcgagctggtccccggacggggtgagccgcacccgggccgcggtggcgccggtcgcgtacaggtgcaccccggtccaggagaacggcagcttcacgcccgcctcctggtcgccggcgagcaccatggcgtgcagcgcggcgtccagcagggccgggtggacgccgtagtgcgcggcctcctcccgctcgccgtcgggcagccggatctcggcgaacagctcgccgtcccgccgccacaccgcgcgcaggccctggaaggcggggccgtagtggtagccgccctcggcgagtccgtcgtagacgccctccgtgtcgaccggctccgcgccggccggcggccacgccggatccggcgcgggttcctcgggcgcgtccaggccgagggtgccggtcgcgtgcagcgtccagtcgtcctcgccggtacgggagtggacggtgaccgtgcaggtgcccgtctcgccgtccggggtggcccggacctgcaccgtgacctcgtccttggggccggagcccagcaacagcggtgcctggagggtcagttcctccagatggggacggcccaggtggtcgcccgcccggatcgccaggtccacgaaggcggtcccgggcagcaggaccgtgccggagacggcgtggtcgagcagccacggatggctacgcccggacagccggccggtgagcagcacgccctcgccgcccgccagcgacacggccgcgccgaggagcggatggcccgccgcctcgagaccggtcgcggacagatcgcccgcgccgcggcgggactccagccagaaccggcggcgccggaacgcataggtcggcaggtccacctgccgggccccggtgccgtcgaacaccgccggccagtcgacgccgacgcccagcacaccgagctcggcggccgaggtgaaaaagcgccgcgcgccgccgtcgtcccggcgcagcgagcccaccgccaccgcggtccggcccgtatcgtcgatcgtgtcctggaccgagggcaccagcacggggtgcgggctgatctcggcgaagacggtgaagccctggtcgagtgccgcgcgggtcgccgcctcgaactccacggtgtgacgcaggttctgataccagtagccggcgtccagcttcgcggtgtcgagcggggccccggtgagggtggagaagaacgggatcgccgacgaacgcggcgtcagccccgccagttcggcggccaggtcgccctcgatctccgccacttgggatgtgtgggaggcgtagtcgaccgggatgcgacgggcccgcacgccgtcgtcggcgcagcgggcgagcagttcgtcgagcgcgtcgggatcaccggccaccacggtgctgacgggaccgttgaccgaggccaccgagacgcgccccggccacccggcgatcagctcccgggccgccgccgacggcagcgccaccgacaccatcccgccccgccccgcgagcgtcgagccgatcgccctggcgcgcagggcgacgacccgggcgccgtcggcgaggtccagcgccccgcagacacaggcggccgcgatctcgccctgcgagtgcccgagcaccgcgtccggttcgacgccgtacgaacgccacagcgccgccagcgacaccatcaccgcccacagcgcgggctgcaccacgtccacccggtcccagggcggggtgcccggctcctgccgcaggacggcgagcagcgaccagtcgacgtacgggcgcagcgcctcctcgcactcctcgatccgggcccggaacaccggtgcggagaccagcagttccgccgccatccccgcccactgggcgccctggccggggaagacgaacaccacgcggtcgtcgccgagcacggacccctcgaccacacccggcggcagcgcctcgtccggctccccggcccggcgcgccagcccggccgcggcggccagcagctcgtcccggtcgccgcccagcaccaccgcgcggtgggacagccgggcccggcccgtcagcgtcctgccgacatcggccacggacagctcgggacgcgccgccacatgcgcgacgagccgctcggcctgggcgtacagcgcggcccggtcgtgcccggagagcacccacggcaccacgccgcccggaaccgtcccggatgtcccgggctcgtcgtcggcaggcggctgttcgaggatgacatgggcgttggtgccgctgatcccgaacgaggacacggcggcccggcgcggacggcccgcgtccggccactcccgctcctcggtgagcagttccacggtgcccggggaccagtccacctcgggcgacggccggtccacatgcagcgtcctcggcagcaccccgtaccgcatagccatgatcatcttgatgatgcccgcggccccggccgccgcctgcgtgtggcccaggttggacttcaccgaccccagccacagtggctgctcggcgctccgctcccggccgtaggtggccagcagggcctgcgcctcgatcggatcgcccagcgtcgtccccgtcccgtgcgcctccaccacgtcgacgtcggcgccaccgagccgcgcgttcgccagcgcctgttcgatcacccgctgctgcgcgggcccgttgggcgcggtcagcccgttggaggcgccgtcctggttgaccgcggtgccccggacgaccgccagcacggggtgcccgttgcggcgggcgtccgacagccgctcgaccagcaggagcccggcaccctcgccccagcccgtaccgtccgcgctctcggcgaaggaccggcagcggccgtcgggggacagcccgccctgccgggacaactcgacgaacacacccggcgtcgacatcacggtcacgcccccggccagcgccaggtcgcactcaccggtgcgcagcgcctgcgccgccaggtgcagcgccaccagcgaggacgagcacgcggtgtcgagcgtgaccgcgggaccctccagacccagcgtgaacgcgatccgccccgaggcgacactgccggccgagccggtcccgatgaacccctcgacctcctcgggcagtacggcctggtcggcgccgtagtcgtggtacatcaccccggcgaacaccccggtccggctgccgcgcaccgcccgcggatcgatgccggcccgctccagcgcctcccacgacgtctccaggagcagccgctgctgcgggtccatcgccagcgcctcacgcggcgagatcccgaagaactccgggtcgaactcggccgcgtcgtacaggaagccgccctcccgcacgtacgaggtgcccggccgggccagctccgggtcgtacaactcctccacgttccagccgcggtcctcgggcatgtcaccgatcgcgtcccgccctgcggcgaccagctcccacagctcctccggcgaggccaccccgccgggataacggcacgccatgcccacgatcgcgatcggctccccgggctcgacggcggcggacgcccggggtgccggcgacgcctcctgcccgccggtcagctcgccgagcaggacctccgccacggccgacggcgtcgggtggtcgaagaccagggtcgcgggcagccggagaccggtcgcggcacccacgccgttgcgcagctcgatggcggccagggagtcgaaaccgagctcccggaaggtccgccgcgcatccagcccgtcgggcgtcggatggccgagcgcggtggccgcgtgggtccgtacgaggtccaccagcagccggatttggtccgcccgcggcagcgcccgcagccgggccgcgaacgccccttgcgcaccggctccgtcgaccgcaccggccgcccggcgcaccggcgcccgcaccaggccccggaacagcggcggcagggtgcccacggccgcctgcgcccgcagcgcgccgagatccagcggcagcggcacggcgaccggagcgtccagcgcgagcgccgcgtcgaacagggccgccccctgctcctcggagatcggcagcaccccggcaccggccatccggcgccgcgtctgctcgtcgacctcggctgtcatgtcgctgcgttggttccagaagccccaggcgagggaggtggcggggtgtccgtgggtgcggcggtggtgggcgagggcgtcgaggtaggtgttggcggcggcgtagttggcttgtcctgcggtgccgagttgtccggcggcggaggagtagaggacgaaggtggtgacggggtggtggagggtgaggtggtggaggtgggtggctgcgtcgatcttgggttggaggacggtgtggagttgggtgtcggtcagcttcgtggtggtggcgtcgtcgagggtgcctgcggtgtggatgacggtggtgagggggtgttcggtggggatggtggtgaggagggtggcgagttgttcggggtcggtggtgtcgcaggcggtgacggtgacgtgggcgccggctgcggtgagttcggctacgagttcggtggcgccgggggcgtggggtccgcgtcggctggtgagcagcaggctggtcaccccgtgccgggtgacgaggtggcgggcgaggagggcgccgagggtgccggtgccgccggtgatgagggcggtgccgtgcggatcgatctcccgcggcacggcgtcgcctgccacggcgtcgtccgccacggcccgggtcaggcgcggagcgaaggccctgccgtcccgtagggcgacccggggttcgtccgagccggccgccgagcgcaccgccgccagggaccgcggcgtgccgtcgacgtccacgaggacgatccggcccgggtgttcggtcaccgccgagctcagcaggccccacgcggccgcctgcaccgggtcgagcgggtcgccctcacccacggccaccgcgttccaggtcaccgccaccagccgcgagtcggcgaaccgctcgtcggccagccacgaccgcaccaggtccagcgcccgcccggcgaggtcgtgcgcctgcccggcaaggtcgcgctcctgcccggcgaggtcgtccgccgcgtccgcgccacccgagccctcggacgggccggccgtggcgacgacgaactccggcatcccggcacccgcgtccagcgcggcaccgagccccgccaggccggggtgacgctcggcgcccgcgagccccgtgagcggccccgaaccgagcaccgcccagcggccctccggctcggccgcgccgaccggagcccacgacggcacgaacaaggcgtccgaggcaccgtccggcgccgcgatccgcccggcgggccgcaccaccagggagtccaccgtcgccacggcctcaccggcggcgtcggcgaagaacagggagagcgagtcggcgccggtcggcgtcagccgaacgcgcaggaacgacgcaccggccgcgtgcagcgccaccccgcgccacgcgaacggcagcctgccccgctgctcccggccgaactcgcccggcacgaacgcggacgcgtgcagtgcggcgtcggcgagcgccggatgcagcccgaactccccggcgccggtggccacctcgtcgggcagccggacctcaacgtacacctcctcgccccgccgccacaccgcgcgcagcccctggaaggccgggccgtactggaaaccggcgtccgcgaggtccgcgtagaagccgtcgacgtccagctcctcggccccggcgggcggccaggccgtcagctcgtctccgggacgcgtacgagccgtggtgagggtgccgccggcgtgccgcgtccacacctcctcggcggactcctcggcctgtgcgtacagggcgaactcacgctcgccggactcgtccggagcacccacggcgagctggacgcgcaggccgccgctcgacggcaggacgagcggaagctccagcgtgagatccccgaccgagtcgaggccgaggtacgtcccggcccacagcgccagttcggcgacggcggtgcccggcagcagaacggtgtcgccgatcgcgtggtccgccagccacggcaggctgtccgtggacagcctgccggtgaacagccggccgcccccggccgccggcaccagcacggcaccgagcagcgggtgttccgcgggggccagccccgccgcggccatgtcgccggccccgggcacgccgcgcagccagtaccgggtgccctggaaggcgtacgtcggcagcggcacccgccgtcccgcccgcccggcgaagaacgccgcccagtccaccggcacaccggccgtgtgcgcctgggccagcagggccgtcagggtgcggacctccggccggttgcggcgcagcgccggtgcgacgaccgcgccggcggtgccggtttccgcgagcgtctcctcggccatggacgcgagcgtctcctcggccatggaggtgagcgcggcatcggccccgagttcgaggaacacggtgacgccctcggcgtcgagggcgcgcaccacgtcgtggaagcggaccggctcgcgcgcctgccgcgcccagtacgccgggtccgcccacgcggccggctccaggagggtgcccgtcacgctggagacgaccggaatggcagggggaccgaacgtcagccgggcggcgacctgccgcagcgggtcgaccacggggtccatcagcggcgagtggaacgcatggctcaccgggagccgccgggtcctgcgccccaggccggtgaagtgcgccgcgacggcggtgacgacgtcctcgtcgcccgacaccaccacggaacccggcccgttgaccgccgcgacaccggccaccgactcgtgcccggccagcaggggcagcacctcgtcccaggtcgccgccacggagaccatcgccccgccctcgggcagttcctgcatcaaccgcccccgggcggtgaccagttcactggcgtcggccagcgacagcatgcccgagacatgggccgcggtcagctcgccgaccgagtgcccggacagcagccgcggacgcacaccccactcctcgaggagccggaacagggccaccccgagggcgaaggtcgccgactgggtgtagagggtacggtccagcagccgcgcctcctcgctgtccggggcggccagcagcagcggcagcagcggccggtcgagccgggcgtccagctcggcacagacggcgtccagcgcgcgggcgtacgccgggaacgcctcgtacaactcccgccccatgccgggacgttgagctccctgcccggtgaacaggaacgcgccgcgcacctcgccggcgagtccgctcaccagcccggcgggactgcctccccgccccagctcggccagcgagtccagcagttccgcgcggtccccggcgagcagcaccgcccggtgctcgaaggcggtacgggtcgtggcgagcgcgcaggccacgtcgtcgagcggcagatcggggtggtcgagcaggtgcgcgtgcagccgggcggcctgggcgggcagcgccgcgggcgtggccgccgacagaaccaccggcacgacctgcgctccggcgacggaagcgccggaggcgatggaagcgccggaagtgtcggaggtgccggaggcgatggaagtgacggagccgtccgcgccggccgggccgtccgcgccggccgagccgctcgccccggccgggccgtccgcgtcgagatccgccggcgccggttcctccaggatgacgtgcacattggtgccgctgatcccgaacgaggacacccccgcccggcgggggcggtcgccgcgcggccacgggcggttctcggtcagcagctccaccgcgccctcggaccagtccacttcgggcgtcggacggtccacgtgcagcgtcctcggcagctgctcgtgccgcatcgcctggaccatcttgatgatcccggcggcacccgcggcggcctgcgtgtgcccgatgttcgacttgaccgagcccagccacagcggctgctcggcgctccgctcccggccgtaggtggccagcagcgcctgtgcctcgatcggatcacccagcgtcgtccccgtaccgtgcgcctccaccacgtcgacatccgcgacgccgagccgcgccgaggccagcgcctgctgaatgacccgctgctgcgagggcccgttgggggaggtgagaccgttggacgcgccgtcctggttgaccgcgctgccgcggacgatcgcgagcacctggtggcccctgcgacgggcgtccgacaaccgttccaccacgagcagcgcggagccctcgccccagccgacaccgtcggcggcggccgcgaacgacttgcacctgccgtcgcgggcgaggccgcgctgccgcgagttctccacgaaggtggcgggggtggacatgatcgtcgcgccacccgccaacgccaggtcgcactcctcgtcccgcagcgcctgcacggcgaggtgcagcgccaccagcgaggacgagcacgcggtgtcgagggtgacggccggcccctcgaggccgaggaagtacgagatccggcccgaggccacactcgcggccataccggtgctcagatagccctcgacctcgtcgggcagggcaccgggacccgaggcgtagtcgtggtacatcagcccggtgaagacaccggtgcgcgagccggccagcgaccgcggatcgagaccggtgttctccagggcttcccaggcggtctccaggagcagccgctgctgcgggtccatcgccagcgcctcgcgcggggagacgccgaagaactccgcgtcgaactcggtggccccgcgcaggaatccaccctcggtggcgtacgaggtgcccgggtggtcggggtcggggtcgtaaagctccccgagctcccagccgcggtccgtcggcatgccggtgacggcgtcctcaccgcgccggacgaggtcccacagctggtcgggtgagccgacaccgccgggcagccggcaggccatcccgacgatcgctatgggctcggtgtcgtcggcctcaagtttcttgatgcgccgatgggcctgccgcagatcggctgccatcttcttgaggtaatcaaccagctgcgcttcgttcgtcacctgtgaacctgcctgagagattggcaaaccgcgcccttcgagggcgaaggtacggacggctcgcccctagccgcgtcccctcagccaccccagaagcggcctcgcccgggaatgcggccgggtaggggttggcgctaggggtgcggccgtgcctagcattcggcgaattcccgtgccgtgacgaggaactggagtgtattccgcaatgagcgtttctgagaaggaagccgaaacttcggccgagcaggaattcaccaggccgccggccccggagaagatgcgggatctggatttcctgctcggtgatttccgtgcggagtggaccaacttcaccgccgacccggccacgaccggcacggccgcctggaacaccgcgtccaccttccacgggcacgcctacgagatgacgcagcgggtcgaggcgcacgacctcaccggccgcttcgtcgtccagtgggtcgagtcggaatcgtcgttctccggctactactacgacgactggggaaaccgcaccctgctgacctccgagggctggcaggacggttatctcgcgttcaccggagaatgcttcggattcggcaagtccttcctgctcaaggagcagtacgaaatcgtcgacgagaagcactacgtcaaacgcggtttcatcaagttcgacgaaggcgactggatccccgcggacgaggtgcactgccaccgcgaggcgtgacccaccgagcggtccccaggatcccggccattcggtaattcggagccgcggtaattcggtaaggacggaacagcggaacgccgtggacccacgcatacggatcgacgctcgggctacgtgacccccgggaaaggtgaaccatgaccctgctgaccgaagcggtacgtgcgggcgcgccgccgcaggagctggagcgcgcgccgctgcccggggagtacaccgccgcgtacatccaggccgaggacgcccggatgttcgacggagtcgccgacaaggacatccgcaagtcgttgcgcgtcggccaggtcccgatgcccgaactggcgccggacgaggtgctggtcgcggtcatggccagcgcggtcaactacaacaccgtgtggtcggcgatgttcgagccggtctccacgttccgcttcctgcggcagttcgcgacgcagggcggttgggcccgacgccacgatctgccgtaccacgtgatcggttccgacggggcgggcgtgatcgtgcgcgtgggctccggcgtacggcgctggggcatcggcgaccacgtggtgatgagctgcgtccagcccgacgaccaggaaccggccacgcaggccgacgggatgctcggcgccgagcagcggatctggggcttcgagaccaacttcggcggcctggcccactacgcggtcgtcagggcaagccagttgatccccaagccggcccacctcagctgggaggaggcggcctgcaaccccctgtgcgcgggaaccgcgtaccggatgctcgtcggcgaccggggcgcccgcttcaagcagggcgacgtcgtactgatctggggcgccgccggcggactcggcgcgtacgcggtgcagctcgtcaagaacggcggcggcatcccggtcggcgtggtcagctcgcccgccaaggcggaggcggcccgcagactcggctgcgacgtggtcatcgaccgccaggacatcggcctcgacgaccgcacggccgacgacccccgtgcggtgatcgaggtgggcaagcggctcgggaccgccatccgcaaacgggtgggggaggacccgcacatcgtcttcgagcacgtgggccgtgccaccttcgcggtctcggtcttcgtggtccggcgcggcggcacggtggtgacctgcggctccagcaccggctaccagcacggctacgacaaccgctacctgtggatgaaactcaagcgaatcatcggcagccacgcggcgaacctccaggaacaatgggagtgcaaccgcctcgtctccctcggccgcatcgtgccgacgctgtccgcggtctatcccctggaggagatcggcgaggccgcccggtcggtccagacgaaccagcacatcggcaaggtcggagtcctgtgcctggcatcgggccccggccagggcgtgacggaccccgaacgccgtgccgacctgggcgaggaacgcctcaacccgctgcgcggactcacaccgacgcgacaggccggctgagagcgcctccagttcccgtacgcctgtcgtgaagacgctggtaatcggccgagagagcccgtcgggccgtgcccggcgcgaaggagatgtgatgagcactgcgacggcggcctccccgacccccgtgaccacgtccgcgcccgaggcgaccgagcccgaggcgaccgaggagtccgccgccgcgcgggcgatccggcgcgtgggcgtggtcggctgcggagtgatgggcgcgggcctcgccgaagtgtgcgcccgggccgggctcgacgtactggtcacgtcctcgggcgaggacgggctggcccggggccgcggccggctcgaacgctccctcgcccacgccgtccgcaaggacaggatcagcgacacggcccgcgaagagacgctcgcccgcgtctccttcaccaccgacctcgccgccttccgcgaccggcaactggtcctggaggcggcccccgaggacgagcccacgaagctgcggatcttccaggcgctggacagggccgtcgaggacccggaggcgatcctcgccaccaacacctccgcccttcccgtcatgcggctggcccgcgcgaccgaccgccccggccaggtcctcggcctgcacttcttcaacccggcccccgtgctgcccctggtcgaggtgatcggttcgctgctcacccgcgaccgcacccggcgcatcgccgcggagttcgccaccacggtgctcggcaagcaggtcgtccacgccggcgaccgctccgggttcgtggtcaacgccctgctgatcccctatctcctgtccgcgatcaggatgtgcgaggcgggattcgccggcgcgcaggacatcgacaaagcgatgacactgggctgctcgcaccccatgggaccgctggcactggccgacctcatcggcctggacaccgtcgcggccatcggcacggccctgtacgaggagttcaaggagcccacgcacgccgttcccccgctgctgtcccgcatggtcgacggcggcctgctcggcaggaagtccgggcagggtttctacacgtactgagcacgcgcgcaccgcccgcgctcgcgatcacgcgcgcataccaagtccacacccgcggtgtcatctcgctgagctaccgcatggcccgttcgtgtgacggtgagcacacttccgggtaaagactgcatcaaatagtttgtgatacggttcacgagaacccgagatatattggggcggccggagcgagacaggccgcccgtacgaggcacgcctcgttcacctcgggctagggtcatctctcgacgaccgaaacgaaccccccccaagatttcgccggaggagctgccgcaatgcagtccaacgacgcccgaacgctcctgcactgtgctctgcccaccgctgccgcgggcgtggtgggagtcgcggtcagtgccgccgtggccggtggcaagggtgcgctaggcgccggcttcggcaccgttcttgttctgctgttcatgtgcagcggccttgtggtgctgctgcggaccgcgcgctcgctgccccacctgttccagatgatggggctgttgctctacaccacgcagatcctgctcctgatgatcctgttgaccatcttcaggggcacctcggtgttcaatcccaagtgcttcgccctgaccctgcttgcggccaccctggtgtggatcgctgcacaggtgcgatcccacatgaaggccaaggtcctctacgtggagccggactccgctcggacgccgtcgtgacctgtagggccggtgtaaaggggcctccgctcatttgctatggtctcgccacaactgtggcagagctggcgtgggtggtagccgtgcctgtgacgccttttggctcggagcccagtcgccgcccccatatccgcaagtccagtccagtgccgttccgcggtcgcaggccgcgccgacacattgaggttgccgtacccatgcgccacgctgaaggagctcgcggtgagtgatgccaagacgctcgccttcgagaccgattgtcatattttcgaagggtgcggtttcccgacccccggtctgcactccttcgtcttcgagccgatcttcacggtcggcggcttcgagttcaacaagccgatcctgttggtactgctgagcacgatcatcgtcatcgggttcttctgggcggccttcaacaagccgaagctgatcccgggcaagctccagatgatcggtgagctgggctacgacttcgttcgtcgtggggtcgtctacgagacgctcggcaagcgggagggcgacaagtacgtcccgctcatggtctcgttgttcttcttcgtctggatgatgaacatctggtcgatcatcccggtcgcgcagttcccggcgacctcgatcatcgccttcccggcgggcctcgcagcggtcgtctatgtgctctgggtgagcctgacgttcaagaagcacggcttcgtcggcgccttcaagaacatcacgggctacgacaagtcgctcggcccggtgttcccggtggtcatgttcttcgagttcctctcgaacctgctcatccggcccttcacgcacgcggtccggctcttcgccaacatgttcgccgggcacgtactgctgctgatcttcaccatcgccagctggtacctgctcaacggcatcggcatcgcctacgccggcgtctcgttcctgatggtcctcgtgatgacggtcttcgagctgttcatccaggcgcttcaggcctacgtcttcatcctgctgtcctgcagctacatccagggcgctctcgccgagcaccactgagcacggcacccccccgaacatccggtggccaacccccaccggcccgtgaaaaagaaggaagaaacggcatgtccgctctccagaccctcgccgcggtcaacatccagggcaacctcggtgcgatcggttacggcctcgccgccatcggcccgggcgtcggcgtcggcatcatcttcggtaacggcacccaggccctcgcccgccagcccgaggcggccggcctgatccgccagaaccagatcctcggcttcgtgctctgtgaggcgctggccctgatcggcctggtcatgggctttgtctacccttcctgatccggtctctgacgcgaaactttgacggaaggcacagatgtgatcctggtacagctggctgctgaggaagcccagaatcccctcattccggaggtcccggagctcgtcatcggccttctggccttcgcgatcgtcttcttcgtcctcggcaagaagctcctcccgaacatcaacaaggttctggaagagcgtcgtgccgcgatcgaaggcggtatcgaagaagccgaggccatgaaggtcgaagcccagagcgtgctcgagcagtacaaggctcagctcgccgaggctcggcacgaggccgcgcgtctgcgccaggaggcgcaggagcagggcgccacgctcatcaccgagatgcgtgcggaaggccagcggcagcgcgaggagatcatcgctgccggccacgcccagctcgaggccgaccgcaaggccgccgcgcaggcgctgcgccaggacgtgggcacgctcgccaccgacctggccggcaagctcgtcggtgagtccctcgaggaccacgcccggcagagccgtgtcatcgaccgcttcctcgacgggctcgaggagaaggccgaggcgactcgatgactgcacacggagcgagccgcgaggcaaccgctgccgcacgtgagcgtctcgatgcgctgacggactcgacgtccgtggacgtggtccagctcgccgacgagctggccgccgtcaccgcgctgctcgaccgcgaggtgtcgctgcgtcgggtcctcaccgacccggcgcaggccgccgaggccaaggccgagctggccggtcgcctcttcggcagccagatcggcggccccgccaccgacctggtcaccggcatggtgcgctcccgctggtcgcagtcccgcgacctggtggacgccgtcgaggagctggcggacatcgccgacctcacggcggcccagcgggcgggcgtgctcgacgacgtcgaggacgagctgttccggttcggccggatcgtctcgtcgaaccccgcgctgcgggccgcgctgaccgaccgcaccgccgacaaggcggccaggagcgagctggtgcacagcctgctcggcggccgggccaccgcgaccaccgagcgtctcgtgacgcgccttgtgaccacgccgcgtggacgtagcctggaggcgggactcgagtccctgtccaagctcgccgccgagcgccgcgaccgcttggtcgcggtcgtcaccacggcggtcccgctgagtgacacgcagaagcagcgcctcggcgccgccctcgcgacgctctacggccgtcagatgcacctcaacatcgacgtggaccccgaggtcctcggcgggatgcgggtgcaggtcggcgacgaggtcatcaacggcagcatcgcggaccggctcgaggacgcccgccgccgcatggcgagctagcagcaactcaatacctagtagtaccgacggccctggttgggccgtgcagaggattcacctcttttcagggggagtccccatccccccaaagtgaaacttcgggcccaacaaggagagcagggaacccagatggcggagctcacgatccggccggaggagatccgggatgcgctggagaactttgtccagtcgtacaagccggacgcggcctcgcgcgaggaggtcggcacggtcaccgtcgccggcgacggtatcgccaaggttgagggtctcccctcggccatggccaacgagctgctgaagttcgaggacggcactctcggcctcgcgctgaacctggaagagcgcgagatcggtgcggtcgtcctcggcgagttcagcggtatcgaggagggccagccggtgcaccgcaccggtgaggtgctgtccgtcgccgtgggcgagggctacctcggccgcgtcgtcgaccccctcggcaacccgatcgacggcctcggcgagatcgagaccagcggtcgtcgcgccctcgagctgcaggcccccacggtcatggaccgcaagtcggtgcacgagccgatggagaccggctacaaggccgtcgacgcgatgaccccgatcggccgtggccagcgtcagctgatcatcggtgaccgccagaccggcaagaccgccctggccgtcgacacgatcatcaaccagcgtgacaactggcgcaccggcgacccgaagaagcaggttcgctgcatctacgtcgccatcggtcagaagggttccaccatcgcctccgtgcgcggtgccctggaagaggccggcgcgctggagtacacgaccatcgtcgccgccccggcgtccgacccggccggcttcaagtacctggcgccgtacaccggttcggccatcggccagcagtggatgtacgagggcaagcacgtcctcatcatcttcgacgacctctcgaagcaggccgacgcctaccgcgccgtgtccctgctgctgcgccgcccgccgggccgcgaggcctacccgggtgacgtcttctacctgcactcccgtctgctggagcgctgcgcgaagctctccgacgacatgggcgccggttcgatgacgggtctgccgatcgtcgagaccaaggcgaacgacgtgtcggcgttcatcccgaccaacgtcatctccatcaccgacggccagtgcttcctggagtcggacctgttcaacgccggtcagcgccccgcgctgaacgtcggtatctccgtctcccgagtcggtggttccgcgcagcacaaggcgatgcgtcaggtctcgggtcgtcttcgcgtggacctcgcccagttccgtgagctggaggcgttcgccgccttcggttcggacctggacgccgcgtcgaagtcccagctggagcgcggtcagcgcatggtcgagctgctcaagcaggctcagtaccagccgatgccgaccgaggaccaggtcgtctccgtgtgggccggcaccaccggcaagatggacgacgtaccggtcgccgacatccgccgcttcgagaaggagctgctggagttcctgcaccgcaagtaccagggactcatgacctccatcaaggagggcgccaagatgtcggacgacaccctcacggccatcgccgacgccatcgcggacttcaagaagcagttcgagacctcggacggcaagcttctcggcgaagacgttccggccgccggcaagtgacgtaaggaagggacctgactcatgggagcccagctccgggtctacaagcgtcgcatccgatccgtcaccgcgaccaagaagatcaccaaggcgatggagatgatcgccgcctcgcgtgtcgtcaaggcgcagcgcaaggtggcggcctccacgccgtacgcgaccgagctcacccgcgcggtcacggcggtcggcaccggctcgaacaccaagcacccgctgaccacccaggccgagacggtcacccggtccgcggtgctgctcctgacgagcgaccgcggcctggccggcgcgttcaactccaacgccatcaaggcggcggagcagctgaccgcgcggctcgaggccgagggcagggaggtcgacacgtacatcgtcggccgccgtggtgccgcccactacaacttccgtgagcgcaaggtcacggagctgtggacgggcttcaccgacgagcccacgtacgcggacgccaagaaggtcgcgggtccgctcatcgaggccatcgagaaggagacggcggacggcggcgtggacgaactccacatcgtctacaccgagttcgtctcgatgatgacgcagacggcgatcgacgcccgcctgctgccgctcagcctcgaagaggtggcggaggagtcgtccacacagggcgagatccgtccgctgtacgacttcgagccgtcggcggaggacgtcctcgacgccctgctgccgcgctacgtcgagagccgtatctacaacgcgctgctccagtcggctgcctccaagcacgccgccacgcgtcgtgcgatgaagtcggccaccgacaacgcgggcgagctgatcaacacgctctcccgccttgccaacgcggcccgccaggccgaaatcacccaggaaatcagcgagatcgtcggtggcgccagcgccctggccgacgcgaccgcggggagtgacaggtaatgacgacgacagttgagacggccgttgccacgggccgcgtcgcccgggtcatcggcccggtcgtcgacgtggaattccccgtcgacgcgatgccggacatgtacaacgcccttcacgtcgaggtggccgacccggccaacgccggcgagaagaagacgctgaccctggaggtcgcccagcacctgggtgacggcctggtccgcaccatctccatgcagcccaccgacggtctggtccgccaggccgcggtcaccgacaccggtacgggcatcaccgtcccggtcggcgacttcaccaagggcaaggtgttcaacaccctcggtgaggtgctgaacgtcgacgagaagtacgacggcgagcgctggtccatccaccgcaaggccccgcgcttcgacgagctcgagtcgaagaccgagatgttcgagaccggcgtcaaggtcatcgaccttctcaccccgtacgtcaagggtggaaagatcggtctgttcggtggagccggcgtcggcaagacggtgctcatccaggagatgatctaccgcgtcgccaacaaccacgacggtgtctccgtgttcgccggtgtcggtgagcgcacccgtgagggcaacgacctcatcgaggagatgtcggactcgggcgtcatcgacaagaccgccctggtcttcggccagatggacgagcccccgggcacccgtctgcgcgtggccctggccggtctgaccatggcggagtacttccgcgatgtgcagaagcaggacgtgctgttcttcatcgacaacatcttccgcttcacccaggccggttccgaggtgtcgaccctgctcggccgtatgccctccgcggtgggctaccagccgaacctggccgacgagatgggtctcctccaggagcgcatcacctcgacccgtggtcactcgatcacctcgatgcaggcgatctacgtccccgcggacgacctgaccgacccggccccggccaccacgttcgcccacctcgacgcgacgacggttctctcccgtccgatctccgagaagggcatctacccggccgtggacccgctggactccacgtcccgcatcctggacccgcgctacatcgcgcaggaccactacgacgccgccatgcgcgtcaagacggttctgcagaagtacaaggacctccaggacatcatcgcgatcctcggtatcgacgagctcggcgaggaggacaagctcgttgtccaccgcgcccgtcgcgtggagcgcttcctgtcccagaacacccacgtcgccaagcagttcaccggcgtcgacgggtcggacgtcccgctggacgagtcgatcaccgcgttcaacgcgatcatcgacggcgagtacgaccacttcccggagcaggcgttcttcatgtgcggtggcattgaggacctcaaggccaacgccaaggagctcggcgtctcctgagccccgtgctcaccatgagggggtgggtgcgtc
